United States Patent 6,812,339 (POLYMORPHISMS IN KNOWN GENES ASSOCIATED WITH HUMAN DISEASE, METHODS OF DETECTION AND USES THEREOF) - sequence listing, part 89

SEQ ID NO: 51740 - DNA, 601 bp, Human
tactcctacttaaaactactccagaattgtttattccattctctatagcatgctaggctttaaatctggcactgattagtacaaaaatctcatcaccacaaatgtggtagcattttcccatgaaagaagaaaagggatgggcgtggtgactcacacctgtaatcccagcactttaggaggccaaggcgggttgattgcttgagcctaggaattcaagaccagcctgggcaacatggtgaaaacctgtctctacaaaaaaatgcaaaaagtagccaggcatggtggcacatgcctgtagtcmcagctactcaggagactgaggcagaaggatcagctgatacctcgatcaggaagttgaacctgcaatgagccatgatcacaccactgcactccagcctaagtgacagaatgagaccctgtctcaaaaaagaaaaagaaaaaaaaaaaagacaaagccatttggagaactgacttcctatgaaacacttatatgaaatgctgcccttggatttttaacattttatttttttgagaagaattatagggcatagctatgaaatcatatttactcccaggaagggaagaatttgtatttctattt

SEQ ID NO: 51741 - DNA, 601 bp, Human
cttgctctaaaaacatttatctaatgggcaataattagaggcaaagcaaagcataggtcacatgtggaggaaaaggtaacacagtgcattccttttcttcaagatcttactgcctaatgaaggaaaattcaaacacaatactagattcacttcagaacgcctatcaggttattatgacgtgtcttacaactaattaaaaaggatcctacctcatatcacaacaatgtgtataaatgtaattatactcctacttaaaactactccagaattgtttattccattctctatagcatgctaggcyttaaatctggcactgattagtacaaaaatctcatcaccacaaatgtggtagcattttcccatgaaagaagaaaagggatgggcgtggtgactcacacctgtaatcccagcactttaggaggccaaggcgggttgattgcttgagcctaggaattcaagaccagcctgggcaacatggtgaaaacctgtctctacaaaaaaatgcaaaaagtagccaggcatggtggcacatgcctgtagtcccagctactcaggagactgaggcagaaggatcagctgatacctcgatcaggaagttgaa

SEQ ID NO: 51742 - DNA, 601 bp, Human
atggtttggatttatgtccctgcccaaatctcatgttgaattgtaatccccagtgtaggagaaggggtatggtgggggcagatttccctcttgctgttcttgtgatagtgagtgagttctcatgaaatctgtttgtttggctttttgtttttgtttttgttttgagagagtcatgctctgatgcctaggctggagtgcagtggcatgatctcggctcactgcaacctctgcctcccaggttcaagcaattcttctgcctcagcctccctagtagctgggaccacaggtgcacaccaccacrcctggctaatttttgtattttaggtagagatggggtttcaccatgttggccaggttggtctcgaactcctgatctcaggtcatccacccaccttggcctcccaaagtgctgggattacaggtgtaagccaccgcgccaggccaagatatggttgtttaaaagtgtgtagcatccctccctttgctctctcttcctcctgctccagccatataggacatgcctgcctccccttcgtcttctgccatgattgtaagtttcctgaagcctcccaagccatgcttcctgcacagcctgcggaac

SEQ ID NO: 51743 - DNA, 601 bp, Human
gccaccgaacccggccgcgtcttcttctttctctccccaacacctggcatgttacctgatacatgcaggagttcagcagcaattctgagaacaagtggatggatggatagatgaatgaatgactaaatgaatggatgagaatgtccccttcataacagcaacccatctttcttcacctttagggatagtggcccattactctcctctggagtcccacagtaccccatgaagtggtcttacttgttggaaaatccctccccacgatggctgtaagagctacggctcttctaggctatccagscattttgagggtatcatgcttctctggatactctattttggttattaataatatgaagcacacattccagcttggctttatgaggggttcactcaatccagccaagagacatgatgaaataaatactttccatctactttctactctccagtcactcctttcagacttgggtgagatacaatagtactatctttccaacttaaaacacagcacactgaaaacccttccagatgtgaaaacagactatttttaaatactgtgtttcttgtgatcgctacatacagtgctgctcagaggcat

SEQ ID NO: 51744 - DNA, 601 bp, Human
gtggtgggattacaggcgtgagccaccgaacccggccgcgtcttcttctttctctccccaacacctggcatgttacctgatacatgcaggagttcagcagcaattctgagaacaagtggatggatggatagatgaatgaatgactaaatgaatggatgagaatgtccccttcataacagcaacccatctttcttcacctttagggatagtggcccattactctcctctggagtcccacagtaccccatgaagtggtcttacttgttggaaaatccctccccacgatggctgtaagagctamggctcttctaggctatccaggcattttgagggtatcatgcttctctggatactctattttggttattaataatatgaagcacacattccagcttggctttatgaggggttcactcaatccagccaagagacatgatgaaataaatactttccatctactttctactctccagtcactcctttcagacttgggtgagatacaatagtactatctttccaacttaaaacacagcacactgaaaacccttccagatgtgaaaacagactatttttaaatactgtgtttcttgtgatcgctaca

SEQ ID NO: 51745 - DNA, 601 bp, Human
atgcctcaaatctggaactgattagtataacattcttgtcaccacaaacttgttagcattttcccatgggccacatgccagccattgggataccctccaaccatggcctacccaatgaatccctcccagatatcgtgtttctgttccagtgcatggtggttcagagcctgggatatgtggtcagactgcctggcagtaaaccctggatcctccatttctaaccaggtgaacttaagccatcatttcagctcctgctgcctcatttcctcgcctgtatgtgggcaccaaagattatcctcayagaacagctgtggggactgaaggagataaataaccacaaaatattctctgagctctatttgcctcactagggctccattttttggacgtctttcagatagctctattccaaaagattgtaattattggcttacatgcctcttcctccagtgcttctcaacctatgagcatgttgaactggataattctttgtgggagggggggtctatgctgtgcattgtaggatgtctagcagcaaccctggcctctacccactagatgtctatagcacctccccagctgtaacaaccaaaaatgtctc

SEQ ID NO: 51746 - DNA, 601 bp, Human
tctcagttcaagccattctgatcactttcaatgcctcaaatctggaactgattagtataacattcttgtcaccacaaacttgttagcattttcccatgggccacatgccagccattgggataccctccaaccatggcctacccaatgaatccctcccagatatcgtgtttctgttccagtgcatggtggttcagagcctgggatatgtggtcagactgcctggcagtaaaccctggatcctccatttctaaccaggtgaacttaagccatcatttcagctcctgctgcctcatttcctcgyctgtatgtgggcaccaaagattatcctcacagaacagctgtggggactgaaggagataaataaccacaaaatattctctgagctctatttgcctcactagggctccattttttggacgtctttcagatagctctattccaaaagattgtaattattggcttacatgcctcttcctccagtgcttctcaacctatgagcatgttgaactggataattctttgtgggagggggggtctatgctgtgcattgtaggatgtctagcagcaaccctggcctctacccactagatgtctatagcac

SEQ ID NO: 51747 - DNA, 601 bp, Human
tcagacaccttcttctcttttccctcagcagaactccacgatgcgcatcagttaggagttttctggtttctttttttcttccttccctaacaaataagcagcagcaataacaagagctcaaagttactgagcttcttttgtttaatcctcagaccaccatagtgtctaacaggtagacaccgtgatcgcaatctccatttcacagaagagcagtgaggccggggcaacatgatatttgcccaattcactcagctcattaagtggtataggatttaacgtggggagattaacccccgagtcytgggggctacaggccatgcagggatatgcagcacatagcagaaatctttgctgagtcaggtttgagtaattttcaagttttctctgtcaactttcttaaatatagccttttctctatctctcagcatccctcacctgtgatgttgcaacattctaactggtcttccttcttcccgtttctccttcctccaacccaacttcctcattgctaaaaggttttttcagcagccaatttccatcttccaagcctcgcttaaagctttcagtgactcgacattccacaacataaaggtcctctaag

SEQ ID NO: 51748 - DNA, 601 bp, Human
gggtaagagagcaagaccctgttttaaaaaaaaggaataaaaaaaagtacctactttgtaggcttcttgcaagagttaaatgagctagaggattcaagcacttagaacagagtctagaggaaagtaaacaatcagtaagtggtagctatattttattattacaccagctctgcaggaagttacccatttacaatcatctgcacactccctcacatctcaggggtaagattctagagacggatgcatcttttgtgtcctctatgtgcttaactgctgagccccagctcgggttaagcggctkgccctaggacatcaaacttggtcctagtggaattcggattagcatcttgtctctttgttcagaagggtccttattaaaggggcctggcccttcctctagaagatccacatacctcattagggtttaactgcagtcaggcattggggatataagccctttcactcggtcacaccttggaatctgtggtcactccactggtcaggtgacctgctgctttgaggccgcctgagcccaccgggtccctcaggttctctgaaactgtgcctcaaaccagagaagcagcggggagagagatcagtg

SEQ ID NO: 51749 - DNA, 601 bp, Human
gtgaaccatgattgcaccactgcactccagtgtgggtaagagagcaagaccctgttttaaaaaaaaggaataaaaaaaagtacctactttgtaggcttcttgcaagagttaaatgagctagaggattcaagcacttagaacagagtctagaggaaagtaaacaatcagtaagtggtagctatattttattattacaccagctctgcaggaagttacccatttacaatcatctgcacactccctcacatctcaggggtaagattctagagacggatgcatcttttgtgtcctctatgtgctkaactgctgagccccagctcgggttaagcggcttgccctaggacatcaaacttggtcctagtggaattcggattagcatcttgtctctttgttcagaagggtccttattaaaggggcctggcccttcctctagaagatccacatacctcattagggtttaactgcagtcaggcattggggatataagccctttcactcggtcacaccttggaatctgtggtcactccactggtcaggtgacctgctgctttgaggccgcctgagcccaccgggtccctcaggttctctgaaactgtgcctc

SEQ ID NO: 51750 - DNA, 601 bp, Human
aacctacccccagaaacgttctgaggaggctgaggcaggaggattgcttgagcctaggagttccaggctacagtgaaccatgattgcaccactgcactccagtgtgggtaagagagcaagaccctgttttaaaaaaaaggaataaaaaaaagtacctactttgtaggcttcttgcaagagttaaatgagctagaggattcaagcacttagaacagagtctagaggaaagtaaacaatcagtaagtggtagctatattttattattacaccagctctgcaggaagttacccatttacaatcrtctgcacactccctcacatctcaggggtaagattctagagacggatgcatcttttgtgtcctctatgtgcttaactgctgagccccagctcgggttaagcggcttgccctaggacatcaaacttggtcctagtggaattcggattagcatcttgtctctttgttcagaagggtccttattaaaggggcctggcccttcctctagaagatccacatacctcattagggtttaactgcagtcaggcattggggatataagccctttcactcggtcacaccttggaatctgtggtcactccac

SEQ ID NO: 51751 - DNA, 601 bp, Human
gcagtatggcacaagggttcagttgtgtgggctctggagtctggcttcccagggctcaaatccaagtttaatcacttattggctgtctggacttggacaagttatttaacttcttgggatttatttcctcatccataaaatgagatgatgattgaacctacttcagactgggcatggtgcctcaaacctgtaatatcagcactttgggaggctgaggtgggaggattgcttgaggccaggagtttcagaccagcacgagcaacacagtgagaccctgtctctaccaaaaaaaaaaaaaaaattaaaaattagctgggtctggtggtatccacctgtagtcccacagacagacagtgtccatttcacggtggagaggcctctgaggacttcagtaacttgctggaggcaagcaccgaagagaggcaggggagaagccagccttccagggagtgagataacctgctcactctgaggggattggaccaacctacccccagaaacgttctgaggaggctgaggcaggaggattgcttgagcctaggagttccaggctacagtgaaccatgattgcaccactgcactccagtgtgggtaagagagc

SEQ ID NO: 51752 - DNA, 601 bp, Human
attttgcattggagagacccctcttgctggaggcaaggactgaagtgagccaaggaagaaggcagcctaccagggagtgagataacctgctcactctgaggggattagaccaacctgcccccagaaacattctccagagagagaggaatagacccctgtcgtttgctttatggcaaggcacttagaatgaaaaatcccatgtccttcccgatgggtgcctcatccaaccctaaacccactcccgtgaaatgctattcccttcagcgaggctatgaccagaagaaatggcagccatgggacmactcgagctcccctgaagacactcaaaatcttcaaacatctgggaaacatcagaattcataacctgaaaaaagactgctgccaatgatcatccctgcaaaccgaagcattcattctacacttccccgtcagtcagcgaaggctcctcacgattttattctttgaggatcacaaaagaggaatgttttatggctttctccaagactagtcagtatagaagcttctaagacaattgcactgggaacagggagataagcaattgcggcatgtgaggacgtcaaagataaaggctttcttggga

SEQ ID NO: 51753 - DNA, 601 bp, Human
ctctctaagcccaccgtgtcaagccaaggagagtacgattaagagagcgtggcctctggagtcagagagatctagctagactcaagtcctgctttggtcactagctagatgcaagaactttaccctctgtaaaatggggcagcaacagtggccgcctcttggtgcaatggagagaggcaaatgaagctaagtaatatatgtaaactctctagcacccagccagcacagaatcagtgcctaataaataatgctgactggaaagagtcaggggagcagaggatagggaaggatttgttaaacrggacataattacagcaagataacaggaataaattctagtgttctataccactgcaggatggactacagttaacaataatctagtatatagtttcaaatagctaaaaggaggatattgaacgttcccaacacaaagaaatgataaatgtttgagatgatgaatatgctaatttcccggatctgatcatcatacattgtaggtatggaaacatcacgaggtacctcataaatacatacaattattataggtcatttttaattttttaatgaaaaaataataaatcttgccaaataatactca

SEQ ID NO: 51754 - DNA, 601 bp, Human
aatttctggcttaaaagctttagatctccttcactaaacagtgatgaaatcaataaccccagggatagaaacagtaataataatgactcggaggcctgtagacacaggctgggggctgcaggcctgatcttgcacacattgaagcatcttttgcgtgactgccttgctggtgaaagggcagctcttctaaattcaaagcaacagccaggaggagtcacttcaactcagagttgtgcccctgggctcaaagaacccgaacctgcactctccagagctcacctgctgcctgagctgctacctwaacttcctggactaaagactgcttgaaataggggatggcccagggcagacaaacagagggctgctctagatctgcactctgaagtcacaacaaggatttccatgaacatctcaggtgccgtgctttccaacacgctgctttcctaaaaattcttatgtccctaaatagggaaatacgtaaagcttcgacggctatagataccaagggaatctgctcatgcataaagaagacaacaaggtgagtttttgtcttagctgggtgtggtggcacacccctgtagtcccagcttctcaggaggct

SEQ ID NO: 51755 - DNA, 601 bp, Human
taataagagcaattgtaggaacgagacaccatcaaaatctcattattccataatgtatacagccacactctaaaggagaacaaacccatgcacatttggaaaaaaatgcagtcacaggagcattcacttctgggttttggttttatttttatgggagtttttttagaacattgaattctcatttgcaaattcattttccagtggcatgccaatttccattacctctttaatttctggcttaaaagctttagatctccttcactaaacagtgatgaaatcaataaccccagggatagaaacmgtaataataatgactcggaggcctgtagacacaggctgggggctgcaggcctgatcttgcacacattgaagcatcttttgcgtgactgccttgctggtgaaagggcagctcttctaaattcaaagcaacagccaggaggagtcacttcaactcagagttgtgcccctgggctcaaagaacccgaacctgcactctccagagctcacctgctgcctgagctgctacctaaacttcctggactaaagactgcttgaaataggggatggcccagggcagacaaacagagggctgctctagatc

SEQ ID NO: 51756 - DNA, 601 bp, Human
accaatagctactgggctgtaactatccactagagtagagcatcatggctaaaaaccatggattctagagccggactgccttggccggatcacagttccacctctcacttcagcttgggcaagttatttaacttctctgttcctctgttgcttaccccacttcataggatcaatgtaaaatttaaatgagttactacacgtgaagcatttagagcagttcctgtccacagtaagcaccatgccagaattggctagcgatataattaatactgaacctcaagctccctgaggacagggtggmggcatcttgcattttttattgttttttaatcgctagagccaaacatagcacctgcttcattataggtactaagtaaatattagttatataaatgaatacattgtattgtgataagtaataagagcaattgtaggaacgagacaccatcaaaatctcattattccataatgtatacagccacactctaaaggagaacaaacccatgcacatttggaaaaaaatgcagtcacaggagcattcacttctgggttttggttttatttttatgggagtttttttagaacattgaattctcatttg

SEQ ID NO: 51757 - DNA, 601 bp, Human
atgtcaccttcttccaactaaaaaaaaggacaacatagagaagtcataatttgtatgtctcatctccatttttaaaaaaacaaaaggttaaacactcacttactgaggaaagttaagctgcaccagcaggcttttcatctcttctgcccatttccatagagaaggaaggaaaaataaatgttcccaatataaagtgacaagctactcttaattgcagacctgaatgataacccatggacattggttttagatcgaaaagggtgacccagcttcaacaccttatgttaagacacaaagccckgccactctaaaggacaaccaggaggtaatcacgactcactgcagttgactcacaggtgaatgaaggtcctcttgggggtcccataggttgagtcagagactcctgctctgtgactaaggacctgagtgcttccttgtcttctagaaccaatctagtaaccaatagctactgggctgtaactatccactagagtagagcatcatggctaaaaaccatggattctagagccggactgccttggccggatcacagttccacctctcacttcagcttgggcaagttatttaacttctctgttcc

SEQ ID NO: 51758 - DNA, 601 bp, Human
agaacaagattctgtgccaaaaaaaaaaaaaatcattttctgtgcctccttaagaatgagtcaccaaatctccctgagcatagtttgataaggggagaaacaaggaagtgcagacaatgctagaaacttcagggaaagttctagaatactcctaaaattaatcatagctgccagcacttgcaatgtggcagactccgccttattatcctatttagtcctcacaaaatcctgtgaggttatagtagttaggaagtgtcagagctgagactggttaaaagtcctctcttttaactctagcctyctatcttccacgaatagttctctgttcaccttctaaacatttttctaaagctcatctgtcatgtcaccttcttccaactaaaaaaaaggacaacatagagaagtcataatttgtatgtctcatctccatttttaaaaaaacaaaaggttaaacactcacttactgaggaaagttaagctgcaccagcaggcttttcatctcttctgcccatttccatagagaaggaaggaaaaataaatgttcccaatataaagtgacaagctactcttaattgcagacctgaatgataacccatggaca

SEQ ID NO: 51759 - DNA, 601 bp, Human
gaatctgtttggagaagaggagagagaaacccaggatgggctagcatgcttgctcatggcgtatggtcttagacacgctagctttccttgctactacaagttaatcccttacaatggggatttctgagactcaattcattagccccttgggtattcactaacgactaatctatctaaatattatcttatgagaccaggccatatttgggggcactcttgtagcttccaaattgtgccttatgatggaaaatgcatttcctctgtctctctttgactacatggaaggatgaaataagacaawttttaaaccacgaggaaagtatcaagtccactaaggaatcagggatagatgtgtatactttgatatgatcaataaactttcagactaacaagctgtcactctttcatctcagtttggacttacactctacaggcagaataacaaatttgccaactgatgttgaaaaattgccctggtcctgaggagagtgtctgatatatgccttgctctctctgcacttgagatcattcccattaaaaatgggtctatccaatttctatttttaaaaaactgtactggactacaaaagcagctacaaga

SEQ ID NO: 51760 - DNA, 601 bp, Human
cttcagtgctgtggtggatattacaatgacgtgtattttcctactgccctaagtacccagttatgtgcaaatattagcctttcctcaggtcctcagggagccaggcagcaagttttcattagaactttacagcctagttataaatctaaagtgaaggccactggcagaaaggacagggcaagtggagaatctgtttggagaagaggagagagaaacccaggatgggctagcatgcttgctcatggcgtatggtcttagacacgctagctttccttgctactacaagttaatcccttacaakggggatttctgagactcaattcattagccccttgggtattcactaacgactaatctatctaaatattatcttatgagaccaggccatatttgggggcactcttgtagcttccaaattgtgccttatgatggaaaatgcatttcctctgtctctctttgactacatggaaggatgaaataagacaaattttaaaccacgaggaaagtatcaagtccactaaggaatcagggatagatgtgtatactttgatatgatcaataaactttcagactaacaagctgtcactctttcatctcagtt

SEQ ID NO: 51761 - DNA, 601 bp, Human
agtaatctcttggttgtctcagattggctgaagaatacaacagattcgtgctttatgcatggacgctaatagctggatgaccagttgatctattgtccaaagcagggaacttgcaaataaaaaggtagctctgttaacagctatgctgggaccacaggacaggtgcaacccaggatgtatggtcattttactaacagactgtttgtctctcgagaaaggacttcatctgagggtacaatggtggctgcgtccaccacgttcttactccctgaacggcacagtcagcaaagggattatgaaytggagatttagccagggattgaggcaggatgagggcatgaatgtggaaagtggtttctaaaatgtattaaaagtgagcctatttttagtagagacggggtttcaccgtgttagccaggatggtggcgggcgcctgtagtcccagctactcgggaggctgaggcaggagaatggcatgaaccagggaggctgagcttgcggtgagcccagatcgcgccactgcactccagcctgggggacagagcgagactccgtctcagaaaaaaaaaaaaaaaaaaaaaaagggagcctattccagcca

SEQ ID NO: 51762 - DNA, 601 bp, Human
atcaaaaaattcacacaggcagataattcaatagaggtagacagataattagatacgaggggatactgtagataagagggcattactttacattttaattccattcctccttgaatttcctttttagcctctaagctggcatttccagcacccactcagctacccagtaaatggcacgggagtgaatgttttaagttaacaataaataaatgaacaaactaaactaataaatttagatatattatcttcccagaggtgtgagaggaaaacattttacttctttctaaaattagacaaacayaaaagcaactcaacaaaaacaacaaaataataatgatttgtttcttttaaaaagaggtggagagctgacttgaaagagggcaggatctaaaagattctgtgcccctctttctcccttgtcctccctcccccacaccatgcattaggactacctgacaggcagaagagagaaactgcaacctctcacaaagtgaggcgggtctgtagctgatgcgcttagaaagagaggaggaggaggtaactggacccctcacaggaccccccaccacgttttccccaccagtttcctcccatcaggcaa

SEQ ID NO: 51763 - DNA, 601 bp, Human
tcaacaactttttccataaagggtcagatagtaaatattttagccctggtgggccacatatggttctctgttgtatatttttctttttttaaataatcttttaaatatgcaaaaaccattttcagctcaggggttgtacaaaaagatgctgcgagctagatttggcagactcatagacaattgactggatgatacaggggaaaaaagcaccttctgtcaagtcgtgagtctattcttttctgcctctaagagaacatggaatattatgcaagaccgcagccggccactgtttctagcaaamcctggcaccctagaatttaaaatctggctgcatgggatgtgtacagactgtctttgcataaatcagcctaattgacagtggtcacataatcatcagaggtatgttctgctctgctctagagggcagacagatggtgagtcctttccaccggtagcatctccattttcactgtgccgtatgagtaccatcagaccaagccacaaagccttcaccagtgtttatatcttcattatcaattcagctctgatgagcccacttggaaataataccgcagggagggctctaggcttcagtcactta

SEQ ID NO: 51764 - DNA, 601 bp, Human
cgagcaggagaaggtgaaaaaactccgtagcagttcttcctgagctggcccctgccatcttctttcaagccagggaaaaaggtaggacgtgctgtcatggcagccgaaacacatgctgttcacacgggtgaactgggataaaaaagcgacaggtggaagccttggagaggaggtgacagacacaggagctacttctagaacaacaaacagactctctgttccttgggcaaacctggaataaccctatgtagggagagcaagacacaaatattgaaacgtaattacatttatcctaagtaaygcccattaagctttgttaaaacaggcatacagtggttgtcacaaatcagattacaactggaaaagtcaatcatcattacattttgccttctttcatctgagttatttcaaacactctgaaccagggatcaacaactttttccataaagggtcagatagtaaatattttagccctggtgggccacatatggttctctgttgtatatttttctttttttaaataatcttttaaatatgcaaaaaccattttcagctcaggggttgtacaaaaagatgctgcgagctagatttggcagactca

SEQ ID NO: 51765 - DNA, 601 bp, Human
catgctgcaaagaaagggaaaaagcataagactcagtttaaaagttgtttattttttttttcttcaaaaaaaaaaaaggttccaatacattattcccctactcaagaacctgcagtgatctagagagaactggttaagtggatgatggtagcatcccaaagcaaaatactatgcacccagttgtgaaaatcagaaaattagtgttaaataggggggaaacgctagggtatagaatatggtgacatttatagaaagcttgcaggcatggggtggcccagattatgcaaaatgttacaagttkctgtgcatatacacacacaaaaaatgtctagaagaatgttcacccaaagtgggcatttccgcaaggcaggattttggttgctttttcactcttttctgtcttgtaagaatgttttacgttgagcttgtttccacagggcaggagttaagagccatcctggctgtggccgttattaacttcagaaccttgggcaagttgtttgaacctctctgagcctagtttcctcatttgcaaactagagataataccttccccacagggttgttgtgaggattaaatgagatggtccaagtaacaccc

SEQ ID NO: 51766 - DNA, 601 bp, Human
gccgaggtcccagtggctgctgttgttggaagagtttcctattggactgactcccgcattgtcagcatcaagagcatgctgcaaagaaagggaaaaagcataagactcagtttaaaagttgtttattttttttttcttcaaaaaaaaaaaaggttccaatacattattcccctactcaagaacctgcagtgatctagagagaactggttaagtggatgatggtagcatcccaaagcaaaatactatgcacccagttgtgaaaatcagaaaattagtgttaaataggggggaaacgctaggrtatagaatatggtgacatttatagaaagcttgcaggcatggggtggcccagattatgcaaaatgttacaagtttctgtgcatatacacacacaaaaaatgtctagaagaatgttcacccaaagtgggcatttccgcaaggcaggattttggttgctttttcactcttttctgtcttgtaagaatgttttacgttgagcttgtttccacagggcaggagttaagagccatcctggctgtggccgttattaacttcagaaccttgggcaagttgtttgaacctctctgagcctagtttcctc

SEQ ID NO: 51767 - DNA, 601 bp, Human
cctcctctgaacctcaaactatagtgtatgctatgaggacaaaacactgactaagcgcccttactcaagatgacctgcagaggaagagatattagcaaacaaacgggtacctatggtcgtaatgacagttccagcaaagaaaaaggcactgccgaggtcccagtggctgctgttgttggaagagtttcctattggactgactcccgcattgtcagcatcaagagcatgctgcaaagaaagggaaaaagcataagactcagtttaaaagttgtttattttttttttcttcaaaaaaaaaaaaggttccaatacattattcccctactcaagaacctgcagtgatctagagagaactggttaagtggatgatggtagcatcccaaagcaaaatactatgcacccagttgtgaaaatcagaaaattagtgttaaataggggggaaacgctagggtatagaatatggtgacatttatagaaagcttgcaggcatggggtggcccagattatgcaaaatgttacaagtttctgtgcatatacacacacaaaaaatgtctagaagaatgttcacccaaagtgggcatttccgcaaggcaggattttg

SEQ ID NO: 51768 - DNA, 601 bp, Human
atgcctgaatggccagctggtggaacagtcagaacacacggcatttattgattaggttcaccatcttcaaagggcatggtttgtggcaccccaaaacaatgacaatcatgacatcaaagatcactgaccacagatctccttaacagatataatcaaaaatgaaaaaggttgaaactattgtgaaaattaccaaaatgtggcagagacacagagtggagcacacgacgttggaaaaatggcaccaatagacttgttcaatgcgggattgccatacaccttaaatttgtttaaaaaaaaaaaactcaacatcttcaaagcacaataaagcaaagcacaataaagtgagatacaacttatatagaatgacaccatgaataagagtggatagtggaagagggaaaggaaattgagatgctaagttcactgactgccttatatgtaatagctgagtgccaagagttatcatttaaagctggcaaatcatataagagaaacataagcaaatttaatcatttaaaagatgatgtccaccaaaactttgtgttggaaaaagagagaaaagagatatcatcacccgttatagggatcgaatacatgctgg

SEQ ID NO: 51769 - DNA, 601 bp, Human
gcctcagggatctgggatgcctgaatggccagctggtggaacagtcagaacacacggcatttattgattaggttcaccatcttcaaagggcatggtttgtggcaccccaaaacaatgacaatcatgacatcaaagatcactgaccacagatctccttaacagatataatcaaaaatgaaaaaggttgaaactattgtgaaaattaccaaaatgtggcagagacacagagtggagcacacgacgttggaaaaatggcaccaatagacttgttcaatgcgggattgccatacaccttaaattwgtttaaaaaaaaaaaactcaacatcttcaaagcacaataaagcaaagcacaataaagtgagatacaacttatatagaatgacaccatgaataagagtggatagtggaagagggaaaggaaattgagatgctaagttcactgactgccttatatgtaatagctgagtgccaagagttatcatttaaagctggcaaatcatataagagaaacataagcaaatttaatcatttaaaagatgatgtccaccaaaactttgtgttggaaaaagagagaaaagagatatcatcacccgttataggg

SEQ ID NO: 51770 - DNA, 601 bp, Human
ttcatgtgctcactcactggagtatcacttttaatttctttcaggaatttttcctggccaggaacagtggctcatgcctgtaattccagcactttgggaggccaaggtgggtggatcacttgggcccagaagttcaagaccagcctgggtaacatagtgaaaccccatctctagaaaaaaatgtttaaaaaattagccaggaatggtgatgcacactagtagtctgagctacttagggggctgaggtgggaggatcccttgagcccaggaatcaaggctgcagtgaaccatgatcacaccrctgcactcctgcgtgggtgacacagagagatcctgtctcaaaaaaaataaaacacaaaatttcctttgcactcacaactttgctaactgtttggcagaagagacttagctgttggcctgtttcagagttcaaaatgccttcctcaccaatcttaattatttctagatttacatttaaaatgagagacatgcaactgactcttcctttcacttgaacactgagaagccactgcagggttattaattggccaaatttcaataccattgtgcctcagggatctgggatgcctgaatggccagc

SEQ ID NO: 51771 - DNA, 601 bp, Human
ttttacctacagtagaacttttttcaaattggaatcaatcttctcaaaccctgccactgctttatcaactaagttgatataatattctgaattctttgttgtcatttcaacaatgttcacagcatctttaccaggcaggagcagattccatctcaagaaatcactttctttgttcatccataagaagaagctcctaattcattcaagttttatcatgagatgcagcatttcagtcacatcttcacactctacttctaattccaacacatcagcagtggcatcctctagtgaagtcttgaasctctcaaagtcatccatgagccttggaatcaacttcttccaaactcttgttaatgttggtattttgacctcttccaattcatcacaaatgttcttaatggcatctacaatgatgactcctttccagaagatgttcaaatcactttgctcagactcatcagaggaatcattatgtatggcagctacagccttatgaaatgtatttcttaaataataagagttcaaagtcaaaattactccatccatgggctgaagaatggatgtggtattagcaagcatgaaaacaacatttatctccttg

SEQ ID NO: 51772 - DNA, 601 bp, Human
atgtaaagccaggcgtggtggctcacacatgtaatcctagcactctgggaggccaaggtaggaggatcctttgaggccaggagtctgagaccagtctgggcaacacagcaagacctggcttctacaaaatattttaaaaattagctagccctggtggtatgcgcctgtagtcccagctactcaggaggctgaagccaaaagatcacttgggcccaggagttggagactgcagtgagctatgttcataccactgtactccagcctggacaacagagcaagacccagtctcaaaaaaaaaaaagaaaaagaaaatgtgagtcaataaaatggatttcattttgtttcaactatccttcaaatgttaagctacaactgtgaacaatgcaagatctcacagaatattgctcccctgagccattcttaaggcaactacttgaagatgactttcagccaagtaagtgatcatgagataaaccacagcaaaaggactagagatgaacattaatgatatctaactatagagctacgactaaaacaaatgcaaatatcagggtaacaaattaaaatctaaattacataccctgaggttatacaggcatac

SEQ ID NO: 51773 - DNA, 601 bp, Human
caagaaaattaggagtttccttcaatatacacactaatgtctcatgaatccaataccgggtatcagagagcattttccaaaatgtacttcttgaagtggcccagactttctcaattttaattggtgtacaatagatcctcctacaatgcgtgacactttttcccaggttaacaatctgctgaacacaatgaaacctgacattggtcttcttggatccactacagcaacgccctctggtgttgttcaggttgctaacactttttgcccgtatactaaatggtgtcaggccacccagcttccyttgttggacgctgtgagtctgtggattaagctgacctaacctggcctagagtgccagaaaaggcttctaagccccagacccactggtgtcatgggcatcttgaatacttttaatagctaacaccaatatatttgcagatttgcaagtgtaaacctagcatgtcatataattagattaagagtgtttctaaataacaatggcaattttccttcatccaaaatgttcttgttgcatatgactttctggatttcacctagaaacaacataggtcctgaaggctagatcttaaaacaaaagcaa

SEQ ID NO: 51774 - DNA, 601 bp, Human
aagctgctcatgagagcctttctggaaagaaatttggcaagcctttcatttcctttgacagagcaaacccttggtaacctttccaaggcaacaaccagagatgaagaccacacttcacaacgttaacaccatggtgttacactattactaaaatagaaacagcttaagttcccaggaatatgtgattatagtgtgaatagtggatccaatagaaaccatcaaagaatacacttttcaaagaactttagtaatatgcaaaaatgtctgcaatattacgttgcaaattttatgatcgcaaggraacaggccaatatttgtgtatttcacaattaatgaaatacacagctcctcagctctcacggttcctctttcctgactcctaactagtggaaaattgctcaggaagaactggaagaattgctgggctctgagttttcttataaaccttgcgaccacatgcaacaaatgaatttaccactaagtaactggaaaaacaattatttctgcacctcattattcttacttacattgtattaagggcttctttggaattctctaactgtatgactctataaagatcctccactctggagttaaaatt

SEQ ID NO: 51775 - DNA, 601 bp, Human
gagcccttgtctctacaaaaaaaaaatttttttaattagcccggcatggtggtgcacaactatagttccagctacttggttggctgaggcgcgaggaccatttgagctaggagtttgaggttacagtaagctatgatcacaccactgcactccagcccaggcaacaaagcaataccccttctctgaaaaataaaaataaaaataaaaaataaacatccaatccagtgctgggtaagtaccaacaggtgcctcgatagtttgatagggacaacccttaaatgaggctgccaggctagtgacrcagtgactggctaccacctggtcctgaccagaggctctctctctgatgtgggcagagtcaggtggctcaatctgaaaatgcctcacagactaaaatctaatcgcatttcacagatattggtaagaacctgatcgctcgctgtccttctacaaatgacagcttgtgaaaaagcatctgcacatagaagtgagcatcattcatccagcttagaaaagctagttacgggggacccaccagctgagccaataatcaaaggcaggtgggactttctcacgttgaattagttactgagaaagggac

SEQ ID NO: 51776 - DNA, 601 bp, Human
ctcagtcttctcatagataaaatgaggctaataacagtacccacctcatgtggttatgcaggattaaatgagataatgtatgtggagcacaatgcacgttaactagtaagaactcagtaaatgttagccatggtgattgctcttttcaaaggcacaggttaaacatcccatctaaatcaagtggggctcacactcataatctcagcactttgggaggccaaggtgggaggatcacttgaggccaggaatttgagaccagcctgaacaatattgtgagcccttgtctctacaaaaaaaaaawttttttaattagcccggcatggtggtgcacaactatagttccagctacttggttggctgaggcgcgaggaccatttgagctaggagtttgaggttacagtaagctatgatcacaccactgcactccagcccaggcaacaaagcaataccccttctctgaaaaataaaaataaaaataaaaaataaacatccaatccagtgctgggtaagtaccaacaggtgcctcgatagtttgatagggacaacccttaaatgaggctgccaggctagtgacgcagtgactggctaccacctggtcctg

SEQ ID NO: 51777 - DNA, 601 bp, Human
ccacagggcccacgcttagatgggtcctgtgcttggtttaatgctctaagggaccccacttcaatttgtactgggtgccacaaattatgtagctggtcctggtgaatctagctggactccactgcttactaactatgaaataccgggcaagttatttaacttctctgggcctcagtcttctcatagataaaatgaggctaataacagtacccacctcatgtggttatgcaggattaaatgagataatgtatgtggagcacaatgcacgttaactagtaagaactcagtaaatgttagccayggtgattgctcttttcaaaggcacaggttaaacatcccatctaaatcaagtggggctcacactcataatctcagcactttgggaggccaaggtgggaggatcacttgaggccaggaatttgagaccagcctgaacaatattgtgagcccttgtctctacaaaaaaaaaatttttttaattagcccggcatggtggtgcacaactatagttccagctacttggttggctgaggcgcgaggaccatttgagctaggagtttgaggttacagtaagctatgatcacaccactgcactccagcc

SEQ ID NO: 51778 - DNA, 601 bp, Human
tgagcaatatgtctccaggaaaactcagtcccaggagaaaacaggcggttgattcctatcttccctccagaaacttcactgttctcccatagcacccacagcatcaggtggtgactttcagcagaagacaaccaactccacaagggcaaacagccaaggggaggctgtaatgaacgcacagcaccaggatgagctcagatctgttcacctctggctagaaaagagttccccgtttttcaggaagagaaagctggcatttaaagaggacttgtgcctgaggagtgcacacaaaggcttccayttgctgtttacgtgccaaagtcaaatcttggcccaactgtgtgttgtgcagccctacttgtttagttgagagtgtgctttcttattatggtcaccagtctgtctgcgcaggcagggctgctttatggatgtgcaccctgtgcagtcccacagggcccacgcttagatgggtcctgtgcttggtttaatgctctaagggaccccacttcaatttgtactgggtgccacaaattatgtagctggtcctggtgaatctagctggactccactgcttactaactatgaaataccgggcaagtta

SEQ ID NO: 51779 - DNA, 601 bp, Human
tacctgtgaaatatgatgcaaactaagcaccccgtttgccttgtgctttactgtgggaaggaattgtttctgagcaatatgtctccaggaaaactcagtcccaggagaaaacaggcggttgattcctatcttccctccagaaacttcactgttctcccatagcacccacagcatcaggtggtgactttcagcagaagacaaccaactccacaagggcaaacagccaaggggaggctgtaatgaacgcacagcaccaggatgagctcagatctgttcacctctggctagaaaagagttcccygtttttcaggaagagaaagctggcatttaaagaggacttgtgcctgaggagtgcacacaaaggcttccacttgctgtttacgtgccaaagtcaaatcttggcccaactgtgtgttgtgcagccctacttgtttagttgagagtgtgctttcttattatggtcaccagtctgtctgcgcaggcagggctgctttatggatgtgcaccctgtgcagtcccacagggcccacgcttagatgggtcctgtgcttggtttaatgctctaagggaccccacttcaatttgtactgggtgccacaaa

SEQ ID NO: 51780 - DNA, 601 bp, Human
gatctagttacaccccgcctctctgactgccctgctcatccttctagaatgcttgggtagaactttgaagtaaggtgtgacagttgtctgtaggctctagaactagagactacacagatttctgttctgattcttctatttaccaactctcaggtcataggcacattcttaatctctctccctcactttcttcatcaaaagacaaggctattaaagtgcctacccatagctattaaagattaaatgagttacatgcaaagcaagagttacatgtgaagattaaatacctgtgaaatatgawgcaaactaagcaccccgtttgccttgtgctttactgtgggaaggaattgtttctgagcaatatgtctccaggaaaactcagtcccaggagaaaacaggcggttgattcctatcttccctccagaaacttcactgttctcccatagcacccacagcatcaggtggtgactttcagcagaagacaaccaactccacaagggcaaacagccaaggggaggctgtaatgaacgcacagcaccaggatgagctcagatctgttcacctctggctagaaaagagttccccgtttttcaggaagaga

SEQ ID NO: 51781 - DNA, 601 bp, Human
tccaagtgtctcagaaagaaatatattgcagacataggcaaacaagtggaggcttggaactggatgaacaggcatctcattaatcctgacaagtgctacacccccttcctccagctttcagagatgaccacccccacccacctcctgggtaaggcactgtggcttaccacggagcatcagggagaagtgaggagatgaaagatctggatcaaattccacctcacactacctggttctccttagacccacttaacatctgcaaatcctagtgtcagaggtactcaaggaaaatgcagggagraaaaaatcaatggactgtaaagtactgtaccaatgcaaagtattattattattatattatcacaattggttccttatttgttcagtgttttgttgactagaacacaaaaataatattaaagctaagttcttgggtaagagcatgagtgatgcaatactcaaacaagcctttaaatatattcacagccatctttctttggtgacacactgcccagtggacagaaagtcatcattcttgagtgatgctgtatctcatgcatgggcgtgtgtgtgagtgtatttgtgctccatgcctttggtg

SEQ ID NO: 51782 - DNA, 601 bp, Human
tgtccaagtgtctcagaaagaaatatattgcagacataggcaaacaagtggaggcttggaactggatgaacaggcatctcattaatcctgacaagtgctacacccccttcctccagctttcagagatgaccacccccacccacctcctgggtaaggcactgtggcttaccacggagcatcagggagaagtgaggagatgaaagatctggatcaaattccacctcacactacctggttctccttagacccacttaacatctgcaaatcctagtgtcagaggtactcaaggaaaatgcagggrgaaaaaaatcaatggactgtaaagtactgtaccaatgcaaagtattattattattatattatcacaattggttccttatttgttcagtgttttgttgactagaacacaaaaataatattaaagctaagttcttgggtaagagcatgagtgatgcaatactcaaacaagcctttaaatatattcacagccatctttctttggtgacacactgcccagtggacagaaagtcatcattcttgagtgatgctgtatctcatgcatgggcgtgtgtgtgagtgtatttgtgctccatgcctttgg

SEQ ID NO: 51783 - DNA, 601 bp, Human
acttgtgaaaacactgaagaccccagcttgactgtctcacaatagcctaactttggggaatataggttgtccaagtgtctcagaaagaaatatattgcagacataggcaaacaagtggaggcttggaactggatgaacaggcatctcattaatcctgacaagtgctacacccccttcctccagctttcagagatgaccacccccacccacctcctgggtaaggcactgtggcttaccacggagcatcagggagaagtgaggagatgaaagatctggatcaaattccacctcacactacctrgttctccttagacccacttaacatctgcaaatcctagtgtcagaggtactcaaggaaaatgcagggagaaaaaaatcaatggactgtaaagtactgtaccaatgcaaagtattattattattatattatcacaattggttccttatttgttcagtgttttgttgactagaacacaaaaataatattaaagctaagttcttgggtaagagcatgagtgatgcaatactcaaacaagcctttaaatatattcacagccatctttctttggtgacacactgcccagtggacagaaagtcatca

SEQ ID NO: 51784 - DNA, 601 bp, Human
aaatgagcctctacagtttcactttatgcaggtttatggtgactcttggaaacattcaagtaacttgtgaaaacactgaagaccccagcttgactgtctcacaatagcctaactttggggaatataggttgtccaagtgtctcagaaagaaatatattgcagacataggcaaacaagtggaggcttggaactggatgaacaggcatctcattaatcctgacaagtgctacacccccttcctccagctttcagagatgaccacccccacccacctcctgggtaaggcactgtggcttaccayggagcatcagggagaagtgaggagatgaaagatctggatcaaattccacctcacactacctggttctccttagacccacttaacatctgcaaatcctagtgtcagaggtactcaaggaaaatgcagggagaaaaaaatcaatggactgtaaagtactgtaccaatgcaaagtattattattattatattatcacaattggttccttatttgttcagtgttttgttgactagaacacaaaaataatattaaagctaagttcttgggtaagagcatgagtgatgcaatactcaaacaagcct

SEQ ID NO: 51785 - DNA, 601 bp, Human
tatgtatttcaaatagtgctttgaaaatacccgcagcaatcttaagagtactgccattacataagtaacttatgtacaatgagtactgggcttaccctatatggatgaggctaaagaaagtattgctggaagaaaaagtcctatagcattagcacactttatatggagatgaaagtctaaattaattaatattcatttttgtgccaattgatattacaatcttatgttaaaaagtatctagacagtaatctaaccattctcccaaatctgggtaaatcatgtggggcctgtttctgaatcyattcaatgagtgagttattgggtccatggttattgacaggttgggaatgcaacatgataaaaaaacgttgatggttagtccatcattcagccacccacaggcctgcagaactcacggttgccttctgccttcgggaatgagtcacctggatactttcttttgcaatcttctgttctgaatcattcaaacctcttataataatctaaattacagcttccatttctaaaatgagtgttcaggctaggcttcctcatcttgtatttcctttactcaccaggattttgatttaaatatgcaaaa

SEQ ID NO: 51786 - DNA, 601 bp, Human
gaagtctaaaaacaggaaagaatagggaagggaaggctttgtgctgtctctccccaccgccagtgaagtttcgccccatctggtttttttttctctttactgggaactccacatcatctctgagtcctacctctccgcccaactacctcttgcattgagggtaataagatgctaaaagtttattgatggatgtttgaatacaagagaatctttttatagtcaggtctactaatatgtatttcaaatagtgctttgaaaatacccgcagcaatcttaagagtactgccattacataagtaayttatgtacaatgagtactgggcttaccctatatggatgaggctaaagaaagtattgctggaagaaaaagtcctatagcattagcacactttatatggagatgaaagtctaaattaattaatattcatttttgtgccaattgatattacaatcttatgttaaaaagtatctagacagtaatctaaccattctcccaaatctgggtaaatcatgtggggcctgtttctgaatccattcaatgagtgagttattgggtccatggttattgacaggttgggaatgcaacatgataaaaaaacgt

SEQ ID NO: 51787 - DNA, 601 bp, Human
ggttagaatttaaatatgacacagtactcactcgaaagaccttctccactcttgcaatgcttttcccaaagatggttccaagttggtctccaattccagccaataagaaaccaaagagtggaattccaaagatggcatataaaatacaaaagattttgcctccttcagtgctcggagcaatattcccataccctggtgagaaatatgaaaaagagggagagtggcagagaaattagcatactgaccaaagaactcacagacttttttaaaagtttgtacattcccccaccttatgagcttyagggagtagaacttcatttcaaaggccctctacaattcgcaacattgttccattgcttctcttccttctccccttataaacggttttaaggtttcttggatattaacacattttaggaaattcatggtcactcagaactttcattttcatttctgacaaaaagtgataccacctttttctgaaacaccaagcatcatgggcatgtctagtttagcgagacctgaatgcgtgggaaggaatcaccactgcacttattagatttgacaagagcttctttttcacagtcttacccatgggctc

SEQ ID NO: 51788 - DNA, 601 bp, Human
gaaggagaaactgaacttgtctcacctcttcaaaaaatctgtgttggcaaatccatacttaaccctcttgtgttgtgattgcagaaatatcactctaaaataggaagctactcaaagaagggagtttaggtgcaagatgtttgacttccattggccaaaacagaaaatacaatcataacattaaaattattccattaaaagcagacaatgcccctgatactgcctcctggatcctgtcaggctaaagccaactggatcacagtggttagaatttaaatatgacacagtactcactcgaaasaccttctccactcttgcaatgcttttcccaaagatggttccaagttggtctccaattccagccaataagaaaccaaagagtggaattccaaagatggcatataaaatacaaaagattttgcctccttcagtgctcggagcaatattcccataccctggtgagaaatatgaaaaagagggagagtggcagagaaattagcatactgaccaaagaactcacagacttttttaaaagtttgtacattcccccaccttatgagcttcagggagtagaacttcatttcaaaggccctctacaatt

SEQ ID NO: 51789 - DNA, 601 bp, Human
ccactcatgcctgcaactaatgccaggaataatttattaattaattttaattttagtaaataaattccttgagttgagatagttgtctcttgtttaaagataaatattccagaaaggaaaaaacccactaaggcaatagcaatcatcaacagttcagtaggaagtagtacatcaggatgccatttctgagggagcactcagcagtgagagatgggagagagagagaccattaggagacaggtgcaaagcacagagcagtgtctggagaagtcaggcttctggaagaagcaggattagcctraagacactgtgcttgaaaataaaacggagtaagggagttccaacaacaaaatggatggatttacagttttctacatcattacaaacacaatgaggaaccccatcttccatcttgaaggagaaactgaacttgtctcacctcttcaaaaaatctgtgttggcaaatccatacttaaccctcttgtgttgtgattgcagaaatatcactctaaaataggaagctactcaaagaagggagtttaggtgcaagatgtttgacttccattggccaaaacagaaaatacaatcataacattaaaat

SEQ ID NO: 51790 - DNA, 601 bp, Human
ttttgtggatgagtaaactgaggcagctgacccaggatcagtgagattataaaatggctcacccagctatggtgcctcgttcctcccattctactctttttaaaaagcctctgaaactgctcatctgaaagctcccttgcattcttctaaagagaagtatgagccattattgcagagacagccttgaactcaaagtttaagagttcttagagggggaaaaaagcacagctttagagcttccagctgatctgcctttggccaccattcctagatcctggaaaagacctcagaatgtcatttktaaatattaagtcatcataagaaagcattccctgaggaaggtttgaaagacttgagaattaggtcagcggtgagtaagagggcagaagtgaccttacatctgagcaaaacaggtgttctgtgaaagcatacaaatgagtgcgagttaaagggcattgggaaccccggtttaatcactcagccactcatgcctgcaactaatgccaggaataatttattaattaattttaattttagtaaataaattccttgagttgagatagttgtctcttgtttaaagataaatattccagaaaggaaa

SEQ ID NO: 51791 - DNA, 601 bp, Human
tcacacaccacagagctcctcagatgaaacccggatgagtggctagcctgcccatgagggcttctcttggagagaaacacagaagccctgggctctatatgtctgccctatatgacaagctcttttccacacatcatttcatttaatcatcaccaaaacctgacaaagtagattcaaattctatccccttttgtggatgagtaaactgaggcagctgacccaggatcagtgagattataaaatggctcacccagctatggtgcctcgttcctcccattctactctttttaaaaagcctctraaactgctcatctgaaagctcccttgcattcttctaaagagaagtatgagccattattgcagagacagccttgaactcaaagtttaagagttcttagagggggaaaaaagcacagctttagagcttccagctgatctgcctttggccaccattcctagatcctggaaaagacctcagaatgtcatttgtaaatattaagtcatcataagaaagcattccctgaggaaggtttgaaagacttgagaattaggtcagcggtgagtaagagggcagaagtgaccttacatctgagcaaaacag

SEQ ID NO: 51792 - DNA, 601 bp, Human
cagggctgctatgtctggtttaggaagaactaaacatctgaaaagcagggaagctgagcactgatggtttccatggagactactggggagcccaggtgcacggtctaatgaggccaccggccagccagcatgaaggagcaaaggctgtgggacattccagtaaaactcacacaccacagagctcctcagatgaaacccggatgagtggctagcctgcccatgagggcttctcttggagagaaacacagaagccctgggctctatatgtctgccctatatgacaagctcttttccacacatyatttcatttaatcatcaccaaaacctgacaaagtagattcaaattctatccccttttgtggatgagtaaactgaggcagctgacccaggatcagtgagattataaaatggctcacccagctatggtgcctcgttcctcccattctactctttttaaaaagcctctgaaactgctcatctgaaagctcccttgcattcttctaaagagaagtatgagccattattgcagagacagccttgaactcaaagtttaagagttcttagagggggaaaaaagcacagctttagagcttccagctga

SEQ ID NO: 51793 - DNA, 601 bp, Human
gtccaatcctttcttctacaaataaggaaactgagctctaaagaagctacataaaaataaaaatgccagatcagtcatttccccaattgaatcctgttctgagtgttcaaactaccagattcttttttctctaagtcagagggccatgaggcagcagctaaaagggtgcttccaagaagttcaaaagagttcttggagacagggctgctatgtctggtttaggaagaactaaacatctgaaaagcagggaagctgagcactgatggtttccatggagactactggggagcccaggtgcacrgtctaatgaggccaccggccagccagcatgaaggagcaaaggctgtgggacattccagtaaaactcacacaccacagagctcctcagatgaaacccggatgagtggctagcctgcccatgagggcttctcttggagagaaacacagaagccctgggctctatatgtctgccctatatgacaagctcttttccacacatcatttcatttaatcatcaccaaaacctgacaaagtagattcaaattctatccccttttgtggatgagtaaactgaggcagctgacccaggatcagtgagatt

SEQ ID NO: 51794 - DNA, 601 bp, Human
gtagcagatgtccagatgattgcaacctcttccatcacttcaaatatagtaactagaattttttctgctaaggaggatttcaaaaacttttagtccaatcctttcttctacaaataaggaaactgagctctaaagaagctacataaaaataaaaatgccagatcagtcatttccccaattgaatcctgttctgagtgttcaaactaccagattcttttttctctaagtcagagggccatgaggcagcagctaaaagggtgcttccaagaagttcaaaagagttcttggagacagggctgcyatgtctggtttaggaagaactaaacatctgaaaagcagggaagctgagcactgatggtttccatggagactactggggagcccaggtgcacggtctaatgaggccaccggccagccagcatgaaggagcaaaggctgtgggacattccagtaaaactcacacaccacagagctcctcagatgaaacccggatgagtggctagcctgcccatgagggcttctcttggagagaaacacagaagccctgggctctatatgtctgccctatatgacaagctcttttccacacatcatttcattt

SEQ ID NO: 51795 - DNA, 601 bp, Human
ctttatttattgattgattgattaatacaggggctcaccctgtcacccaggttggagtgcagtggcacgatctcaactcactgcaacctccacctcctgggttcaagcaattctaatgcctccgcctcccaagtagctgggattacaggcatgcaccaccgtgccctgcaaatttttgtatttttagtactgacagggtttcaccatcttggccaggatggtcttgaacttctgacctcaggtgatccacccacctcagcctcccaaactgctaggattacaggtgtgagccaccatgccyggcagaaagccaactttagattttatttttactccaccgtaaatcctctcttcccaagagctgagagaaaacataacagatcaagagaagggcttaacactcattgagcagaagaaatacataaaccttcccccatgagaactaaaaattcacaaccccaagctttgttagcttatacaattttcatttctcaaataaccacctaaacgtaattggacttttaaatgtagtttaaatcaatggcagaaaactgagattttctaccaaaactttacatgcagcaagcaaactgctgcagga

SEQ ID NO: 51796 - DNA, 601 bp, Human
ttcaggcatcttgaagaccaactttatatttactttatttattgattgattgattaatacaggggctcaccctgtcacccaggttggagtgcagtggcacgatctcaactcactgcaacctccacctcctgggttcaagcaattctaatgcctccgcctcccaagtagctgggattacaggcatgcaccaccgtgccctgcaaatttttgtatttttagtactgacagggtttcaccatcttggccaggatggtcttgaacttctgacctcaggtgatccacccacctcagcctcccaaastgctaggattacaggtgtgagccaccatgcccggcagaaagccaactttagattttatttttactccaccgtaaatcctctcttcccaagagctgagagaaaacataacagatcaagagaagggcttaacactcattgagcagaagaaatacataaaccttcccccatgagaactaaaaattcacaaccccaagctttgttagcttatacaattttcatttctcaaataaccacctaaacgtaattggacttttaaatgtagtttaaatcaatggcagaaaactgagattttctaccaaa

SEQ ID NO: 51797 - DNA, 601 bp, Human
gaatatgcaactgctctaaaaaaagataaattttaagggagttccttttgtatttcctgatatgaggttgggtgaaaacgtgctatttggtcatgaagcagccatcttgcaatgtgagtgacaagtctgaggatgaagagctaccatgccaaggaaaacagagcagaaagaggtaacaaatctggatacacctgacattgtggagctgatagcacaagcctgagtcaacgtacctccaggcttcttgctatgtgagataagggttcaaattcttaacccattgttaatgagtgttgggagyatgaaaattgtcagaatcaaaatggggttacttgtgcttaaaactctgacaaacagagtcagggaaagccaggaaggaaggattctcatgcacaaatgcctgattacaagagctatcataaaagactgcaaaaactacaaccttgcacaaaacccatcacctcgttatgcagaaaagcatttctgcgaagacatctacccagcaactgactgtccaaccttggactggcatcacccttgttattgatccttgtattcaaggataattagctcaaaacaattatgtaatcctgttcatttt

SEQ ID NO: 51798 - DNA, 601 bp, Human
aaagaggcttaattggacttacagttccacatggctggggaggcctcagagtcatggtgggaggtgaaaggtatttcttacatggtggcagcaagagaaaaatgaggaagaagcaaaagcagaaacccctgataagcctatcaaatctcgtgaggcttattcactatcatgagaatagcacaggaaagactggcccccatgattcaactacctccccctgggtccctcccacaacacatgggaattctgggagatataagttgagatttgggtggggacacagccaaaccatattaatgamattctggaaaagacaaaactaataaaaacatgagtcattgtcaaaggttaggagaacgggattgatgaacaagcagggtacagaggatttttaggagagtgaaatactatgtatgatactataatggtagacgcatgtcattataaatttgtccaaattcatagactctacaacaccaagagtgaaccctaatgtaaactatggactctaggtgataatgatgcatcaatgtaggttcataaattgtaacaaatgtaccagtctggtgcgggatgttgataatgagggagactgcacatg

SEQ ID NO: 51799 - DNA, 601 bp, Human
ttaactaaaggagttgaaaactaatgttcaaccaaaaaacctgtgcacagaggtttatatcagctttattcgtaattaccaaaacttagaagcaaacaagatgtccttcagtaggtgaatggatacataaactatggtacacccagaaaatggaatattattcaccacccagcagaaatggactacaagccatgaaaagacatagaggaaacttttatccatatttaagtgaaataagccagtctgaaaaggctacatacagtatgattccaactacacaactgtataagtccgttttcaygctgctgataaagacatatctgaaactgggaacaaaaagaggcttaattggacttacagttccacatggctggggaggcctcagagtcatggtgggaggtgaaaggtatttcttacatggtggcagcaagagaaaaatgaggaagaagcaaaagcagaaacccctgataagcctatcaaatctcgtgaggcttattcactatcatgagaatagcacaggaaagactggcccccatgattcaactacctccccctgggtccctcccacaacacatgggaattctgggagatataagttgag

SEQ ID NO: 51800 - DNA, 601 bp, Human
cccaacagccacctaatttatgacaaggaagagtgaagacatcttctctatgagtgatctcagtggctagcagttaattgacatctatgtgagacgttatcatttgcttactccaacttcttcgctaacagaattctaattttgttcatcacagcaatgtgttcagccccaagagatgaaacatgattcctctgctccttaagcattggaatcacttggacagcttggtaaacacagattgctgagctccagccccaccgcccccaccacgaccacaaataattttcatttctaacaagtytccagtggatgccgatgccgatggtccaagggatactgatgcctaaggttgagggaccaaactttgagaatcactggtccattatggcaatactatcgtcctttgtccgatacttcctttcctatcctcccttgcagatgctaatgtgatctcattctggtcaatgagacagaaggggaaatctacagggtaacttctgggaaagatttttcttccataaaaggagctgatgtcaacacaatattgaaaaagaagaaaaaaattggaggactgacactaactggctttaagaattactat

SEQ ID NO: 51801 - DNA, 601 bp, Human
gaggttaaggcaggattagtggttctaatccaggtcctaccaccaattcactgtgtggatccaggcaagtcacctcacaggctccattttctcaggtgtgaaatctatgagtctcacaatagtagtattccccccgaagagtgatgcacaaacgacctggaactaaattcctgaaaggctggtcaccctagagtgggacccaggagtgcatcttagagcatatgaacatgactataccagtgcgcaacaattttaccatccactactattcttggagataaaagaatgcattccaaacccmctttgcagctacgaatgggacctggtaactagctcgggccaatgggctctacctgagggacaacgctctgaagagccagcaagcagcgctcagctgtttcccccaccctatctagcccctgagcctgagaagctgcctgggttgcagcagatctggcaggagtgggagtaggctgtttgtgataggctagcttatcttgattgattcaaggatcccaacagccacctaatttatgacaaggaagagtgaagacatcttctctatgagtgatctcagtggctagcagttaattgacatcta

SEQ ID NO: 51802 - DNA, 601 bp, Human
ttccaagtaattttggcactcgtaagtctagggtaatgttttattatttgtcagtgacacccagaatcatttggatccataagcaaataaacatttctgccatatccttggggcggggggaaagccaaaaaaagaaaaagaaaaaaaaaaaaaggtgtcccttggttttacaggaaataccagaaagcctgctgatccgagccggaaaaaaagaagcaggtacttcctaccagaggccaaagtccagcttggagccaagaaaatgagaatcagtccagaatttgactggttttcctacagyatcctatcaagtgataatcagcctggcccagcaagacagctaccccacagcaggggagaaagaggccgcctgcttccaaaacctgcttcagaatccaatgtcagccctccttcatcccaaataagcagatatttgggatgctaactgcccagatatttccctgggaactcaggaagaattatttttactttaattagtatggtatactaaaatattctaaactccacattggtttcatggtgtagattaatctgacattaatattttcagcccatctggaagaggttaaggcaggattag

SEQ ID NO: 51803 - DNA, 601 bp, Human
tgaactcccgggctcaagtaatccttctgtcttggcctcccaaagagctgtgattacagacgtggaccactgcgcctgcctcttgaaatagtaattattttaagttaacccttttgctgctgaatgctagctcaaagatgccttgggagaaacagaagcttcctgccaattgtgttcttaaaagcctctccttgatccatgccaggcacatggcagaggcctgcaggagtctttggcttccgccacatgccccttcctggaatctaaagtggttgatcagtccactaatttaaccgtattmgcactttgagattgtcatcacttccatcttaaacatgtggcctgttctaaattttccaagtaattttggcactcgtaagtctagggtaatgttttattatttgtcagtgacacccagaatcatttggatccataagcaaataaacatttctgccatatccttggggcggggggaaagccaaaaaaagaaaaagaaaaaaaaaaaaaggtgtcccttggttttacaggaaataccagaaagcctgctgatccgagccggaaaaaaagaagcaggtacttcctaccagaggccaaagtccag

SEQ ID NO: 51804 - DNA, 601 bp, Human
tcagcctcccgagtagctagaactataagcacacaccaccatgccaggctaatttttgtatttttagtaggaacagggtttcatcatgttggccaggctggtctcaaactgctgacctcaagtgatctgcctgcctctgcctcccaaagtgctgggattacaggcatgagccaccacgcccggctcgattttcttttttttttcagagatggggtctcactatgttgcccaggctggtcttgaactcccgggctcaagtaatccttctgtcttggcctcccaaagagctgtgattacagaygtggaccactgcgcctgcctcttgaaatagtaattattttaagttaacccttttgctgctgaatgctagctcaaagatgccttgggagaaacagaagcttcctgccaattgtgttcttaaaagcctctccttgatccatgccaggcacatggcagaggcctgcaggagtctttggcttccgccacatgccccttcctggaatctaaagtggttgatcagtccactaatttaaccgtattagcactttgagattgtcatcacttccatcttaaacatgtggcctgttctaaattttccaag

SEQ ID NO: 51805 - DNA, 601 bp, Human
aagtgctgggattacaggcttgagtcaccacaccaagccactctatgctcttaaaaccatcgaagcagagcattgaggcattctgatgagcccagaaaaagaagaatgctttggaggacaaggccagctatctcagggcaccaagaggcttggctttgagctgtgcatttcctcctgtttttaacattaagcaggttgtacaaagtagagcagtggatggaagaacagagtggggactatctttgcctggcaactgctctcgcagaggtgggtcaaaacaagtcagctattggtacagtawaggcccctcttttattaggttggtacaaaagtaattgtggtttttgacattacttttaatgtcctatagtgataccagaatataaacccatctttgtattagtcacatagcagcagacatgagcaaggggacacctaaatcttagattaacctccaagaaaagagaacacaaagaaagagatattaactaataatgagctggtattagggaactaaagcagatacataaagaaccagaggctatgatgcaattcaacacactgagagagagcatgaagtcagaaaactaaaatcctttta

SEQ ID NO: 51806 - DNA, 601 bp, Human
gtgctaagtgaaataggccagacacaaaaggacaaacactatatgactccattgacatgaggttcccggagtggtgaaattcatagacacagaaagtagaatggtggtcaccaggagctgggggagaggaaatgagcagttattattgaacagactcagagttgtcatttgggaagatggaaaagttctggagatgatggtagtgatggttgcacaacaatgtgaatgtacttaatgccactgaactgtacacttaaaaacaggatggtaaattttatgttgtgcacactttaacacaattaaaaaaaggcataaagaaaatcttgaagcaggctctaaagtatcctaccaactcctgggagtaacttagaggaaaagaaaacttctggccaggcgcggtggctcacggctgtaatcccagtgctttgggaggccgaggcaggtggatcatgaggtcagaagtttgagaccagcctggacaaaatggtgaaaccccgtctctactaaaaatacaaaaattagccaggcgcagtggcaggtgcctgtaatcccagctacttgggaggctgaggcaggagaattgcttgaacctgagaggcag

SEQ ID NO: 51807 - DNA, 601 bp, Human
gtccatcaacagataaacaaataggcaaaatgtggtatatacagacagggggatattactcagccttgaaaggaaggaaattctgacacatgtgcaatattcatgaagccttaaagacactgtgctaagtgaaataggccagacacaaaaggacaaacactatatgactccattgacatgaggttcccggagtggtgaaattcatagacacagaaagtagaatggtggtcaccaggagctgggggagaggaaatgagcagttattattgaacagactcagagttgtcatttgggaagatggaaaagttctggagatgatggtagtgatggttgcacaacaatgtgaatgtacttaatgccactgaactgtacacttaaaaacaggatggtaaattttatgttgtgcacactttaacacaattaaaaaaaggcataaagaaaatcttgaagcaggctctaaagtatcctaccaactcctgggagtaacttagaggaaaagaaaacttctggccaggcgcggtggctcacggctgtaatcccagtgctttgggaggccgaggcaggtggatcatgaggtcagaagtttgagaccagcctggac

SEQ ID NO: 51808 - DNA, 601 bp, Human
aaaaaaaaaaaaaacagaaaaaagcaagtgttggtgaggaagtggaaagacagaatccctgggcattgttggtgggaatgtgaaatggtgcagccactgtagaaaacagtgtcacggttcctcagaaaaattaaatctgtaattatatgtgactcagcaattccactgctgggtatatgtccaaaataattaaaaacagggacttgaatagatgtttatacacccatgttcatagcagcattattcataacaaccaaaaagtggaaacagcccaaaagtccatcaacagataaacaaatargcaaaatgtggtatatacagacagggggatattactcagccttgaaaggaaggaaattctgacacatgtgcaatattcatgaagccttaaagacactgtgctaagtgaaataggccagacacaaaaggacaaacactatatgactccattgacatgaggttcccggagtggtgaaattcatagacacagaaagtagaatggtggtcaccaggagctgggggagaggaaatgagcagttattattgaacagactcagagttgtcatttgggaagatggaaaagttctggagatgatggtag

SEQ ID NO: 51809 - DNA, 601 bp, Human
gatcacatgagcacatctgcgtgaacacttgcagccagtgaagtgtggccgacgacgaagaagacaacctgcctccttcacgcagaccgaatggcaacggcatcccctgggggagccccagaggagccgacgaacctgccgtctgcactcttgcttgtgctgtttgcctttcgaaagggctcgctgcatcgcggccagtgcatcttctcctcccaaggccatgcttgatggctgaggtcccgtcccagatacagaccctgttgcccatgggtttctttctctctgtcgctaccctttctgkggccccctccacttctccagccccacccacctccatgcccatttccaggaagggtaggacagagggcagcatcagcaagcatctcttcatttgtgaagcttacacatcctgggtgcttggaaaaagacctggttcgtgtctctctcctctctaatcaattcacaatcaataaatatttactgaacacctccaaagcacttagcactgagcaggtcctacagggatacaggccaataaaggcacagtaacatttagctttaagcccctatgctttacttgagcagaacaatccattggcaa

SEQ ID NO: 51810 - DNA, 601 bp, Human
aattctcactcattcttggattttttcttctttttttactagaatctgcgtatgtggtaagatcacatgagcacatctgcgtgaacacttgcagccagtgaagtgtggccgacgacgaagaagacaacctgcctccttcacgcagaccgaatggcaacggcatcccctgggggagccccagaggagccgacgaacctgccgtctgcactcttgcttgtgctgtttgcctttcgaaagggctcgctgcatcgcggccagtgcatcttctcctcccaaggccatgcttgatggctgaggtccygtcccagatacagaccctgttgcccatgggtttctttctctctgtcgctaccctttctggggccccctccacttctccagccccacccacctccatgcccatttccaggaagggtaggacagagggcagcatcagcaagcatctcttcatttgtgaagcttacacatcctgggtgcttggaaaaagacctggttcgtgtctctctcctctctaatcaattcacaatcaataaatatttactgaacacctccaaagcacttagcactgagcaggtcctacagggatacaggccaataaagg

SEQ ID NO: 51811 - DNA, 601 bp, Human
aaggaacggaacaaataatggaggaaacatcactcaatctgagaggggaaatgatgtaataatacagtatctaaacagaagagacagtgtttgagctcagtaaaacccatcttccgaggatcccttgttggtatttgaagggccaggcttcttttcggaggaaactttagtcttcctttaggatcttttagtaacactttgatgcatttttataaaaatacaaactggcccttgttttcaagatctggtaagagcacgggcaagctgagaggcagtcagcatgtagctaaaataaattctyactcattcttggattttttcttctttttttactagaatctgcgtatgtggtaagatcacatgagcacatctgcgtgaacacttgcagccagtgaagtgtggccgacgacgaagaagacaacctgcctccttcacgcagaccgaatggcaacggcatcccctgggggagccccagaggagccgacgaacctgccgtctgcactcttgcttgtgctgtttgcctttcgaaagggctcgctgcatcgcggccagtgcatcttctcctcccaaggccatgcttgatggctgaggtcccgtccca

SEQ ID NO: 51812 - DNA, 601 bp, Human
gataaattcccttttattttaaccacatgatatctattcctgattctaattgctcaagctaatctgcaaaatagtttagaatgagaagggacagtcctgacaactgagacgagatgcccgatacacccatttgtgactactcgggagtgagaggggacctgggggtggggagtggataggtagacaaacaaatattaataataataatttagtatcagttctttcaagcattccccaggctcgtatagaaagactgcagatgttgttcatggtgaaattcacttctgccaaggaacggaamaaataatggaggaaacatcactcaatctgagaggggaaatgatgtaataatacagtatctaaacagaagagacagtgtttgagctcagtaaaacccatcttccgaggatcccttgttggtatttgaagggccaggcttcttttcggaggaaactttagtcttcctttaggatcttttagtaacactttgatgcatttttataaaaatacaaactggcccttgttttcaagatctggtaagagcacgggcaagctgagaggcagtcagcatgtagctaaaataaattctcactcattcttg

SEQ ID NO: 51813 - DNA, 601 bp, Human
cttcctcttccttggggaaaaggttgataagcctccaaagggtagataaaagagagagacacctaatataaatacagaattaaagggctcaggacaattgaggctttctgaagagcagcagagtcaagaagcatacagcaatgtcaggaaaaggatgccagaaagaaagtggtaataacattgcaagaataccatatggcatttacatgtcatgtactgcattttaaatgttgatacttgctttttttttgttagctctggtgccaactctgttatagtacacagcaaaatttattttttwaaaaaaatcacatggaagttctctgtaatctattttcaaattgtagataaattcccttttattttaaccacatgatatctattcctgattctaattgctcaagctaatctgcaaaatagtttagaatgagaagggacagtcctgacaactgagacgagatgcccgatacacccatttgtgactactcgggagtgagaggggacctgggggtggggagtggataggtagacaaacaaatattaataataataatttagtatcagttctttcaagcattccccaggctcgtatagaaagact

SEQ ID NO: 51814 - DNA, 601 bp, Human
gttcacgccattctcctgcctcagcctcccgagcagctgggactacaggggcccgccatcgcgcccggctaattttcttgtattttttagaggagacggggtttcaccatgttagccaggatggtctcgatctcctgacctcatgatccgcccgcctcagcctcccaaagtgctgggattacaggcgcgagccacagcgccagcccaaggtcactctgtttatctttttttagagggggattgtgcaggattaggagagtaggagggataggggatgtctcactatgctgcccaagctggsctgatcctccagcctcagcctctcaagtaactgggacctagtccagcttcaaggtcattttctatatcaagatgtataaggttatgtctagcaatgttcattcattgattcatcaagtatggattaagtgctctctgggttccaggccatgtgctagcacctgaagatgcagtggtgaacaggcagatgggacccgacctcacacaactcataggctgatggggatgcccaccatcaatacagtgagatgaatgttattcttggggtctacaagatgttatttggggggggtgttgacct

SEQ ID NO: 51815 - DNA, 601 bp, Human
tggcaataagcattagcagggagcagctccctacagacccatcttttattcaaaataattgtacttcaaagcctaagaactttttttccccattgccatttatttgcatacaatactagtttcgatttcaaggtcactctcttttttttttttttttttttttgagacagattctcactttgtcgcccaggccggagtgcagtggtgcaatttcggctcactgcaagctccgcctcccaggttcacgccattctcctgcctcagcctcccgagcagctgggactacaggggcccgccatcrcgcccggctaattttcttgtattttttagaggagacggggtttcaccatgttagccaggatggtctcgatctcctgacctcatgatccgcccgcctcagcctcccaaagtgctgggattacaggcgcgagccacagcgccagcccaaggtcactctgtttatctttttttagagggggattgtgcaggattaggagagtaggagggataggggatgtctcactatgctgcccaagctggcctgatcctccagcctcagcctctcaagtaactgggacctagtccagcttcaaggtcattt

SEQ ID NO: 51816 - DNA, 601 bp, Human
cctgtttagattacaacaccctaggaggtggtctctaaacttgttagggtgtttgcggttgtcacaactggaggggcacgtttggcatgtactgggaggaggtcaaagacgttcagatgtcctgcaatacaacaatcagtgccacaaatcacagaaccatcccacatttagcatgagctttgaatgtcccactgagaaaaactcatgtctacaattatctgagccaagaacctaactcccttttacatgtgaagacacacacacaaattgtttgcatcttttcaaagttgaccaaattttwtaagaatctgactctaatgtaaatagattagctggaaccttgctgagagttgttctctattttggaaaaccacaccactggagaaaaagtcctttgtgacatcttagtcatcaacacaacatacctgaaccaatctgcatttggagatattgcattctacgtatagatgccaagactcactgcttcagcaggtctcctagggtttcataacagagcacctattattgaaacattactttccatttatttctcctttatattatagctagaaaatttgcattgaatttttcagaattatct

SEQ ID NO: 51817 - DNA, 601 bp, Human
ccgcccacattggcctcacaaagtactgggattataggcataagccaccatgcctggcccgtagtgcatttttctacagctgcctcctctattttagcacctcaagaaaatatgagagtactgtttaaagcaaatattctataaaaacaataaaaccattcatctagcaagagataaactgacaggattttataatttggaattctagtaaaggtacataacatagaaaggtatagtcagatggatgtacacacacatatgcatataataaatatttgtggaatagaactgaatattaatrgcatgggaaatacatcaagggaagaggcttaactattggaacatggccattttcacgagaatagaaattaaatatgtaaattcttgaaagttacatgggagccccctggaagctctgtttataaccctgtttagattacaacaccctaggaggtggtctctaaacttgttagggtgtttgcggttgtcacaactggaggggcacgtttggcatgtactgggaggaggtcaaagacgttcagatgtcctgcaatacaacaatcagtgccacaaatcacagaaccatcccacatttagcatg

SEQ ID NO: 51818 - DNA, 601 bp, Human
aacctctgcctcccgggttcaagtgattctcctgcctcagcctcccgagtagctgggactacaggcatgcaccaccatgcccagctaatttttgtatttttagtaagatggagtttcactatgttggccaggatggtctcaatctcttgacctcatgatccgcccacattggcctcacaaagtactgggattataggcataagccaccatgcctggcccgtagtgcatttttctacagctgcctcctctattttagcacctcaagaaaatatgagagtactgtttaaagcaaatattctayaaaaacaataaaaccattcatctagcaagagataaactgacaggattttataatttggaattctagtaaaggtacataacatagaaaggtatagtcagatggatgtacacacacatatgcatataataaatatttgtggaatagaactgaatattaatggcatgggaaatacatcaagggaagaggcttaactattggaacatggccattttcacgagaatagaaattaaatatgtaaattcttgaaagttacatgggagccccctggaagctctgtttataaccctgtttagattacaa

SEQ ID NO: 51819 - DNA, 601 bp, Human
ttttcttttcttttttttttttttttttttgagatggagtcttactctgtcacccaggctggagtgcaatggcgtgacctcggctcactgcaacctctgcctcccgggttcaagtgattctcctgcctcagcctcccgagtagctgggactacaggcatgcaccaccatgcccagctaatttttgtatttttagtaagatggagtttcactatgttggccaggatggtctcaatctcttgacctcatgatccgcccacattggcctcacaaagtactgggattataggcataagccaccaygcctggcccgtagtgcatttttctacagctgcctcctctattttagcacctcaagaaaatatgagagtactgtttaaagcaaatattctataaaaacaataaaaccattcatctagcaagagataaactgacaggattttataatttggaattctagtaaaggtacataacatagaaaggtatagtcagatggatgtacacacacatatgcatataataaatatttgtggaatagaactgaatattaatggcatgggaaatacatcaagggaagaggcttaactattggaacatggccat

SEQ ID NO: 51820 - DNA, 601 bp, Human
agccctctccagttcttgctctctgctgtccatgttccttcacccttgcatggtcccctgtccatagaactgctcaacctgcatcactgtctgtccatccatccatgtgtctccctactacacagtgtgctccttcatctcaatgttctaagtgcctggcacagtgcatttttcttttcttttcttttcttttttttttttttttttttgagatggagtcttactctgtcacccaggctggagtgcaatggcgtgacctcggctcactgcaacctctgcctcccgggttcaagtgattctyctgcctcagcctcccgagtagctgggactacaggcatgcaccaccatgcccagctaatttttgtatttttagtaagatggagtttcactatgttggccaggatggtctcaatctcttgacctcatgatccgcccacattggcctcacaaagtactgggattataggcataagccaccatgcctggcccgtagtgcatttttctacagctgcctcctctattttagcacctcaagaaaatatgagagtactgtttaaagcaaatattctataaaaacaataaaaccattcatctagcaaga

SEQ ID NO: 51821 - DNA, 601 bp, Human
gtttccctagcctaaaaatcctctctgctccaccgattcatccctctcttcccccaggctcttggcaatcatggatctttgtaactgtctccatagtttagacttttctagaatgtcatgtagttggaatcatactgcatgtagccttttcagattggcttcttccacgcagcaatatgcatttagcattcctctacatcttctcatggcttcatagctcatttctttttagcttctgtgcccttttaagggctgttccatctgctaggataaggttcttcgccctttttaatgcttgtcrgactcctgttcattcctcacacacaattctgacattacctcttgcaggaagccctctccagttcttgctctctgctgtccatgttccttcacccttgcatggtcccctgtccatagaactgctcaacctgcatcactgtctgtccatccatccatgtgtctccctactacacagtgtgctccttcatctcaatgttctaagtgcctggcacagtgcatttttcttttcttttcttttcttttttttttttttttttttgagatggagtcttactctgtcacccaggctggagtgcaatgg

SEQ ID NO: 51822 - DNA, 601 bp, Human
ttcagtgcctttttcaagatttgatttttttagaaccatttttgcttcacagcaaaattaagagaaaggtacagagatctcccatatagcccccgccccaaacatgcacagccttccccactatcaacatcccatgccagagtagtgcactggttacaagtgatgagcctatactgacaatatcatccagaatccatagtatacattagggttcactgttggtgctgtacatcctatgggtttggacaaacgtctgatgacatgtatccaccattatagtatcatacacaatagtttcccyagcctaaaaatcctctctgctccaccgattcatccctctcttcccccaggctcttggcaatcatggatctttgtaactgtctccatagtttagacttttctagaatgtcatgtagttggaatcatactgcatgtagccttttcagattggcttcttccacgcagcaatatgcatttagcattcctctacatcttctcatggcttcatagctcatttctttttagcttctgtgcccttttaagggctgttccatctgctaggataaggttcttcgccctttttaatgcttgtcagactcct

SEQ ID NO: 51823 - DNA, 601 bp, Human
aagaaatgcatcctgcctgctgcctcatgctgcctcctcctcctcctcctccagaatacgtcaacccacttctgaggaaactgtcagggaccccaccccccgccatttcccccaactcccccctacccccgctgcaggcaggtagttgctgacccctctctcttgctgtagtagcagttagtttgcagttctggagagactggatggtttattggtgccccaatactgctccattttatacttcagtgcctttttcaagatttgatttttttagaaccatttttgcttcacagcaaaattragagaaaggtacagagatctcccatatagcccccgccccaaacatgcacagccttccccactatcaacatcccatgccagagtagtgcactggttacaagtgatgagcctatactgacaatatcatccagaatccatagtatacattagggttcactgttggtgctgtacatcctatgggtttggacaaacgtctgatgacatgtatccaccattatagtatcatacacaatagtttccctagcctaaaaatcctctctgctccaccgattcatccctctcttcccccaggctcttggca

SEQ ID NO: 51824 - DNA, 601 bp, Human
gattttactttcttctttgcactcccctgcattttccaaggcctctacagtgaccatgtatactctttgtagtctttgtgatgaaagaaaaaggaaaagggggagaggtaggagagagcgagagggagagggctaagaagagaagggaaggagaaaacgagcaacatgctcaagaacatggcagaggttccctcgagaaataacagcactgtgcccttgaaaatcattcacttggtccttcttccttttggaaaaggagtgacaacccttccttggagggaaaactaaaagagaaaaggargaagagataatccccatggtaacataagagggatgggccttgtctgagccttcaggatcccaggaatgtttgccaaaggtggcagtgggagagctgtaaggacctggccatgatccagttcaagaaatgcatcctgcctgctgcctcatgctgcctcctcctcctcctcctccagaatacgtcaacccacttctgaggaaactgtcagggaccccaccccccgccatttcccccaactcccccctacccccgctgcaggcaggtagttgctgacccctctctcttgctgtagtagcagtt

SEQ ID NO: 51825 - DNA, 601 bp, Human
cagaaggagctgatggagtaacacagggaaggcacaggctgtggccaggacacggtgacaacccctgccagtacccgagggcagggaaacttggacagggtaggtagcaggtgggaggggtactgtggggccagtggagcaccaggcattggggccaaatgtagatgcagagaaaagattcagaagtacgattatcaacgtgttagtggtggatttctttggacaaaggatatttacaggattttactttcttctttgcactcccctgcattttccaaggcctctacagtgaccatgtatwctctttgtagtctttgtgatgaaagaaaaaggaaaagggggagaggtaggagagagcgagagggagagggctaagaagagaagggaaggagaaaacgagcaacatgctcaagaacatggcagaggttccctcgagaaataacagcactgtgcccttgaaaatcattcacttggtccttcttccttttggaaaaggagtgacaacccttccttggagggaaaactaaaagagaaaaggaggaagagataatccccatggtaacataagagggatgggccttgtctgagccttcaggatccc

SEQ ID NO: 51826 - DNA, 601 bp, Human
cccactccaggagcagtcacaaggatggttcttgcagcagcatccaggggccaccgccctgtatatgcccgggcagacacagcagtggcttcctccgggaccagttccatggtgtgatttggtcattgtttttaacaaggtaccttcccagtttgggtttccaaccatcccaaggatttggtagctatccaatatcctttttaaaattattttcatttttgtttaaattagccatagtttctctcattttgagctaagctgcctgcctgcaacagctactcctggaggtcagggcaagctkgcttcagctgcctcgaggcaggtcaaggacacagctcaattggacaccctggaacaggcctggaattctgggctccaagaacagccagactgtaagcagatgtgatgtaactgctgtgggtaatatctctctgacattcctaaatcttaaaagtcttgttacaatgtacagctggtgtcagctgcagtttggaaggtgttgtatctattcctgagaatctagtgttaccggggagagtggtgtccgtctccctcagctctaggacagcaggacagtagcactcccccttctgaggcagaa

SEQ ID NO: 51827 - DNA, 601 bp, Human
aggtcctccgacagagggtgagggactggaaccctgagtggggtgggcatggaaggtaaaccttgcccttgatcaagatggaagtgaaagcatcagcggggagcttccatgggaggtggggtggcaggcaggagcagacatatcttggatgttatataaagaaacagggaccctgtggaagccattccagggatggtggtaccaatgttggtatgccccactccaggagcagtcacaaggatggttcttgcagcagcatccaggggccaccgccctgtatatgcccgggcagacacagcartggcttcctccgggaccagttccatggtgtgatttggtcattgtttttaacaaggtaccttcccagtttgggtttccaaccatcccaaggatttggtagctatccaatatcctttttaaaattattttcatttttgtttaaattagccatagtttctctcattttgagctaagctgcctgcctgcaacagctactcctggaggtcagggcaagctggcttcagctgcctcgaggcaggtcaaggacacagctcaattggacaccctggaacaggcctggaattctgggctccaagaacag

SEQ ID NO: 51828 - DNA, 601 bp, Human
gagggacgagatcttcctagagtcttccggttgcggggggtgggtggtgggaagcaaaacgtccagtctggaggccaagaggaagagactagatgcagagctttctgctggtgattcaccacctgtgcacagcccagctctcaagagtcctggatcctcctaggtcctccgacagagggtgagggactggaaccctgagtggggtgggcatggaaggtaaaccttgcccttgatcaagatggaagtgaaagcatcagcggggagcttccatgggaggtggggtggcaggcaggagcagacrtatcttggatgttatataaagaaacagggaccctgtggaagccattccagggatggtggtaccaatgttggtatgccccactccaggagcagtcacaaggatggttcttgcagcagcatccaggggccaccgccctgtatatgcccgggcagacacagcagtggcttcctccgggaccagttccatggtgtgatttggtcattgtttttaacaaggtaccttcccagtttgggtttccaaccatcccaaggatttggtagctatccaatatcctttttaaaattattttcatttttgttt

SEQ ID NO: 51829 - DNA, 601 bp, Human
ctccgtcctcctctttcgtctcactggcacccgccactccccagaccattctgaaaagaggtgtggagattctcagaggcagacttacagaaccactttctcctcttccagacagtaggcaagaccgggttaggaacacagacagagagaaggcggaatggccactcagcctggagcaaaagtacagtgggagggacgagatcttcctagagtcttccggttgcggggggtgggtggtgggaagcaaaacgtccagtctggaggccaagaggaagagactagatgcagagctttctgctgktgattcaccacctgtgcacagcccagctctcaagagtcctggatcctcctaggtcctccgacagagggtgagggactggaaccctgagtggggtgggcatggaaggtaaaccttgcccttgatcaagatggaagtgaaagcatcagcggggagcttccatgggaggtggggtggcaggcaggagcagacatatcttggatgttatataaagaaacagggaccctgtggaagccattccagggatggtggtaccaatgttggtatgccccactccaggagcagtcacaaggatggttcttg

SEQ ID NO: 51830 - DNA, 601 bp, Human
tctgtcctccgtcctcctctttcgtctcactggcacccgccactccccagaccattctgaaaagaggtgtggagattctcagaggcagacttacagaaccactttctcctcttccagacagtaggcaagaccgggttaggaacacagacagagagaaggcggaatggccactcagcctggagcaaaagtacagtgggagggacgagatcttcctagagtcttccggttgcggggggtgggtggtgggaagcaaaacgtccagtctggaggccaagaggaagagactagatgcagagctttytgctggtgattcaccacctgtgcacagcccagctctcaagagtcctggatcctcctaggtcctccgacagagggtgagggactggaaccctgagtggggtgggcatggaaggtaaaccttgcccttgatcaagatggaagtgaaagcatcagcggggagcttccatgggaggtggggtggcaggcaggagcagacatatcttggatgttatataaagaaacagggaccctgtggaagccattccagggatggtggtaccaatgttggtatgccccactccaggagcagtcacaaggatgg

SEQ ID NO: 51831 - DNA, 601 bp, Human
ctttctttcttcctttcttcctttttttctctttctttccatatttatctctctttctttctttccttcctttcttctttccttccttccttccttctttttttagacaaatacttttaatgtaagcatctagggatgcttgtccacataaaactataaataataataaaataagcattaagaaatcttacagagaaaggtgtgtgaactagaagagaaaaaggcaacaagaagcaaacaaaattagaaaatctttcagaaggataatttaagagcataattgagaaaaaaattggggtayagaaagaagagatagaacaatagtttgagggatctagaatttttctggaggcatacaagaaggcttcccagctacgtgtgtacctaattgtttcagagataaaaagaaaatggagagaagggagaaagggatatgcatgaactttctagttagactaggaacgagaagttagataagaaggaaatacagctttatagaaagtcatgcagaaataaaccctacactgggaaggcctgcactaagggaactggacaggaacacctacaaatgagaaaattcctttagcatatttttcaagct

SEQ ID NO: 51832 - DNA, 601 bp, Human
tgtattaggaaactcatctttccacagatataaaccatattcttcagtataaagggaatatagtaatgttaggctttaatttatcatctcctttgtcttattttattttattttattttattttattttattttattttattttattttattttattttatttttttgaggcagagtctcactttgtcgcccaggctggagtgcagtggcgcaaactcagctcactgcaacttccgcctcccaggttcaagcgattctcctgcctcagcctcccgagtagctgagattacaggagcgcacygccacgcccagctaatgattgtatttttagtagagatggggtttcgccatgttggccatgctggtcttgaactcctgacctcaagtgatccacccgcctcggtctgccaaagtgctgggattacaggcgtgagccaccgtgcccggcccatgatttttttattctagcagaaagctcagtgattattccattatgaagggggaaagaggtgaaatcctctggtgttcagcaagctctcctcaagggaaggtgagttcccttctttagcttgtgaatgttcacccggaaggaagacatgtt

SEQ ID NO: 51833 - DNA, 601 bp, Human
tccttgtatagggagctccacctgctgcaatacacatggccactcaactcttattctgacccaggaactgttaacccagccccttcctctccccttccttttgggagttaccccttgtgatctcctatctaattctgaggttgtattaggaaactcatctttccacagatataaaccatattcttcagtataaagggaatatagtaatgttaggctttaatttatcatctcctttgtcttattttattttattttattttattttattttattttattttattttattttattttattttttttttttgaggcagagtctcactttgtcgcccaggctggagtgcagtggcgcaaactcagctcactgcaacttccgcctcccaggttcaagcgattctcctgcctcagcctcccgagtagctgagattacaggagcgcaccgccacgcccagctaatgattgtatttttagtagagatggggtttcgccatgttggccatgctggtcttgaactcctgacctcaagtgatccacccgcctcggtctgccaaagtgctgggattacaggcgtgagccaccgtgcccggcccatgatttttt

SEQ ID NO: 51834 - DNA, 601 bp, Human
agagatgctgtaagcacacatcagtgagaatagtgaagtggaaccttcaagaagcctactgaaaaagtcccactcaaaagccgaatacacaaatggatcatatatacacacacagaaaaaagtttatatccagcttctgactctgagtcatgttgcaagacacctatgacagactggccagttcagtactttgctggtttcactatgcaaagttcttgaaaaagatgttggtatatatgggtaaattgtttttatcactagactaccaatataggtgcatctgggatggaaaaaaataaaattcacaaataataaaaactcaggccaggcatgctggctcacacctgtaatcccagctcttcaggaggctgaggtcaggagttcaagacctgcctggccaacatggggaaaccccaactctactaaaaaatacaaaaattagctgggcatggtggcagatgtctgtaatcccagctacttaggagactgaggcagggagaatcacttgaacccgggaggcagaggttgcagcgagccaagattgcaccactgcactccagcctgggcaacagagagagactccgactaaaaaaaaaaaaaa

SEQ ID NO: 51835 - DNA, 601 bp, Human
atgagtagagcttttaaacactctctgcctaaaatctccatggcagagatgctgtaagcacacatcagtgagaatagtgaagtggaaccttcaagaagcctactgaaaaagtcccactcaaaagccgaatacacaaatggatcatatatacacacacagaaaaaagtttatatccagcttctgactctgagtcatgttgcaagacacctatgacagactggccagttcagtactttgctggtttcactatgcaaagttcttgaaaaagatgttggtatatatgggtaaattgtttttatcmctagactaccaatataggtgcatctgggatggaaaaaaataaaattcacaaataataaaaactcaggccaggcatgctggctcacacctgtaatcccagctcttcaggaggctgaggtcaggagttcaagacctgcctggccaacatggggaaaccccaactctactaaaaaatacaaaaattagctgggcatggtggcagatgtctgtaatcccagctacttaggagactgaggcagggagaatcacttgaacccgggaggcagaggttgcagcgagccaagattgcaccactgcactc

SEQ ID NO: 51836 - DNA, 601 bp, Human
ttaatattcaatgcttgttaacaggccattttaatgtaaatgctcaaatttttccttagacgtagacagtcccagatttaatgcttctctttgccattgaggaatgttccctcatatgtggcttaagataatctctgtttagcttcaggaggtcgctgctggttgtcctttcctggatatattgtatacctcattgtcaatgacaaaaaatgtcctcattctcctttggttcctcttgccaactctggtttgagctctcagacagtcgcagctcacaatcttggaagcttttttatttgcmttccaattaattccatcctacttccaaaaccccaggctcagccacctccccgtcccatttttcatcatccttccgaaactgccaagaattgcagataacgtttgcgatgtcaggaaccagctgcagagggattctgagaggcacaaacctcactctccctgcctccctgccacatccccctgccacttacagaatggagctgtgtttccacggtggggttgctaggcaaaattgcatggcttacttaccagtaagcagagccgctagcagaaagctctgtgagagcccagatctaactga

SEQ ID NO: 51837 - DNA, 601 bp, Human
ctgctgctgaaaaaccatagtagtgtttaagagcacagagtctagggaaagactgcctgagacacatcccaaccccactgctaaatagctgagtgaccttaggcaagtttctcaacctctctgtgcattagtttttttcctctataaaatggagataagaaatcccacctcatcggattgtttggaagattaaacaagtgtgcaaacacttagcacagtgcctggttaatattcaatgcttgttaacaggccattttaatgtaaatgctcaaatttttccttagacgtagacagtcccagrtttaatgcttctctttgccattgaggaatgttccctcatatgtggcttaagataatctctgtttagcttcaggaggtcgctgctggttgtcctttcctggatatattgtatacctcattgtcaatgacaaaaaatgtcctcattctcctttggttcctcttgccaactctggtttgagctctcagacagtcgcagctcacaatcttggaagcttttttatttgccttccaattaattccatcctacttccaaaaccccaggctcagccacctccccgtcccatttttcatcatccttccg

SEQ ID NO: 51838 - DNA, 601 bp, Human
cagcaaggtaaacatttcaccactactcattgccccggctaacaagtgtgttcctgggctgcttctcctagacatccaagggtcacactcagagaatgtttggagcatttaattatcagggtattttagggacttaagaaatgcgcgtcttgcatgtgtatgtgtgtgtaggtgtatgaaaatatgtgtatacccatactttgctataaaaagaagtgctgtgggcgtaaggttttagcaatatctgttattctagatacccatgtttttgctgccctctaggtatttaaaaaaaaaaaaagttgccttaattgaacattttaaactgcagctttcacaatggaatcacaaaccatctcatgtgccgtgtggtgatcttcagttttcttatccccattagccctgtaactgttcactgctgctgaaaaaccatagtagtgtttaagagcacagagtctagggaaagactgcctgagacacatcccaaccccactgctaaatagctgagtgaccttaggcaagtttctcaacctctctgtgcattagtttttttcctctataaaatggagataagaaatcccacctcatcggattgtttgga

SEQ ID NO: 51839 - DNA, 601 bp, Human
tttgcagaaatgtatgaaaagttcaaagcccaaaaggagatttcgccatagatcattaagtcaatctaattgctggcaatgggagtaccattcctcctcaaatattcctcctcaaatgcatagtgaagttaaagtgaattaaatgtttgtgagatgcttgttaagtcataaattaagatgtgaatgtaattgcaatctaaatgaggttgaggttggcaaaagaggactgcaagtacgtaggaagctggagacgttcctggacttcaggagatgggcaggagggaagatggggaaggacagsggtggatttgtttgacggcagacaaggaggtgtataacaaaggctagatcgtggcatcttaattgcatcatctactggagactttatcagcaaggtaaacatttcaccactactcattgccccggctaacaagtgtgttcctgggctgcttctcctagacatccaagggtcacactcagagaatgtttggagcatttaattatcagggtattttagggacttaagaaatgcgcgtcttgcatgtgtatgtgtgtgtaggtgtatgaaaatatgtgtatacccatactttgctataaaaag

SEQ ID NO: 51840 - DNA, 601 bp, Human
tcatttgcttctcccgcaacatcttttatcgattgcgaaaagcacagccaacagattatttttcccgccagagccccagtgcctggcctgcccagggtgcttacctgccacaaaatcaccaaagcccaccgtggtcagagtgaccaccacaaagtaaatggactccaaggccgtccagccctcgatgtacttaaagatgacagcagggatcgtcacaaacacaatgcagccggccaagatgaacaggatggttgagatgacccggatcttggtctgactcacttgctttttctaggaagascaaaggagaaagataggcaagtcagcggcatcaccctggattcaggatatagatgcacagaaaacggtactgtgtcagtgacttttaacctttctctggtcattggctgcttggaggaaatttgatgaacgctgtgaactctttcctagaaaagtgcattcagaatttttcaagtggtctaggaggttctcaggctccctgaagcctgttcgtggacaccaggtcaaacaaacaaaaaaatcctgcttagccaatgctttgaatgtttcttgcatggttccatgactgcagcccaaatgc

SEQ ID NO: 51841 - DNA, 601 bp, Human; identical to SEQ ID NO: 40231

SEQ ID NO: 51842 - DNA, 601 bp, Human; identical to SEQ ID NO: 40232

SEQ ID NO: 51843 - DNA, 601 bp, Human; identical to SEQ ID NO: 40233

SEQ ID NO: 51844 - DNA, 601 bp, Human; identical to SEQ ID NO: 40234

SEQ ID NO: 51845 - DNA, 601 bp, Human; identical to SEQ ID NO: 40235

SEQ ID NO: 51846 - DNA, 601 bp, Human
tgatcagtaagagagctttgacctgctccatttccaacctgggctgctttgcaacctggtggtcccccactcctgggaggtcaccacatggatgccaaacttaatgaggacacctgatcagcacagaactcctgggatcaagtgatcctcctgcctcagcctcctgagtagctgagaccacagacacgtgctaccatgcccggcttattttttctattatggttattattacttctgtacgattatggttccttttttttttttttttttttcttgagatggagtcttgctctgtcgcccrggctggagtgcagtggcgcgatctcggctcactgcaagctccatctcccaggttcacaccattctcctgcctcagcctcccgagtagctgggactacaggcgcctgccaccatgcccggctaattttttgtatttctagtagagacagggtttcaccatgttagccaggatggtttcgatctcctgacctcgtgggcctcccaaagtgctgggattacgggtgtgagccactgcgcccagcctgatgatggtttctgttatctgctattgtgactcccccaagtgtctgcttgaccccct

SEQ ID NO: 51847 - DNA, 601 bp, Human
gcgctgggattacgggcatgagccagcctgtttttgagatgggctcttgctatgttgcccaggctggctcaaactcctgggcttaagcaatcctctggccttagcttcctgagtagctgggattacaggtgtaccccaccatgcctgactccccttttttctagatgagtcaagtcaggtccagggagcctgactgatcatttattttttataataaaaatagctatcattaccgctagtctatttttttctattattatgattactctttattattattattattattttttttttttttgagacgaagtttcactcttgtcccccaggctggagtacaatggcacgatctcagctcactgtaacctctgcctcctgggctcaagggattctcctgcctcagcctcccaagtagctatgattacaggtgcctgccaccatgctcagctaatttttgtatttttagtagagacagggtttcaccatgttggccaggctggtctcaaactcctgacctcaggtgatccacccgccttggcctcccaaagtgttgggattacaggcgtgagccaccgcgcctggcatactctttatttttaat

SEQ ID NO: 51848 - DNA, 601 bp, Human
ggcctcccaaagcgctgggattacgggcatgagccagcctgtttttgagatgggctcttgctatgttgcccaggctggctcaaactcctgggcttaagcaatcctctggccttagcttcctgagtagctgggattacaggtgtaccccaccatgcctgactccccttttttctagatgagtcaagtcaggtccagggagcctgactgatcatttattttttataataaaaatagctatcattaccgctagtctatttttttctattattatgattactctttattattattattattattwtttttttttttgagacgaagtttcactcttgtcccccaggctggagtacaatggcacgatctcagctcactgtaacctctgcctcctgggctcaagggattctcctgcctcagcctcccaagtagctatgattacaggtgcctgccaccatgctcagctaatttttgtatttttagtagagacagggtttcaccatgttggccaggctggtctcaaactcctgacctcaggtgatccacccgccttggcctcccaaagtgttgggattacaggcgtgagccaccgcgcctggcatactct

SEQ ID NO: 51849 - DNA, 601 bp, Human
taaaataaagaggcaaacactgggataaaaccattgaacaatataagtgataagaatctaatgtgcacctccaccaaaaaaaaagaaacgcagaacagaggccgggcacagtggctcacacctgtaatcccagaactttgcgaggctgaggccgagtcaggaggatcacttgagcccaggagttgaagaccagcctgggcaacatagcaagtctttataaaaatgtctttataaaaattagctgggtgtgatggctgatgcctgttgtctcagctactcaggaggctgaggcaggagaatygcttgaacccgggaggtcaaggctgcagtgagccatgattgtaccactgcactccagctcgggtgacagagcgagaccctgtctcaaaaaaacaaacaaaaagcacaggcacacaggcacacaaggaaaatctgtttgaatgtaacacaaatgagtttgacatcactagttaaaagcaaagatcctaggttcaaatcccaccagctatgtgaccctggacaagatatttgatgtctctgaccctcagtttcttcaaccataaaaggggattgataataatagcacctactgcacaggtta

SEQ ID NO: 51850 - DNA, 601 bp, Human
aaaaataaaataaataaaaccctatggtaaataaaaactaaatataaaataaagaggcaaacactgggataaaaccattgaacaatataagtgataagaatctaatgtgcacctccaccaaaaaaaaagaaacgcagaacagaggccgggcacagtggctcacacctgtaatcccagaactttgcgaggctgaggccgagtcaggaggatcacttgagcccaggagttgaagaccagcctgggcaacatagcaagtctttataaaaatgtctttataaaaattagctgggtgtgatggctratgcctgttgtctcagctactcaggaggctgaggcaggagaattgcttgaacccgggaggtcaaggctgcagtgagccatgattgtaccactgcactccagctcgggtgacagagcgagaccctgtctcaaaaaaacaaacaaaaagcacaggcacacaggcacacaaggaaaatctgtttgaatgtaacacaaatgagtttgacatcactagttaaaagcaaagatcctaggttcaaatcccaccagctatgtgaccctggacaagatatttgatgtctctgaccctcagtttcttcaa

SEQ ID NO: 51851 - DNA, 601 bp, Human
acaaaaaattagccgggcgtggtggtgggcacctgtagtcccagctacttgggaggctgaggtaggagaatggtgtgaacctgggaggcggagcttgcagtgagccgagatggtgccactgcactccagcctgggcaatagagcaagactccgtctcaaaaaaaaataaaaaataaaataaataaaaccctatggtaaataaaaactaaatataaaataaagaggcaaacactgggataaaaccattgaacaatataagtgataagaatctaatgtgcacctccaccaaaaaaaaagaaaygcagaacagaggccgggcacagtggctcacacctgtaatcccagaactttgcgaggctgaggccgagtcaggaggatcacttgagcccaggagttgaagaccagcctgggcaacatagcaagtctttataaaaatgtctttataaaaattagctgggtgtgatggctgatgcctgttgtctcagctactcaggaggctgaggcaggagaattgcttgaacccgggaggtcaaggctgcagtgagccatgattgtaccactgcactccagctcgggtgacagagcgagaccctgtctcaaa

SEQ ID NO: 51852 - DNA, 601 bp, Human
cttaaataaagcttctcctgctgtatctgttcctatgataaggtgagctgattaaaaaaaaaattaccatttgtaaccattcatctgtgagaatcatatttcttgattctctgtaactcaaaatgccaagtacaccagaagcatagagtgttgtacaactgcaattattatctgtctcggagtttaaatacttgtgtatctgtctcagagtttaaatacttgtgtttattctgattgttttcttttttaaaaaaatctttttgtagagatggcatctcgctatgttgcccaggctggtctwaaactcctggcctcaaatgatcttcccacctcagctacccaaaccttgagataataggcacgacccaccatgcctgaccaacctcctcattctacagactgggagaccaagctggaaagatgcatgtgttgtatatgtcatctccagattgtttttttgagatggagtctcactctgttgcccacgctggagtgcaacggcatgacctcgactcaccacaaattccacctcccaggttcaagcaattcttgtgcctcagcctccccagtagctgggattacaggtgaatgccaccacacc

SEQ ID NO: 51853 - DNA, 601 bp, Human
ccagcctcagtctcccaaatagctaggactacaggcatgtgccaccaccaccatgtcgggctttgattcctttttttttttttttttgagaaggcctcctgattctcctgcctcagcctcctgagcagctgggattacaggcacacaccaccatgcccggctaatttttgtatttttagtagagacggggtttcatcatgttggtcaggctggtcttgaactcctgacctcgtgatccaccaaccttggcctcccaaagtgctgggattataggcgtgagccactgtgcccagcctgattycatttttaaaaaaaatatttttcatccttacaaaaaactttggctgggcatggtgactcatgcctgtaatctcagcactttggaaggctgaggcaggtggatcacctgaggtcaggagttagacaccatcctggccaacatagcaaaaccctgcctctattaaaaatacaaaaattaggcgtggtggtgggcgcctgtagtcccagctactcgggaggctgaggcaggaaaatcgcttgaactggagaggtggaggttgcagtgagtcgacatcgcgccattgcactccagcctgggcga

SEQ ID NO: 51854 - DNA, 601 bp, Human
tttttattttattattatttttttgagacgagtcttggtctgtcgtccaggctggagtgcagtggtgtgatctcggctcaccgcaacctccaccctcctgggttcaagcaattctcctgcttcagcctcctgagaacctgggattacaggttcccgccaccatgcccagctaatttttgtatttttagtagagacggggtttcgccatgttagccagactggtatccaactccagacctcaagtgatctgcccgcctcagcctcccaaagtgctgggattataggcatgagccgctgcgcycaaccagaaaacttttaaatatgtttggaacaacttgggcatgtcaatctatttccccaactgttatacacaccagattttgaagacatagtatgaaaaacaagcagaatgtttcattgagttttgtttcttttttaagagacagggtcttgctctgtcaccccagctggagtgcagtggcacaatcatagctcacttcagacttgaactcctggtctcaagccgtcttcccatcttggcctcccaaagtgcggggattataggcatgagccacctcccctggccttaataatttttatg

SEQ ID NO: 51855 - DNA, 601 bp, Human
aggtgttcctcctgcctcagcctcccaaagtgctgggattacaggcatgagacaccacacctggccccataccctcattgttaatggctgcagtctaaggtcatggacaggctttggagccagcaagacctgggttcaaggtcttgctctgctgcctacctctcagccttggttcccagctctgttcatgtactgtcctttccctgttcaaaacccttccttggctcactgttgcttgcaggatagagccccaaatccttgaagcctgaagcctctgtcacctttgaaaccagccacgccycaacccctgacctgaatctcaatgtgacagccaccctttcctgaggtactctgccctttctacagatcttatagctctttctcttttccaagatctatactttcctatggatcttttttaaaatttttattttattattatttttttgagacgagtcttggtctgtcgtccaggctggagtgcagtggtgtgatctcggctcaccgcaacctccaccctcctgggttcaagcaattctcctgcttcagcctcctgagaacctgggattacaggttcccgccaccatgcccagctaatttt

SEQ ID NO: 51856 - DNA, 601 bp, Human
tatgcaacgtgttaggagcagtgtctagcacagaatgaccctcgatgatctcaggtcaaggacctaatttctccaggccttgattttgtcatctgtattggggggttgttgatagcagcctcctctcaggctttcctggggattaggtaggagtgggtgctgactgcggtagctggcagacagtatggtgtatgcctacctttccttcattgttttattttttttgagacggagtctcgctctgtcgcccaggctggagtgcagtagcgtgatcttggctcactgcaacctctgcctcccrggttcaagcaattctcctgcctcagcctcccgaatagctgggatcacagggacccgccaccatgcctggctaatttttgtatttttagtagagacgacatttcaccacatcagccaggctggtcccaaactcctgacctcaggtgttcctcctgcctcagcctcccaaagtgctgggattacaggcatgagacaccacacctggccccataccctcattgttaatggctgcagtctaaggtcatggacaggctttggagccagcaagacctgggttcaaggtcttgctctgctgcctacc

SEQ ID NO: 51857 - DNA, 601 bp, Human
agtccagtccctttcctggtcccaccctagacaagccaagtctcactcagcccccctaaggttccaagtgtcctcagcgcttctggggcacttggtttccagcccaagtaacctagtctaggcctgagtcccagcccatcttttacaggacggctcctcctgtagccacatccctccagtaggcccgccccagcactgggctccacccccaaggtgccaggctgtttccgggtccacccccctctcatggctccgcccacttctccagccccaccccacaacccacccgcccatggggtargcgggccccaggcacctccagctgagatgtggctccaggggctggccgggtacatgaaggcggcgttctggatctggtcattgatgtcctcatcctcgttgaaagggaaggtgccgctgaggctgacgtacatgatcacgcccactgaccacatgtccagcgagcggttgtagccctggttgagcagcacctcgggtgccaggtaggccggcgtgcccaccactgagcggcggaacgacttctcgccgatgatgcgagcaaagccaaagtcacacagcttcacctgcagagggcaaggga

SEQ ID NO: 51858 - DNA, 601 bp, Human
aagcaaaccagcagtgtgatgaagtagagaataagggttggaggctactttagatagggtagtgggggaaggccttactgagcaggaggcgtttaagctgaaactcacagagggagaactggagaggagtgttccagggaggtaaagcagcctgtgcaaaggccctgggatggggaatgaaagggtactggcatggctggggctttggctacttagggggagaccaataacaagatgagattaggacagaggccagatcatgcagggtctccgtgagtcattacaaagaccagtttggaattttttttttttttttttttttgagacgggagttttgctctttttgcccaggctagagtgcaatggcgcaatctcggctcactgcaacctccgcctccctggttcaagcgattctcctgcctcagcctcccgagtagctgggattatagacgcacaccaccatgcccagataatttttgtacttttagtagagatggggtttcgccatgttggccaggctggtgtcgaacctctgaccgcaggtgatccgcccatctcggcctctcaaagtgctgggattacaggcatgagccaccacgcc

SEQ ID NO: 51859 - DNA, 601 bp, Human
agagcgagactccatctcaaaaaaaaaaaaaaaagaaggcccacttgtcacctgctgtgtgaccttgagcaccggcctttcttccctgagcttcagtccccagatttggagacgggggttaatgtagtttccctgggcttgtgagagttcagtgaagggggacctgtgtactaaagccctgcatggctctggtacatcacggcccccagtggggacaagcctctaaggctgtttaagccttggctctcctgcctgtcaaatgggcacgagggagggatcaagcctggctctgcaggtgcaracagggcatttgaccttgagcaagacctccatggcttgtctgtaaaatgagcaccagatggtccttactcccgtggagacatgaggattccacaggtcacgaggtaaagtgcagggtacagctatagctcatctcaaataaaatccgacctctcctccttggccagatgtcacatcctgtcactccacacttagaacatcagtgtccagacctcactgtggctgcccggggcccagggatctgtcccaccagcctccctgcctcatctctcctccccctgcccactccacccagctgcct

SEQ ID NO: 51860 - DNA, 601 bp, Human
tagctcatctcaaataaaatccgacctctcctccttggccagatgtcacatcctgtcactccacacttagaacatcagtgtccagacctcactgtggctgcccggggcccagggatctgtcccaccagcctccctgcctcatctctcctccccctgcccactccacccagctgcctcagctctcactggccctcagacaaggctcaaccacctctgggcctctgcacctgctcttcttgctatcggagtgctcttccctcagtctgctgctagtgcccagcttggggctggaggggtgggygggcgggtgtgtggagtcctggagactgtggccgagaggacaagccctgagctaggttggttgggacaggcaggaggggcaggctgaagagatgtctctgggctcagggtagccctcagcttccccatctgtgaacagggagactgggcgtcacccagcccagggcctgtcctcgcagggttggagcactgcctcatgcctcttcttctgtctccgcagccaaggactacgagaacgccatcaagttctacagccaggccatcgagctgaaccccagcaatgccatctactatggcaacc

SEQ ID NO: 51861 - DNA, 601 bp, Human
aaaacccaccactgaataggttagcagaataattgcaggtgaggatctgcactttgaagaaaagaggaagggcagtcgggcacagtggctcacggcagtaatcccagcactttgggaggccagggtgagaggattgcttgagcccaggagtttaagacaagcctgggccacatagggaggagacctcatctctacaaaaaatacaaaaattagccaagcgtggtggcacgcacctttagtcccagctactcaggaggctgaggcaagaggattacttgagctcaggagctcaaggccgcartgagctatgctctcaccactccactccagcctgggcgacacagtgagaccctgtctcaaaaaaaaaaacaagaagggtgatatgctgccagggacagcagacaggatatgtgtgatatgctgatgagggaggggacctagggcacagtgagaattcgctagtgccctcacccacctaatgaaaatcctgacggtatgaggctctgcagagcgagcacacaccttcacaccaggtgtgctctgcatcttccttcagggaggctggctgaatcattacagcaccctgggacgtgggaactgg

SEQ ID NO: 51862 - DNA, 601 bp, Human
tggggacttactgtagccaagatagaattcaagattcagtacaaactgtaggcaagtaataaaaacccaaaaacagtggtcagggctagaatctaaacacagatgtgcaactgaagcatcatttttcctttccagtcccccagttttaccaaagacactaataatagcaagaccaatttattctcaaaataagttttagtgttatactttatttgcataaagtacagcaagattagtgactgaccatatagactccttttaagttggctttcccggaaaatgaggaatttcggattagactttttttttttttttttttttgaggcggagttttcctcttgttgcccaggcaggagtgcaatggcgcaaactcggctcactgcaacttctgcctcctgggttcaagtgattctcctgcttcagcctcctgagtagctgggattacaggcacctgccacacacctggctaatttttgtatttttactagagacggggtttcaccacgttggccaggctggtcttgaactcctgacctcaggtgatccacctgcctcggcctcacagagtgctgggattacaggcctgagccactgcacccgg

SEQ ID NO: 51863 - DNA, 601 bp, Human
agtagttactgtcttagcatcatctcttatttggaaatgatctagatattcaatgaatatttgtcattaatttagcttagtaaaaccctaagggcataattaccaaaagatttgagaaacctttttaagtaggcatattataaaacataattattattaaaagttcatttataaagttgattctatttatatgtatttaatttattcatttttagtgattgttgggaaaatttcgtgagacagacaaatccaaccatcatctcaagttaaattttctattaaccattttttattattgtaygttaggcaagtatcatagaagtaagaaccttaaagttagatacatacatattttgctggtaactcagaaaacatagtttttatttatttatttttattttttatttttattttttttgagatggggtctcactctgtcgcccaggctggagtgcagtggcgcgatctcggctcactgcaagctccgccgcccaggttcatgccattcccctgcctcagcctcccgagtacctgggactacaggcgcccgccaccacacccggctaattttttgtatttttagtagagatggggtttcacc

SEQ ID NO: 51864 - DNA, 601 bp, Human
atctagatattcaatgaatatttgtcattaatttagcttagtaaaaccctaagggcataattaccaaaagatttgagaaacctttttaagtaggcatattataaaacataattattattaaaagttcatttataaagttgattctatttatatgtatttaatttattcatttttagtgattgttgggaaaatttcgtgagacagacaaatccaaccatcatctcaagttaaattttctattaaccattttttattattgtacgttaggcaagtatcatagaagtaagaaccttaaagttasatacatacatattttgctggtaactcagaaaacatagtttttatttatttatttttattttttatttttattttttttgagatggggtctcactctgtcgcccaggctggagtgcagtggcgcgatctcggctcactgcaagctccgccgcccaggttcatgccattcccctgcctcagcctcccgagtacctgggactacaggcgcccgccaccacacccggctaattttttgtatttttagtagagatggggtttcaccgtgttagccaggatggtctcgatctcctgacctcgtgat

SEQ ID NO: 51865 - DNA, 601 bp, Human
catccattgtggaactagagggtgtgagttacggtgtctgtggttggtggcagtctagagtccacgtagcacgtggcttcaggcgatgagtacttctcttaagtgagaagtgggatatgactgctgtcctattccagtgcctctctgggcctgatcatttaaaggggctcaccatataacttttctttctcatacccacccttttcgaagggacattggaattggccactgtgctggatctaggtcgtaggcagcaaagtaatctagcacatgcctcctcttagatcacttccattcagayagggtgtggttacataggtgcgggactagtgggctatttttatcagcaggctatataactgcattcactgttagccccagtttcaccagatggtgtgaaagcacaacccactcccatccggcccttgggaattctgacagaaggtttaaaaacatagttacggtttcttaggaattatccctgcttccagcacttggtgctggtagatagagccttggtgctaggaccattacatcaggtaggagaaagaaagagagaaataaaatttataatcactgtaccagcgtatttctcccttgg

SEQ ID NO: 51866 - DNA, 601 bp, Human
cactggagggtccagagaacacacctttcaccaatactttgagaagcagatttatgagggggccccggcatccctggttgctcctctctgcaagctggaccttacggtgggaaccgcagtcactcagttggaaaacttacatgcagtgggaacaattagatcctggagaggcagggaccaagtgtcagcactcagctgctgaaggcaagatgtctgtcatggacacagaagcaaatccacaattagaataatctgactgttgcgccccagtcagaataagggcttatgggggcctggtgakgaatggagttttagctcaggtccgactctcagtgggttgagtgggtccctggacccctcctgtggtcatttcccccgttccagctgcacaattggaataaatgtactcagcagctggcggaaaatccccacgtttgttccctaagctgtggagtaagggccattatggtgggaaaggctaaatggaagccatagagctgcctctacctaggaaaattgtaaatcaaaacagcagcacatccctggagagattgtagagattagtgccaccatcagagacttgaaagctgcaggggtggag

SEQ ID NO: 51867 - DNA, 601 bp, Human
tcactcagttggaaaacttacatgcagtgggaacaattagatcctggagaggcagggaccaagtgtcagcactcagctgctgaaggcaagatgtctgtcatggacacagaagcaaatccacaattagaataatctgactgttgcgccccagtcagaataagggcttatgggggcctggtgaggaatggagttttagctcaggtccgactctcagtgggttgagtgggtccctggacccctcctgtggtcatttcccccgttccagctgcacaattggaataaatgtactcagcagctggcrgaaaatccccacgtttgttccctaagctgtggagtaagggccattatggtgggaaaggctaaatggaagccatagagctgcctctacctaggaaaattgtaaatcaaaacagcagcacatccctggagagattgtagagattagtgccaccatcagagacttgaaagctgcaggggtggagagccttaccacacccccacttcactctcctgtttggcctatgcagaagacggctgcatcctggagaatggcaggggattatcgtaagcttcaccaggtggtgaccccagttgcagctgc

SEQ ID NO: 51868 - DNA, 601 bp, Human
atggatgaactgtataacagggatgaactgtatagtggcagagtctgagatcttagtgtacccgtcacccgagtactgtacagtgcacccagtacatagattttacccctcacccctcccactctcccccttctaggtctccagtttccattataccactctgtatgccttgcatacccatagcttagcttccacttacaagtgagaacatagagtgttttattttccattagtgagttatttcacttagaataatggcctccaactccatccaagtctacaaaagacattattttgctcytgtttacgggtaaagtagtattccttcatggggatcttgatcacccttcccttctgcaagctatcacactggtccacgacactgatggcattttactaattggacctagtgagcatgaagcagctactctgtacttattggtaagacagtgtggagtgaggcaattctcctaataaacaccctctcatatatatccacatgcataggtatagtcatgcattgcttaacaaggggtagtttttgagaagtgtgttgttaggtgatttcattgtgtgagcatcatagagtgtgcttacacaa

SEQ ID NO: 51869 - DNA, 601 bp, Human
cttagcttactgtaacttactttataaactttttaattttttaaaactttctcactttgttgtaataacacttagcttaaaacacacatatacacctgtacaaaaatattttctttatatccttattctgtaagcttttttctgttgaaaaaatatttcttttgctttttaaacttttttgttaaaaacgaagacacaaacgcagacattagcctaggcctacgcagggtcaggagatcagtatcactgtctcccacctccacaccgtgtcccactggaaggtcctctggggctgtcacaygcatggagctgtcatctagggtgacagtgccttctggatacccctgaaggacctgcgtgaggcccttgagaaggtgtggttcttttcagaaaaatgtccatggtggttcgcttggcttcttttttcgtcatggatttgtgtgagtaatggcgttgtgctgagacattcccatggctgtgctgtcaccaggcaataggactatttcagtgtgtttatcttctgggaccacacttgtatatgtgggccactgctgactgaacatcattatacagctcatgactgtgtgtatgtctctctctt

SEQ ID NO: 51870 - DNA, 601 bp, Human
agaaccctgactctcatgatggatctgtccctcacggggtccttttccggaagacaccacctatgttctttcctgtctatgcttggaacttgggtgcaaacctaggccggatctgggggactccctctgtgctccctggcccttcctgggatctcctgatttttgttctgtggctttgggttccttacatcagagtccagcacagtcagttagaaatgcgtgttgccttgcaagcggatactagtgcctgtacacctacagcatggatctgtgaaagtaacaggaatagtcacaaccactrtttcatccagcgctcgccagggcccagggtgtgaccttcatgcagtaatataactcatttcatcttcacggctaccctgcgcagtggagactctctttgtccctggtttataggtgaggaaaccaaggcccagagggtagctcactccactgaggttgcacagccaggaggtggcagctttgtcccagagtcaggccataagcagggcaggcgcagcgggtccgagtttctcggcacagcactcacccttagctcaggcagtgcaccttggtggtctctctgacttactatacagagaat

SEQ ID NO: 51871 - DNA, 601 bp, Human
tgattactctccagtggcatgtctggaggttttgctgcagaaatggccgtgtatgtgcttgtgattactaggtactgccctggacctgctgggggtgtcctatgatagagcatgtacacaaaatcatgtgggtttttttgtattgttttgttttggtttttttttgagacagaatctcactgtgttacccaggctggagtgtgatggcacaatcatgactcactgcagccttacctgggctcaagcaatcctcccacctcagccccccaaagtagctgggactacaggcatgcaccaccayacctggctagtttttttgttgttgttgttatttttttctagagatagggactcactatgttgtccaggctggtcttgaactcctgagctcaagtgatcctcccacctcagcctcccacagtggtgggattataggtgtgagccaccacacccggccatctaccaaatcaccttactaaaatccaaaaaattcccaatccccaaatacacgcagcccccagggcttcttcggggattgtgaacctgtgttaccatttcaccagctccagacatcattacccatgagtactcgctgacgaag

SEQ ID NO: 51872 - DNA, 601 bp, Human
cagtggcatgtctggaggttttgctgcagaaatggccgtgtatgtgcttgtgattactaggtactgccctggacctgctgggggtgtcctatgatagagcatgtacacaaaatcatgtgggtttttttgtattgttttgttttggtttttttttgagacagaatctcactgtgttacccaggctggagtgtgatggcacaatcatgactcactgcagccttacctgggctcaagcaatcctcccacctcagccccccaaagtagctgggactacaggcatgcaccaccacacctggctagyttttttgttgttgttgttatttttttctagagatagggactcactatgttgtccaggctggtcttgaactcctgagctcaagtgatcctcccacctcagcctcccacagtggtgggattataggtgtgagccaccacacccggccatctaccaaatcaccttactaaaatccaaaaaattcccaatccccaaatacacgcagcccccagggcttcttcggggattgtgaacctgtgttaccatttcaccagctccagacatcattacccatgagtactcgctgacgaagataatgctttt

SEQ ID NO: 51873 - DNA, 601 bp, Human
agtggcatgtctggaggttttgctgcagaaatggccgtgtatgtgcttgtgattactaggtactgccctggacctgctgggggtgtcctatgatagagcatgtacacaaaatcatgtgggtttttttgtattgttttgttttggtttttttttgagacagaatctcactgtgttacccaggctggagtgtgatggcacaatcatgactcactgcagccttacctgggctcaagcaatcctcccacctcagccccccaaagtagctgggactacaggcatgcaccaccacacctggctagtttttttgttgttgttgttatttttttctagagatagggactcactatgttgtccaggctggtcttgaactcctgagctcaagtgatcctcccacctcagcctcccacagtggtgggattataggtgtgagccaccacacccggccatctaccaaatcaccttactaaaatccaaaaaattcccaatccccaaatacacgcagcccccagggcttcttcggggattgtgaacctgtgttaccatttcaccagctccagacatcattacccatgagtactcgctgacgaagataatgctttta

SEQ ID NO: 51874 - DNA, 601 bp, Human
tgctgctgcctggcattaagttctcacgacaatcctccagggggtgctggcaccacccctactttctagaaactgagggaggcttgagatgtgaggccgcctgtcctggcaggcctggattcagacccaggaggcctagtcccagagcccaggctcataaccactgccccacgctgcctccctggagggcatgcagtgtgccccagggacgagaggcccaggcagggaggggaggtggtggaaggggagcccatcccagcgtgcatagcggaaatcaggagcctgggctttggcgcagttycgcctgggagagaagggaatcctggcttcctgggtgggtgacttcacctccccgggccttggttttcttgtctgtcagatgaggattgtgaaaacactgccatgtagaggtgcatggaggataaatgagcaagtgaattgcttacacaatattaggcacatagtaagtgctctagaagtgagctgtgtattattattgttgccgctgccactgttggtattcccactccctttctcctccctgcgctgtcattgtttgccttcatctgccttcccagcccgcccacccctggagaacagg

SEQ ID NO: 51875 - DNA, 601 bp, Human
tcacctggcaccactgtgcagggttcacaagcattcacccatgcagctctcccagtggccctcttgagggagatatatatggttctcagtcccacctcagagagaaactgagccacagagaggcagactcacctgcctgaggtcacccagctcatgacttgcagagctgggatttgaacccggtctcagggatctgtgaccctcagttcctctcttcagtggacaaaacagggaaatcttttgtcctgggcctccccagagtgtgagggagggaagtaacagcactcggtgctgctgcccrcctgcccctgctgcatgccgggccccctgtgttacttattccttcccacagccctggcaggggagccctgtgtcacctccctgttagagattaggtaacctgggcttggggagtccatgtcgtccagcaagtcattggccctttgtgtgagtctgggctgttctgtgaccgtagacccagccgggcccttcctctcatgctccgccaccttggtagtcacgatagtagcatcaggacctgtgcttgggatgctgctcaccccacagggattctcacagggcacctgaagctgagcccgca

SEQ ID NO: 51876 - DNA, 601 bp, Human
gcaccaaggtgtgggtggagctgcaggctggccatgcaccccaggctccaggctcggacaggcctgggccagcacccacctgctgtgtgacctaagctggtagctcagtctctctgggtcttggcttgtcttcgtctgcctcaggatcacatttgaatggcacctggcactggccacacttgggttccatcctggctttgccacttcccagctgtgtgaccgaagcaggttacttcactgcttggtgtcacagtttccccatttgcaaagagggataataatatgtgcaaccttgttactyagcagttactgagaggacaggttaagaacagggcctggcccacacctgatgctatctaagtatttccccgtgttatggtatctgctcgatgaacggccacttgtagggccactaggcctatgcattgttgagtgggagggcccgtgtcccatctcccccatggctccaggcctctctgaggagagctgaaggaggtggactgactagtccccgcacctccccgccactggctttccgggagacaggaggcagggtcctcagtgccatactactgaggctcagcggccaagctctggctgg

SEQ ID NO: 51877 - DNA, 601 bp, Human
atatgtgcaaccttgttactcagcagttactgagaggacaggttaagaacagggcctggcccacacctgatgctatctaagtatttccccgtgttatggtatctgctcgatgaacggccacttgtagggccactaggcctatgcattgttgagtgggagggcccgtgtcccatctcccccatggctccaggcctctctgaggagagctgaaggaggtggactgactagtccccgcacctccccgccactggctttccgggagacaggaggcagggtcctcagtgccatactactgaggctyagcggccaagctctggctggagccacggtgaggaaaggattagaaacccagatcccttgagccctgccaagtcctcactccctgggaggtgctgacaggaggcttgaggccaggcaggagcagcccatctggcccatcttctgccaccacccccaaccccaccgcaccgcacccttcccctccacgcttgccatgttttcctcagcaggacagatatttaatggtgactttgtggaccgaggctccttctctgtagaagtgatcctcacccttttcggcttcaagctcctgtacccagat

SEQ ID NO: 51878 - DNA, 601 bp, Human
tacacgcctgtaatcccagctgcctgggaggctgaggcaggagaatcgcttgaacccaggaggcacatgttgcaatgagccgagattgcgccactgcactccagcctagtcgatagagtgagactcagtctaaaaaaaaaaaaaaaagccaggcatggtggcaccgtgcacccgtagtcccagcttcttgggtggccaaagtggaaggattgcttgagcccaggagtgtaaggctgcagtgagccatgatcacaccgctgcactccagcgtgggcaacagagcaagaccctgtctctttgaaaaaaaaaaaaaagtaagaaacttgaagtagagcccagagtatttgctggaggaacagacacaggtgtgagacaaagagggaacgaaaggggccctctagggttttggccggagtatctggagggctatggctgccagtgacgaagacgggaacatgtagagcagggtgtggccaggagctgaggagctcccctttggatgtggctgagactcaggagacatgggatgtgggtggggttccaaggggtgttgaaaatgtaggtttcttggtgtccagatgagattagacaagaggagctc

SEQ ID NO: 51879 - DNA, 601 bp, Human
ggggcctgtgggtgggtggcaccttccctcacagcggcatcccccatctccccagatcatgcacggaggcctgttcagtgaagacggtgtcaccctggatgacatccggaaaattgagcggaatcgacaacccccagattcaggtgagcagcgcggggccaggtgtctccagcagaaaggggcagcctgggctgagctctcccctgcaacccagccctgcctcggaggatgggctttgtgcccttggcaagaaacagcgggtctgagcctcagtttcctcacctgcgacttgggccagtgyacctccttcatggggctgtgatggcaagcacggtcgtgaccatggtgcggggtgaaggcacggtgaccgccgagcacacctgtccttatttatttgtgagttcagctgtggaaccctggaaggaggggaggtcttggggctcctgtgctagtgacgggcacacttcagagagttcacccacaggtgcacacgcacgtgcacactgtgagtgctgcagaggacatggattgggtgggctggtgctgggtgctcaggaaggcctctccagggaggcgaggtttgagctgacactgcgggaag

SEQ ID NO: 51880 - DNA, 601 bp, Human
atttgtgagttcagctgtggaaccctggaaggaggggaggtcttggggctcctgtgctagtgacgggcacacttcagagagttcacccacaggtgcacacgcacgtgcacactgtgagtgctgcagaggacatggattgggtgggctggtgctgggtgctcaggaaggcctctccagggaggcgaggtttgagctgacactgcgggaagcagaggcatctgccgtgcacagagcctggcgagcatattccaggcttgaggaggggtcctaaggcagggagaagttggcgagtgggcagggytgtgctttgagggctgacattggacatggggttcactgggcccaaatcctatggcgctttacaggccccagtgaggaactttgttcctagggcagtgcggagccaccaaaggctttgagtgggagaggggcctgatctgaatagtgacattgaaagctctatctggcttcggggccacaggggattgaatggggtctggagggcagatcagcagagagggtgggggtggctcagaatcacagtcacctgtcctgaatgtccatgtccatgctggatgtcccctgcccaacacccacccag

SEQ ID NO: 51881 - DNA, 601 bp, Human
gtgctttgagggctgacattggacatggggttcactgggcccaaatcctatggcgctttacaggccccagtgaggaactttgttcctagggcagtgcggagccaccaaaggctttgagtgggagaggggcctgatctgaatagtgacattgaaagctctatctggcttcggggccacaggggattgaatggggtctggagggcagatcagcagagagggtgggggtggctcagaatcacagtcacctgtcctgaatgtccatgtccatgctggatgtcccctgcccaacacccacccaggmtgggctgtggggtcagcacctggccgggccaggaggtggcctgtgagtgaccacccccggggaggtggacgagtccctaatgtttccctcgctccccaccagggcccatgtgtgacctgctctggtcagatccacagccacaggtgagtctagggtggggtgcagggccggcgggtgtgggctgtggcagcaggtggaggcagacagtcaccctgaacccctgtctctcccttctgcccaccctcagaacgggcgctcgatcagcaagcggggcgtgagctgtcagtttgggcctgacgt

SEQ ID NO: 51882 - DNA, 601 bp, Human
ggcggggcacccattcccccagtatccccatctcaccgatggtatccctgtccacctggtgtttcaccctcaggcctcaagaattattctatttcttttatcccccaacacacttcctaatttagtgttgcagcttctacctcgggaatgtatttccagtgggccctcctctttccatctccagagataccctctgacccagcctccctctccgggctggagagctgcaggagcccccttcctgggccctgctagtcctgggctcctgtaaataaatctgtcacttgtcagcgtggatgawcttgttaaatgtaaatcagatggctacaccctgattaaaagcgtgcattggcttcctcatccctttaacagaaacccattcctccaggatcctgttgatcgggccttgtctgactcttctctctttccttgctctggcatgcagtcttttgtgttccttgatgccacattagtttttgtcttagggcatttgccatttcctagtctgagaagcactttttgctagtcttgtggctccaagtgatttagcgtcttcagagaggccttcctcaaacctgcttaaaagttacctttcccttct

SEQ ID NO: 51883 - DNA, 601 bp, Human
tagtcctgggctcctgtaaataaatctgtcacttgtcagcgtggatgaacttgttaaatgtaaatcagatggctacaccctgattaaaagcgtgcattggcttcctcatccctttaacagaaacccattcctccaggatcctgttgatcgggccttgtctgactcttctctctttccttgctctggcatgcagtcttttgtgttccttgatgccacattagtttttgtcttagggcatttgccatttcctagtctgagaagcactttttgctagtcttgtggctccaagtgatttagcgtsttcagagaggccttcctcaaacctgcttaaaagttacctttcccttctgaacaccagtcctcctgtagcaaagtggttctcaaactgtggttcctggacccctgggggttccctgagatgttttcaggcttctgtaaggtaaatatcatagactaagactgttaggctttttcactctgttaatttttgcactaattgtacaaaagcagttgttggcacaactgctgacatcttagcacgaatctaggtggtggtggcggtgcctaagagtgaggctgtattaccttcatgtatcacagt

SEQ ID NO: 51884 - DNA, 601 bp, Human
ttccctgagatgttttcaggcttctgtaaggtaaatatcatagactaagactgttaggctttttcactctgttaatttttgcactaattgtacaaaagcagttgttggcacaactgctgacatcttagcacgaatctaggtggtggtggcggtgcctaagagtgaggctgtattaccttcatgtatcacagtcaagaagaacaggttgcaccagagaaaatgcagaatagatatgacaatccaactgtcttctgttaatcgagacattacaaagatttgtaaaaatgaaaaccattcttaactatttttggggaagacatatttttcataaaaataattatgttaatgtgtagtagacattttaaataagtaaatattttaaaaattgcttagttttaatttctaataggacaaacatcaatagatataacttacataaactagaaggcttctagggcctctttttttttgttttgttttaaatagagatggggtttcacaatgttgcccaggctggtcttgaactcctgggctcaagtgattctcccacgtcagtctcccagagttttgggattacaggcatgagccactgcttccagct

SEQ ID NO: 51885 - DNA, 601 bp, Human
gtattaccttcatgtatcacagtcaagaagaacaggttgcaccagagaaaatgcagaatagatatgacaatccaactgtcttctgttaatcgagacattacaaagatttgtaaaaatgaaaaccattcttaactatttttggggaagacatatttttcataaaaataattatgttaatgtgtagtagacattttaaataagtaaatattttaaaaattgcttagttttaatttctaataggacaaacatcaatagatataacttacataaactagaaggcttctagggcctctttttttttgttttgttttaaatagagatggggtttcacaatgttgcccaggctggtcttgaactcctgggctcaagtgattctcccacgtcagtctcccagagttttgggattacaggcatgagccactgcttccagctgagggctgcatttaagaatgtatcaaggggtcctgaaaccaaaatgagggacattgctctatcacttactgtgttaatcacatttctcgtaagtgaagtggttttattttctttgttgccctattatgaatttcattcctaagaaaactctgcaagggatgtagggatt

SEQ ID NO: 51886 - DNA, 601 bp, Human
tttttttctttatcataattattttagcaataatgtgaccttgagggaaaccacattttggaatcttgtatgatttccatctgttttctccaatggaatagtgcaaaatttttctttttagcttgcccctttagttggcctcctgctgtttctttttccttttggagggatatttgtaatacttagttcatttccagagagcggagacaggcagaccatgagcccaatggataaacaagtcttttcctgattaggttaccagttcaggaattttcagttttcttggatgaattcaagagcscaaggggaggcaccaccagtgtaagctaggggtagtagggctttacttttttttttttttttgagacaaggtctcgttctctcacccaggctggagtgcagtggcatgatcttggctcactgcaacctccgcctcccaggttcaagtgattctcccacctcagcctcctgggtaggtgggattacaggtgcatgccaccatgcctggctaattttttgtatttttactagggatggggttttgccatgttggccaggctgttcttgaacttctgacctcaggtgatccacctgccttggc

SEQ ID NO: 51887 - DNA, 601 bp, Human
gtagggctttacttttttttttttttttgagacaaggtctcgttctctcacccaggctggagtgcagtggcatgatcttggctcactgcaacctccgcctcccaggttcaagtgattctcccacctcagcctcctgggtaggtgggattacaggtgcatgccaccatgcctggctaattttttgtatttttactagggatggggttttgccatgttggccaggctgttcttgaacttctgacctcaggtgatccacctgccttggcctcccaaagtgctgggattacaggcgtgagccccyacgcctgccagactttatcctttgaagcggcaggaggcagccagagctgtaatcccctcaggcttctggtaacagtgcagtccttacttgcttcagggagacagcttctgcttaaaacagtaactttctaacaatatcaggtgtctatccaaggatgaaaccctccactctccataattgaactttttaggtaggccgaaatttggagtatgtgtttatttattttggagacggagtctcgctctgttgcccaggctggtatgcagtggcgtgatctgggctcactgcaacctccgcctt

SEQ ID NO: 51888 - DNA, 601 bp, Human
ttttttttgagacaaggtctcgttctctcacccaggctggagtgcagtggcatgatcttggctcactgcaacctccgcctcccaggttcaagtgattctcccacctcagcctcctgggtaggtgggattacaggtgcatgccaccatgcctggctaattttttgtatttttactagggatggggttttgccatgttggccaggctgttcttgaacttctgacctcaggtgatccacctgccttggcctcccaaagtgctgggattacaggcgtgagcccctacgcctgccagactttatcytttgaagcggcaggaggcagccagagctgtaatcccctcaggcttctggtaacagtgcagtccttacttgcttcagggagacagcttctgcttaaaacagtaactttctaacaatatcaggtgtctatccaaggatgaaaccctccactctccataattgaactttttaggtaggccgaaatttggagtatgtgtttatttattttggagacggagtctcgctctgttgcccaggctggtatgcagtggcgtgatctgggctcactgcaacctccgccttctgggttcaaacaattctcc

SEQ ID NO: 51889 - DNA, 601 bp, Human
attagataacctctaaagattttataatcctggcattaagtagtgacatcacatgggtttaaaaccttggtctttcatgcaaaacgagcttgggaaaagctatagtgtaaaccgtaattccttattagataaagtcaattccacactttcggaatgctttttatatttcaagcctttatgttgtctgtgtgtacagagatagtgcgtctctgctttcaagaaagtagcagtgtttttcaagctatgttttgtcatagaacttttcttcacatgaagtatcatggcaaggcctggagcgtgkctctcacccttggcaactcacgcattatggaatctcctgggggaggttttttttttttttggacggagtctcgctctgtcgcccaggctggagtgcagtgctatgatctcggctcactgtaatctctgcctcccggactcaagccatcctctcacttcggcctcctgagtacctggcactacaccctcgtgctactacgcccggctaatttttgtattttttgtagagatggggtttcgccatgttactcaagctggtctcaacttcctggactcaagctatcccctgccttagcctccc

SEQ ID NO: 51890 - DNA, 601 bp, Human
gctgggattacaggcgtgacccaccgcgcctggctttgaattcagtttttaacctttgtatatccacttcggctagaactgtttattgcctcattgaatggtactggcattcttgttaaaaatcaatggatgataaatatatgtgtttacttctgaactctcactagtgtctctgtccttttgccaatatcatactgttttgatgtgtcaatgatactttatgtcaagacacattaaaatggatagatagccattagaattagttatttgtgtatcacttaacgtcacctcacaaattgtkggtggtacatgtcatatttagaagacattgcacatttttaggaaatacatacctttgcattgttgggcagcaaactaggctcaaatactcatcatcacatttatcagcttgaaaatgcttggcagagaacattcagtggaggggttaaaacatatggagtgaagtacattgatcttgggcacagaagtcagaaagagacaactgtctttattgtgttaattttcataaagttactatttaggagaacaaccagtctttctatcccatgactaagacaaagggccttatcagctttaggga

SEQ ID NO: 51891 - DNA, 601 bp, Human
tacatacctttgcattgttgggcagcaaactaggctcaaatactcatcatcacatttatcagcttgaaaatgcttggcagagaacattcagtggaggggttaaaacatatggagtgaagtacattgatcttgggcacagaagtcagaaagagacaactgtctttattgtgttaattttcataaagttactatttaggagaacaaccagtctttctatcccatgactaagacaaagggccttatcagctttagggagattatggttaagtaaacattagagctttttactgtagaaaataaygcatagtgcatgtaaacctttaatgcctttatctctcagagacttcactgtggtgggaggagtgctgtgacctgtggaaagtcgtggaaatttcagggattgcagtcgtgatggctgtgattccagatggagtcatagtttacagtgtagtgcaggagttggcaagtattctttatgtcaagggtcaggtggtaaatgttttaggctttgtaggttgtacggcctctgtcgtgactactcagatctgctatatgcctgagtttcagcaaacctttgtgtaccaaaaaaggctaggccaca

SEQ ID NO: 51892 - DNA, 601 bp, Human
aaggtagaagggagttttaaattaaagaagaggccgggtgcagtgtctcacgcctgtaatcccagcactttgggaggctgaggcggcgtcaggagttcgagaccagcctaaccaatgtggcgaaaccctgtctctatgaaaaatgcaaaaattagccaggcatggtggcacatgcctgtaatcccagctactctagagactgatgcaggagaattgcttgaacctgggaggtggaggttgcagtgagtggagatcacaccagtgaactctagcctgagtgacagagtgagactccatctcaaaaaaaaaaaaaaaggaaaagtagagaaagggtggtagagatgacctaaagcggtagcaatttggagtggcctgatgcctgtcaggtgttccaggcatacttctaacgacagcatctggtctcaggatgagagggtgggagcagtgtgggtgcctggccagggggctgttgtcttagaggaatagggggtgacggagtagggttctgagggtggtgcacactgacagcagagtgaggaagatcaaccatatgttagaacgatttttattcaaaatgtaaaaacaaaaacataaaaagctt

SEQ ID NO: 51893 - DNA, 601 bp, Human
agagactgatgcaggagaattgcttgaacctgggaggtggaggttgcagtgagtggagatcacaccagtgaactctagcctgagtgacagagtgagactccatctcaaaaaaaaaaaaaaaggaaaagtagagaaagggtggtagagatgacctaaagcggtagcaatttggagtggcctgatgcctgtcaggtgttccaggcatacttctaacgacagcatctggtctcaggatgagagggtgggagcagtgtgggtgcctggccagggggctgttgtcttagaggaatagggggtgacrgagtagggttctgagggtggtgcacactgacagcagagtgaggaagatcaaccatatgttagaacgatttttattcaaaatgtaaaaacaaaaacataaaaagcttgggggttaggtcagttattttagaaagtactcagaagctgaaactgttatatctctcattttaatatgaaatacatcattaagatttatggataactgagattttaaatgcacactgcttacgagtttgtcataagaggccaatttgagttaaatccatggaatgctataaatgcaataagttttgttggaact

SEQ ID NO: 51894 - DNA, 601 bp, Human
ttgggaggcattaggaatgtctgctgctaaaaacctcaagtccttcttttagctgtctttaaaaaaaatgcagctggggctgggcacggtggctcatgcctgtaatcccagcactttgggaggcagagatgggtggatcacgaggtcaggagctcgagaccagcctgaccaacatggtgaaaccctgtctctactaaaaatacaaaaattagccaggcgtggtggcgcacacctgtaatcccatctacttgggaggctgaggcaggagaatcaattgaacccgggaggtgaaggttgcagwgagcagagatcgcaccattgcactacagcctgtgcaacagagtgagactccatcttaaaaaaaaaaaaaaattagctatcccccagaaggccatcccatgaagaggcggtcattcatttgatcacatgtttctttgatcactggtcccctaatggatttgatgacctctgtggctgcagagacccctgcacaatggaggtgtgtggagacgtgtgcatatgtgcaggtgtgggtatgctgttccagcagggtccacagtctcctgcagcctagctggggctcctttcagttaaaagccct

SEQ ID NO: 51895 - DNA, 601 bp, Human
aagataactctttttctggaaaattcttaattcataagtaaagcaacaacatttttctttttttttttttgagacggagcctccctctgttgcccaggctgaagtgcagtggtgcaatctcggatcactgcaacctctgcctcctgggttcaagcgattctcctgcctcagcctcccttgtagctgggattacaggcgtgcgccatcaagcccggctaatttttgtatttttcgcagagggggtatcactatgttggccaggctggtctcaaactcctgacctctggtgatccacccaccytgggctcccagagtgttggaattacaggcatgagccactgtgcccggcctcgacatcatttttcaattttaaatgtatagtccgtatctcctagggttttatctatcaatttcagttaattccttctcatttttgggcaacatattaagtagtttcaacatagaggctgtgaaaattgttttatcatcctgagatagctttttaattttgcatttcagaaattaagttgagctcttttattaatgtactcagcctttaggttaaaacacttgtaactgtgttctgaaaacccaattttca

SEQ ID NO: 51896 - DNA, 601 bp, Human
tttattaatgtactcagcctttaggttaaaacacttgtaactgtgttctgaaaacccaattttcaacagacattttatttgtctcttcctaacctcgaagctgtttcttaccatactacacagttttccaagggaattgtatatcaattgctagggtcccaacaatcattttattttatttatttttatttatttattttttttttaggcagagtctcactctttcacccaggctggagtgcagtggcgcgatctcagctcactgcaagctcggcctcccaggttcacgcctttctcctgygtcagcctcccgagtagctggggctacaggcgcccaccaccacgcccggctgattttttctgtgtgtctttagtagagacagggtttcaccgtgttagccaggatggtcttgatctcctgacttcgtgttccacccgccttggcctcctgcctcccaaagtgctgggactacaggcgtgagcccctccgcccggccccagcaatcatttgatttgggcctgggaagtcataaaacatttgctgttagttttagtgtagaaattttggaagtatggtctttgaacaggatgtgaatatagt

SEQ ID NO: 51897 - DNA, 601 bp, Human
gacattttatttgtctcttcctaacctcgaagctgtttcttaccatactacacagttttccaagggaattgtatatcaattgctagggtcccaacaatcattttattttatttatttttatttatttattttttttttaggcagagtctcactctttcacccaggctggagtgcagtggcgcgatctcagctcactgcaagctcggcctcccaggttcacgcctttctcctgtgtcagcctcccgagtagctggggctacaggcgcccaccaccacgcccggctgattttttctgtgtgtytttagtagagacagggtttcaccgtgttagccaggatggtcttgatctcctgacttcgtgttccacccgccttggcctcctgcctcccaaagtgctgggactacaggcgtgagcccctccgcccggccccagcaatcatttgatttgggcctgggaagtcataaaacatttgctgttagttttagtgtagaaattttggaagtatggtctttgaacaggatgtgaatatagttaagaataaatagaataaaaattatgcatatctttttcttagtagactcactttttatgtatgaagtt

SEQ ID NO: 51898 - DNA, 601 bp, Human
tatatatgagagagcaaaggttttatttttaagagacagggtcttgctctgtggcccagactggggtgcagtggtgggatcatcggtcactacgccccgaaactcttggactcaagagatccttccacctcagcctcccgaataggtaggactacaaatacgtgccgccatgcctagctaattttttagtagagatggggtctcactgtgttgctcaggctggtcttgaactccagacctcaggcaattctcctgccttgtcttccccaagtgctgaaataaaaggcacgagccactgtgygtggcagtttttcttttttacttaatcttgttttgcagcagttttgagacattgagtttgtgaattagcatttaaaggctttaatatttctactagagttttgtttactgagtggtttaagatactggagttttgtttactgagtgatttaagaaacaatgtggattattgatgaaatcttaaagtgatttggaggtgaaatgcgtcagtggtttgtagtgactttgaaacactatacagtaggttcacatggtttaagaagcatcattatggcttttgtgtgttttggtgtgtgtggct

SEQ ID NO: 51899 - DNA, 601 bp, Human
tgtgagagtagattttaagtgttctctccataagaaatatatatgtgagataacgcatgcaaaacaggttgatttagccattcctcagcatataccaaaacatcatgtggtacaccataaatatgtacagttttacttatcaatttaaaaatcaattagttaaaaaaattataagaaagaaaacatactatgtggagagaatgcatttgtggtatttcaaacttttttctatacatgcttttcttaatagtttatgtttaaaatagttttttaaatacaaaaataggattatgtcattatrcagactacttttgtaacctacctttttccataatatattgtaaatacctgctccctcttttcactcatcatcaaagttatcactcattatcaaatattaatattttaaattattaaaatctgcagtatctcgggtgggtgtggcagctcatgcttgtaatccgagcactttgggagaccgaggcacttgagctcaggagtttgagactagcctgggcaacatagactgtcactacaaaaaaaaaaaagtctttggcatctggatttagcatagtaaaatttaatagttttcatcattgtt

SEQ ID NO: 51900 - DNA, 601 bp, Human
ctatgtgtcttaagtgtaattccacatctgttaatcagagagctgtcactttctttttaacaggtgcatggtattatattgtttaaatgtgtatcataattaggaagtcactgctgttaggcatataggttgtttccagccttttccagacaaagctatggtgatcaaatatttttgtcgatgtttgagttctcaagatgggcagtgtggtatcccagaggacatttggttatcactgttgtggggctgggcgtgggtggggtgcttctgttatcttgtgagtagaggatgctgccgaacwccctgcagtgcccagcacagcctccattgctacgagtgacctggcccagaacatcagtagtgtgaggttgaggaaaccctgggttaatagaaatgtgagatatattcctgcaaatggagttgttaggtcaaaggatatgtgaattcaaaattttgatattgtcaaattgttttccaaagagattttgtcagtttatcctccagccaataaatggtgtgtaagattgctcatttcttcataccattttctttctctttaaaaaaattattacttaaaaaaaaatagaaatcaggtctcacc

SEQ ID NO: 51901 - DNA, 601 bp, Human
ctcctggtctcaagtagtggttggattataggcgtgagccactgtgcccagcccattttcttttctttttttttttttgagacagagttttgctctgttgcccaggctagaggcacaatctcaacccactgcaacctctgcctcccgagttcaagcgattctcctgcctcagcctcctgagtagctggaattgtaggcacctgccaccacgcctggctcatttttgtatttttagtagagttggggctttgccatgttggccaggctggtctcaaactcctcacctcaggtgatccacccrccttggcctcccaaagtgctgagattacaggcatgagccgctgcacctggccagccatcccattttcaatactctgttgtaaaagttgtctcctccaatctggtaatttaaagatagtatgtttttgttttaatttatatttctttaattatgagtgaagtttagcatctttccatgtttattagccatgaataatatttttattttaattaagtaatttttttttgcaaggtggatgtgtggggattattggtcttattcttgcaaacttgtgtaaagtatttacattcctggaaagtt

SEQ ID NO: 51902 - DNA, 601 bp, Human
ggctcatttttgtatttttagtagagttggggctttgccatgttggccaggctggtctcaaactcctcacctcaggtgatccacccgccttggcctcccaaagtgctgagattacaggcatgagccgctgcacctggccagccatcccattttcaatactctgttgtaaaagttgtctcctccaatctggtaatttaaagatagtatgtttttgttttaatttatatttctttaattatgagtgaagtttagcatctttccatgtttattagccatgaataatatttttattttaattaartaatttttttttgcaaggtggatgtgtggggattattggtcttattcttgcaaacttgtgtaaagtatttacattcctggaaagttaggtttttctgccttgtgtgacaaaattatttcttggtttctggtttcattatttttctcttcctggcagaaatttttaaattgtcatggactcaaattttcagtctgttcatttatggattctggttcttatggcttgattagaaatgcttcccaattctaaaattattttctaaaatattccacacgtctggaacatcccacactgatctgc

SEQ ID NO: 51903 - DNA, 601 bp, Human
tggtcttattcttgcaaacttgtgtaaagtatttacattcctggaaagttaggtttttctgccttgtgtgacaaaattatttcttggtttctggtttcattatttttctcttcctggcagaaatttttaaattgtcatggactcaaattttcagtctgttcatttatggattctggttcttatggcttgattagaaatgcttcccaattctaaaattattttctaaaatattccacacgtctggaacatcccacactgatctgcctggtacagatcctcatacatgcagagcagaactcgyatggaagggatgcatccacactgatgctgcagtgtagcccatccccgcagggcctccctgcctccccctagttcccacgtggaccacttctctcgcagggcttccccatgtccccccagttcctatgtgggctccttctctcgcagggcctccccgcctccccataattcctatgtggggtccttctctcgcagggccttcccccagttcctgtgtgtgctccttctctcccaggacccagcgcctggcagcaccagcattattactcactctctcatcctgaatgctctgaaggagccg

SEQ ID NO: 51904 - DNA, 601 bp, Human
ggcctccctgcctccccctagttcccacgtggaccacttctctcgcagggcttccccatgtccccccagttcctatgtgggctccttctctcgcagggcctccccgcctccccataattcctatgtggggtccttctctcgcagggccttcccccagttcctgtgtgtgctccttctctcccaggacccagcgcctggcagcaccagcattattactcactctctcatcctgaatgctctgaaggagccgtctgctcagccaggacccccatggtcttcctgtccaacagccctcagggtgccacatttctcaagccagccccccgaccctacttcagatggcaggcacaattagatatggtcttcctcctctgccgtggttttgtgaagtcagcagggtcacctacttcactttgctgccatgtgggacctctcccttcccattcttatgattccaggccttcagttaaccaccctccttcaggttacattatctgacacaaaagacacagtgcaaagcagaggagagtagaaggctcggggtttagtttttgaatatttggatattaaccaactgttaaaagtcaaagtgacacaggca

SEQ ID NO: 51905 - DNA, 601 bp, Human
gtggaggaggaagggggagagggctcagctggaggcaggtgcaggtggaggaggaagggggagagggctcagctggaggcgggtgcaggtggaggagaaagggggagagggctcaggtggaggcaggtgcaggtggaggaggaagggggagagggctcagctggaggcgggtgcaggtggaggaggaagggggagagggctcagctggaggcgggtgcaggtggaggaggaagggggagagggctcaggtggaggcgggtgcaggtggaggaggaagggggagagggctcagctggaggcrggtgcaggtggaggagaaagggggagagggctcaggtggaggcgggtgcaggtggaggaggaagggggagaggactcaggtggaggtggaagtggagcagctcctggtatgtcttgcacgtgttcccagctttcctcagactgtgctttcttagtgtctcatgaagttttttatagactttcaggcagaacccaagggtctgcgtattaaccagttagatctgtatgatctagtaagtatttctgtcttaataacttaatagttatttgaaagaccaacccgggtgtgttgggtactgca

SEQ ID NO: 51906 - DNA, 601 bp, Human
gtggaggaggaagggggagagggctcagctggaggcgggtgcaggtggaggagaaagggggagagggctcaggtggaggcaggtgcaggtggaggaggaagggggagagggctcagctggaggcgggtgcaggtggaggaggaagggggagagggctcagctggaggcgggtgcaggtggaggaggaagggggagagggctcaggtggaggcgggtgcaggtggaggaggaagggggagagggctcagctggaggcaggtgcaggtggaggagaaagggggagagggctcaggtggaggcrggtgcaggtggaggaggaagggggagaggactcaggtggaggtggaagtggagcagctcctggtatgtcttgcacgtgttcccagctttcctcagactgtgctttcttagtgtctcatgaagttttttatagactttcaggcagaacccaagggtctgcgtattaaccagttagatctgtatgatctagtaagtatttctgtcttaataacttaatagttatttgaaagaccaacccgggtgtgttgggtactgcacagcgtctgtatccttgcatttcctatttacaatcattcgtaca

SEQ ID NO: 51907 - DNA, 601 bp, Human
caccaaaaacatggggtggcctgaggcatctagagatctgcatggggtgcctattttgggaaatgagagcagagcctgagtggggcacatctgtgggtagccctgggagctgagagcccatctggttgtggagtctgggctgggcgggggtatggtctgctttccaccgctcagccgctgggaggagtggagatggtggtttgcctggaggtgggggcttctgaagcatgtgctgtggaataacaaaggagtcagggccatgggaatgttggcgggagagctgaaatgttgagccgtgtgktctaggcagagaggtgaaacttgaggggtgtgcgtgaaccctctgttaggatgacacaggtaaaggtggttgaagatgtctgtgcatgccacatgttctgggtggcccaacccgaggacgacatgaagggcaaagattacctctaaggctacacccatctacaggggtcaccagcacagtgagctttaccgttttccattctgaagttccttcagatgtgccttttaatacttcactgtgatttcctccatcactggaaagagaaacaactgttagctgtcattcgcagatgttctaaag

SEQ ID NO: 51908 - DNA, 601 bp, Human
tgttgatgcttaggtcagagtttgtgactgtgcctccctcacctggcaggctggcgtatgtggtacagagctggtagggcagccgtgccctcaggtttgtccaacatcttcatttgttatctctgagttctttgcttctgaaccatggtttacagtgagaacgggaggaggaaggtgcactgcttctctttaaaggcgttatctggaagatgcatttcagtcctgctcacattcagttgggtagaacgtagtcatcaggccagtgatctagtggttgggcggctgcgaaatagtgttgagytgattagctgtatgctcagccagtaagtctattattgcataagaaaggaagaatcagtattggagcacaattaaaagtcttttccctgtatgtcaaaataatacattccttgctgcctttgcattttgtgtttgatttttcagttaattgatttgaatatggcatattaatagtaactagagggataatttcttacctttaattgtatttaaaaataacctctaaggttccagccacagtggagcagcttccttctcctaggggtcccccgtatcactattgttagagataaccagccaa

SEQ ID NO: 51909 - DNA, 601 bp, Human
agaagaatggtgtggtggttaattttctgtgtgaacgtggagagtgtttttggatgagattaacatttaaaccattgagtaagcagattgccctccatgatgtgggtgagcctccttcagtcaaagacctgaatagaatgaaaagactgacttccccaagtgagagggattctcccgcagacggcctttggttgtcacttacattatcagctctcctaggtctccatctgccagcccacgctgcagatttggggcttgtcagcctccataatcatgagacaatttcttacaacaaatatctttttttttttttttttttttaagacagagtctcactttgttgccgaggctggagtgcagtggcactgtgtcggctcactgcaacctccgtctcctggattcaagcaattcttctgcctcagcctccagagtagctgggattacaggcatccaccaccacacccggctagtttttatatttttagtagagatggcgtttcaccttgttggccaggctggtcttgaactcctgacctcaggtgatctgcccgcctcggcctcccaaagttctgggattacaggcgtgagccaccgcacctgg

SEQ ID NO: 51910 - DNA, 601 bp, Human
ggagagaaagcagaaagacagtgatgtagccgtctgtaagctggcaggtcttggctgtggcctgggaggtgctggatcctgctcgcaccatctgagcacgtcgtgcataaactggggttgtcactcagacagatccaacaaatgcctgagtaatatccgtgtagatatccctgaaacacatgaatcagatcatttggtaaaagagtaagtgaaaagagggtgggtgtgagccagggcagtatcagtacggagaggagcgggctgcgaggggttttgtgatgtgattttgagacaggaggcrtagtggggaatcattggtaatgaaagcagtgcattttgttcagatgcattcaggactgcagaggtttttttttttttttaagagctgcatcaaattatgatttttttttgtggggagtttcctagaacaaattttcttttatcaacaagtcactaaaaatttagtagtttattatttccttaaattattatacaataatactactttaaagttatttaaatgatttttggatttctcaaaacatttcacttttctttgtctttttctgcagtgtagctagaggtagtatcaattaacagc

SEQ ID NO: 51911 - DNA, 601 bp, Human; identical to SEQ ID NO: 36219

SEQ ID NO: 51912 - DNA, 601 bp, Human; identical to SEQ ID NO: 36220

SEQ ID NO: 51913 - DNA, 601 bp, Human; identical to SEQ ID NO: 36221

SEQ ID NO: 51914 - DNA, 601 bp, Human; identical to SEQ ID NO: 36222

SEQ ID NO: 51915 - DNA, 601 bp, Human; identical to SEQ ID NO: 36223

SEQ ID NO: 51916 - DNA, 601 bp, Human; identical to SEQ ID NO: 36224

SEQ ID NO: 51917 - DNA, 601 bp, Human
acaggcatgagctaccacacttagcctggggacacgtttctatataaagatgttccttttaattaaaacttttcaattactagtgtacttttaacatagtgattatatctgaaaatacctctccaaggatggagtatcatttgatatcttagaaagaccatgaggaaaactattcttgtctcgtaagtcataacattaattgcttataactaaccttcattacgttcctaagttaagcatactccgccatgtaaaattattgcttttgatttattcacttttatcagagtgaatgttttcrgcgggatttgcttggtttgaagaagttatattaaaaatttaacaaatgcttttatagttatcatgcaacttgtgacacataaatcattgtgaatttttagtaaagtttgaaatttatgaccaggtgcagtggctcgtgcctgtaatcccagcactttgggaggccgaggtgggtggatcatgaggtcaggagtttgagaccagcctggacaacatggtgaaaccccgtctctattaaaaatacaaaaaattagctgggtgtggtagcgggcacctgtaatcccagctactcaggaggctg

SEQ ID NO: 51918 - DNA, 601 bp, Human
tcgtaagtcataacattaattgcttataactaaccttcattacgttcctaagttaagcatactccgccatgtaaaattattgcttttgatttattcacttttatcagagtgaatgttttcggcgggatttgcttggtttgaagaagttatattaaaaatttaacaaatgcttttatagttatcatgcaacttgtgacacataaatcattgtgaatttttagtaaagtttgaaatttatgaccaggtgcagtggctcgtgcctgtaatcccagcactttgggaggccgaggtgggtggatcmtgaggtcaggagtttgagaccagcctggacaacatggtgaaaccccgtctctattaaaaatacaaaaaattagctgggtgtggtagcgggcacctgtaatcccagctactcaggaggctgaggcaggataatcgcttgaacccgggaagtggagtttgcagtgagccgagatcatgccattggactccagccccggcgacagtgtgagactccatctcaaaaaaaaaaaaaaagaaatttatcgtggtgaaatattgcctatctagaaatcatggtgaatggtgttttggaaagctgatg

SEQ ID NO: 51919 - DNA, 601 bp, Human
caatacaaggaattcccatatacccttcatccatattcccccaaatgttaacattttactacatttgatttcgctgtttagctatttttttcctgaattttctgagagtgacttgtagatataatgcccttttaactgtaaatattttttagtgtgtatttcctaaaatcaaggacatccttgtacataatcatagtaaagtcatcaatatcaggaaattaaaattgacccagtactattgtccactgtaccgaccttattgaaattttatcattggtgtcagtaacatacttgataacaratgaaaaggattttgtcaacagttacactttcctttggtaaaaaggaataagttttgataaacagttatactttcatgtagtcatgtagatttacccttctaggagcaattattggagcacctgtttcctcacagccttttcaagaaattatcaaaatttggggattttttttactcatccaatgggttagaaaatggtgtcttattgtacgtttaatttgcatttttcttacaaggagtaaggttgaaagcttttcaaaagagtacctatattttcctataagactaattcttgacttc

SEQ ID NO: 51920 - DNA, 601 bp, Human
gccttttcaagaaattatcaaaatttggggattttttttactcatccaatgggttagaaaatggtgtcttattgtacgtttaatttgcatttttcttacaaggagtaaggttgaaagcttttcaaaagagtacctatattttcctataagactaattcttgacttcttttgtccatatggtattaaagatgatagcattttgtgagctatatttgtgggatacagtttactcctagacaacacaaatttgaactgcaaaggtccacttatatgcaggttttatcctgcctctgccaccccragagagcaagacccccgacttcctcagcctactcaacatgtagacaaagagaggaaaaccacttccacttaatgaataggagatatattttctcttctttatgcttttcttaataacattttttctctagctttattgtaagattatagtgtataatacatgtacaaaatatgtgttacctgttgatgttattggcaagtcttctggtcaacaggaggctattgacagttaagtttttggggtatcttataggcagatttttaactgcatcggggtcagtgcctctaacctccgagttgt

SEQ ID NO: 51921 - DNA, 601 bp, Human; identical to SEQ ID NO: 36225

SEQ ID NO: 51922 - DNA, 601 bp, Human; identical to SEQ ID NO: 36226

SEQ ID NO: 51923 - DNA, 601 bp, Human; identical to SEQ ID NO: 36227

SEQ ID NO: 51924 - DNA, 601 bp, Human; identical to SEQ ID NO: 36228

SEQ ID NO: 51925 - DNA, 601 bp, Human; identical to SEQ ID NO: 36229

SEQ ID NO: 51926 - DNA, 601 bp, Human; identical to SEQ ID NO: 36230

SEQ ID NO: 51927 - DNA, 601 bp, Human; identical to SEQ ID NO: 36231

SEQ ID NO: 51928 - DNA, 601 bp, Human; identical to SEQ ID NO: 36232

SEQ ID NO: 51929 - DNA, 601 bp, Human; identical to SEQ ID NO: 36233

SEQ ID NO: 51930 - DNA, 601 bp, Human; identical to SEQ ID NO: 36234

SEQ ID NO: 51931 - DNA, 601 bp, Human; identical to SEQ ID NO: 36235

SEQ ID NO: 51932 - DNA, 601 bp, Human; identical to SEQ ID NO: 36236

SEQ ID NO: 51933 - DNA, 601 bp, Human; identical to SEQ ID NO: 36237

SEQ ID NO: 51934 - DNA, 601 bp, Human; identical to SEQ ID NO: 36238

SEQ ID NO: 51935 - DNA, 601 bp, Human; identical to SEQ ID NO: 36239

SEQ ID NO: 51936 - DNA, 601 bp, Human; identical to SEQ ID NO: 36240

SEQ ID NO: 51937 - DNA, 601 bp, Human; identical to SEQ ID NO: 36241

SEQ ID NO: 51938 - DNA, 601 bp, Human; identical to SEQ ID NO: 36242

SEQ ID NO: 51939 - DNA, 601 bp, Human
cttcctaaataaatagtctgagcattttttttccccaaaatcgaagcattttttttctgattaaaaaatacggtaaatataaaaggggataaaaattcagataatgtagaagaacataaaaaataaggtaaaacataaaacccaaagctgtaatcccaccacccaaatggaaccacagttaacattttaatgtatatatccttctacacctttatatgaatgtataaggtacatagttataaatttctgcagaaatttataaaatgatgtacacatcatgtagatgagctttattgaaggrcattatgttgtattcatggtttcaataagtagtatggaatttttcatgcccttagtcactgagattcttagatgaattcctaccagtagaagtgctgtgccaaaggggtgtacatttttaaatgattcgttgagctaagatgctgaaaaacctttcagactttaattaggaaaatcataatgatacattatgattagttataatgaaggtgaattataacaaagctatgccagcattttgatagttgaagactaattataataaggctgtgtcagaattttcatagttgactgtaaaaaa

SEQ ID NO: 51940 - DNA, 601 bp, Human
tgaggtgacccaggcgcaccgcacgccagggttcctgctcactggacacaggggctcccctttggctgacctgcctgtagccaagcagccctgcctacgtcgtgcccccagggacctgtcgggcagcccctgtcagccacatgtggtgctgggaagcagagcttgcatctcactcagaggcattcctcctgagctgtgcggagcgcgtgactgcttatggagtttaacacaccttcttcacctgcccttacgcaccatcaactcctgcttgtcacataattaaccttctaaatgttagcarttcgtatcatgttttaaaattgtagttggaacaaaagtaaccgactggctgggcgtggtggctcacacctgtaatcccagcactttggcaagccgagatgggcttgaggtgaggagtttgagaccggcctggccaacatggggaaactccgtcgctactaaaaatacaaaaattagccaggcatggtggtgggtgcctgtgattccagctacttgggagtctgaggcaagagaatcacttgaacctgggaggcagagattgctgtgagctgagatcgcacctctgtactccagcctgggc

SEQ ID NO: 51941 - DNA, 601 bp, Human
gtagtgcacaagggtcacccaggagccttgtgagcgggcaggtggttctccaagcaggttcttgaggaagggctgtagagtgaagctttggtggcagtgatgaccctgggatgcgctgtggcccatttcggggcctgctgtcctcaccagctggcagctcaggctccctggcttcacaccagtggggtcactttctcatttaggatgctgcttttggacaaaagtcctgtgggtcctcagcgcctcaggacaaactccatcagctgcccctctggctcctgcctggcccctgctacgccaygtggacttgggctctgctggctgagctgccagtacctcgtttgccacgccctctccctcccacccactgcacaggtggctcctgtgcctggcatccaggatgtgcctgcagccacacaccctgccattagcgcttccctgctgcccccctcagcccttccactctggcctgcggacatgggagcaggaggctttgtgagcagcacgagccgggtgggtcttctggagcctgtgtctatccagatacattagtgtttctgttaagctttggtgggttaagttcattctgtatattcttttc

SEQ ID NO: 51942 - DNA, 601 bp, Human
ccctgctacgccacgtggacttgggctctgctggctgagctgccagtacctcgtttgccacgccctctccctcccacccactgcacaggtggctcctgtgcctggcatccaggatgtgcctgcagccacacaccctgccattagcgcttccctgctgcccccctcagcccttccactctggcctgcggacatgggagcaggaggctttgtgagcagcacgagccgggtgggtcttctggagcctgtgtctatccagatacattagtgtttctgttaagctttggtgggttaagttcattckgtatattcttttctgtactttaaaaaaaattatcaaatacaaaatttttaaaccaaattgattaattagcatgcattgtccaacaagtaatttaaaaatatccaatagaaattgtgtagctttatttgaatcttttttctattagctggcaaacttagacttgtgctgatttaatactctgaaaacttgcaaaaaccagatgaaaactttcttagctttttgaatggtatttttctaaacataatgaatccttggtagcaataaaaccaccattttattgtcaagagattaatgaaccta

SEQ ID NO: 51943 - DNA, 601 bp, Human
tgtgctgttcattacccaccttccctgtgactctgacgcagctgccccagctgccagggccaacagctgttgcgccattcctctctgctggggcttggtgcttgctgttacattctcatgttgcaaaattcatgtgctccagggaaatgcaaattcctgtaatctttacctcagtgtaaaccaaatatagtaaagaaaccaactgcaaataataatacaaaccaaaagtaaataacctttagattatattgttttagctgatttgtgtatcacttccataagtatagctaatcgttgagtwtagcttttattggacactgatttttaaatcagggtatttgcattaagaatacttaaggttggctgggggtgtggtggctcatgcctgtaatcgcaggccgaggcgggtggatcacctgaggtcaggagatcgagaccagcttggccaacacggtgaaaccccgtctctcctaaaattacaacaaattagctgggtgtggtggcatgtgcctgtaatcccagctacttgggagtctgaggcaggagaatcgcttgaactcaggaggtggaggttgcagtgagctgagattgtgccattgca

SEQ ID NO: 51944 - DNA, 601 bp, Human
tcaaattgggtagtctgataagggtggtggcagcagctgtcaacagacatgtcacaaaaaagtatagcattcaccggtatttgaaaatagcaatattcaatcaacttctctatgtagggaggtagggaacatgaagctttgttagtataggtaggaacttcaggtgcagtggctcacacctgtaatcccaccactttgggaggccaaggttggtggatctcctgaggtcaggagttccagactagcctggcgaacatagtgaaacccccatctctactgagaatacaaaaattagccacaygtggcgcatgcctgtaatcccagctacttgggaggctgaggcacaagaatcacttgaacccgggaggcagaggttgcagtgagctgagattaagccactgcactccagcctgggtgacagcgcaagactttatctccaaaaaaagaaaaagaacttttcaatttagatcatgtttatgtaaaaaattaggctgatatatggagatacctaaaatagcctaattttgcttttttaaaaagctgcatatgggaagtaaggaacccaaatcaagttagaagctctctttctctggaatccctg

SEQ ID NO: 51945 - DNA, 601 bp, Human
agcaaaattgtatatgtgtttctaagcaaataagtgttttttaaatatacacacatgtagagactctgagatgtaatttatataagttcacctaattatttaaagtatacaattgaatggttttcagtgtatttacagagttgtacaaccatcaccatggtctaattttagaacgtttcatcaccccttaaagaaacgtggagccatgagccatcactccatgttcccccgacccccggcccaccctcaccgctgcccctggcaactgccagtccactttctgtctccgtagatgcatccrttctgggtatttcatagaaatgtgatcatccgtgtggtcttttgtgactggcttttttcattccttagagtatttccaaggctcctccatgctgtagcatgtaccagaactttgtaccttcttattactgaacaatattcccttataccacattttcatttgtgcatttatcggttgatgggcatttgggctgtttccattttttggctatgggtaattctcctgtggacatttctgtacaaggcttctgttttcacttctcttgggttgctgggttacatggtgactccacggttcact

SEQ ID NO: 51946 - DNA, 601 bp, Human; identical to SEQ ID NO: 36243

SEQ ID NO: 51947 - DNA, 601 bp, Human; identical to SEQ ID NO: 36244

SEQ ID NO: 51948 - DNA, 601 bp, Human; identical to SEQ ID NO: 36245

SEQ ID NO: 51949 - DNA, 601 bp, Human; identical to SEQ ID NO: 36246

SEQ ID NO: 51950 - DNA, 601 bp, Human; identical to SEQ ID NO: 36247

SEQ ID NO: 51951 - DNA, 601 bp, Human; identical to SEQ ID NO: 36248

SEQ ID NO: 51952 - DNA, 601 bp, Human; identical to SEQ ID NO: 36249

SEQ ID NO: 51953 - DNA, 601 bp, Human; identical to SEQ ID NO: 36250

SEQ ID NO: 51954 - DNA, 601 bp, Human; identical to SEQ ID NO: 36251

SEQ ID NO: 51955 - DNA, 601 bp, Human; identical to SEQ ID NO: 36252

SEQ ID NO: 51956 - DNA, 601 bp, Human; identical to SEQ ID NO: 36253

SEQ ID NO: 51957 - DNA, 601 bp, Human; identical to SEQ ID NO: 36254

SEQ ID NO: 51958 - DNA, 601 bp, Human; identical to SEQ ID NO: 36255

SEQ ID NO: 51959 - DNA, 601 bp, Human; identical to SEQ ID NO: 36256

SEQ ID NO: 51960 - DNA, 601 bp, Human
tccgacgcctctgtgcttcctcccgcagtggctgacaggaagcctcccagctccggcagcaaggccccggacgccctcagtagcttacacggactgcccatcccggcctcgacctcctaggggcagctctccccggacccgagcccggagggaacggcaggcggacccgggcgcacaggtctgcgcggcggccccggcaatcggcacgggcaggatcggaggactcgcggaggaggaagccagtgccggcccgcggggtgcacgcccagccagcccccaggcccagccctgcctctggccsgacccaccacacttcctttattggtctgggtttttaggcttctctgaacttgggttttagactgccgtaccctcctcacaatccttgctctgacgtggcctccttcgctctgccagcttcaaatttcttttttgtcactcccttgtccgtctccgtctcgcctctctccctgtttccttcccccctctttctttctcactctccctcccttccctttctctttcccttcctccctaccttccaccccggctttccccgaccttccagggctccctctgcccttccactctcttttccttg

SEQ ID NO: 51961 - DNA, 601 bp, Human
gaggcagtttatttctacatgggattggctccttgacatgcagtagccagatagtggcactaggattgcctgacactggtccttgcaagggacagggaggtacttttctctacagaattggtttcctccttgacaaaaaatgtggctagatataggtccggggcttggcctgttaccatccatcccaacctagcgacatttacttttctccacaggatcatttttctcttgacgaaggtcgtcgcctgtttctggatttcccgatggcctgagcatcatccgcgcagtgaacatcctccckaaatcggctcgatcccctctcccccaaaggatctagctaattctaaatcaagcacaaactttatcttcctgtactccctagagagcaccttccgacttcggggctggctgcaccactgcaatcccgcgtagcagccaagcgtccctctggattgttcccgcttttgcagcaggccacaccccctccagctcaggccccgctcaccttgagttctggagcacttccggtccgtaacctgggtcaggggtcccctgcccaggaccagggcttgcccgtccgagggcaggaagatggggggcg

SEQ ID NO: 51962 - DNA, 601 bp, Human
ggagtgtggcctgcttcaggctatagcatccagggagtaagaggcagtttatttctacatgggattggctccttgacatgcagtagccagatagtggcactaggattgcctgacactggtccttgcaagggacagggaggtacttttctctacagaattggtttcctccttgacaaaaaatgtggctagatataggtccggggcttggcctgttaccatccatcccaacctagcgacatttacttttctccacaggatcatttttctcttgacgaaggtcgtcgcctgtttctggatttcycgatggcctgagcatcatccgcgcagtgaacatcctccctaaatcggctcgatcccctctcccccaaaggatctagctaattctaaatcaagcacaaactttatcttcctgtactccctagagagcaccttccgacttcggggctggctgcaccactgcaatcccgcgtagcagccaagcgtccctctggattgttcccgcttttgcagcaggccacaccccctccagctcaggccccgctcaccttgagttctggagcacttccggtccgtaacctgggtcaggggtcccctgcccagg

SEQ ID NO: 51963 - DNA, 601 bp, Human
cgggtctcttcccagcgcagggtcagtgggtggaggccattgaccaaatacagtgtgtcccccacccccagagagccctccaaccccggcttcaactcctgggtcccggtagttgaggggttaactcccagctgcagaaagagagggaggagctgggactggctccgcccccaccgggagcttcctccaatcaaatacccagcggaaaaatcagcccttctccaccactatcagacccttaggccccacctcttcactttggaacgggctttggaacggttacaggttttcagccttgtcygaatcttttttttttttttttttttttcccctggagatataggcttgttttgtcgcccaggctggagtgcagtggtgcaatcttggctcattgaaacctgtgcctcctgggttcaaacgattctcctgcctcagctacccgagtagctgggattacaggcacccgccaccatgccccgctaatttttgtatttttagtagagatggggtttcgccatgttggccaggctggtcacaaactcctgatctcgggtgatccgcccgcctagcctcccaaagtgctgggattacaggcgtgagc

SEQ ID NO: 51964 - DNA, 601 bp, Human
agagatgagacacatgggactcagaatgtggtggtaacagcatttgaactcaagtctctctggacataaaaaatcctcatcgtaatagctcctactgagacagtcatggtcattgctgattactgggtggtcactgtgggtaacgcaggagctgacatatatcattctccccactgcttaactgcttacaacgatccctgcatttatcattaggcccatttctcagaaaagtaagtagaggctaaaaagttgagagcacgcaacaaacgtgggattgggtcccagtctgtggcggctcccwcagccctcggcgtggccctcaccttgccctggggtttcaccccagctgcggtgaacactagcaacttctccaagttctcccagccggggtttgacttccgcatacgcttcttcggcagctcagcatctctcttctcatcttgggacaccagaggggtgccaggcggagtatctggctgggattctggtgtgcgggtctcttcccagcgcagggtcagtgggtggaggccattgaccaaatacagtgtgtcccccacccccagagagccctccaaccccggcttcaactcctgggtcccgg

SEQ ID NO: 51965 - DNA, 601 bp, Human
ctggtgtcaccaaggaaagacaaacagcagcactgtgatacctctgaccctcctcactcacaggctgactcacaccaaccctgccaggcagggtgttatcactgccatctcacagatggggaaaccgagtcacagagcacctccatctcaagcatccgtgatgcctctgagtggggcccgacatcttaaccttactgtctcctgttactccttatgacgccagccccaggattacagtctttaaaatgggggttaatgtcttacccagcctccttcttcccctggccttcaccacctcggkgggctaataaccgtgaaaataaaagcaggagcaaagctttgggtgctaactgcatgtcaggaactatgccacgtgctttttttatggattcagcatcgtagagatgagacacatgggactcagaatgtggtggtaacagcatttgaactcaagtctctctggacataaaaaatcctcatcgtaatagctcctactgagacagtcatggtcattgctgattactgggtggtcactgtgggtaacgcaggagctgacatatatcattctccccactgcttaactgcttacaacgatccctgc

SEQ ID NO: 51966 - DNA, 601 bp, Human
tccagccactttgcaccgtgctcctggccccctcccccctccgtggtctctccacacagccccctccctccaggtctcccgacttcacctcctcccgttccccacgcggccaccggagggcacccaccctgctacagctccagcctccggcgtgccggcgcctcccaggttccccctccctcagggcaaaagcggggccctccctgtggccctgccctctcccctccctcgcttagagccagccgcatgggcctcgctgtccctaactagcccaggctagggactgcctcagggcctttgyacttgctgtcactcccacaaggggggggaccgctttccccaggtgtccacctggctccctcctttccctgccttaggccttttcctctgatgtcacctcctcagaggccatccctgcccaccacgggtgatgcctgctttctccagctccctccctcctgctgttttacacgccagtctgcccatccgcctagagtcaccgccctcgccgtgagggccctgctggagcaggccgtcccgctcactgataccttcagctcaagaatgcgctaaacttcagaacaaatgcacacacaaacga

SEQ ID NO: 51967 - DNA, 601 bp, Human
ggctgcttcgcctggtctgtgccccacatcaggaatcatcccccgacctttcatgtcctcactctccagccactttgcaccgtgctcctggccccctcccccctccgtggtctctccacacagccccctccctccaggtctcccgacttcacctcctcccgttccccacgcggccaccggagggcacccaccctgctacagctccagcctccggcgtgccggcgcctcccaggttccccctccctcagggcaaaagcggggccctccctgtggccctgccctctcccctccctcgcttagrgccagccgcatgggcctcgctgtccctaactagcccaggctagggactgcctcagggcctttgcacttgctgtcactcccacaaggggggggaccgctttccccaggtgtccacctggctccctcctttccctgccttaggccttttcctctgatgtcacctcctcagaggccatccctgcccaccacgggtgatgcctgctttctccagctccctccctcctgctgttttacacgccagtctgcccatccgcctagagtcaccgccctcgccgtgagggccctgctggagcaggccgtc

SEQ ID NO: 51968 - DNA, 601 bp, Human
gtctggaacacacgggacaccccgttcccaccagctcggagggaggcgtcccagcccaccctcagcagcctccaggcccttacctcccacaaagatgctgtccccgatggatatgggcgtgccgtcgttggcctacgggagacggtagtgaggaggcccttcccacaaatgtccccccgcagcggtagcgggtccctggggctgcttcgcctggtctgtgccccacatcaggaatcatcccccgacctttcatgtcctcactctccagccactttgcaccgtgctcctggccccctccccmctccgtggtctctccacacagccccctccctccaggtctcccgacttcacctcctcccgttccccacgcggccaccggagggcacccaccctgctacagctccagcctccggcgtgccggcgcctcccaggttccccctccctcagggcaaaagcggggccctccctgtggccctgccctctcccctccctcgcttagagccagccgcatgggcctcgctgtccctaactagcccaggctagggactgcctcagggcctttgcacttgctgtcactcccacaaggggggggaccgctttc

SEQ ID NO: 51969 - DNA, 601 bp, Human; identical to SEQ ID NO: 22623

SEQ ID NO: 51970 - DNA, 601 bp, Human; identical to SEQ ID NO: 22624

SEQ ID NO: 51971 - DNA, 601 bp, Human; identical to SEQ ID NO: 22625

SEQ ID NO: 51972 - DNA, 601 bp, Human; identical to SEQ ID NO: 22626

SEQ ID NO: 51973 - DNA, 601 bp, Human
taatgggatgagcctccagccgcctcttgaagaagtaaatatccttttgtgagacccctccccaccctgacctccacatcaatatatcttgccacacatctggccctttcttgaggtctaaccatacccctcttgcttcaaaccagtttaccccaggcccccagacacttagtagcaacccctccaggttcacagcccccgctggcctcccccagtatcgccgctacttccttaactccacctccaacccccctttgcccttccctgtgtctgcccccattttccttcccctcccctcccyagctgtgggctgagctagagacggggtcagagagactggagagatggtaggcgtggctgaggtatcggggtgctcccctggatggtgctctgggggggtcctggaagtggaaaatggggttgttaggttttggggttcctgggggggcaagatggcaggcgggggctgtagggttgtcatggtatgattttgggggttctatactactcttcagggaaaagtagggcgctggaggtttaagaggctgtggggagcccccagatctgacccatgatcccatcggccccctcccaggtgtcc

SEQ ID NO: 51974 - DNA, 601 bp, Human
cagttaaaaacaaaatcgcggccgggcacagtggctcacgcctgtaatcccaacattttgggaggccgaggcgggcggatcgtgaggtcaggagatcaagaccatcctggccaacacggtgacaccctgtctctactaaaaatacaaaaaattagccggacttggtggctggcacctgtagtcccagctactcgggaggctgaagcaggagaatggcgtgaacccgggaggcggaggttgcagtgagctgagatcacgccactgcactccagcctgggtgacagagcaagactccgtctcaaaaaaaaaaaaaaaaaaaaagtaacatcacctgatacccagtccacataaaatttctgctcctgcctcaaaaatgtccagaacgatgtatgaattttaaaactgttagaagggttcatggcttctgctcacgcagttctctgaactgaagtggggtccccaggctctagcccccgggggaggtgaggtgaggggcaggcctcccgggggctgacgtggccacccttgtccgcccgcagtggtgaccatcatcaaggggaaggtggaggaggtggagctcccagtggagaaggtggacatc

SEQ ID NO: 51975 - DNA, 601 bp, Human
actaaaaatacaaaaaattagccggacttggtggctggcacctgtagtcccagctactcgggaggctgaagcaggagaatggcgtgaacccgggaggcggaggttgcagtgagctgagatcacgccactgcactccagcctgggtgacagagcaagactccgtctcaaaaaaaaaaaaaaaaaaaaagtaacatcacctgatacccagtccacataaaatttctgctcctgcctcaaaaatgtccagaacgatgtatgaattttaaaactgttagaagggttcatggcttctgctcacgcrgttctctgaactgaagtggggtccccaggctctagcccccgggggaggtgaggtgaggggcaggcctcccgggggctgacgtggccacccttgtccgcccgcagtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggtgaggccccagcgggacgggtgcagctcgcgtgggctggggtccaggtagaa

SEQ ID NO: 51976 - DNA, 601 bp, Human
ggctggcacctgtagtcccagctactcgggaggctgaagcaggagaatggcgtgaacccgggaggcggaggttgcagtgagctgagatcacgccactgcactccagcctgggtgacagagcaagactccgtctcaaaaaaaaaaaaaaaaaaaaagtaacatcacctgatacccagtccacataaaatttctgctcctgcctcaaaaatgtccagaacgatgtatgaattttaaaactgttagaagggttcatggcttctgctcacgcagttctctgaactgaagtggggtccccaggctstagcccccgggggaggtgaggtgaggggcaggcctcccgggggctgacgtggccacccttgtccgcccgcagtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggtgaggccccagcgggacgggtgcagctcgcgtgggctggggtccaggtagaagacgaaaaccacgctcaatttttcccacagac

SEQ ID NO: 51977 - DNA, 601 bp, Human
gtgaagctgggtggctgaccgggggatcctgtcggggaggagtaagttgttgagtgggggaggagaggagactacaggggcagggaccccactcgggccaccctcctgagagccaggggaactggcgcagggtttaggttggcatttgtgttgccgtttgaagccatcatgttgttggacttgtcaaggggttggggagacagtggagtggggcgcctgcattctaggaggtctggacagagttagggtggcactgccaggtttgggtgttggagaggagggagcaaggaatctgggctcraacccacatggtttattgggagccggataggcaggatgcagagtgaaggaggagccgaggctgggtgccagtgagggagggctagcaggaaggggacagcgaggtcacaggccctctgggagcttaagggagggaggaggggatgaagcgaggtggggacgcatcccggagctcgccctctcatgtcctgcaggaggtggacatctataccgtcaaggtggaagacctgaccttcacctccccgttctgcctgcaagtgaagcggaatgactacgtgcacgccctggtggcctacttcaa

SEQ ID NO: 51978 - DNA, 601 bp, Human
cccaggctgaaaccctgccctcctggtgcttccactctagacaagggggtcagtgacatggtgatgccagttggaggtgacctctgtcaggctgggagcagggcagacaggtgttggtgtaggtgggctccagggcaagaggcagcccccagtagagtgcacggggttttctagcccagctgggaggcatgagaggagaaaggcagctttttgttttctgctcccctttctttttcctcctgagcacttggcaggagctgccatcacctgagatcagggggcttccgggggagctgggggrgcttctcggagacagggtctgggcagagatccagtgtggtgggtctgagcaggcaggaggatggaaggcttggagcctggagtcgccgggagtggtctgggttggaaaagtgggtcccggccgatgggtgcgagggtgggtggcactcagggtagtcatggaatgtggaccctgggacacccacgagcctgtgacagcagcagttgtcaactgggcagttttactgccccctccgctccccgcccccccccaggacgtttgccaccgtctgtggaaacatttgtggttgtcactccggag

SEQ ID NO: 51979 - DNA, 601 bp, Human
gcacttggcaggagctgccatcacctgagatcagggggcttccgggggagctgggggggcttctcggagacagggtctgggcagagatccagtgtggtgggtctgagcaggcaggaggatggaaggcttggagcctggagtcgccgggagtggtctgggttggaaaagtgggtcccggccgatgggtgcgagggtgggtggcactcagggtagtcatggaatgtggaccctgggacacccacgagcctgtgacagcagcagttgtcaactgggcagttttactgccccctccgctccccgcccccccccaggacgtttgccaccgtctgtggaaacatttgtggttgtcactccggagaaggggtggtcctggcatctggtaggtaggggccagggggctggtaaatgtcctgcagccacaggaccaccccctacaaagactcatgcagcccccgggaccacggcactagctgggaaacggatactggagagggaggaggagtcctcgggcgttggtgactttgtctcatcttcatgtgctggagggtatggggggaggagaggaagtggagacagcaggctggaccattgtgtttcactg

SEQ ID NO: 51980 - DNA, 601 bp, Human
gggtgggtggcagtccccgagacagtgtctccccttccctactttcctgcagggcgtggacgagtggatgtggccagcctggctgtggggctgacaggtggcatcctgctcattgtcctggccggcctgggagccttttggtatctgcgctggcgacagcaccgaggccagcagccctgtccccaagagtaagggggcttcagcgaggagggggtggtggtggagagcaggggagggaggaagcattgacctaaagggatgtgctaaggattgggggcaggcaggcactgatgaaagacckaaggacacagtcatttggagagtgagtctgtgagctggcttgtgtctggttttggcgactgtcgctctgtctggatcctcagtacctggcccgcagtaggagctctgaccacttttgctgccagcctgtctttgcggtactgagattaccagtatccgtggaattacgactctggatattgtatctggtgaggctgcgacggtgcagcctgtggtgtcttggtgtctgtggtatgtcagtttcagtggtaacaggtgcagcacctgagtgggtgtgggaaattggtgaggagtgcgtctg

SEQ ID NO: 51981 - DNA, 601 bp, Human
agatggagtttcactctcattgcccaggctggagtgcaatggcatgatcttggctcactgcaacctctgcctcccgggttcaagtgattctcctgcctcagcctccagtgtagctgggattataggcgcactccactacgcccagctaattttgtatttttagtagagatgggtttctctatgttggtcaggctggtttcgaactcctgacctcaggtgatctgcccgccttggcctcccaaagtgctgggattacaggtgtgagccaccacgcctggccctttttttttttttttttttwaaaaaaagacaaagtctcactctgttgcccatgttggagtgcagtggccggttcacagttcactgcagcctcaatttcctgggctcaagaaatcctcccacctcagcctcctgaggaactagagctacaggtgtgcgccatgcacccggcagggctgtctttttctctattgctctgcctgtatctggtgcacatgagtgtgtctgaataagagtgtgtctctgtggttgctgatttctgtgtctacctgtctgtgtgcagctgcctgtcatttgaggcgcttttctgtgtgtaaggcta

SEQ ID NO: 51982 - DNA, 601 bp, Human
tgatggcaggaatgaaaatccagcttgtatgcatgctactcctggctttcagctcctggagtctgtgctcaggtaagcaaaacagaatttcacaactccctgaagtgatttcttttttctcttttgcagtgtgttgctacttatgttaatgtatctggggagaagagttgctcccttttattcaggatttaccttttagtgacagaaactgagtatctctttctctgcctttatgattactgagagatgtattttctcttttaaaatctgcaaagcaataaaagggatttcaatgaaacaytgcacgacctcctttggaattcaacaactagagggaaaaaaaccctacaaaactttcaattaggctgatcattatctaatgagaaatacagaggcagtggctgtcaacctgcaaacccatcattaaatcccattccattcaaaatgttttactctcatcctcattcattctcttaggaagcggtggccctcacgcccttgtaatagtccccgtattattttcttgtttgtgttaagataacaaataaagtgaaaattgatacttagtgaaaaatgaagcattatttgtagaaaattattt

SEQ ID NO: 51983 - DNA, 601 bp, Human
aggtaaaattaagccaatgggttctccaattgtggcatttctttttactgagtgtgtagtacaaggaagatagagtcatttttaactttatttttattattgtatagtattttccaaattttccttctctgtaaaatattcattaacagaaacttggatagagttttttaaaaatccagagatccattttcaatgctgttgtacatgtgttgttgaacagctccacttttgctttaaacaatttccttaaatgcctatgaaaaaattaaggatacataattttgaattctcttaaagtacaatacaattctttcaacgtgtgttttgtaaaaaacatctcaagttaagtaaacctcagtatctttattattctaaaattatcagtaagcaattccctttggttttgtcttgaaaaagtctcttgtatagtcttcattatgttgtgtttttaaatgttaatatgcatattttctatatatgtaaactgtggctggtaagaaataagctactctagcatatttggtaaaatatgtgttatacaatgtaatcacatttttaaagcctgaaattcaaagattaaacaactcccagtgatcaatag

SEQ ID NO: 51984 - DNA, 601 bp, Human
tttttttttagattaacctaaaatctgtagattatgatataattatatgatatgtaattatagtaaacctgattttgattttactcagattcagaagaggaaatgaaagcattagaagcagatttcttgaccaatatgcatacatcaaaggtaactttttcttttctttaaccctgagttgaagaacatatgaactttcattataaacatggtatccttttcccatagtaataacttctcatcaagattgaaaagttccttgagaggcatttcctttttgaaaaaaaaaatttcttttagttaaaagaagttaaaggtgttgatatgacaggcaaagaaattataattctatcaatcagcatgttgcaattttaattaattgccacacatatttacttgcctgtaaatgtttttaaaggaacttgcttccatgccttttacattgggtatgatgaaaggtatattggtctcaagttaaatgaaaacaaagtgagctctttgccttttttattatattgggggaaacaaaaaggtgttcctaaattagaaataaaagttcatgacaacctgcaaaagaaatgtagtatagaggggatagcaa

SEQ ID NO: 51985 - DNA, 601 bp, Human
aaactggaataaaacataaatatttgtatttaaatatattaggcaaataaaaatatatttttatgtacataaaatatatttttatgtatattttaatgtacataaaatatatttttatgtatattttatgtacgtaaaatatatttttatgtatattttatgtacgtaaaatatatttttatgtatattttatgtacgtaaaatatattttatgtatattttatgtacgtaaaatatattttatgtatattttatgtacgtaaaatatattttatgtatattttatgtacgtaaaatatattttatgtatattttatgtacgtaaaatatatttttatatatattttatgtacgtaaaatatatttatatatatattttatgtatgtaaaatatatttatatatatattttatgtatattcttatgtatattttatgtatataaaatatattttatgtatattttatgtatataaaatatattttatgtatattttatgtatataaaatatattttatgtatattcttatgtatattcttatgtatataaaacatattcttatgtatataaaatatattttatgtatcttttatgtacata

SEQ ID NO: 51986 - DNA, 601 bp, Human
gaataaaacataaatatttgtatttaaatatattaggcaaataaaaatatatttttatgtacataaaatatatttttatgtatattttaatgtacataaaatatatttttatgtatattttatgtacgtaaaatatatttttatgtatattttatgtacgtaaaatatatttttatgtatattttatgtacgtaaaatatattttatgtatattttatgtacgtaaaatatattttatgtatattttatgtacgtaaaatatattttatgtatattttatgtacgtaaaatatattttatrtatattttatgtacgtaaaatatatttttatatatattttatgtacgtaaaatatatttatatatatattttatgtatgtaaaatatatttatatatatattttatgtatattcttatgtatattttatgtatataaaatatattttatgtatattttatgtatataaaatatattttatgtatattttatgtatataaaatatattttatgtatattcttatgtatattcttatgtatataaaacatattcttatgtatataaaatatattttatgtatcttttatgtacataaaatat

SEQ ID NO: 51987 - DNA, 601 bp, Human
tatattaggcaaataaaaatatatttttatgtacataaaatatatttttatgtatattttaatgtacataaaatatatttttatgtatattttatgtacgtaaaatatatttttatgtatattttatgtacgtaaaatatatttttatgtatattttatgtacgtaaaatatattttatgtatattttatgtacgtaaaatatattttatgtatattttatgtacgtaaaatatattttatgtatattttatgtacgtaaaatatattttatgtatattttatgtacgtaaaatatatttwtatatatattttatgtacgtaaaatatatttatatatatattttatgtatgtaaaatatatttatatatatattttatgtatattcttatgtatattttatgtatataaaatatattttatgtatattttatgtatataaaatatattttatgtatattttatgtatataaaatatattttatgtatattcttatgtatattcttatgtatataaaacatattcttatgtatataaaatatattttatgtatcttttatgtacataaaatatatcttatgtatattttatgtatataaaa

SEQ ID NO: 51988 - DNA, 601 bp, Human
caactgacgaagttggataaagcaactttcatccctctattgagaattagatccttggaatggttttcatgtcaaatcagtaactgacttaattgaatataacattttgttacctttgtggccaaacttggtttaccagatcaaaaactatatttattgtaatatattatatatttcatccttttggtgtttccatcataaattgaagcctgaaaagtactcaaaggtctatttgatgcttttcttcaaagggctggattagtgtacggccttgaaatatatagttagtaaagtttatagmaattttttaaaagagctagcctggtgaactaggaagaatactgaactgagtcagaattaccatgttcttatactatttcagccactgaatggccgtctctcctttgaaaaaacaatttctttgaacttcatgtatctcgtatctcacctacatatgtcttgctgtcttaacagcaaatgagatagaatgtagaaaaatgctctgaaacaaaagagtttattcatgtaagtttcacttattttatctctatcttgcagttaatccaggaagatattcttgatactggaaatgacaaaaatg

SEQ ID NO: 51989 - DNA, 601 bp, Human
cataagaatgaatattctatcataatttagattcatcattaagatcaatggcttactcaaaaaactttcaaagcatcaaatatgaggcctaaaaagatagagggaagtaaagccggtcctaaaatttaataagtccaagattccctctgaaacccaccagtccttctcaccctctaacttaaattgctttagagtcctggggccataaaacagttgctgacttccctggggaaagggggaaacaccaccatctcagacaggtactaacgaaaaagctttcccagccacaaaaacagctttrcacttcaaacagctcccaccgccgcctcaccctcaaattattcctggggtcctataatcctggagttatttggagggacagcgatgtttgccttggcctttcaaagatgcgtttctctagatcccaaacaggaaccagacagaaggcaaagcgtctgtccgcttggatgtcccaccgctgtcaggcatttaatcaccggccagtgtcccctgacccgcgcgacacatggcgcatcaaccgcatcgcagaggaagtctgccccttcctcagcccctacggaagcgcccgggctgcaaggcc

SEQ ID NO: 51990 - DNA, 601 bp, Human
tacctttaagagacaaaggacaaaacctaaatagtagcacagacccttacagcatctagaattcaaaggagtgacaaactttgtgttagtaacttgctactttccaccacttatttgaaaagtgttagacttaggtattatgtatggaaaagcagtctacacatatatatcctaacatataacatacatatcaggaagccataaacatcagctcgccagtggtaaataatacttcgccaacagagtactaatgaagcttcagaaggcctcacattcagagaaatcaagttataatgttggyattaaggctctatttgcccctcaggagttttattttcacattattaacatccagaaataatcgtcaaactttagcatgttactagccctgtatattgaactgaatctagagatgtttttatccaaaggtgtagctttaaaaggaagttatgaaatccaaggagagagaaactctaagaatatgtttgacttgttaagattaagcatatcattaataaactttcacttaaaggtaaaaaaaaaaaatcctcaaaatgttggtatcatttccagactgtcctgtcagcatcagaacttacag

SEQ ID NO: 51991 - DNA, 601 bp, Human
tgaatgaatggcttcattttacacaccagagaaatcttaataagaatatgttttaatgtaagccagtcattttaagttcatcacttattacaaaaataatctttcctttaaatcaattatagacacctgcccataactttcttaaagtctgtgttgttgtacacgtaatagcatagtgttgttacattattgttgctatcaaaagaagaactgaagttaaaatataattattctaaaatattcatgttatgaaaaatgtttaaaggtcagttatcagcatttattccaatttcaaatttgraataaagttctagttcaaaaacaatttgctgcaagtcctctggaaactttcagtaatgtttatttacaacaaagaaggtaagacaagcgtttataaaaatctacagtctttggttgctttcttaataaaaatgtacacatcattaatcacatattgtgggttgtatgtctgtacacacatacacatatacatctaataatagtagtgataatagaaccgtcactgaaatactagaatcgtaaaagctgcttttctacagatgcatgcatttccctgttttaaaggtcttccttatgaatg

SEQ ID NO: 51992 - DNA, 601 bp, Human
ataaatcatttgtttattcatgttaaataaatttaatatgtacattaacttctgacttaacttaaaagtatatggaatgttttccagagactattttgactgtgtcaattaccctagataccaaagttgttgtattgtgttgcttgatgaaataggacatagatcaaccctcaaaaccagtattacaagcctggcaaatagcatcacatttgggtgacgcacagaatccatcaccctagggaaaaatgcattgggtcatagtacagagtctttacatgttccatattatttctacataacrttttgagatgatagaattgtaaactataaagtggtagcccataaagtgatatactcacaaacagtcctgtcccttaactgctcctcttaacagaaatgagacttaaaaaatgatctcagaagcatttcttacaatacactgaaaggtggcattttgatttataatttttttcatttaaaaaaattccttagtaaattcagagcagatataagtattatgataacaattgattcattatgtttaaactccatactcatttcaaacttttagacttcataatgtaggtcatgttaactcctt

SEQ ID NO: 51993 - DNA, 601 bp, Human
gacacagtgaaggtgcaagattgtgtacacatatttacacataaaatgtgtacattattatttttaccaatgacctaaaatcatcttactggcagctttcttaaagcttatcaaagtaaaaagaaaaagcaaaatatgttataaataatgagggcattccttcaaaagcacaagttttcttaaaaacgggactttaaaaatagaataaacagtgatgggatagagtaaaatagtttattataattgaggtttagatgacagtgagtttcttacagtaatttaccacatcatacatccaaakaatgtaattcaaatgcattataaatacaaaggagaaacatctcttagtgttggtttataagctacagaaaatagtatttcatatttttcaatccttgaatgtgtaactacttactgactacttgtaaattattttctaaaacttccctaagtttgcagaactgaggagcaaattttgcaataatcttctaaaaaggtatacttccaatattaatttaaagacagcttaacatattccgtattttttaatttataatttaaatataattactaatataaaaattcagcagccaaacacagg

SEQ ID NO: 51994 - DNA, 601 bp, Human
tttcataaaaggtgatcactctgagtatttctacctgatatgatattcatgtcgtagctcctaaaaatcagttacaaattccaaacctcagaactatccttaatagatggctactattctagtttgcgttactccctcgacttgatggaagtacaatcatttattgaactacactagctcaactcataaatacgttaagaagcctgtgactgatgttattgaatttataagctaccagaaacaagtaaactccttactgtagacctcaaagagttgataacatgacacttggcattgtacytcttgggaatctaaaacatactgatggtgagaatctttcaagtattcttctgccctaaatccagaaaacatgactttcaagcatcatccatggtcgaatggtcaaattcacatttataaacttggaatagagagtttggtggaagtactgcataactaaaattgactttttttaaaagccagaactatgtcacagttggtgcttataattgtttcaaaattatacaactttatttaattccatgcaacgcatttccacatagaaatggaatagcaaactcctactcaatagcaaacaata

SEQ ID NO: 51995 - DNA, 601 bp, Human
aaattgcatccatattgtactgtgaagtcatggctaaaaatggaaagttgagaaattttaaaagaaaaatagaggcattaaatgtatattttaaattattttcactacatttgaagttgaaatttatcattcaaaagacaggattcataaggaaagtatttaaaataaatgaggttcttttatttttctttcattagttttttataaatgctgaggagtttatgtaaaacaccacttatggtttttccagccagattttaataactaattgcacatttcaagcctaatctcacagatgccrtctacagtttttcaacctgccaagggaactatgactgttatgaataaagaaacatccatttcatggaagataaaaatatccttaattcaaatggactatttttaaaaatactactctctatatagataaatgttaaagctgctttaagctaaagggaaaagtaatacaaactagcttcttattagtgaccattttcataagcagtttttcagtaccaattagattttatctaaatgaatccaacattactattgctaaggtgtctgaaaaaagcattaagcctagatttttcacagtaat

SEQ ID NO: 51996 - DNA, 601 bp, Human
agaacttatgcaataccagataatctttattttcctctgaaacctgacaaaccaatttcacaattttctcagtacctgaaagtctatgttgccagccaaagtgttcttcccctatgttcctatttaatgcaacacttttgagaactactgcatccaagtcatttgtaaagggaacaaaaatgaattacgtatgctctcactctcctcaggttcatgatgcccggtagcttctggtatgagctatgctaaagccacacataaacaggagcacaaggcggggatgttttaacctaaatgagcrgaggtagagcgtttcaggaagaagaatacagaagtgaacatgccgaggaacagatagaatccctgtagttaaggttgcgtagaaggcatttcataaggagggaagaatatgaacaaaagtcggtgtgagaatgttctaggactagaaagcactatagtaaggatagacacatgatgtagtacatttggaactggtaaattgggggcaaactgaagggtcctgaatgccaaattaaggatgataaacaagtttaaaagcaagtacttacggaggctgaaggccactgatatgggaactcag

SEQ ID NO: 51997 - DNA, 601 bp, Human
tagggcaaacatcaagaaacatctagaacttatgcaataccagataatctttattttcctctgaaacctgacaaaccaatttcacaattttctcagtacctgaaagtctatgttgccagccaaagtgttcttcccctatgttcctatttaatgcaacacttttgagaactactgcatccaagtcatttgtaaagggaacaaaaatgaattacgtatgctctcactctcctcaggttcatgatgcccggtagcttctggtatgagctatgctaaagccacacataaacaggagcacaaggcrgggatgttttaacctaaatgagcggaggtagagcgtttcaggaagaagaatacagaagtgaacatgccgaggaacagatagaatccctgtagttaaggttgcgtagaaggcatttcataaggagggaagaatatgaacaaaagtcggtgtgagaatgttctaggactagaaagcactatagtaaggatagacacatgatgtagtacatttggaactggtaaattgggggcaaactgaagggtcctgaatgccaaattaaggatgataaacaagtttaaaagcaagtacttacggaggctg

SEQ ID NO: 51998 - DNA, 601 bp, Human
tagccagagatttcctcccatagtaaggaactcccttttttgcattaatctcatgcctcttacagtttgcccaatgatcacaggtgaataagatttaaggatgagtagctgctgatgaacccaatttgggatctggcaagaggaaatcagagcgtcaaatcaaggaggggtggcagcaaagaggaagcaaaagagaagacaagaggaaagagagtttatggagagaggaagccaagttgggaagtggggagaagggcaggctggccaggggatgcgacgcgacagggcagagggagtgggragaagcgggcaggaggcggcctccacgcagctggcagggcaggcagcgctgggagagggaggaggagagggaggctgcaggcaccgcgcagcagccgaggatgagagaggtaaccggagggaacgggcgcacacaactgcttccgcaggacttcctgcgataacacgcccacagcccgggcgccgagcacgcgtggtggcggccgcaggcccggggctcctgcgagagcgaacgccagcgacacacacgcagctcctgtcgtgtcgccgctgccgcctaggcagggccgcagacagcagc

SEQ ID NO: 51999 - DNA, 601 bp, Human
tttcatgatatggccttactaatatggacttctagaaaaggaaattaatacagagggtgtaaaaagcatgtccgtaacaagaattaatttaaaaataagcttgatgatgtaaagaaggcaaaaacttgatagggatccacgtatagctactgtcttaaagttcataatttaagaaaaacataaaggcctcagttcccagaatgctaaaaatacagtagccttatatacatatatagccttagtcactccaaaaggcttcatgtgcttttgaaactattacataaggtaaattttgattaartgactttatttatagtttctgattgagaatgcatgagacacacacttccatctactcaagaatgtttgtgtaagtaaatatacttcaaaatatcagaaacactttaagcagctccttgaaaacgctatatgacaaagtacatgactaacttaaagactaataatattttcattaataaaatctagtactttatcacaattttagttatctccataaaaaatgggcaattttgttatattcatttgagattattttttcagattgtccttctttgccttattcctggactcattaataacc

SEQ ID NO: 52000 - DNA, 601 bp, Human
cctgtcacctacaagttaaaatggccacctcacatccagtcatatatcaactattttctttacctaatattaggtacactggaaatctcaaggcaaaatgaagcagttggatacaaattatatgaatcaatatagctcagtcattgcaaaatatctcttgtggaaaaatttcagaacagccctactaaaaatactaattttcatgatatggccttactaatatggacttctagaaaaggaaattaatacagagggtgtaaaaagcatgtccgtaacaagaattaatttaaaaataagcttsatgatgtaaagaaggcaaaaacttgatagggatccacgtatagctactgtcttaaagttcataatttaagaaaaacataaaggcctcagttcccagaatgctaaaaatacagtagccttatatacatatatagccttagtcactccaaaaggcttcatgtgcttttgaaactattacataaggtaaattttgattaagtgactttatttatagtttctgattgagaatgcatgagacacacacttccatctactcaagaatgtttgtgtaagtaaatatacttcaaaatatcagaaacac

SEQ ID NO: 52001 - DNA, 601 bp, Human
ttgtttatttattttaaaattaacgaagaaatcaagagataaatcctgtcacctacaagttaaaatggccacctcacatccagtcatatatcaactattttctttacctaatattaggtacactggaaatctcaaggcaaaatgaagcagttggatacaaattatatgaatcaatatagctcagtcattgcaaaatatctcttgtggaaaaatttcagaacagccctactaaaaatactaattttcatgatatggccttactaatatggacttctagaaaaggaaattaatacagagggtrtaaaaagcatgtccgtaacaagaattaatttaaaaataagcttgatgatgtaaagaaggcaaaaacttgatagggatccacgtatagctactgtcttaaagttcataatttaagaaaaacataaaggcctcagttcccagaatgctaaaaatacagtagccttatatacatatatagccttagtcactccaaaaggcttcatgtgcttttgaaactattacataaggtaaattttgattaagtgactttatttatagtttctgattgagaatgcatgagacacacacttccatctactca

SEQ ID NO: 52002 - DNA, 601 bp, Human
cccctacagaaagcaatactagaagttgaagtgttacaaattaaaaagaaggatctaaacttccttatgttgttttttgtttatttattttaaaattaacgaagaaatcaagagataaatcctgtcacctacaagttaaaatggccacctcacatccagtcatatatcaactattttctttacctaatattaggtacactggaaatctcaaggcaaaatgaagcagttggatacaaattatatgaatcaatatagctcagtcattgcaaaatatctcttgtggaaaaatttcagaacagcyctactaaaaatactaattttcatgatatggccttactaatatggacttctagaaaaggaaattaatacagagggtgtaaaaagcatgtccgtaacaagaattaatttaaaaataagcttgatgatgtaaagaaggcaaaaacttgatagggatccacgtatagctactgtcttaaagttcataatttaagaaaaacataaaggcctcagttcccagaatgctaaaaatacagtagccttatatacatatatagccttagtcactccaaaaggcttcatgtgcttttgaaactattacata

SEQ ID NO: 52003 - DNA, 601 bp, Human
ttcttttaacttgtattgtacatatctggagaacaaataaacttgaaaagaggtcaaagtgctcaaattatagaaaaatgcaaaataaaacaaaaagtttagaaaatactgtgatccacatttatgacaactgaagtaataagtatgccccccatactctaggacttgctcctccagccatgagaaaaatatatggtggacctaaagtctttattacttgaatattaaagccagtgtttctggtgctgtgctttcaatacctttgttctaataaggtaattatttagctaagacgtttgayggcaaactgtagttattaataattggtttagtattatttttatcataaggtcatggttttctcttaaacatattactttaaaaagagttgccgtgctaaatcatatattaaagggacaacttttttgtgacaaaacatctctagttttaaatactataacttatgaaatcaactcatgttatcaactgaaaaattctcccctacagaaagcaatactagaagttgaagtgttacaaattaaaaagaaggatctaaacttccttatgttgttttttgtttatttattttaaaattaacgaa

SEQ ID NO: 52004 - DNA, 601 bp, Human
ctgaactttcttttaacttgtattgtacatatctggagaacaaataaacttgaaaagaggtcaaagtgctcaaattatagaaaaatgcaaaataaaacaaaaagtttagaaaatactgtgatccacatttatgacaactgaagtaataagtatgccccccatactctaggacttgctcctccagccatgagaaaaatatatggtggacctaaagtctttattacttgaatattaaagccagtgtttctggtgctgtgctttcaatacctttgttctaataaggtaattatttagctaagaygtttgacggcaaactgtagttattaataattggtttagtattatttttatcataaggtcatggttttctcttaaacatattactttaaaaagagttgccgtgctaaatcatatattaaagggacaacttttttgtgacaaaacatctctagttttaaatactataacttatgaaatcaactcatgttatcaactgaaaaattctcccctacagaaagcaatactagaagttgaagtgttacaaattaaaaagaaggatctaaacttccttatgttgttttttgtttatttattttaaaat

SEQ ID NO: 52005 - DNA, 601 bp, Human
taaaataaggccttagaaatactattttgaatagtctaagcactcccatagttaatgacacacagaaattacaaagattagaaacagaacaatcattatcattatttatagaaataaatattcaatcgtttgacattcaccaaacctgttttacatgttttatctaaactgattcttccccccaaaacctgtgcccaggtactactactcacagcctatgggtgagaagactgcattctagagaaattatagaattactttaagactggttttattccaacagagccacttcacaaaaagraaaacatagctacaacctatgggacttctaaccatagctggacagaagtctattccagacaatcacatgtcccaaaaggcactgtgatgactgaactttcttttaacttgtattgtacatatctggagaacaaataaacttgaaaagaggtcaaagtgctcaaattatagaaaaatgcaaaataaaacaaaaagtttagaaaatactgtgatccacatttatgacaactgaagtaataagtatgccccccatactctaggacttgctcctccagccatgagaaaaatatatggtggacct

SEQ ID NO: 52006 - DNA, 601 bp, Human
acaaatatttttaaaaaatgatggcacatgtcattaaaggcccaaagaacaaggcaaagatgtacaatgtgaaaaaacaatgcaaaaatacttcttgcaagtttttccaatttagaccttgaactcggcactattgaataccaaagcttatagaactgaaattcaaacataacagagcttttgaatttaaggcatgtattctaccaaaggatgacactgagctagccttttgggataatataatgccactctttctacaatagctgacggctagaatgctcagtttgttcctgtccgtaawtatcctaaatataattgttaaaattaaaaataaaataaggccttagaaatactattttgaatagtctaagcactcccatagttaatgacacacagaaattacaaagattagaaacagaacaatcattatcattatttatagaaataaatattcaatcgtttgacattcaccaaacctgttttacatgttttatctaaactgattcttccccccaaaacctgtgcccaggtactactactcacagcctatgggtgagaagactgcattctagagaaattatagaattactttaagactggt

SEQ ID NO: 52007 - DNA, 601 bp, Human
gctaatgttgatgttttgacatcctcccatgaatcatgaatgttcttaatggtatctcaaatgatgtatcctttccagaaggttttcaactcactttgtccagatccaccagaggaatcactatggcaggtatagctttatgaaatgtatgtcttaaataatgacttgaattttgaaatttctccttgatccaaggactgctgaaaggatgttgtgttagcaggcatgaacataacattcatctctttgtacatctccatcagagcttctggggtgactgcgtgcattgtcagtgagcagkaatacttttaaaggaatctttttccaagtagtaggtctcaacagtgcacttcaactattcagtaaaccatactgtaaacaaatgtgctatccttcaggctttgctgttccttttatagagcacagctccacagagtagatttagcataattattaagggtcccagaatctttggaatgctaaatgagcaatggattctacttcaagtcaccagctgcattagcccctaactagtcagcctgtcctttgaatgtgctcctttgtctccactgaaaatctgttgtttagtgtagccactttc

SEQ ID NO: 52008 - DNA, 601 bp, Human
atgtgtaatcccagcactttgggagactgagatgggaagaattccttgaggccaggagttcaggaccagcctggaaaatacagcaagactccgtctttacaaaaaattagaaaattagcaaaggcatgatggcttgtgcctgtagtcccagctatttaggaggctgaggctggaagagcccttgcgcccaagagttcaaggctacagagagctatgatcgcaccacaggacaccagcctgggcaacacagcaagaccctatctcaaaaaaagaaaaaaaaaagaaaagaaaacatatatgaatatatatatatacacacatacacattcaagacactacatacataatagtcatatatacgatatgaatacaaacagaaacacacagatggacctactgactcctttattgctgagcaaaaaaataatacagaactgtgtttaaatgacaaagatgacagaaaatcagtatcattcacagcctctgaaagtcttattttggaaatttttgtatgatttctagaacttcttccattatttaaaaacttacataaccaaaagagtaattctaatcatctcatcaatacactccataagcctcc

SEQ ID NO: 52009 - DNA, 601 bp, Human
tgtccaaattacacattcataaacatacgtggatataaactcaatgttatctttgagctaaatagattatacagatatcactgcataaagaagctctattttttcaactattgttgctaatgctgtccagctaccgtgatcagtttaaaaccttatatgccaaatttgttattattttataataacttaaattttatctgactaaaattgagccaggaaccaagatatggcaaaggcctttaattaaatatggaatgtggaaagacccaggattgcactgagccatcttcagttcatatakttacaatcagtagttctcaaatgcttgcagatacctcagatctatcccacatgctcctccctgattattaataaatcctttcttctccactccactcagtctgtgtccccagatccacctatcctaacaatgaaggacagaaaaccaatgcctggggtcacaatcagtaaacacatgtctattatagaccctatctcacccttgaaaatcccaagcagatcccatagctttacaggcttttgaattttgttttatcattattgcattattttacccccaaagattaaaacaaaagatcag

SEQ ID NO: 52010 - DNA, 601 bp, Human
tttgcctaaatgaatcttcatatatccaaatacatgttaaagaaaaaatgcattaaccactgtacttttataagaaaattacaaaactttcttttttcaaagactttaggctatagtcacaatgacactgtaggacacatgtatatatataaaaagaatgcacctatttcactaactagggaaactaaaatagagcaagaatacctcatggagcctcaaaaggcaaggggaattgattatttttcctttcataaccagtgagaggcaaatgtattaaaatccctgattggaataagatcayaatttcactgtgcaaattgagaaatgttaccatttgtttccctgcagaaaagtagtttttccttttgttttcctctcaaaacacacacacacacaattaaaatatctgcaatgacaactgttgattcacataggccaatctgactttacatttgcacacaagtcagtttcaacttcatccctacttctctgttaaacttaggctatttcaactggtctctgggcaaagagccaagcacagcacttaaattcaaaaagagtagctcatcgaagagtataaatgtttctatttatcttgatg

SEQ ID NO: 52011 - DNA, 601 bp, Human
ataaatgtcctatttgcctaaatgaatcttcatatatccaaatacatgttaaagaaaaaatgcattaaccactgtacttttataagaaaattacaaaactttcttttttcaaagactttaggctatagtcacaatgacactgtaggacacatgtatatatataaaaagaatgcacctatttcactaactagggaaactaaaatagagcaagaatacctcatggagcctcaaaaggcaaggggaattgattatttttcctttcataaccagtgagaggcaaatgtattaaaatccctgattkgaataagatcataatttcactgtgcaaattgagaaatgttaccatttgtttccctgcagaaaagtagtttttccttttgttttcctctcaaaacacacacacacacaattaaaatatctgcaatgacaactgttgattcacataggccaatctgactttacatttgcacacaagtcagtttcaacttcatccctacttctctgttaaacttaggctatttcaactggtctctgggcaaagagccaagcacagcacttaaattcaaaaagagtagctcatcgaagagtataaatgtttcta

SEQ ID NO: 52012 - DNA, 601 bp, Human
gcaatacttcaatggtagatcgctttttttataaactgcttcaaacttcgtaaactcaatgtcagatcctgttctttcctatccatttctatttaatttgctctctctgaattgactgttcccaaatttttaaagctatttttgaacatcttaaatcttgttgagttttaaatgtcaacaccttcaaacaacttccaccaaataaatctcttattaattcacatcaaactaatccaaaatgatcatttctattaacatatgcttcagagcacaaaagcccattaatagtcatctggacacyagaactaaccaaaagccctctgagataaaatgcacattatttagatatcctatttcaaaggttttgatgctagcccaaacacattttattaggcttttatttcatcttgctatgttctctagattttaaatatctcatttcaaatgcacttgtctaggtaaaaggagatagtgtggtaagtaagtaataaatgtcctatttgcctaaatgaatcttcatatatccaaatacatgttaaagaaaaaatgcattaaccactgtacttttataagaaaattacaaaactttcttttttcaaag

SEQ ID NO: 52013 - DNA, 601 bp, Human
acatgagtaaaaatcgtatggaaattgcatatccagtttctacacctgatttaaatcacctgctcgtgtgatcaagggcaagtccttttgcttctctgagcctccatctttacctgtacaataagggaatttgaataaattatttctaaaattcccccacctctgtgactctacaatagttccggttaatagcacttcaattttacctttaaaaagtttgcccaattgcactgaaagactacagaacagcaaaccaccggcgccaagggtggtttaaataccaccgaagcctatctttgcytcaatttctcacttcccccaatattcattcattcagtaaatatatccaacctcagttatgtgccaaacacactaagcaagatgactttaattttattatttgtcattaatttaagaaagaaagatatgcttaaaaagcaaagaaaatgactataaggaactcctcaaggaaaactgacacttctgagtatctttctaaatataatttcataaacaaatatgtgtgtgcatatatatgtacagacacacacacatcacattctgaacaagactctaaaaaatcaggagggcaagatcctgt

SEQ ID NO: 52014 - DNA, 601 bp, Human
attctataaattctatattctttgtagtatcttgaccctaagcaaagtaaagaatcaaaacatgagtaaaaatcgtatggaaattgcatatccagtttctacacctgatttaaatcacctgctcgtgtgatcaagggcaagtccttttgcttctctgagcctccatctttacctgtacaataagggaatttgaataaattatttctaaaattcccccacctctgtgactctacaatagttccggttaatagcacttcaattttacctttaaaaagtttgcccaattgcactgaaagactayagaacagcaaaccaccggcgccaagggtggtttaaataccaccgaagcctatctttgcttcaatttctcacttcccccaatattcattcattcagtaaatatatccaacctcagttatgtgccaaacacactaagcaagatgactttaattttattatttgtcattaatttaagaaagaaagatatgcttaaaaagcaaagaaaatgactataaggaactcctcaaggaaaactgacacttctgagtatctttctaaatataatttcataaacaaatatgtgtgtgcatatatatgtaca

SEQ ID NO: 52015 - DNA, 601 bp, Human
tgagcaaatctggagcaagatcctctccctccccagggttttaataaagcaacaagagaaggaggaacatgatataaaaggttacaggacataagtcattttcataacagactgtgatgttggtgaaattatttaacctctaaaaccccttcaaccctaatgaccataatacttaactacattggggtggggataaaagatcttaatttgtaaacaccagcaaatgcttttatagggaaaatcttaaagcaattaaaatacgtaatcacaacaatgaacacagtcattagttttggcaacwctattttaaactttatcatcctactacatagcaatatccttcatgcagtctaccttacccctggaaaagttcaaaatgcccgttagagtaagtctactatgaattgccattttagatgatgggctaaaagtgaagttgagaaagaggaggtaaagaatttaaaggagaacagcaaagctcaaaattgctattttaagtcctctatttaattgtgagattaaaaattgacctctggggctatgtaatagtgagcaggcctacattacattattctccacctgaacagcccatataatgaga

SEQ ID NO: 52016 - DNA, 601 bp, Human
gcctgaaagatataaaagcatgagcaaatctggagcaagatcctctccctccccagggttttaataaagcaacaagagaaggaggaacatgatataaaaggttacaggacataagtcattttcataacagactgtgatgttggtgaaattatttaacctctaaaaccccttcaaccctaatgaccataatacttaactacattggggtggggataaaagatcttaatttgtaaacaccagcaaatgcttttatagggaaaatcttaaagcaattaaaatacgtaatcacaacaatgaacayagtcattagttttggcaactctattttaaactttatcatcctactacatagcaatatccttcatgcagtctaccttacccctggaaaagttcaaaatgcccgttagagtaagtctactatgaattgccattttagatgatgggctaaaagtgaagttgagaaagaggaggtaaagaatttaaaggagaacagcaaagctcaaaattgctattttaagtcctctatttaattgtgagattaaaaattgacctctggggctatgtaatagtgagcaggcctacattacattattctccacct

SEQ ID NO: 52017 - DNA, 601 bp, Human
tacatctgcaaaacaaagcaaaagaaaaattttccttcctaaatgatgtaaacatattttcatgtatcacacctaaaatatattaatatgctggcatcataggctgcctgaaagatataaaagcatgagcaaatctggagcaagatcctctccctccccagggttttaataaagcaacaagagaaggaggaacatgatataaaaggttacaggacataagtcattttcataacagactgtgatgttggtgaaattatttaacctctaaaaccccttcaaccctaatgaccataatacttamctacattggggtggggataaaagatcttaatttgtaaacaccagcaaatgcttttatagggaaaatcttaaagcaattaaaatacgtaatcacaacaatgaacacagtcattagttttggcaactctattttaaactttatcatcctactacatagcaatatccttcatgcagtctaccttacccctggaaaagttcaaaatgcccgttagagtaagtctactatgaattgccattttagatgatgggctaaaagtgaagttgagaaagaggaggtaaagaatttaaaggagaacagcaa

SEQ ID NO: 52018 - DNA, 601 bp, Human; identical to SEQ ID NO: 37218

SEQ ID NO: 52019 - DNA, 601 bp, Human; identical to SEQ ID NO: 37219

SEQ ID NO: 52020 - DNA, 601 bp, Human; identical to SEQ ID NO: 37220

SEQ ID NO: 52021 - DNA, 601 bp, Human; identical to SEQ ID NO: 37221

SEQ ID NO: 52022 - DNA, 601 bp, Human
agctttcatgcataataactatgttgggttaatttgctgctccacagaaataattctatctgtggaaaatcacaaactaagatggaatttttagagaactttaccaagatgaaactggtgttttaagagttctttatatctcccttaaagtgataagattgccattctgacatttaaaggaccaggaaatttctcttctgattcttcttacaagtattgcaaaatatgttcactacctgttatttacaacctctttgcctgcttttcttaattggtattaggtcaatagagaggtctgagrcaaatgagctgtagctatcaagtggataaaaatgactgatattttaagggatttatttcattagttctctgggtacttctaatcattcctaaaaaaagttactagtaaagctaatatgttttgaaatccccctggccttataatacaataaaaatctacaaactgtaacaaaaactaatacactttctcaagctgaccatgaattttgactatgctaaaattactaaaattaaatgtatacatttatttagactcagttccatgtttcgttctattcaaaatggtaacagtttctttttt

SEQ ID NO: 52023 - DNA, 601 bp, Human
cttccctcagaagttgtccctagagtgaacagactgaaacgcctgccggaaatccaggtattaacttcatattacttgctaattataaaacactgtttcacatactgacattattcacttccaacccttttatctaaaacaagtatttgcttcccaatcatagtttgacagcagagtgtatctgacataagacagtgaaatgatctttaatagacagcagttcaaagcatgtagctttcatgcataataactatgttgggttaatttgctgctccacagaaataattctatctgtggaaawtcacaaactaagatggaatttttagagaactttaccaagatgaaactggtgttttaagagttctttatatctcccttaaagtgataagattgccattctgacatttaaaggaccaggaaatttctcttctgattcttcttacaagtattgcaaaatatgttcactacctgttatttacaacctctttgcctgcttttcttaattggtattaggtcaatagagaggtctgagacaaatgagctgtagctatcaagtggataaaaatgactgatattttaagggatttatttcattagttct

SEQ ID NO: 52024 - DNA, 601 bp, Human
tatcttaacaagattatgttcctgcatgctctttcctaccactttttgtcttcctcggtgtgtgctgcaaggatttagcagacagcatagtctaggatcagctgttttatttctagttctattagttcaaactcagatagctcacacatctgttttacttctaaaatcactgcccaggaaaagtgtccagctccttctacccaaacataaactttactataaataactaagaacctaacaaataactgtttgggggaaatggaagtgtgtttaaaaatctgaattcttccaaactataggycttagtaattttcgtttttagagttttccctgacagcctagatcagcttccctcagaagttgtccctagagtgaacagactgaaacgcctgccggaaatccaggtattaacttcatattacttgctaattataaaacactgtttcacatactgacattattcacttccaacccttttatctaaaacaagtatttgcttcccaatcatagtttgacagcagagtgtatctgacataagacagtgaaatgatctttaatagacagcagttcaaagcatgtagctttcatgcataataactat

SEQ ID NO: 52025 - DNA, 601 bp, Human
atattacatgaaaagctaaccaatcatgctgcatctatgatttttacaaatttaagcatgacaactgatagaacatgctggataaatgaaaaattggaaaactaacatcctggtcaaatcaattagctctaagctagccattatagcttctcttgttttcttggtaaagaatttacatgtcttctgcttttaggactgggcatgctacctcaaggtgttggggggagaatctgataaatgccacactcagaaaggacagtcttggctttctgatggctatttacagtgacctccattatcyggctggggctctatcttctatgcagcacaaagaaacattgttatttggcagtatttttacaaagttgtaattctttgacttagtcatttgtgatctaatttatacaaaagtggatattatcagcacaagcatgtctaaatttcaattattcctccaagtatatttgaaataacttgcacttaaaccgggaaatcttcgaatttgtttaaattatgtacttcttttcccaactgtatatctcatatttgctctcaagtccattcaaattatttaaaaccatccatgtcaaaccaaaatata

SEQ ID NO: 52026 - DNA, 601 bp, Human
attctatagacagtctgaattgataaaagtctcattcaccagtttttctaaactgcaattgtcctcaactcagaaaaacaaagaaacagaacctgctaagatctacaacttccctcctactccagatcaaagaaaatgccaaggcaaaaaataaatgtttagaagtaaaattcaagacaagtcaaaataaaccacagtaagattaatggtctctgatttttttttcaaaccaaactgtaatcccctgctcaaacgattgtactgatacatgttaaagatctataaactcatacaattaaayctgttgaaaatacaaatccaaaggatgacttcctctctctaaaatctgttcttcctgcttctaacatgacatattgtgcaactctgataaaaatatttacaacacagaaatgtaacactcctagctcaaacataagacagtacttggtaagttaatcatgtgattcttctattagccttagaatttcattaagggccaaaataaatttaatagctggaaaccagtagctaccttcttaaagtcctgaataatgcagtaataaaaagaattcactaatatgaaaaggcaacatatatatca

SEQ ID NO: 52027 - DNA, 601 bp, Human
atcaataaggatttacttgaaagaagtgacagtaaaagaataaagaagggaacaatgggacacactgctcaagtgtttggggcgtgatatcaaacagaaatccaaggtaactccaagatttccagcctgacttagctgaaaacaggagtaaagaagaaaggaggcaaaaagaaagttgttgtggggaacttcacttttacatatgttgactttgaagtgccaatgaattccaaggtggagcttcccatcagctggaaaaacaggtcttggaacaaaccatcatttattataagattcccaratatgttcctggacacatgaaaggatgcaggcattctttaatcttatatcaacagttcaactaaacatgaaaggagaaatgctaggccaggagactctgtgaattcccaaactcctcactatgtcccacccgtctattgctttctgaattcaatgaaatcacacagctccaagcacagctggagaatccagcacactcaaattggacactctaaaggcattctgatttgttctctgcttccacacccattcctgcactgaatgtaggcggaggataaaaccttaattacacagccttgga

SEQ ID NO: 52028 - DNA, 601 bp, Human
gtatagtgcttcaaaaaaacattctagaatatagagtgtgcttcagtgatatacttttgatggagaataaatgtttcagaatctcaataacaactcaaattatatggcatcatctgactctcatgccatccatagcttatttctgaggtttattcctatcagtgacactgtaacaactcccttatttggatttataatacaagagccaaccaacggcaggggagggtacaggggaaaccaaaactcaaactcctacactgggcacattgaagaagaaaatactgcatattcctcattatgmagatttttattattggctttttgcataatagcaataaacagtttaccctaaactggttttctcattttactcagtataattctgaattaatttttctatattatctggtatttcagatgacagagtaccaataaatcttaaagtccatcttaataggccggggacagtggctcacacctgtaatcccagcactttgggaggccaaggcgggcggatcacctgagatcaggagttcgagaccagcctggccaacatggtgaaaccctgtgtctaataaaaatacaaaaattagccagatgt

SEQ ID NO: 52029 - DNA, 601 bp, Human
gagatgataaaaatgttccatagccttccttggccaatatggtagccactagccacaagtaggcttagtaaaaatgaagaactgttttttaaatttactttcatatatttttctcagcatttcactaatttatttgtaattaactgaaatgtatttattttaaaaatttcttttttagaggcagggtctcagtctgtcacccaggctggagtgcaatgtcacgatctccgctcactgtcacctctgcctcctgggctcaagtgaatcttcccaccttagcctccagagtagctgagacaayagacacatgccaccacacccagctaatttttgtattttttgtggaaacagggttttgccatgttgcccagactggtcttgaactcctgggctcaagctagccacttgccttggcctcacaaaatgctgggattacggcatgcaccaccatgcccagcctaaaatttaaatagccacattttgttagggaataccatattagatagcacactcaacagtaacatgtgcataggtaggattattatttaataaaatgaatcattcaagtaaatttttcctgcaaatgggataaagagattac

SEQ ID NO: 52030 - DNA, 601 bp, Human
tacatatatatatttaaatggatagccatcaatcaggttctttgttccggaacttaaacttgattcaaaagggataaattcagatgtatccccttctttaacacaggcaaagaaagaaagtatgcaaaatctagagataaaaattttcttgtttaagctttcacattgcatctgccttgccaagcttccctattataaaatgctttgaacttctgcttgttgacccaagattcccaagaaaccaccaggcatcatcactatttctttgattttgcaatctttaagcctcatgtgccatgaycacactgaaagggttgaacaaagagcatacatatacttaagaaatccctaaacatatgattctgaagtggatttaaattattactaagcatcccaacatactaaaaaggttgttgttatttaaaaacaacctaagaagtcagaaaacccaggctacgaatcaatactatcaggagaagggactacgaaagaaggcaactttgtgaaaaattatcagtaaagcattttggtttaggattaactaagctataaaaaacgagttaggtctttgaagttggtgtacgtgtctagatgtgttttt

SEQ ID NO: 52031 - DNA, 601 bp, Human
tattttgtttacctaaagcatgtgaaaaccctgttttcccagacattctcaagcaatgcctcagctgcatcaatagaaaaaccacttgtccaactgagctggtatctagatgtatcagaatgagtgcgtgtgcgtgtgtgtgtgtgtgcgcacatacgtgggtgtgcaggtccaagatgtgtgtgtgttctggctggtttcctcatgattaaagaaaatcatgaagatttctcaaaaaaaaagttgtccttgtccttttcaaaaaaagaatggactatctgatttttacatcactcaacamatgtacatgcacaatgtgcacatacacacatatccacgctagtaaagctcagaaagcagctgatgtctgcgagcctcagaaataaattaacatgcagctaacatcagaggagccagaaacactcattgcaagtgtgaacacatatttgatgcaggactgtgtctttcccagggctgaccttataaattaaacagtgtaaatctcaagtaagtgttttttgaacattttgattcactgtgaacattgggatgcccttcaaattaacatctcacattatgagcctattgttggacatgaact

SEQ ID NO: 52032 - DNA, 601 bp, Human
aaattctgacattattcagtaatagttttattcatattttatttcttgggggattattttgtttacctaaagcatgtgaaaaccctgttttcccagacattctcaagcaatgcctcagctgcatcaatagaaaaaccacttgtccaactgagctggtatctagatgtatcagaatgagtgcgtgtgcgtgtgtgtgtgtgtgcgcacatacgtgggtgtgcaggtccaagatgtgtgtgtgttctggctggtttcctcatgattaaagaaaatcatgaagatttctcaaaaaaaaagttgyccttgtccttttcaaaaaaagaatggactatctgatttttacatcactcaacacatgtacatgcacaatgtgcacatacacacatatccacgctagtaaagctcagaaagcagctgatgtctgcgagcctcagaaataaattaacatgcagctaacatcagaggagccagaaacactcattgcaagtgtgaacacatatttgatgcaggactgtgtctttcccagggctgaccttataaattaaacagtgtaaatctcaagtaagtgttttttgaacattttgattcactgtgaacattg

SEQ ID NO: 52033 - DNA, 601 bp, Human
gtatgttacaatagctcattatattccatatcttactaaatgtctttgatattttgcccctccttgctctctcttaaatattctgtctaatgcctcattttgattaattcatttgctctctttgtctaatatgtagtttaatcaatccatatgttttaagtttcgagagttatatttctcaattaaaacaatgttatttgttaattttttggtgatcttgatttttttttaattttactttaagttttggggtacatgtgcagaccgtgcaggtttgttacacaggtatacatgtgccatsgtggtttgctgcacctatcaacctgtcatctaggttttaagccccacatgcattaggtatttgtcctaatgctctccctccccttgcccccgactctccaacaagcccagtgtgtgatgtccccctccacaccgtgtccatatgttctcattgttcaactcccacttataagtgagaacatgcggtgtttggttttctgttcctgtgttagtttgctgagaatgatggtttccggctccatccatgtccctgcaaaggacaccaactcgcttttttatggctgcatagtattccgtggtg

SEQ ID NO: 52034 - DNA, 601 bp, Human
taggaaattatttatacaaatgtcaatggaattgaaactgtggctaaaatgtatcttattccaagacttgataactgttcttgcatagtattcagaagcattagttccgaaatttctaataaatcatgtatacaaataaaggtaatattgctttgtgaggttttatttgtttgtttgtttgtttgtttggtgaactataacatcctgggtaactttttgtctcatagtgggtattttctaattgaactatcatgtttatttcaaggtattataagcaactgatttattaggtattattttkaaaaatatgacacataacatacacaaatttaaatgtaagatagagattgagcaggagctaaattaatttgactacctactgcaaccaatgtcaactctttcagtctgattttacccattttacgtctggaagttgcaagcactgtttaaaaattttaaaatgcattcgtaaatctcctaatacacagtcttgtcatcgcatacactaccaaaatatgtgtgtagttttccacattttagccaacaatgaacattttaatatttgtactagaccataattatattactgagtttgtagtag

SEQ ID NO: 52035 - DNA, 601 bp, Human
cacaaagcaaaattattttcaaacggtagactctcagttcttactggtgaaacgaccaaccacatgtaagcatgtagactcttaaggagaatgcttaagcttcaaactttggctctgtattctacaatgtaagtaacttcgaataatttactgaacctgtctcagtttcctcatctgcaaaatgaaaataaagttgtctcctgatatggttcttgtgcataataagtaaataaatgagagttaatcagtataaatcctaaaattaaataaagcccctctgttctctgtgaatccacattcygtactgtttctgcaagagtttaaacttacaaactggtgttttggtatcattcattgccattcccccatgtaccttaaccatgaccaaaaaaaaaaaacatttttaaaaccaagcttatgtcctagaagatcctttgctttaggacatggcccagtagaatatattctatgcttttctgcttcatctagcggcgtttaatgacatgaaagaatgagcagtttagccttttactgcttaattgtcaagctttactcttttttcattaatagcagtcagagccagtatcttcaaattctaaat

SEQ ID NO: 52036 - DNA, 601 bp, Human
ggttccttgacatggtgagatctctgcttgaattctctaaagaaatccatgcctataaattaaaactacaaattaccactgacacttctaccaaaactggtaactccagtgataaaatgccaaagaatcatagtgattctgtttcaagatatcaagactgtaaataccagggtgacaagaaggagaagggatcaacatatatgaaaagaaatacaaaattcctgtggaccacaaagcaaaattattttcaaacggtagactctcagttcttactggtgaaacgaccaaccacatgtaagcrtgtagactcttaaggagaatgcttaagcttcaaactttggctctgtattctacaatgtaagtaacttcgaataatttactgaacctgtctcagtttcctcatctgcaaaatgaaaataaagttgtctcctgatatggttcttgtgcataataagtaaataaatgagagttaatcagtataaatcctaaaattaaataaagcccctctgttctctgtgaatccacattctgtactgtttctgcaagagtttaaacttacaaactggtgttttggtatcattcattgccattcccccatgta

SEQ ID NO: 52037 - DNA, 601 bp, Human
gaaagcacttaacaaaccatgattgattttcaccccaagatggttataatggactcactgtccactttagcatatttgtggttccttgacatggtgagatctctgcttgaattctctaaagaaatccatgcctataaattaaaactacaaattaccactgacacttctaccaaaactggtaactccagtgataaaatgccaaagaatcatagtgattctgtttcaagatatcaagactgtaaataccagggtgacaagaaggagaagggatcaacatatatgaaaagaaatacaaaattcytgtggaccacaaagcaaaattattttcaaacggtagactctcagttcttactggtgaaacgaccaaccacatgtaagcatgtagactcttaaggagaatgcttaagcttcaaactttggctctgtattctacaatgtaagtaacttcgaataatttactgaacctgtctcagtttcctcatctgcaaaatgaaaataaagttgtctcctgatatggttcttgtgcataataagtaaataaatgagagttaatcagtataaatcctaaaattaaataaagcccctctgttctctgtgaatc

SEQ ID NO: 52038 - DNA, 601 bp, Human
ccaaaagaatgttcctattttatggaaggaaaattcaaaggtataaaacatgaaacaaaatctcaagtatttgttgagagtgcttaatgtagcatacaagagcttacattttgttgagtaaatatccatatttactttttacagaagattgtttccaatcttttccctatttttttcattgtttaagtagtaaagaaatatacaacaaatgacaaataatgggaggatgaattgaccataaaagcacaatagtaaaattaattccctcaagtggaaacagcctaacctttaacgtgaagaygattatcaacaagaggaataatcttgccaccaatgtcaaggccagaaaattcaaaaacaggactaagaatacaaaagacaatagacaatacctaaaatctaggacctagaacctctgtggagctcatctacaaaagcttcttatcaaaaacacattctaggcagggcctggtggctcacgcctgtaatctcagcactttgggaagcagaggcgggcagatcacctgaggtcagaagttcgagaccagcctgaccaacatggtgaaaccccatctctaataaaaatacaaaaattagctgg

SEQ ID NO: 52039 - DNA, 601 bp, Human
ctgaaattccaaaagaatgttcctattttatggaaggaaaattcaaaggtataaaacatgaaacaaaatctcaagtatttgttgagagtgcttaatgtagcatacaagagcttacattttgttgagtaaatatccatatttactttttacagaagattgtttccaatcttttccctatttttttcattgtttaagtagtaaagaaatatacaacaaatgacaaataatgggaggatgaattgaccataaaagcacaatagtaaaattaattccctcaagtggaaacagcctaacctttaaygtgaagacgattatcaacaagaggaataatcttgccaccaatgtcaaggccagaaaattcaaaaacaggactaagaatacaaaagacaatagacaatacctaaaatctaggacctagaacctctgtggagctcatctacaaaagcttcttatcaaaaacacattctaggcagggcctggtggctcacgcctgtaatctcagcactttgggaagcagaggcgggcagatcacctgaggtcagaagttcgagaccagcctgaccaacatggtgaaaccccatctctaataaaaatacaaaaa

SEQ ID NO: 52040 - DNA, 601 bp, Human
tttattatcaaattccctaccatcttctgctgttaaagagagaacagtgactgctacattaggacaaatatttgattaaaaaagaagaacagaagtattgcactgtaaaaagcatacccgaaagatacacaagtgatgtggaaaaagtcatattttgtttaactataaaaactgtgtatggctgtctaaataaatatcagggaaacactttctacttccctgatataacttgctatgaattaccaaattaaagtaacaaaataaattttgtgagctattacttaaagctgtaagatactgyaagttatgtactcatacatgtaattttagataatcatcaaaatatttccttgccaggcactgggtacacattggtgaataaaagatatatagtctttgcccacctgctgcttagagtctcgtcaggaatgactagacaggaagtttcacatgactataagtctattaagtacaaagagtgacaggtgctaagaatgaaatggatagtaattggtataaagggctgcgtaggtaatcaggaaggactttctgagggagatatatgaaatcaaagggtgaaaagaagctatccttggaggat

SEQ ID NO: 52041 - DNA, 601 bp, Human
tttaaatccatttagtgaattaaatattgctcactgatctgtaaagtctagaaaataagatgtatttataacccatgatttttctctaaacaaattctatccatctatgagaacgtaaacacattcaagaaattgagtgtctgttgagtgtcaaacaccataatagaggctttacaaatatattcattaaaagggtgtgtgtgtgttttctttttaaatggcataaaacaagacaattttattatcaaattccctaccatcttctgctgttaaagagagaacagtgactgctacattaggrcaaatatttgattaaaaaagaagaacagaagtattgcactgtaaaaagcatacccgaaagatacacaagtgatgtggaaaaagtcatattttgtttaactataaaaactgtgtatggctgtctaaataaatatcagggaaacactttctacttccctgatataacttgctatgaattaccaaattaaagtaacaaaataaattttgtgagctattacttaaagctgtaagatactgcaagttatgtactcatacatgtaattttagataatcatcaaaatatttccttgccaggcactgg

SEQ ID NO: 52042 - DNA, 601 bp, Human
actctgttcattttgccttgatagatgcagtttaccctgatggataatcatgaattatatcatttaagtcactattcttaagttttcacacctgatttaaaatgcccttttcactttctgttatttaaactaaattgaggatttttccccctgtagatacacttcaatttctaatgctgaaatgctttgtacagcttttccatatattaaaaggaactaaatttaaatataaaataataaatcattatcaaattattaaatgattttaaaaaagaaataaagtgttcttttctatcatcawatttaaatccatttagtgaattaaatattgctcactgatctgtaaagtctagaaaataagatgtatttataacccatgatttttctctaaacaaattctatccatctatgagaacgtaaacacattcaagaaattgagtgtctgttgagtgtcaaacaccataatagaggctttacaaatatattcattaaaagggtgtgtgtgtgttttctttttaaatggcataaaacaagacaattttattatcaaattccctaccatcttctgctgttaaagagagaacagtgactgctacattag

SEQ ID NO: 52043 - DNA, 601 bp, Human
acttgaggccagaagagtaatgacatgctgagaaaacaacaaatattgacaatgataaaaatgcagctccatgtatattcactggaggggagttccctaaattgaaccccctcttgaagggcacagaaactgtttctctttttttcccgaagttactcctaataaacttgcttcttccctgcaggaaggattctttgtttctctctgtacagggggcatctcctcttctgtattcaagtccttctcttagctccagggcatgactacagatgggaaagctaacagcttctataattaactrtgcacctctaaggggcgtttttcaactccgctagagaatactgagaagcacagataggcttcagagaatctgcaggaaatgagagcagagcagccaagcagacattgggaagagcaatttttctccccagaatacatccagagagaactcactggtctatgacccgcaggtcaaagcacctggctaatggaactctatttcccaactggatcttttgtaaaggttagctggtttctgatcctaccttctatgcacaaacaaagcttcaaaatcatccagagaagctcaaaactttcacag

SEQ ID NO: 52044 - DNA, 601 bp, Human
aatatccaataaaattggtgatttccaaaagcactattcaaatataaaatgtgaatcttaaaagatttaaattttattgcaaccacagaatgattcaatattcttccttttatatatgcatatgcatgtatttgtatatattaatgtaattttatcagatctctgaaatttagtagattacagcctttgaagataataaatcatagggttggaatttggctattattgtagaacacagctaaggaatctcttgtttaaggtttcctacttcagcagctaatgtggaggaactgaaaaggckgttaaaatgatgcaatagaaacttgaaatcagggatttaaggaagtggaggaattgagaaaaacaactttttagaaaagtattaacatctccatcttgctcaaaaaatgcaaccactacgctcaggttttttataccattgcttaataaattgtcatttcaaagtcttagagtatataaacaatggcagaaaaggtaatattccagaaacagtcaaacaatatggcgtcaaatgaagatgtcatggatgaaaccaattttaagtagaaaaaggaaggaaaggggttccagtgatatagat

SEQ ID NO: 52045 - DNA, 601 bp, Human
ttttttggcctttagtaaacatgacctcaaaattctgcttttttttttttttctaccactggtagggtaatgaattagaggtaggtaattcggtatgataatttcagaataccaactaataccaccaaagtagaattggtgtcaaattcacaatgagaatgggctgtttcttaattctgttaggtgtcttaaaaagctcatcatctaagatatgtacacattaaaaatttcatatacagctaataacctaaatgttgcccaataaattaaattggctacccttcctattccaaatatccartaaaattggtgatttccaaaagcactattcaaatataaaatgtgaatcttaaaagatttaaattttattgcaaccacagaatgattcaatattcttccttttatatatgcatatgcatgtatttgtatatattaatgtaattttatcagatctctgaaatttagtagattacagcctttgaagataataaatcatagggttggaatttggctattattgtagaacacagctaaggaatctcttgtttaaggtttcctacttcagcagctaatgtggaggaactgaaaaggcggttaaaat

SEQ ID NO: 52046 - DNA, 601 bp, Human
ttttaaattattacaggacatcttcactaataactatgcctctgaaactataaacttatagtactttttttttggcctttagtaaacatgacctcaaaattctgcttttttttttttttctaccactggtagggtaatgaattagaggtaggtaattcggtatgataatttcagaataccaactaataccaccaaagtagaattggtgtcaaattcacaatgagaatgggctgtttcttaattctgttaggtgtcttaaaaagctcatcatctaagatatgtacacattaaaaatttcatatacagctaataacctaaatgttgcccaataaattaaattggctacccttcctattccaaatatccaataaaattggtgatttccaaaagcactattcaaatataaaatgtgaatcttaaaagatttaaattttattgcaaccacagaatgattcaatattcttccttttatatatgcatatgcatgtatttgtatatattaatgtaattttatcagatctctgaaatttagtagattacagcctttgaagataataaatcatagggttggaatttggctattattgtagaacacagctaa

SEQ ID NO: 52047 - DNA, 601 bp, Human
tctatggtgtattttaaattattacaggacatcttcactaataactatgcctctgaaactataaacttatagtactttttttttggcctttagtaaacatgacctcaaaattctgcttttttttttttttctaccactggtagggtaatgaattagaggtaggtaattcggtatgataatttcagaataccaactaataccaccaaagtagaattggtgtcaaattcacaatgagaatgggctgtttcttaattctgttaggtgtcttaaaaagctcatcatctaagatatgtacacattraaaatttcatatacagctaataacctaaatgttgcccaataaattaaattggctacccttcctattccaaatatccaataaaattggtgatttccaaaagcactattcaaatataaaatgtgaatcttaaaagatttaaattttattgcaaccacagaatgattcaatattcttccttttatatatgcatatgcatgtatttgtatatattaatgtaattttatcagatctctgaaatttagtagattacagcctttgaagataataaatcatagggttggaatttggctattattgtag

SEQ ID NO: 52048 - DNA, 601 bp, Human
cttattcaggaaacaataaaattaatacagttgcatctgcataaatttatctaaaaaataaatacctttgtgtagatgtacatcataaaaaaaaacttgtcagaaaagtatacaactttacatgaatgctgactatactatactacttagtttaaaatgattaagaaacatctattggaatatataaaataatttacttatactgttggtacaggtaattttaaacatgttaacctcttcacagacctaaactttaaataaaaacactgggttttcaaaatattattagtaaatgttggtraccattttcaggaggtgattcatgttctataagatctattctagaaatgttaagataataaagttgtcatataagcttagactatttctagcaaagattctaaagcccttaatacttcttcctactaacacaagaaaatactcaaaaattttgtagaaatattgtgtgattaatatgcaaaaaaaagcctagttttcctagagcaatttataagatcaagtttatggcaatgtggcttttgtcatactcaaagcacagaagtcaacacagaggcatatgcaactgaaaatttttatatca

SEQ ID NO: 52049 - DNA, 601 bp, Human
atgagctccccctaaagactcacccaataagcttaactgtacttccgtattttattaacaaatgaaaaactacacaatgttggttaatttttttgtgaaatttaatgatcgatttttggatccttattcatgtagttatcagataaaaagccaagttttctgcaatggaatatccaatctaaaaattccattacaaaaataaaatccagaatttcttattcaggaaacaataaaattaatacagttgcatctgcataaatttatctaaaaaataaatacctttgtgtagatgtacatcataaaaaaaaacttgtcagaaaagtatacaactttacatgaatgctgactatactatactacttagtttaaaatgattaagaaacatctattggaatatataaaataatttacttatactgttggtacaggtaattttaaacatgttaacctcttcacagacctaaactttaaataaaaacactgggttttcaaaatattattagtaaatgttggtaaccattttcaggaggtgattcatgttctataagatctattctagaaatgttaagataataaagttgtcatataagcttagactatt

SEQ ID NO: 52050 - DNA, 601 bp, Human
cttttctaaagaaatttaaactggaaaccaagatcaatctcaaggagatttatctttcctctagctgcaagaaaaaagtgctctaataactacagcatttgaacctatggaagaacctgagctacaagttatctataacattccgttttgacaaataacatggaggagtttacctgaatgttgattttccatgagctccccctaaagactcacccaataagcttaactgtacttccgtattttattaacaaatgaaaaactacacaatgttggttaatttttttgtgaaatttaatgatcratttttggatccttattcatgtagttatcagataaaaagccaagttttctgcaatggaatatccaatctaaaaattccattacaaaaataaaatccagaatttcttattcaggaaacaataaaattaatacagttgcatctgcataaatttatctaaaaaataaatacctttgtgtagatgtacatcataaaaaaaaacttgtcagaaaagtatacaactttacatgaatgctgactatactatactacttagtttaaaatgattaagaaacatctattggaatatataaaataatttac

SEQ ID NO: 52051 - DNA, 601 bp, Human
tctcattaatcaaactaataaaaccaaacttctatacctatggaatatggaacgaatttgacaactttctactgtcaaaaatggtatataaatgtaaaagatgaataatcaataaataagaaaaagctacttcacttttacacggtaaaacagaactgtcatgttcactattacacataatgaatttgatacatggattgtatttttaaaatctaaactaaaacatatttgagtttaaatcatatatttttcaaatagatgtcaacagaaatacatctatatggcacagaagcagagacakgtacaaggatttttcatctctgcatatagtcaatagtttttaatcatttattttactctcaggcaaagaaaatatcaactgctacctaaagagaaactaccaacagggcctaaagtcatggcttcataaccagtgtttagagaggtatatacttcccatttttcctgatatagtctgatctctttggtattttacttatgcacatgtaaaaagtccaaatcgggtgagaaaacagttatgtacataaacattaagtcagtgctacctctttgataactggaattttgctttcattttaat

SEQ ID NO: 52052 - DNA, 601 bp, Human
agccaagcaaaagatagttatataggaaataatgaacagatactgcactaaaggataacatttcacagtagctgcaaacctacagtccaattcactaagatacatctgcttcacctgctttagaaacctgggccagcagaactatgccagacctcacaaacagcctaggttacaaaaacattgttgttgtcgtttttcaagtgctattaatgtgggtgggagtgtaaactagggcagccactatggagaacagtatggaggctcctcaaaaaaaccgcaaacagagctacatacatgatcyagcaatccctctcctgagtatttttccaaaggaaaggaaattagtatattaaagagacacctgtacccccatgttcactgcagcactattgacaataatcaagatacggaatcagcctaggtgtccaacgacagataaatgaataaacaaaatgaggtaaatacacacaatggaatatattcagtcataaaaaaagaataaaattctgtcatttgcagcaacgtgaatagaacaggcgaacgttattttaagtgaaataagcctggaatagaaagttaaacactgcatgttctcacttat

SEQ ID NO: 52053 - DNA, 601 bp, Human
aattccctgagattctatgtgctttgtctaccaagactttttttatgatcaagcatcagtcttgtataaaaatttaaactaaatgtaacactacaggcaaatgcaattcaataaatcatgttgtcagggatcttatcacttccttcacacaaaatatcattttaaccagaaatctattttaaaaatcttttccattttgtacctaaattctcataaaagtttgattcataatcagtaccttttttaatggtagcaaaattataaagtgtattttgcctttaaaaatagatatctatagtgyatatacttagcattttctggttattcatgatgttacacatatataaatttccatggtagaaaatggtttatccttttcctaattaatatgtccaaagtaattcttcaaaattaagaaactgccttgtttaaaagaggcaagttaacatataaaattacaagtgagagggaggcatttaatcattctgagatgaacaatgatgccaaacgctcaatttatcacaagtgtgctgtcatcagaaaaaaacaaaactaagattcctttgcttcactcctaaccactgatataaagctgtgttcc

SEQ ID NO: 52054 - DNA, 601 bp, Human
ggttatgagcagggactctagaattgccagagctagaatttaatgtctgccattataagcagtgtgatctaggcaaaatacttaatatccaggcctcagtttactcatttaaatgatggggataataatagtttcaacctcaaagagttctggtgaggatgaaaggaatccatccagtaataaattaatggaaaggtagtaagcttaatcctagaaactgaatgctaaattgacaaccagttataaatatccgtctattttaaccaaatattttttgtaatgctttcctatacaattgttytaaagtagtttcaccagattttcttttcttcattaagaattcaaatttaacacctacaaacaggtattcttgtgttacccaatgtatatagctacaatcagaaagttaattccctgagattctatgtgctttgtctaccaagactttttttatgatcaagcatcagtcttgtataaaaatttaaactaaatgtaacactacaggcaaatgcaattcaataaatcatgttgtcagggatcttatcacttccttcacacaaaatatcattttaaccagaaatctattttaaaaatcttttcc

SEQ ID NO: 52055 - DNA, 601 bp, Human
tggttttcatcttctttacagtatattgtattatccaactctttcacaataagcatgtatcacttatgtaatttcaaaaaggtattttgttttgtacatacacacataaaaacgtgtatgcttagatgaaacaaattaattctgaaactgtagaaagtcacccaagtatttattagcaaaccatattgaaccaaaagaggctatgcaatggttatgagcagggactctagaattgccagagctagaatttaatgtctgccattataagcagtgtgatctaggcaaaatacttaatatccargcctcagtttactcatttaaatgatggggataataatagtttcaacctcaaagagttctggtgaggatgaaaggaatccatccagtaataaattaatggaaaggtagtaagcttaatcctagaaactgaatgctaaattgacaaccagttataaatatccgtctattttaaccaaatattttttgtaatgctttcctatacaattgttctaaagtagtttcaccagattttcttttcttcattaagaattcaaatttaacacctacaaacaggtattcttgtgttacccaatgtatatag

SEQ ID NO: 52056 - DNA, 601 bp, Human
ttaataaggaatgtcttaaacatactaggatgtcactattccatggtataatgaggcacaaaaatgaacattgtgggatgtatttgttgatgagaaaagatgtccacaatacactgaaaaattaaaaaagaaaattataaaacagggaggtacatgatcctatacttgaataaaatatatatttaaatatacataaaggatacattagatgccaaaatatgaacacgaaagtatttacaggttggaatttatgagtggttttcatcttctttacagtatattgtattatccaactctttcrcaataagcatgtatcacttatgtaatttcaaaaaggtattttgttttgtacatacacacataaaaacgtgtatgcttagatgaaacaaattaattctgaaactgtagaaagtcacccaagtatttattagcaaaccatattgaaccaaaagaggctatgcaatggttatgagcagggactctagaattgccagagctagaatttaatgtctgccattataagcagtgtgatctaggcaaaatacttaatatccaggcctcagtttactcatttaaatgatggggataataatagtttcaa

SEQ ID NO: 52057 - DNA, 601 bp, Human
gcaaagaggacagatttttctatattaccagggaactttcaggtaggcaatttctgacactaagatttagataagccaaatatgtgcatctcctaaaatatagccagtattgccttcaattataccatgattttgcaaacaaatatacttctaaaatgttaacaagtaaagttttttttcactgttcaatgtacaaaagaggatgtttcaaaagttccactctgagtctttttttaaaaaaatagcaaataattatttttaagtaaagtgaatgtctctttcaaatgcagtgtttgtacawttttagattccatatagaagagtggcttaacttgtttgtcttaaacattcataaataacatcatacatctttttataaatgtatggttaagagtggcctgagaatctgtatttttagcatataggtagcacaaatgcaatgttaattcagaaagtattcttgcccctgcttcttcaaattttcataaaaaataataaaaatattctatagttagcaataatatattgcatatttcaaaatggctagaacagaggacttaaaatgttaccagcacattgaaattctgataaatactcaagg

SEQ ID NO: 52058 - DNA, 601 bp, Human
cctgaaccacagccagagttaaatgtggagcatacctacctccaaacccagctggaacctcaaaggttagtatatattttagactcttcaaaaatattttaatcacatgtgaatttgaggaaagctctgattttaaaaactcaaaaacactcagtagtcacacagcataaagttatgacagtattagctggataataaatttgtagaccacaaactgtccatccagacaatttacactttaaaaacatccaaccttcttagaattagtttgtaagtcaggcaaagaggacagatttttctrtattaccagggaactttcaggtaggcaatttctgacactaagatttagataagccaaatatgtgcatctcctaaaatatagccagtattgccttcaattataccatgattttgcaaacaaatatacttctaaaatgttaacaagtaaagttttttttcactgttcaatgtacaaaagaggatgtttcaaaagttccactctgagtctttttttaaaaaaatagcaaataattatttttaagtaaagtgaatgtctctttcaaatgcagtgtttgtacatttttagattccatatagaaga

SEQ ID NO: 52059 - DNA, 601 bp, Human
cactttctcatagaattattttctcattgtgcttactttcctttaacttcattcatcagcagccccttgacatgattcttttgcagcaaagttgtttccaaagaatgggctttcttgtacaagataagttcaaataatacaatttttgaagctttcagactgtatgtgtgacagttgcttataacttatggattctcagccactggttggaaatcatatttaagaatttgtagttcatatatatatatagatatagatatagatatagatatagatctagatctttggacatcagcatcaytacgtccaaaatataagattttgtcttaaagttgcctcgggtatcaattcatagatctgaatgtttaaggttttaaaggaaatttacttgactctagatttgcttgactctgcaattgtaaagagatttgagaaactgcatacttcaaactataatcttccaaagcaggaaacagtatatgaggcttgagtgactcacccagggtcacacggctagttagtcacaaagtgaatctagaacacaaagtctcctttcctccaatccagagcactttccactacatcacaagggaagagcaaa

SEQ ID NO: 52060 - DNA, 601 bp, Human
ggaaggagactttaagcatgtcactttctcatagaattattttctcattgtgcttactttcctttaacttcattcatcagcagccccttgacatgattcttttgcagcaaagttgtttccaaagaatgggctttcttgtacaagataagttcaaataatacaatttttgaagctttcagactgtatgtgtgacagttgcttataacttatggattctcagccactggttggaaatcatatttaagaatttgtagttcatatatatatatagatatagatatagatatagatatagatctakatctttggacatcagcatcactacgtccaaaatataagattttgtcttaaagttgcctcgggtatcaattcatagatctgaatgtttaaggttttaaaggaaatttacttgactctagatttgcttgactctgcaattgtaaagagatttgagaaactgcatacttcaaactataatcttccaaagcaggaaacagtatatgaggcttgagtgactcacccagggtcacacggctagttagtcacaaagtgaatctagaacacaaagtctcctttcctccaatccagagcactttccact

SEQ ID NO: 52061 - DNA, 601 bp, Human
tgaggaaggagactttaagcatgtcactttctcatagaattattttctcattgtgcttactttcctttaacttcattcatcagcagccccttgacatgattcttttgcagcaaagttgtttccaaagaatgggctttcttgtacaagataagttcaaataatacaatttttgaagctttcagactgtatgtgtgacagttgcttataacttatggattctcagccactggttggaaatcatatttaagaatttgtagttcatatatatatatagatatagatatagatatagatatagatmtagatctttggacatcagcatcactacgtccaaaatataagattttgtcttaaagttgcctcgggtatcaattcatagatctgaatgtttaaggttttaaaggaaatttacttgactctagatttgcttgactctgcaattgtaaagagatttgagaaactgcatacttcaaactataatcttccaaagcaggaaacagtatatgaggcttgagtgactcacccagggtcacacggctagttagtcacaaagtgaatctagaacacaaagtctcctttcctccaatccagagcactttcc

SEQ ID NO: 52062 - DNA, 601 bp, Human
tgggatgaaactgaattattcacatccattaaacagagtttgaatgattcacagccaattttatttttataattgtaatgaaacagctgggattagagtctattcatggactcataagaaatttgcaccccacctactaaaattagtttctgcatccaaaattctgatttgaacatctgactgtgaacaaaacaggcatcatcgctcaatgccaagaaactgaggaaggagactttaagcatgtcactttctcatagaattattttctcattgtgcttactttcctttaacttcattcatmagcagccccttgacatgattcttttgcagcaaagttgtttccaaagaatgggctttcttgtacaagataagttcaaataatacaatttttgaagctttcagactgtatgtgtgacagttgcttataacttatggattctcagccactggttggaaatcatatttaagaatttgtagttcatatatatatatagatatagatatagatatagatatagatctagatctttggacatcagcatcactacgtccaaaatataagattttgtcttaaagttgcctcgggtatcaattcatagat

SEQ ID NO: 52063 - DNA, 601 bp, Human
agggtttctatttcttagctatcactgcaaggcaattcaaaataatggaagccaagaaataatactgttttcctgtttctcaggagtctatatacatgatctggtaaagtgacctatgcttgccaataaactctactactgtgtggtcccatagaggagcctgactgttgggacgccaattctcaaaatttaaaatcgcaagcaagttgcaattattcagctataaacatactaaaagtggcactattgataatagcaaaaaatagaaataaatgtccaacaataagaaatcgatagacartttttctaggacaactagtacaacatatagtgaaatactatgaagtcaataaatatgatgtagcagaatatacgctgctataaaacagcgtgtaatttattagaaagtgaaattaaaagttatttaataataaacatacaaatctatgtttgcaggtgcatgtctatgtgtgtgagtgagcatgtctgagtgtgcatgtgcctgtgtgtctgtgtccagaagtaaatacattaaaaacgttgaaaacttattttcttctttttgcttgtttatattttctaaaatgtctataatgaacat

SEQ ID NO: 52064 - DNA, 601 bp, Human
tttgggacaactaagtcggttttctcaacacaatgtgatctgttcctctttaaacaatcataatcattctcgtctcccttcacctcttttatggaagtctgattgtattttagctgtcaccatacctgtcttatcacctacagctaactgtatataacttgagtacagaaatcttgatatactcattttcataccctttataagttcttccacagttcctgcctgaaacccagcaggtgctaaattaatatttatcggacaacaagaaactttagagaccagtatatcaggaattaactcyacaaagttatcctctgctttttctatttctatttctttcaagtttgagtacaggttagtttggtctagtgaatatctgttctttgaaaataaatcctgaatccatatgaataccaatatatttaaattcggacactcaccaacacgcattccaatcccacaaacagaagtgtgtcttgttaaaatttcatgaactaccaaatataatgaatctctagtgttatgaaaggactttgcctagagaagtctaatgcttggagaagcaactgaaaagagacaggacatagaatagttttgtact

SEQ ID NO: 52065 - DNA, 601 bp, Human
aggctttcagtttatattcaattattaaatgaatgttagttaatttggaagtcattccaactcctctattccctatgacagcctacgtttccagctatccattagatattttcatctgaatgccttacaaacttggtaagtacaaaaccagcttcattattttaccctcacagaacagctgactctagaattctgctaatgatacactgaaaataaatatacgccagactccgtggctcacgcctgtaatcccagcactttgggaggccgaggtgggtggatcacctgaggtcaggagttygagaccagcctaaccaacaatggagaaaccccgtctctactaaaaatacaaaattagccaggcgtggtggcgcatcccagctactcgggaggctgaggcaggagagtcgcttgaacccaggaggtggaggttgtggtaagctgagatcatgccattgtgctccagcctgggcaacaagagcgaaactccatctcaaaagaaaaaaaaaaaagaataaatatagtaaagcgtgtgaactttgaagccaggctacttggacatgatccagtttgatccagccattcactagctgggtgactt

SEQ ID NO: 52066 - DNA, 601 bp, Human
tattaagatatgtaacagtgttagcgattaaacaacaggtgatatatcacaggcaagcatttctcttttttcctcaattataaaataagacattaaacaagacttgaaaataagccactgggttaaatctaagagaaatgattagcgaataaatcagaacaccaatacataaaactaaaatttgatagttcttatatataatgaatctatccaacaggcatagtaaatacggcattcatttttaaatgggtattcaagaatcttttcatgtatatttttttctttgataatatgtatataygaccctaagtagtagggctattttttatttatatctgaataaacgctatttacatatatacacaccctacatatatatttatatatttaaaagaagataaacgttttgaagttatttacataattaaacaattaaatttttattttagactttgatttaaatacccaccttctgttctaaaacgtactcttcttttagtttagctggttacaataagatacttaaagcatgcatgtctttgtggtgtttctgaatcctatcaattacgaaaagactttgacatacccagaggatcttaaa

SEQ ID NO: 52067 - DNA, 601 bp, Human
tgatacagtattaagatatgtaacagtgttagcgattaaacaacaggtgatatatcacaggcaagcatttctcttttttcctcaattataaaataagacattaaacaagacttgaaaataagccactgggttaaatctaagagaaatgattagcgaataaatcagaacaccaatacataaaactaaaatttgatagttcttatatataatgaatctatccaacaggcatagtaaatacggcattcatttttaaatgggtattcaagaatcttttcatgtatatttttttctttgataataygtatatacgaccctaagtagtagggctattttttatttatatctgaataaacgctatttacatatatacacaccctacatatatatttatatatttaaaagaagataaacgttttgaagttatttacataattaaacaattaaatttttattttagactttgatttaaatacccaccttctgttctaaaacgtactcttcttttagtttagctggttacaataagatacttaaagcatgcatgtctttgtggtgtttctgaatcctatcaattacgaaaagactttgacatacccagagg

SEQ ID NO: 52068 - DNA, 601 bp, Human
gtacttattataacaaaacttttaataagcatatttttttcttaacattaaatgggtaaataggctagtaaaaagtcataaataggcctatctctcagatccaaattgtttacaagaactgaaagccttaaagcttggaagattttaatcaagacttccattaaccccctaccaatatcccagggatcgtaggaattttaaacaaaagggaaagcagaatgcttttaaaatgacttaatgtgatacagtattaagatatgtaacagtgttagcgattaaacaacaggtgatatatcacagrcaagcatttctcttttttcctcaattataaaataagacattaaacaagacttgaaaataagccactgggttaaatctaagagaaatgattagcgaataaatcagaacaccaatacataaaactaaaatttgatagttcttatatataatgaatctatccaacaggcatagtaaatacggcattcatttttaaatgggtattcaagaatcttttcatgtatatttttttctttgataatatgtatatacgaccctaagtagtagggctattttttatttatatctgaataaacgctattta

SEQ ID NO: 52069 - DNA, 601 bp, Human
aaactccaactgtattgttacctatttccaagactttcacccactatatagttaggttagctattatgacacaagtgcagattgattatgattagagttcatagtccttcaagtttggaaataactacttaaaagcaatctagatataaaacttaaaaggtttgtttaaaataatggaaaattggtatactcagggtagttcctttacttttaaaatgattataatacatcttcagacaattttcaaaagaactaccataaattctgtgatcatcacacaacgaagtgtggctgatttttkaaaagacattttaatttgtacttattataacaaaacttttaataagcatatttttttcttaacattaaatgggtaaataggctagtaaaaagtcataaataggcctatctctcagatccaaattgtttacaagaactgaaagccttaaagcttggaagattttaatcaagacttccattaaccccctaccaatatcccagggatcgtaggaattttaaacaaaagggaaagcagaatgcttttaaaatgacttaatgtgatacagtattaagatatgtaacagtgttagcgattaaacaa

SEQ ID NO: 52070 - DNA, 601 bp, Human
attttatataagaatgaacaattaatctgaataataaaaataaggcttatttataaaggttaagttgaatagtatatacatgcacatatatgcaaatatatataattcagatattttatctttcttaatgcttacatgactctaaactctcacaattttaaattaaaacataaatatgacataattgtaaatttttcagctttatacatcagcattttaccatcatgagaaaagatattctttttcttctttctaatttccccaaagttaaatttttaaaacatagtttactataaaaaaktatcaacaaattagcactgaataaattgttctttatttctagttaatttatttgaaaagttgatattttatgctctagtttctggcatgagatataaaacgtgccactgctctaaaaaatatatcagaaaatttttttccacaaatggcttttttaggaaaaaaaattataattaacaggatcaaaatttcacatagttccacatctctaaacttatatagaaatttaatgattacataacttcaaccatatcagcaaatacacttcttttactagcatgcatcaatatcctcccaatta

SEQ ID NO: 52071 - DNA, 601 bp, Human
cagatatggattcaagacaaaggcaagaaacagaatttggaatgagcacttttgcagtgacttaaaatttctaaatagcttgataacataaaatattccaaatatctaaagcaaggatccttgtcaagaaggtgccacccatcaggtcacaccaacaccatctgggcagagaaggggagcccatgccaggcacctctatcaatgtggacttctcatgtgctccttggtccatttctgtccctaacgtgcaatccactatgttaatataattccctgtgcctcctgcagctctttcagggcrgctgtgtagtagagtctaaatcctctttcagcattcatgatatatcagggattagagtattgaatacagtgatcttctagttgtaagaggctatggtttcaacacctctcatactgagagttttaaaccagttgtgttattttggggcaacttacttaacttttctataccttagtgccatcaataaaattgagttgacaatgcccagcatcataatgttatttggaggattaactgagatgatgactgtgactgacagtgactgtcctaattcctgacccattactgtacttcttccca

SEQ ID NO: 52072 - DNA, 601 bp, Human
gcttagggaagcaatgatttctgagttttgctgttgtttttgcatttttttctttcttctttttttttgtagccagctggtattcctaaggtcagaaaaacatatggaaaatggcaatattccagaaatcagaaaacagaaaaaaaaacagaatttgattaattttgtcactcattcttcaaaccacggacaatgactcttcactaagtaatggcaacttcaacctctatctgtaaaaatttaagacagctacaaaagttctaataaattgggataatcacacattttcattttgcctcgaagtttagtgagatgatatgttttcaagagatctgtaattaaaaatggtttagtgcctataatttcatcaaaccattctgtgaaaggaaagagataagatggaaaaatgaagagaaaaattgatgcaagaaactaaggcaataatactgcttcaaaacctgataggataaatgtaataatcattctaataccatatatgtttgtagcatttatgtctctgctttttatcctaaataaacccacgcatctttctcatttgagaaaatttacattgctttccctggaatatttcttgccaact

SEQ ID NO: 52073 - DNA, 601 bp, Human
accaatatgaactgagcttgcagagggaagggaagccaagcaccttaatcatgtgcagatcatgatcgacaaatccaaaaatatttttcaaaacttaatgatgaacgaagaattacgttttcccagtacgtgtataaatgccccttgagtaataagcagttataatacatcaagacgatagcagtaagaacaaaacaaatataacaataaaaagctccatgaaaggaggtatgagaaggtaaatttttgtaggcaagtataatttcaccctcttaacaaacattgtaattttaaaaaataraccaatgatattaaaaataaaaatcctaattctgtagagccatttaaacgtacttatatcaaagaggaagaccattccctttattttgaagctttcaatagtctctttactctgattgttccaatggataaagaaaatggttattcactttcatcaattttcctaacttttttcaatattttaaagaagttgtttatttaaaaaaaccacatttttaagttttagtacttaattcaaatctgtaattggaattatcaagaattgttccctcttctcttttccaaaataatccaaaactca

SEQ ID NO: 52074 - DNA, 601 bp, Human
tataataagaagtaagtaggtgtgagctcattctgatttattcctaggtctcacgcaccacaaatggtttatgtttattacccttgaatgttcagatatacacagaagaagtaactgccatgagagatatttctgtatggttcactactgaatacccagtacccagcataaagccctgctctcagcagacactgatatatgtttattgaatgtgtgaatgaatctagcttcatcacattcgatgccatatgagaaaatcattttagggcaatacagagtttataaatgaattaaaatttgraatcaaatttccaaagattttattttttaaaaaatgtcaaattcctgtaaaatcttacccttgaaagtgcccttgaaatgcactttcccccaggtgtacatcttttatatgaaaccaaatcatcaagttgttgacttcaataacagacaatggatggatgaactggccttttaagtctttttatacaattcctttactaacattatatacttatagaaatactgagtcataaatgtatacatttcaaatcttcatcttgactttcttgggaggcactaggttcccaaagcacaagaatga

SEQ ID NO: 52075 - DNA, 601 bp, Human
ccactaaggcatccaggcactggttttccatagaattcaaggttatagtttggcacaactaatcttgcttctcaatatttcttctcagtgctgcaaagcattttagcaattaagtatgaaaaacacttactcctggaagcataaaattcactttgtggatttatatcttcccattattggcctgtacttaatcactgctttttttcatcatctactcagtggggttctgtacaattaagatttttcaaatccataattacaattatatttctgtaacatagttttatgacaaattgcataygcttttggagttatcaaattatctagaatcaaacctgctagatataagaaagcaccgtgttaatgataaaacaactgctataactagaaatgataaagaatctttggaatgctaatgtggtatttttttaaaggataaggagatgaaatttaaaaccacttttacaaagatgctatacctaaaaaaattcatatgttaaggggtaacattgctatcagaatacccgtggttatcagctgccttaggggctcttgaactttattttaaatgtatccacatttcaaaatctactaaacacca

SEQ ID NO: 52076 - DNA, 601 bp, Human
aaggctttgcatttcttgctaacacagataaaacattgtatattattcttcaaatttgtgagatattctgtaaactctagtctaagaccagggataaaggacacatgatgataaaccatcttactataatttaacttaatctagcagtaataaagatagttgtaatttactgttaatattgggaaaggttgatgaaataaagctaaaatctcccactggcgttcaatcaaagctcttcaatttccagatgattataaatgaaaatcagaaaacaagccagtggggaaggaatggccagtcraggcttaagcctagctgttctacctcccctagataaagaggctgagccactaaggcatccaggcactggttttccatagaattcaaggttatagtttggcacaactaatcttgcttctcaatatttcttctcagtgctgcaaagcattttagcaattaagtatgaaaaacacttactcctggaagcataaaattcactttgtggatttatatcttcccattattggcctgtacttaatcactgctttttttcatcatctactcagtggggttctgtacaattaagatttttcaaatccat

SEQ ID NO: 52077 - DNA, 601 bp, Human
gaggtgggaggatcacctgagcctgggaggagggaggctgcagtgaaccatgattgcaccactgtattccagcctggacgacagagactttgtctgaaaaaaaataaaataaaataaagtaaaaagaactttcaagactaagacactaagtgtgatttcaatatatcccaactactctacatgtggatctcaaacagggatggtaaaagattaccattcaaaaggctgatcacattggcaacctctaggtgtcaaggttcctgttggcaattattgcttccccctgaaagttttgaaattktcttttaaaaactacagaatgacaaaactattttttttaacagagaaactgatggcaaagataatatgcctgaatggctgctttgaaatactgtgatattctaaattctgaacttttttttactgactgataagcagcatatttaaattgcctattaacacacctgcaatgcctgcatatcctccatccaaagactgaccctagctttaaatctctcggagtcaactgtacaggtcttgaaaatcaacgtccttttattcaaaaccatggtcctttatttattctgtgctcttttgatat

SEQ ID NO: 52078 - DNA, 601 bp, Human
agagggggttgatgaagggaggataatgacatcagtatgtggtcaggtgggcagagctcaggccagtatatttccactatgcaagccagtcgccagcactcaaatagcactttctgctaagacactgctaaacctattgcagaattttaaagactagcagggcacagtggctcacgcctgtaatctcagctcttcggggctaagtgggcagattgcttgagtctaggagttcgagaccagcctgagcaacatggtaaaatctcgtctctacaaaaaatacaaacaaacaaacaaacaaacaaaaaaaaaagccaggcatggtggcttgctatgtagtcccagctactcaggaggctgaggtgggaggatcacctgagcctgggaggagggaggctgcagtgaaccatgattgcaccactgtattccagcctggacgacagagactttgtctgaaaaaaaataaaataaaataaagtaaaaagaactttcaagactaagacactaagtgtgatttcaatatatcccaactactctacatgtggatctcaaacagggatggtaaaagattaccattcaaaaggctgatcacattggcaacctc

SEQ ID NO: 52079 - DNA, 601 bp, Human
tattagactgttgaatcctttagaaagtgatagctaaaatttggaaaatcatctaaatttgtgatctgattataaatagagaatatgtggagttcatgatattcctcatacaattaacacttcaatgaatttattatcaggctctgatagctgagtatttgctaaacttgaattccaaatttatagtctttattaaacacttacttttttccaaaaattcttaaaatgtatttgtatactacaagttataaaaacatttttaattttaaagaaactaagagtgtggaatgtttaaaagtaygaaatattaataaacatttctacaaaagtgtttattgctttcccattcactaaactagttcctcaaaagcattcttaatattaatagaaaagcaaacaagagaagaaaatctgtgaaactggctcagcatttctagtcattaatgaataataggggaggatttttttctccctttctttcaagtcctcagagataacctaagagtagagtcccacttgtcttaaaagggagcttttcaaaatgacaggacagtcagacatccaggccctacctagggccccacctcataccaaagacact

SEQ ID NO: 52080 - DNA, 601 bp, Human
cagaatcttgatcatttagagtgtctgtaaaaataaataatgactgaatcaacaaatgaattatccacattctgaatgtttaactcactctatgtataggtatatgtaaatccttcaaaaagtagtttcttaactaacacactaatatactaacatgaagtttaggctgaccacgctgttaaaaacctttctagctagttaaaaaccattattgctgcttatcgtttatgataatatatgttattgtacaatattctattttcctctttgatatgaaggtagctttgataagtaagtagtmataagtaaatagacaatgaattatttaggagaatgtaaatgtcaccacaacatatataagcagcttaattttcaataacatttagttttctaggctaagatactctgatgatagatattagaaactttcattgctcttcttctttttcacagtagcatagaggtaaataaatttatattagactgttgaatcctttagaaagtgatagctaaaatttggaaaatcatctaaatttgtgatctgattataaatagagaatatgtggagttcatgatattcctcatacaattaacacttcaa

SEQ ID NO: 52081 - DNA, 601 bp, Human
taaatttgacctagtacaatggtcacagactacacacttctagaatgctgaaatgtaaaaatgcatcactacctaatagggagataaggtgtccaagagaataagacgaatattcacaaaagtattacatctgctactaaagaaactcaaagcgtgtgtcctaatgatagtgggccaattttaagtttacataaaaccttgatttttaaacagtaccaaaattacatatttttatacataacattatataaatcataatatattaaaattttttattatgttgagtaagtagtattttttrttgctttttaccaagattattgagatgtaacctttacttgggcaggaatcttgcatatttcaactttgtaattgcaatgcccagatcagaatcttgatcatttagagtgtctgtaaaaataaataatgactgaatcaacaaatgaattatccacattctgaatgtttaactcactctatgtataggtatatgtaaatccttcaaaaagtagtttcttaactaacacactaatatactaacatgaagtttaggctgaccacgctgttaaaaacctttctagctagttaaaaaccattattg

SEQ ID NO: 52082 - DNA, 601 bp, Human
ttccccccaccccctaaagccctcttaccttcaaactttaatcctggcaatatccacagtgaaaggttcatccaagaaataactaattaaatttgacctagtacaatggtcacagactacacacttctagaatgctgaaatgtaaaaatgcatcactacctaatagggagataaggtgtccaagagaataagacgaatattcacaaaagtattacatctgctactaaagaaactcaaagcgtgtgtcctaatgatagtgggccaattttaagtttacataaaaccttgatttttaaacagyaccaaaattacatatttttatacataacattatataaatcataatatattaaaattttttattatgttgagtaagtagtattttttgttgctttttaccaagattattgagatgtaacctttacttgggcaggaatcttgcatatttcaactttgtaattgcaatgcccagatcagaatcttgatcatttagagtgtctgtaaaaataaataatgactgaatcaacaaatgaattatccacattctgaatgtttaactcactctatgtataggtatatgtaaatccttcaaaaagtagtt

SEQ ID NO: 52083 - DNA, 601 bp, Human
caaaaaaaaattaaagtatctgtctgaggtctacatgatgaatgaagttacataatgtactttacaatctaaaaatgctggaatttgttaagggagtcatttcacctctttaaaaaaaatgaaaagatattctgatctgttgtttactcctaccactttatcccttcacatcatgaaaaagcaataatcctgttactttaatgcaaagattagtaatcatgagtggaaaatcaaatgcatattaaactaagaattttatgcataacttttcaacagaaatatattatacagcaaatgaccrtcatttatgcaatatatccctttgttacagtacagaaataaataaattagtatttttaattaaaaactgtagcatagtaacttccttggtaacttaactaaacacaaccagcaaactgcaaactgtaccatatttgagctatatcaataacactcttcttataatttttgtaaccatttggttgttataataagtgttcccattagctcttataaaaactgaatctccaatttatacaactcattgaaggtactttatttgtcagcaattccccccaccccctaaagccctcttaccttc

SEQ ID NO: 52084 - DNA, 601 bp, Human
ccaaaagtcaacagctttgctcaagttgtgataaatataaattctatacttatgatgtagtgttttcctctggccttctcgggagccaatgcttgtgtactgtatgtggtttagtacatgttaaatacacatttaaaaattccatttttgtgaagtaaatgtgacaaatgtatgccactaaagtctttatcatcaaagctggataactcacatgttttacgtgcagagtattgagagttcaaagaagcaaagcagattttgattattatgatgcttccaggaaaatgaatgaaatgattcmtagtataaagtttttcaaagtgcttttgaatagacttatatctagtttctaaaacatcttatatagcattaaaagcataattgagcaaaatatgattacatggaataaaattggaataaaattatgttcaaaggcggaagtaaaatgcattttataatctaaattggggagaatacatttgcaacacttaatttagtgtatcccctttatcgctggcttgctaacatagcagaaaagcaggccagtccgtctgctctcacctccatgcaatgcctgccttttgcaggtgtgcctcaagga

SEQ ID NO: 52085 - DNA, 601 bp, Human
gatccaataaattatttttcttaatattccaaaatattaggatatttgtatatcccatgattttatgatagatttgtaaaaagtgagcctacctaaggcaaatttcaaaagaagaaaaatgcttctcagagctttaggattgagtttctgtatcattccagtgctaaaaagtttgaactgtttccaaaagtcaacagctttgctcaagttgtgataaatataaattctatacttatgatgtagtgttttcctctggccttctcgggagccaatgcttgtgtactgtatgtggtttagtacrtgttaaatacacatttaaaaattccatttttgtgaagtaaatgtgacaaatgtatgccactaaagtctttatcatcaaagctggataactcacatgttttacgtgcagagtattgagagttcaaagaagcaaagcagattttgattattatgatgcttccaggaaaatgaatgaaatgattcctagtataaagtttttcaaagtgcttttgaatagacttatatctagtttctaaaacatcttatatagcattaaaagcataattgagcaaaatatgattacatggaataaaattggaat

SEQ ID NO: 52086 - DNA, 601 bp, Human
aaaaccagattacagaaaaaagatccaataaattatttttcttaatattccaaaatattaggatatttgtatatcccatgattttatgatagatttgtaaaaagtgagcctacctaaggcaaatttcaaaagaagaaaaatgcttctcagagctttaggattgagtttctgtatcattccagtgctaaaaagtttgaactgtttccaaaagtcaacagctttgctcaagttgtgataaatataaattctatacttatgatgtagtgttttcctctggccttctcgggagccaatgcttgtrtactgtatgtggtttagtacatgttaaatacacatttaaaaattccatttttgtgaagtaaatgtgacaaatgtatgccactaaagtctttatcatcaaagctggataactcacatgttttacgtgcagagtattgagagttcaaagaagcaaagcagattttgattattatgatgcttccaggaaaatgaatgaaatgattcctagtataaagtttttcaaagtgcttttgaatagacttatatctagtttctaaaacatcttatatagcattaaaagcataattgagcaaaatatgat

SEQ ID NO: 52087 - DNA, 601 bp, Human
aaaaggcacatgcatccctccagccaaagtgcacaggataaatttaacaggcacaacactggaagtaaaaaggccacttcaccactataaagcacttttttcaaaaccagattacagaaaaaagatccaataaattatttttcttaatattccaaaatattaggatatttgtatatcccatgattttatgatagatttgtaaaaagtgagcctacctaaggcaaatttcaaaagaagaaaaatgcttctcagagctttaggattgagtttctgtatcattccagtgctaaaaagtttgaaytgtttccaaaagtcaacagctttgctcaagttgtgataaatataaattctatacttatgatgtagtgttttcctctggccttctcgggagccaatgcttgtgtactgtatgtggtttagtacatgttaaatacacatttaaaaattccatttttgtgaagtaaatgtgacaaatgtatgccactaaagtctttatcatcaaagctggataactcacatgttttacgtgcagagtattgagagttcaaagaagcaaagcagattttgattattatgatgcttccaggaaaatgaatgaaat

SEQ ID NO: 52088 - DNA, 601 bp, Human
tgggcaactgagcaagactctgtctcaaaaaagaatgatttctaatggcaaccaatgatttgtggggcttttaaaggaaagtaattaaaaatagttctgtaacaataacaaaagaggggcagctgtgggctatgatgccaaagcattccagctcttaagtcagatactggtggactctcatgctggctcagccactacttagctgtggggctttgggtaagtcactcaacctctctgaagttcaggagccttatctgtacaatgaagataatcatatttagtggctaaatcttaaggataytgtgaagactaaatgacaattaatgcaaattcatataaagtacaactcttttaactaccatttgtcattactataaattggagttgatcaatctagaaacagctactttgcaaagtagtgacctctctggtactggaaatcttctaccaagccaggagaggacctatctgttaaagaacatcctgtaagaaattcttgacattgagttggaggttgttctatttgacttctaaagcccttggtattcttggaaatctataactaccctgcaagtctcttctgcaccttgactatgttaag

SEQ ID NO: 52089 - DNA, 601 bp, Human
caagtagcttctctactataatactctattaaaaaaaaaaaaaaaaacgctaaacaaaacagccctttggagttaagatttaagacacaggaagtgttaaattagagtaaattagagttttactggataaactcaagaatctatttgttttggggagtgcttttcataccactactatgcagcaattgtaggatgggcaatgctgtcctagtaaccctggataggtaacaaatgttgcaagagtctctccttgctctattaaagaaaacaaacaaaacaaaaatgatttctaggctgggcmtggtggctcatgcctgtaatcccagcactttgggagacccacgtgggtggatcacctgaggtcaggagtttgagaccagcctgaccaacatggcgaaaccccatctctactaaaaatacaaaaaattagccaggcgtggtggtgggcacctgtaatcccagctacttgggaggctgcgacagtagaattgcttaaccgggggtggaggttgcagtgagccaagatctcactattgtactccagcctgggcaactgagcaagactctgtctcaaaaaagaatgatttctaatggcaaccaa

SEQ ID NO: 52090 - DNA, 601 bp, Human
tatgacaggtcctaggaaaacatcatattgtataagatgataacatcaataccataaattcttctaagcaaaagttataagttttaatacatcaattggtaagaatgttctcatatatagtccattgtactccaatatcaaagatggacgattagtagaaaagggattcccctgtccccttttgacagctgaaaaggctatctatattccttgagttgtgtagttagcccaaatgtttgcagctactcagacagacttaggaaccttggtcaagtagcttctctactataatactctattaaaaaaaaaaaaaaaaacgctaaacaaaacagccctttggagttaagatttaagacacaggaagtgttaaattagagtaaattagagttttactggataaactcaagaatctatttgttttggggagtgcttttcataccactactatgcagcaattgtaggatgggcaatgctgtcctagtaaccctggataggtaacaaatgttgcaagagtctctccttgctctattaaagaaaacaaacaaaacaaaaatgatttctaggctgggcctggtggctcatgcctgtaatcccagcactt

SEQ ID NO: 52091 - DNA, 601 bp, Human
atctctttcatgcaaatgaatatgtattcagcattatataattgtaacaagagtcaatatcaattatgtttccaatatgacaggtcctaggaaaacatcatattgtataagatgataacatcaataccataaattcttctaagcaaaagttataagttttaatacatcaattggtaagaatgttctcatatatagtccattgtactccaatatcaaagatggacgattagtagaaaagggattcccctgtccccttttgacagctgaaaaggctatctatattccttgagttgtgtagttmgcccaaatgtttgcagctactcagacagacttaggaaccttggtcaagtagcttctctactataatactctattaaaaaaaaaaaaaaaaacgctaaacaaaacagccctttggagttaagatttaagacacaggaagtgttaaattagagtaaattagagttttactggataaactcaagaatctatttgttttggggagtgcttttcataccactactatgcagcaattgtaggatgggcaatgctgtcctagtaaccctggataggtaacaaatgttgcaagagtctctccttgctc

SEQ ID NO: 52092 - DNA, 601 bp, Human
tgacagatcctgctaaattcaatcactgtcaatctctttcatgcaaatgaatatgtattcagcattatataattgtaacaagagtcaatatcaattatgtttccaatatgacaggtcctaggaaaacatcatattgtataagatgataacatcaataccataaattcttctaagcaaaagttataagttttaatacatcaattggtaagaatgttctcatatatagtccattgtactccaatatcaaagatggacgattagtagaaaagggattcccctgtccccttttgacagctgaaarggctatctatattccttgagttgtgtagttagcccaaatgtttgcagctactcagacagacttaggaaccttggtcaagtagcttctctactataatactctattaaaaaaaaaaaaaaaaacgctaaacaaaacagccctttggagttaagatttaagacacaggaagtgttaaattagagtaaattagagttttactggataaactcaagaatctatttgttttggggagtgcttttcataccactactatgcagcaattgtaggatgggcaatgctgtcctagtaaccctggatagg

SEQ ID NO: 52093 - DNA, 601 bp, Human
cctaaccccctgctatcaggaacctttaagaaaagaatgctcaaggcttatgacagatcctgctaaattcaatcactgtcaatctctttcatgcaaatgaatatgtattcagcattatataattgtaacaagagtcaatatcaattatgtttccaatatgacaggtcctaggaaaacatcatattgtataagatgataacatcaataccataaattcttctaagcaaaagttataagttttaatacatcaattggtaagaatgttctcatatatagtccattgtactccaatatcaaagayggacgattagtagaaaagggattcccctgtccccttttgacagctgaaaaggctatctatattccttgagttgtgtagttagcccaaatgtttgcagctactcagacagacttaggaaccttggtcaagtagcttctctactataatactctattaaaaaaaaaaaaaaaaacgctaaacaaaacagccctttggagttaagatttaagacacaggaagtgttaaattagagtaaattagagttttactggataaactcaagaatctatttgttttggggagtgcttttcataccactac

SEQ ID NO: 52094 - DNA, 601 bp, Human
cgattctcctgcctcagcctcctgagtagctgggattacaggtgccccgcccgccaccacgccctgctgatcgcgaactcctgattctgcccacctcagcctcccaaagtgctggaattacaggcatgagccactgtgcctggccaacaacattcatttggaggaaacctgaggatttgggaacactgcaagccaagatataaagagagaaagaagccagccagaaccacattaaaacctttaacattaaattcttatatttctaataggcatattactctcctttgagtctataattaargtttcaggtaaataagactacattcaaattcataaaagaattagtaaaggatgaaaaatattctcagtataatctgtgctgtgtcttattcagaatgcctgtcttaatcacataggcttctgattgctaacaattaaaatcctgatctcctttttctctccctaatagatgaaagcctttgtgaagaagatgtaaaattcaccctgtcatattactgacaagtggcactgagctggtaaagtagtgtattaatactgattacactgattaatagtaccgtaaaaattggttcaatggtgc

SEQ ID NO: 52095 - DNA, 601 bp, Human
tcaaagaaaaacgtcccaatcctacgttaactgttcccacaaagtccagttcaaatgtttaaataataaaactgccagtgtagttgtcaactacatttgaagttcatcacagactttgtaatttcctagaaattaagtttttaatctagcatccaaattacgggatgtttacttaattttactttttaattatattaagaaatatatcaaatggtataattcatgcctgataaaatcataaaaatgccatatcaaatagcaaatgattaaaagatgcttttattacccatactttgttaarctgactttctaagcatcacttgcttttttaaatcaggaaagggaacaaagaatgactcaattctctctctctgtctctacctctcgccctccccttccctttctccctctctctcttcccttctatagccctctctccctctgcctctccgtctttttaactctgtgctaagctgaaataatctgatgagtctttagctttagctgggccagtgaagcatggggtttaagcttgtggctgtatggtagtgacctgagtgtgaatacctgcccctagagctaggattttaagcaagttatt

SEQ ID NO: 52096 - DNA, 601 bp, Human
aatgaccccttcaccagtttatagatcaattacctatcttatacaattctttgatttgtcctgacaaaaataatttaagaagtgatttctctgaaatttgctctacaacacgttcgatgctcatgtctgtttaacataatattgacagttcccttaataataaaacataaaaatgcaaatatcctaaacattaagacatggaatttaaaaactgttacttgtaattcatcaagacaaaagtgaacaagaaaatgtatttagacataaaataaaatcctcctatcaagaaatgtaaagaacrtttcaggctaaaaagagaataatttcaaacctgtgaagtggcatttttgtgaacacaacaatggaaaggaagcagaagaaacaagcggctaagaggaaggatctagtatgaaatctcaaattgcagcccatcactaagtagcctaatttaactcccagccagccacttgccttcttcaggcctcatttgccttatcagggaaatgggagttatagtatctatctcatagcattactatgaggatttagtaagttaatgtataaaaatattttacttcctgaccctgaggaatgtcatgaa

SEQ ID NO: 52097 - DNA, 601 bp, Human
ttaaaaattgaggctaactctttagcaaattgaaaaatgatgtcctcattttttcttcttcatacaagattaactttagcgatttgtttaagccaagaatctttcttctttttatgtaccatgagaaggtgaaaaaaatgaaccaaagccaacacaatactgtaagtcaagtaagaatctaacttaaattagcctggattttaaaatgaccccttcaccagtttatagatcaattacctatcttatacaattctttgatttgtcctgacaaaaataatttaagaagtgatttctctgaaatttgctctacaacacgttcgatgctcatgtctgtttaacataatattgacagttcccttaataataaaacataaaaatgcaaatatcctaaacattaagacatggaatttaaaaactgttacttgtaattcatcaagacaaaagtgaacaagaaaatgtatttagacataaaataaaatcctcctatcaagaaatgtaaagaacatttcaggctaaaaagagaataatttcaaacctgtgaagtggcatttttgtgaacacaacaatggaaaggaagcagaagaaacaagcggctaagagg

SEQ ID NO: 52098 - DNA, 601 bp, Human
ggttatgtattacacatccacctctaatatggagttttatctattgtctctttcaagattagcaatgacataaaaattgccaattagctttcaaaagatccaataattttttttaaattttttttgccatctgtgatttttcttctgaaagaaccaagtgtttattttttgttattaggcctttggttctaagatatgcaagtgagcatttaaaaaatatatatctatataccaagataaaaagttttaaaaattgaggctaactctttagcaaattgaaaaatgatgtcctcattttttcttcttcatacaagattaactttagcgatttgtttaagccaagaatctttcttctttttatgtaccatgagaaggtgaaaaaaatgaaccaaagccaacacaatactgtaagtcaagtaagaatctaacttaaattagcctggattttaaaatgaccccttcaccagtttatagatcaattacctatcttatacaattctttgatttgtcctgacaaaaataatttaagaagtgatttctctgaaatttgctctacaacacgttcgatgctcatgtctgtttaacataatattgacagttc

SEQ ID NO: 52099 - DNA, 601 bp, Human
tgctattgggttatgtattacacatccacctctaatatggagttttatctattgtctctttcaagattagcaatgacataaaaattgccaattagctttcaaaagatccaataattttttttaaattttttttgccatctgtgatttttcttctgaaagaaccaagtgtttattttttgttattaggcctttggttctaagatatgcaagtgagcatttaaaaaatatatatctatataccaagataaaaagttttaaaaattgaggctaactctttagcaaattgaaaaatgatgtcctyattttttcttcttcatacaagattaactttagcgatttgtttaagccaagaatctttcttctttttatgtaccatgagaaggtgaaaaaaatgaaccaaagccaacacaatactgtaagtcaagtaagaatctaacttaaattagcctggattttaaaatgaccccttcaccagtttatagatcaattacctatcttatacaattctttgatttgtcctgacaaaaataatttaagaagtgatttctctgaaatttgctctacaacacgttcgatgctcatgtctgtttaacataatatt

SEQ ID NO: 52100 - DNA, 601 bp, Human
gtgcctcctataaataaaccacaataaaacgaaatgagtccagcaacaaagaatttagttagaactttccattctcagaaaaataaaaaggattcttgaagaggtgaataaaaagatcttgagaatagcatttcttgatcttccattactgcagaattcatcttatcagttgactgatcagtagtagtcagttaactgaaaaagtcagttaaagtggggaatcataaaaaaaaatgtaatcaccatttaaattactaattatattatttaaattaattattttatttaatcaggaattatmtgtcaaaacacaaaaaatacatactttggctaaactttgaattacataccagttgtcttttttacataaacttgtgcacataatagatcctctaaaatttcttcattgcatgcctgtatcaaaacaacttacgcaccccataaatatatatctaatatatacccatgaaaattaaaaagaaaataaaattttcaaatgcttatgatcttttccccaatctgctacaattatctcacccacacttaatctgacacctcaagtgatacatttttattaaatctttctttctgaagcattcat

SEQ ID NO: 52101 - DNA, 601 bp, Human
gatgcttaaaaatgtcacatcatgttaaacctgagtcaacctaacagtaaggctgtaaaaacaactctacttcctgatttgttactgcattcagctaatgtattgagggcctataatggctcagatcctagaaatataaggaataagaagcaaagaacccttccctaggctagtgcaggagacctatcagtaaagacatgactgtaacacagcatgataggttcactggtataggtagcaacaagggtttcaaagaaaggttagcggttccagataaatttcattttaatttccaatgttrttttaaaaaatttctgggctctaactcaatctatttagcttcagctatctaatttttgcaccatttctaaatattttatgtctagtcccatcctctacccagttcctgattttattatttattattcaaaaagaacgaaatgaaaattatgtagttgaaaagtaaagcaatcgaatttgagttggtagatgcaagaatcagcaaacctgaagatgggtcaattgagataaagaaatttggccaggcatggtggctcatgcctgtaattccaacactgggaggctgagaagggaagactgc

SEQ ID NO: 52102 - DNA, 601 bp, Human
cttctaaatctaaagtcgtactttttaaaacaacctctccaacataatatcaaaaaagtaaagtattctcttaccttgcatatctacatcaaagaaaaccataaggaaaagaaactacagatgtgcacgcagtaagtccaagatgcttaaaaatgtcacatcatgttaaacctgagtcaacctaacagtaaggctgtaaaaacaactctacttcctgatttgttactgcattcagctaatgtattgagggcctataatggctcagatcctagaaatataaggaataagaagcaaagaaccsttccctaggctagtgcaggagacctatcagtaaagacatgactgtaacacagcatgataggttcactggtataggtagcaacaagggtttcaaagaaaggttagcggttccagataaatttcattttaatttccaatgttattttaaaaaatttctgggctctaactcaatctatttagcttcagctatctaatttttgcaccatttctaaatattttatgtctagtcccatcctctacccagttcctgattttattatttattattcaaaaagaacgaaatgaaaattatgtagttgaa

SEQ ID NO: 52103 - DNA, 601 bp, Human
catatatatagcgtatatagtgcatatatagcatatacatatcacacatatatagcatatatatagcatatatatagcgcatatatatagcgcatatatagcgcatatatatagcgcatatatatatatatataattagtatttcacaggctgggtgcggtggctcacccctgtaatcccagcactttgggaggccgaggtgggcagatcacgaggtcaggagatcaagaccatcctggctaacacggtgaaaccccatctctactaaaaatacaaaaaaaattacatatatatgctaagwtttttcatatatatatacatgtatatgtgtatatatatatgagactgtcatatatatatatatgagagtcaagccttttgattcacctactttggataccagttaaagttagtgcttcatctctcattgttattaataaaactgcagagcattataatatgaataatatttcaggctcaaaagtctcacagttcattttatgtgtgataattacattgcccactactacaaaaataaatacactcaagaaagctaccattttcacatcataacataatttaagactgaattgtacaataa

SEQ ID NO: 52104 - DNA, 601 bp, Human
gatattcataaagagagatattgggagagtcaccaaacatacaaaacgatatacagattagataatcagaccttggaaaatacatatttgcaccaggatttcaaaatatctataattggtccaatacttctgaaataagtctacctaatctaagcaagaaatggaatgaaatcagagcgcatttttttttttttaccatacatggtaaatggcatggtaaatagtacagcaaatatttgactgatgaaaactgtaagtcagagaatagatgaagaatctataacccaaagacttttcaggyatattgcagtaaattaaaatctacaaatactggctgagggattatttcaatcaggcactaagcttggtgtctggaatatgtggataggacatagtccccatcttggaagctcagtgtctagaagagaaataaatctgtaaacaactaattataatatggtgccattttagaaagatcagtaaaatatacaggacagagctactccctaatagtaggcccaatgagagaagacttccctttggacttgaagggttgagctgagttctgaagcatgaatagaatttatattgagaccaatat

SEQ ID NO: 52105 - DNA, 601 bp, Human
gaaacaagttaggtgtatagtcctgggtaaggcaagacaaaaataatccaccctgattgaacttagatacgtgtgcaaaccagtgtgaaaacatggagtaacactaaggtaaatgcagtaattacaggagaaacataacccatttgtcagggttgtcaattgcagtaaaaaatatgttaagtgatttttccgtatgtttattgtggcactattcacaacagcaaagacttggaaccaacccaaatgcccatcaatgacagactggattaagaaaatgtggcacatatacaccatggaataytatgcagccataaaaaatgatgagttcatgtcctttgtagggacatggatgaagctggaaaccatcattctcagcaaactatctcaaggacagaaaaccaaacactgcatgttctcactcataggtaggaattgaacaatgagaacacctggacacaggaaggggaacatcacacaccagggcctgtcatggggtgggggaaggggggagggatagcattaggagatatacctaatgtaaatgacgagttaatgggtgcagcacaccaacatggcacatgtatacatatgtaacaaacct

SEQ ID NO: 52106 - DNA, 601 bp, Human
aaaaatgttagaaagggactcaattctgaaagcaagagagaagagagaatgcctaagtactgtaaattttaaaataacaaaatcacagttaaaaatcacaaattcatgccttatatagaaatggcaataagctatgtgctaaagacaaaacattagttctagtacattagaaaagggatccccagactgtcctgccttaaattatgtgtcaaagaaccagactatttgtttctactagcaataaattagatagtcacacaaggattaattacagaattgacccttgaaacactgccagtarcccaattttgaacaataactcaaacttggtctcctaccaaggaatttttaggaaggagaatccaaatggtttaatttctaggagagatacactgatgtgaggcttcctttcatagatttttccagctacttacctaccctctaatatatgtataaccctgtgtttctttcaagggcccagcatcctttgggaacataagactgtgcaatttatatacaagttttccaggggatatcacgtttcctcataaaataaaattgttattactcatggcttcaagaatttgataaagagaaggtg

SEQ ID NO: 52107 - DNA, 601 bp, Human
ttttaaggacttctaaattcagataaagtaagaatttgtctatagtacagagaagccaggaaagaagaagctgtattctatctctatcaggctcactcagcgttccacatggtgttgtggaacgttcataagtaccatgtatgccagtgtataagatatttcatcctaaacaatggtggtggtgggacaggcagcagaaaaaagcaacaggaatatatttaatattttatgggttaatatgtagaatggtaataaccattctcaatctgattatttagcagattcctgaaaactatagtgytgattttcattaacatcttagtagagtgagagagtggttagaaacaaagcttctgaatacaaaaagataatgtaacagcaacacttattctttttatattgtcttcacagctatttctaaaactcagatgcaaagcacatattctataaattgtgctaccatattggacagcacatactatagaaaatttccaacatcacaaaaatttctaagagcactgaaatgtggaggagttcaaagtagtggaaatctatacaggatttcacttgtttggtataaccaatggaaataatttaaaag

SEQ ID NO: 52108 - DNA, 601 bp, Human
aaaggtttcagtaattttgataaatcagaagggcttaaaaggtttcaggtagtttcataaaccagaaggagggatccagaaaaaatagtgtttgatctcccttccgtcaggaatatgcaccatggtaagacttggggtatgtaatggctatgcttttcttttctaaggtggttatgaacatgtgggtacatgtgaaagtttagtatctggaaagcaattccattaaaactatctatataagagctgcagtgagccgagatcactctactgcactccagcctgggcaatagagcgaggctcygtctcaaaaataataataactatccatataaaccatttggaaagctgtctcaaactctaggcaaacttgcatttaaaagactgctgattaatccctaaattctattctgaatatttaaaggtttctctgtagtccgaggctttaatatatcgcaaagccaacctgaaacaaaacaaaaaggctatctaaaagagcatgatgataacaatatccgttgatacatggatgagtctccggctaaggcttggctgtcaaaaggaagctttctttccagcccatcaattgagtgtcaggattgtt

SEQ ID NO: 52109 - DNA, 601 bp, Human
ggtgacggcaatgatagtgaatcctactgctgaccatttggtaatctctaactacgattctctattatccactggatgagaggcaacagagattgtattttgtagtttcttgtattgattcgtttgtgcaagaacatatttcatacacaggaaaaaaaaagagaagaaaaatttcacatttgaagcagtgagtttttgtgtttgtttactcttgacccaaggctgaggttgaagaatggaagctgaaagctctctgtgtttctgtgtttatttaatttagaaaggacttcatctctcactrtaactttcagatgttttcctatatccacgatgtgttaataaattatacaataatatctctaataatgagttctgttatgattgctttgagaagttaataatcacattcatctaacgttcccagaattccaaaaaaataaaaaacacctgtatttaaaaaatttaaatgtgctaatactttatttaaaaaatagcaatatttgtagaagatacaacctcagagcattcttgaataaggatataaaccaagtttatgcaattaaggtaaatattcaaactactatgacattttttataattt

SEQ ID NO: 52110 - DNA, 601 bp, Human
cggaaataagcatctagattctagacactgattcatatacatacctcttcactgtcaatgtaatcataattgttttgcaaattcatcaacagatgacatggaaccactttaaaaaaaacagcattaatatatgtcctgattgtgattggcagttttaattacatgaggtttttatcctgtcagcagtttcaacacagttatccttaggtttaagttccaggaatgctctgtatgcatacatacccatacattttgtgccctaggagatcaggagaaacaggctaaagagcaattaaagtayagaaaaaagaaataacataaaactgggtattttccaggctcatctcacctcatttatctttcagctcttctccctataacttgctgtagattcttggtaaagccatttaacctgttgggagatgaactagatgacaagtataatctactcagtagtcaaacttattgtttatgtaggctttggaaaactaattttaacatgaatattttaaagatgacatctattatttttatctgttagcactgctatgaaaaattatgcaaaacttggaaattaggcaaaaaataaaaaagtaggtgg

SEQ ID NO: 52111 - DNA, 601 bp, Human
tcagatgaatataacttcttaacaatattatcagaaaggatttaccagcataacttctcattgtagtcatcttttaaacttaaatttttaattaattttgaaatccactacgtaaatttgaaatatgtttcctttagaaatcatgtcccagttaaggggttggaataaactaaaatctcataaaaagattctctttcaaaataatttatttagtgactcaaagtccatttcgatagatgatcattggattaaaaaaattaagagcggaattttaaattatatatattttgtttttttccartgtatttagtacacaatagatgtggtgccaacaaaaaaactactaaattatttggtcagaaaattcaggatacataaaaatattttctgtattataactttaaattcaaaaggttttgtcccatattgtgtagacaacattaataacaatatggaaagaaataaaaactaagaaaaataaattaaaaagtcttaagtctgtatttactaaaaacataagattacagagtgaagttctatgacagttcaaaagaaaagaagaattaattatattgaatataatgtttttccaaaactctaa

SEQ ID NO: 52112 - DNA, 601 bp, Human
tcatgttgataagacattaaaaaatttttgtaattgtaaaaagttatattctaagtgctcttataatacttagtaataagctaaaattacatcatgttgtggtttaatatttattaaagtaataaaagagaatatgcataacttaagacccacagaatcttaagttatcatgtaaaatatgataaataagttatcagtgaaatatcatgtaaaatattgactgctaaccttagctgggtagattattaaatggtccttgtcagttagtactcattattttgattttgttagcaaaattcaygacagagtaaaaataatttgggttctgaggccattatctttagtttggttttctctgattccctgaaaactttttaaagtattcccaatgatgttgtgcaggacaaataagcttggcaattatccttttaaaaaaatctataattaaactgagcatactagagcattacatgagctaccacatataccactaaatctacagtcattaacaaaattgtatataaaatgaggggaaaagaaaacaaaggcaatgaatacctcttattaccaatgtgttaacaatgttactttaagaccaatt

SEQ ID NO: 52113 - DNA, 601 bp, Human
taaatatatatcttaatgggattagtttactattgcagaaaagacatatcaatatacatgtgaactttaattactatttcatcttcaaaaacatttaactcctttttcccaagtattgttatggggaatgggaatgacacaaaaatgaataaggcatgggacctgttcttaagatactcataatcttgtggtggatctaaccacacaaaatgtaaacacttgtacccacaccttcttatagaaacctgttacaaaaatattttcaaaaaagattgtttcagtttgcctattctcttacttycatccttttggaaatatctgaaatgtagtcaggcactcataatattaagtatttgaatagaaattaaattgaacttttgtaaatataatgtaactaacatgaattcagttgccttcaatccatgtaataaacatgaaataccaatgtcaacaaaatcccaaactgcagcagaagggagaatgattggtgtttcttcttgcactatattcccaaggacttatatttttgggtaccatttttattttaagcaccatatttggttcttccattatttacatcatgatctcatttgtgaacgtg

SEQ ID NO: 52114 - DNA, 601 bp, Human
ctaaagaatccaattcaatttttgttggtattgtcaattttctaatcatctgcaatgcagtaaatggttccttcaagactaattaatgttcttatcattttacagaaaagaaaagtaaccaaaccagaatttgcactagggaagtttgaaagaagttgatccattttgagaagagagttacagaaaacaaataaggaacccattgacgtcctagtaggctgagctcgacgtgagtgattcttcgttctttggattctctctcactcaatatccagtgtctcatggtgccttaggaattttycttccatctgtgttttatctttgcctttatctccaatgcctaggccaccactctgctgtcctgcctgctgtagctttaccctggaagtactcattcttcaacaggtttccagaggtctcttcccgctgacctccacctttcctgccaatattgcagtaggattaacctgcatgaaacatttttctcatttgtaaacatcaatggttgaaccctgattaacaaggaaaattcaatttcttagctttgtattcaagatttttacttccctgactccaattctatttcctaaatggaaaaatc

SEQ ID NO: 52115 - DNA, 601 bp, Human
tacctaacatggtgagcttatattttatatcagtttgctttcctcgatcatctgatcatcttggcctccgtggagtcttctaattgcatttagttctgttcagttctgcttgaggataatccaaaggatgtctgtttttcatcaggtaacgaccattaaatttggctgcatttccttctaaatcttgttgaatggcataagaaacagaagctagaaaacctttctcttgtaactttgctatggtttctgaacctagacctttctagaatttttgctcactactgcaaaactctgaggccakatccttttggaagtgagtctaaatggtctctaaactttgatctactttccctgggggtacttaagactttggggcatctttctgcataccctggaaacatttggactctatgtaaagttgccagataatttctaaaatgttttgaattgtgagtttatgtttaggcagcatttggggctttccttctcttgaattaaacaaacatcttggccaatcaaatactctcccttaaaaaaaatcttaaaattcctctctgtggctccttatactgtattagtgtgtaaggctggaaagaaatgt

SEQ ID NO: 52116 - DNA, 601 bp, Human
tcgtacgagaagaagggggctggaacaaataagttacagctgattttactctgcaaaatatataaggggttttcaaattaataaccattcagggtccccaaacagcctaatctttgtcaattggtgccaaattatgcaaggtgctgccaattctggttgtctaacaaatcaagaccagtgtatgttactcctcggctgaagcctgattgattctggtcattatatgggctgatctcattttcacacatggaatcaatatgtgagccagatgttcatttacagagaagcacagaaacgactsatctacacgcaactttatcccggaccacagagcaccacagacccaaagtctctcgtcacccatacaaagcttcacacagtacaaaaatctataaaacattccgctaatattactgtcagctgaatgacttttacagtactatataaagttgacagataatacatgccagtcctaatttgagatagaccttttcttttgggacctcaaccattgaacaagcaaacagattgagaagtaacatttattacaacacataaatcattttcttacaactattatataggtctggcccgagggtga

SEQ ID NO: 52117 - DNA, 601 bp, Human
gagagactgttccaataactctcatttaattggtgaaaaaattaaatattggtttagatacttacctaaatattactagttaaattcaaagtaaatgagtctgtatctttaaaactacttggcagtaataatttttaaaagtagatttttattgcttttcttgaactaactagtgttcatacaacacaggtagttttatttgtgcctggaattaaggagtgagacacatttgtaaaatgttcacaatcaacgcctgtcccattttaaaatctcacaagtttttcttcatgattaacacaaktcacaaaataagaaatggtatttggtcattctctgagttcaatctgtgctctagtaaatataacttgtgaggaaaaagtaaaaaggtcaagagtctaattcattttcagtttttaaaactatattttaaaaaagaatgatttgggttaaaaataaagatggcttagttttatctcccttacagtaagtagcagaaacttgagctgaaaacacatagaagctgtactcatttctattcacaaagaactgttctactgtctgtctgcaaataaatctcctcagtaaatagctccaaggttga

SEQ ID NO: 52118 - DNA, 601 bp, Human
ttaagctctgagatgactacggttgagtaatttattgtcaaatataattgagaattgaaattcacttctagaactgattttgttaatcaaactcatcatttttttttctcttctgtgtcaagtagaaatcaaacagtcctaatggagttcatatcttatggcattatagaaaggcttagttatgaaactatcttgttattgttactattacattgcctggctcatatatataaagcatttagagagactgttccaataactctcatttaattggtgaaaaaattaaatattggtttagatwcttacctaaatattactagttaaattcaaagtaaatgagtctgtatctttaaaactacttggcagtaataatttttaaaagtagatttttattgcttttcttgaactaactagtgttcatacaacacaggtagttttatttgtgcctggaattaaggagtgagacacatttgtaaaatgttcacaatcaacgcctgtcccattttaaaatctcacaagtttttcttcatgattaacacaattcacaaaataagaaatggtatttggtcattctctgagttcaatctgtgctctagtaaat

SEQ ID NO: 52119 - DNA, 601 bp, Human
gtcaaaatatatttatttgcagtgaaagttatttatcttgttaatgaactacaaagatttatatgacgctactcacaggtttctaaaagttattggtaaaattaagttaaaagaaatataaaggaaataatttcatgaataatgttaatgacctacaaatttgtaggggaaaaaatggggtaaaaaaacatgcaggaaaaaaaaacatgggggtgacttttcatatactggttatcaagaggctcagcaaattaagctctgagatgactacggttgagtaatttattgtcaaatataattragaattgaaattcacttctagaactgattttgttaatcaaactcatcatttttttttctcttctgtgtcaagtagaaatcaaacagtcctaatggagttcatatcttatggcattatagaaaggcttagttatgaaactatcttgttattgttactattacattgcctggctcatatatataaagcatttagagagactgttccaataactctcatttaattggtgaaaaaattaaatattggtttagatacttacctaaatattactagttaaattcaaagtaaatgagtctgtatctt

SEQ ID NO: 52120 - DNA, 601 bp, Human
ctttccaagacatctgtagaattctgtagaattctctgaatgttgtcattatcaattaggatttattatttcaatgaaagaattataccaaataaacaaatgtacagaaaagacaaagaagtagcttgtgaaatataaagctgtctacaccatgtttgaaatataacaaaatccatggttaagtattgtctctgttaacacagtttacctacagtgcagacaagacagtaaattgtcacacattccaataagagtacttggcctcacttttgaaatcacagtggtaatatttttaatatayaagaattcttacctgtggctagtaatgacatgggaaaacctatgcgctaaaattttttcatgtttgagacaaccacacacttcaccagttttttaagatgtcacatgacaccttgatagtgtatcttctgtaacaggtgttacgtgtgactttgtcattgaatgatctgaaattataaagccttctggtttaccaatttctacttatatatagcattctttatctgaaattttcttctaacccttttaatttttacaaataacaaataacctatctacccactagaagaatgcatttggt

SEQ ID NO: 52121 - DNA, 601 bp, Human
cacaaatggttgcaaattctatatttgcaaatcaattatagaatgatacatgggtggaacaaagaccaggagctgtgattcttactccctacaaaataaagttcagattatttcagagtattcacaactcctctgcaattaaaacttgaactattttttaaattaatataattcagtgccctcatgcacacaacctaatgcacccaactgagaattggcccttgccctacctttaaacacagttgtgtatgtgtgtttggttggttgtttttttgtaagtggtagaataggcaggttcaayagtcttgttaagggaaatagttttcctagcataagtcaggccatatgattatgagttatactgatagcactgagtcactttccatgaaattataatgttaggcatatttattctgaaatccacaaaagattgttgcttttgaaaatatatgaccttttacaacaacgattcattctgtaactagctagttaaaatatattaagattatgtcataaagaaaacaaaatgaaaactcttgtttaggtgtaagaaaatatctgactgtaacaccatcacaggataacattttattttaatgca

SEQ ID NO: 52122 - DNA, 601 bp, Human
ttgctcaactgaattctacatacttcccatacaacttgcttacagtcttgggaaggcaggttaacttccttgtattcttgttttattccctaaaccttctcatttcctactggcatccaattggttaccaagtgctttggcttcaattccactacaacactccaacttcagaaatgtattacatcttacttagactatttaaaaatatatttagtgtgtttttagcctgtcttgtagatgtccaaggccaaggggaatgagaactaggcacaatgagtccagaaactctagagtgtttggkggactactataaaaacaaccattgtccacaaatggttgcaaattctatatttgcaaatcaattatagaatgatacatgggtggaacaaagaccaggagctgtgattcttactccctacaaaataaagttcagattatttcagagtattcacaactcctctgcaattaaaacttgaactattttttaaattaatataattcagtgccctcatgcacacaacctaatgcacccaactgagaattggcccttgccctacctttaaacacagttgtgtatgtgtgtttggttggttgttttttt

SEQ ID NO: 52123 - DNA, 601 bp, Human
ttcagcatattataatccatccttactgaattctgtaaaaatcttcaccctgaacaactgtaccttcagaaaatttctaaagacatagaaacaatatttttaaacattgttgccagtttatcacttgatgtgtgaagaacatggaataggttttcagtcacccaggctggagtactgtggtgtgatctcagctcactgcaagctccgcctcccgggttcacgccattctcttgcctcagcctcccgagtagctgggactacaggcgcctgccaccatgcctggctaatttttttgtgtgtktttttagtagagacagggtttcaccgtgttagccagatggtctcgatctcctgaccttgtaatctgcccgcctcggcctcccaaagtgctaggattataggcaggagccaccgcgcccgacctgaacttggttttaatgacaatatagtccagcgatggcatctattcttgacaatgataaggaatctcaaatttcatcctaaatgaaccagacattcttcccatgtgtatgtagatctttctataggtaatttattcatcttggtttcgggggagggagctaaatgaactgagcagtaa

SEQ ID NO: 52124 - DNA, 601 bp, Human
gtagtactaggttaaggcatgatgacatctggaaaagtgctaaatttctttctttctttctttctttctttctttctttctttctttcttttcttttcttttcttttcttttcttttctagtattatttctgaagagtggtcagctaacttttcttttctttccttttttccaagacgcgatctcgctctatcacctaggctgttgtgcagtggcatgatctcaactcactggaacctttgcctcccaggtttaagcaatcctcctgcctcagcctcccaagtagctgggattataggcaygcagcaccacgcccggccaatttttgtaattttagtagagatggggtttcaccacgttggccaggctggtctcgaactcctgaccttgtgatctacccgccttggcctcccaaagtgctgggattacaggtgtgaggcaccgtgcccggcctatttcttaagttacttaaaaagttcagggtcattcgtatgtcgttacaaaacagtcagtgtaagattttgtctagatttgtctcagctgtccacctctattattacaaaagcaaccaaatgttcagcatattataatccatccttact

SEQ ID NO: 52125 - DNA, 601 bp, Human
ctttagaaaataaaacaatttttcgttgttttcataatgctacataaaaataatactgccagtggccaatatccttcttgtgtgtctttactgggctcctctttccttcctttctctttctcatgaacatcctaccatcgagagggcccttgctgtagctggtgaagacaaaatcttctttttaaaaagctaataaagattttcaaattgggatcttttacagatcagattttacctctaaacaacaagaaaaacagtttaaatcaacaagaacattagagccctaatcagaaccacaagmtagggattgactcctgaaactcgcagatgtctctagtaatggaattggtctgtctaatgtgtttccattctatttccttggtgcagaagaaatgctgctttagtgttcttgtaggtttaaaaaattaataaacagagattaagaggaattactggatttgtttgctgtgtctaagcaatatatctaattagacagtacaactaaaggaatatggggagctaggatacaatgtgaattgatttgtagtactaggttaaggcatgatgacatctggaaaagtgctaaatttctttctttctt

SEQ ID NO: 52126 - DNA, 601 bp, Human
caacatgtcaaatcctgtgctgtttctaaaaatccattacatccaatccttaaaataattatgcaataataggtgttatttatcccaggttgaaaacaaaattataatttacaaagcctaagaaactatcaatagaacccggtactaattggcagaaacacaatttgaacccatctctttggtctccaaagtctaagctcttttcaaccaatgggttgtctttcaaaataaagaccattgtgttatggaaataagcaatgtactctttaactgtaacaatcaattgttaaatacagaaaaraagagcctacatctggataaggtttcctttgcaaacaggtaactgtttaactatatcaatataaaaagacagaaaaataaatcattctaggcagaaagaaggcatatgtgatgaatatcctataacgagtttgtctatttaaaaaagatgcaagtactttgttttttcattctgaaacataaaggctatcatttattataaagtgccaggggagaaaaaaattagtaaattaaactaatttactggttatttcaattcttatgaaaaatgtaaggtagtgtgaatttctaaatgttatga

SEQ ID NO: 52127 - DNA, 601 bp, Human
ccatttgaagactgaaaactacttatttacactagagggtgactgcacatgaaaataggattagtttacctttctaggtactaaatatcttttgctatcatctgttaaaaaaaaaaatgaaatcaaagtctttacaagcccagtcttttgcagaactaaaaggccataggaaaacacatggaattaaccagaggatcaggttacacacaagtgatagattttaatgagcttatcatactgttcaaacaaaattctactgttcaaatgaaattctacacaatccaaatttttagttcaattsagcagggtgatgcttgaattattagacatcttcaaaaagggtgtatctggagtcccttagtcttcttcctggatgatcatttccaattgtcactttatattaaagcgaatgatttgagtcctcgttctaccactagaaccccctcaattccccctctgcttctcatggctcaaaaaataaacgtgtagctacacttagttgagcaactaactacaacatgtcaaatcctgtgctgtttctaaaaatccattacatccaatccttaaaataattatgcaataataggtgttatttatccca

SEQ ID NO: 52128 - DNA, 601 bp, Human
gaaacctgtactatagtctgatagatcttatgtcagaaaaggagaagccaaattatggcagaaaggaggaaaaaaatatatatatatatatttaaattatatataaatttatatcatatataaattagccactcactgcatcagaatcctttttcctattcctattcctaaagaatttgacattggaatgttttccatttgaagactgaaaactacttatttacactagagggtgactgcacatgaaaataggattagtttacctttctaggtactaaatatcttttgctatcatctgttaaaaaaaaaaatgaaatcaaagtctttacaagcccagtcttttgcagaactaaaaggccataggaaaacacatggaattaaccagaggatcaggttacacacaagtgatagattttaatgagcttatcatactgttcaaacaaaattctactgttcaaatgaaattctacacaatccaaatttttagttcaattgagcagggtgatgcttgaattattagacatcttcaaaaagggtgtatctggagtcccttagtcttcttcctggatgatcatttccaattgtcactttatattaaagc

SEQ ID NO: 52129 - DNA, 601 bp, Human
atgtaccatggctacttttaaaaaaatagcagtgtgacacattttgcaaaaaggaagcaaaataaacagaagtagcggtagaacaaaatctttaaagctaaaggaatcacaaggtatctcttcatcctctttaaattcgttttataattctggttactatgacaacatgatgcaactctgtattaccatgacaatctgacacaactttcaaaaaacagtaagcactgtttcattctgttgttcaattgctcccaaggaaacatgctgttatttacttctgtgctgaaacctgtactatagyctgatagatcttatgtcagaaaaggagaagccaaattatggcagaaaggaggaaaaaaatatatatatatatatttaaattatatataaatttatatcatatataaattagccactcactgcatcagaatcctttttcctattcctattcctaaagaatttgacattggaatgttttccatttgaagactgaaaactacttatttacactagagggtgactgcacatgaaaataggattagtttacctttctaggtactaaatatcttttgctatcatctgttaaaaaaaaaaatgaaat

SEQ ID NO: 52130 - DNA, 601 bp, Human
ctgaccttaggcagaatcagaggggtgacagtgctcttggttggaagctttgctaaacaaggactcagaggtaagaatgttcaggaaatgtgtttggcgtgtgtccaggcaacaactagatatgttttcaggagttaattagagaggcagataattttgcaggaacagacagggttccagtgttagaatatctaaacattttgtcagaaatagggagccaccaaaagttactgaatacaacaattgtcaattgttatttattgggtgccaagcactgtgtgtgtgtgtgtgtgtgtgtgcgtgcgtgttcgtgtgtgtgtgtatgggtttaattcaatcgacaaaaataactctatggggtgggtgctattgtcattctagtttatagatgaggaaactgagggacagataattaaatgacccaaagtcacatgatcagttagtggcaaaagtatgaatggactctacgtttctctgaaaagtaagtgaacaaaacagtattgttagtaggataatgagacaaagtgttttttgtttctgtttgagacagagtctcactctgtcacccaggctggagtgcagtggcaagatctcggctcac

SEQ ID NO: 52131 - DNA, 601 bp, Human
aatactgaccttaggcagaatcagaggggtgacagtgctcttggttggaagctttgctaaacaaggactcagaggtaagaatgttcaggaaatgtgtttggcgtgtgtccaggcaacaactagatatgttttcaggagttaattagagaggcagataattttgcaggaacagacagggttccagtgttagaatatctaaacattttgtcagaaatagggagccaccaaaagttactgaatacaacaattgtcaattgttatttattgggtgccaagcactgtgtgtgtgtgtgtgtgtgtgtgcgtgcgtgttcgtgtgtgtgtgtatgggtttaattcaatcgacaaaaataactctatggggtgggtgctattgtcattctagtttatagatgaggaaactgagggacagataattaaatgacccaaagtcacatgatcagttagtggcaaaagtatgaatggactctacgtttctctgaaaagtaagtgaacaaaacagtattgttagtaggataatgagacaaagtgttttttgtttctgtttgagacagagtctcactctgtcacccaggctggagtgcagtggcaagatctcggc

SEQ ID NO: 52132 - DNA, 601 bp, Human
tcattacacaatgataagtatctagataataagttaaccaaaccaatgacaggttcagattcattcaatctgtatttgaatgaatccaaatacaaacgagttaatataaatttttatgataaatgaaatttgtggaaagcaaatatcctagggatatggcttttctttttgtaataacattttcataaatgaaatatacccaggaggacttgatgattatgaaaggttaagggtcttttaatttcaaactaactctcacttggcttctaatacatgtttaaaattttgaaaagaaaaaaawtctattgagatgagaaacaaaaaatccagaggggtgacgtttggttagtcaggaaatacttcaaagagtatgggtcttagaaaatactgaccttaggcagaatcagaggggtgacagtgctcttggttggaagctttgctaaacaaggactcagaggtaagaatgttcaggaaatgtgtttggcgtgtgtccaggcaacaactagatatgttttcaggagttaattagagaggcagataattttgcaggaacagacagggttccagtgttagaatatctaaacattttgtcagaaatagg

SEQ ID NO: 52133 - DNA, 601 bp, Human
aaaagattctctgcatttataatattctatttctacaattatcgaaacacacgggatgaaggaccaaacaacatcaacaacaaaatactgggagggacatatattctgaattgtgatttttcagaaaattcttcaattttgtactcaggatgtcagtttatggtaacaattctctactccccttctgaggtgctaactgggagacaaacaaaggagacatctaaaccctttaccttgtaataattagactttgttaaagacgattccaatttccctcttttgtagctttgttattcactaytacgtttgaggagacctttgtctttgtcttttcctctttcagaatatcacaggtagctgatgttgccagataaaactccaaataagggagtttttgcatttatttacatgggatttaaattccaagatattccaatggaaagagaagtggcaatatgtacagggtgttagcgcattagatcattacccattccatcctgaagtgtaattggcttgcttttttgtctttttagctttggcttaaacctgagagtcttcccatcagtgctaccagaaggaatcatggtaaacttagtggagt

SEQ ID NO: 52134 - DNA, 601 bp, Human
ttattgctaacattcacaggtgtatcagcccaaagaattcgattgtcttagaccacagaattcatctcttgaaatttgaaacagtgattatcttcttaagaatcttacctttaagttaatatcaaggactagaaaaatgttttcccagaattttggaggctggtttattattttataaatttgaaagcgatcactcctttattcagattaaatccaggagagatgacagctctttgaatacacaactcaaaagattctctgcatttataatattctatttctacaattatcgaaacacacrggatgaaggaccaaacaacatcaacaacaaaatactgggagggacatatattctgaattgtgatttttcagaaaattcttcaattttgtactcaggatgtcagtttatggtaacaattctctactccccttctgaggtgctaactgggagacaaacaaaggagacatctaaaccctttaccttgtaataattagactttgttaaagacgattccaatttccctcttttgtagctttgttattcactattacgtttgaggagacctttgtctttgtcttttcctctttcagaatatcacag

SEQ ID NO: 52135 - DNA, 601 bp, Human
atgccattatatgtattaaagttctttgaaaattataatccacaccttacaatccatacacaatctactatatacacacatatgcatgtaatacatgtaattttgcatgcttgcaaaaataactttttcttaatagggctaatgaataatgttctaataatttggaattctatattataaattcataattacactagaagcagctataaacttagtacaataaccaatacatttcgatcttttatattgtgtctcagtaatcgtctacctttctgctgtcattccttttgtctgttattgktattgctaacattcacaggtgtatcagcccaaagaattcgattgtcttagaccacagaattcatctcttgaaatttgaaacagtgattatcttcttaagaatcttacctttaagttaatatcaaggactagaaaaatgttttcccagaattttggaggctggtttattattttataaatttgaaagcgatcactcctttattcagattaaatccaggagagatgacagctctttgaatacacaactcaaaagattctctgcatttataatattctatttctacaattatcgaaacacacg

SEQ ID NO: 52136 - DNA, 601 bp, Human
gatatcagtgcaaggcacacacaagggttctgtcaaacaaactttttatcttaccaagacaaggaagttttactagggcaagaccaagttttacaaggaattcttaaatgtctgaattctcataaaatccagaaatggtagtaagcaagaaagtaaaaccgtgaaataactctttgcattccaatttttctttaatgtgaggatattttaaaatacctttattataaggggataaagatatatagttaattatgccattatatgtattaaagttctttgaaaattataatccacaccttamaatccatacacaatctactatatacacacatatgcatgtaatacatgtaattttgcatgcttgcaaaaataactttttcttaatagggctaatgaataatgttctaataatttggaattctatattataaattcataattacactagaagcagctataaacttagtacaataaccaatacatttcgatcttttatattgtgtctcagtaatcgtctacctttctgctgtcattccttttgtctgttattgttattgctaacattcacaggtgtatcagcccaaagaattcgattgtctta

SEQ ID NO: 52137 - DNA, 601 bp, Human
ttttctgtaatgggacagcaaagcctggatgacagcacatctgttacagcatggtttactgaatatttgaagcccattgttgagacctacttctcagaaaaaaaaaaaagattcctttcaaaagatcactgctcattgacaatgcacctggttaccccagagctctgatggatatgtacaaagagatcagtgttttttttcattcctgcaaagacagtatttatcctgcagcctgtggaccccaggagtaattaggacttttcaagtcttattattcaagaaatacattttataaggctgwagcggccatagatagtgactgctctgatggatctgggcaaagtcaattgaaaaccttcaaaaaaggattcaccactctagatggcattaagaacattcgtaattcgtgggaggaggttaaaatattaacactaacaggagtttgtaagaagttgattccaatcctcaagaatgactttgaggattttaagacttcacgtggagtaagtaactatagatttggtggaaatagcaagataactagaattacaagttgagcctgaagatgtaactgattgctgtaatctcatgataacatttg

SEQ ID NO: 52138 - DNA, 601 bp, Human
ctcatttatcattctaaaatacctggagcccttaagatttatgctaaatgtactctgcctgttttctgtaatgggacagcaaagcctggatgacagcacatctgttacagcatggtttactgaatatttgaagcccattgttgagacctacttctcagaaaaaaaaaaaagattcctttcaaaagatcactgctcattgacaatgcacctggttaccccagagctctgatggatatgtacaaagagatcagtgttttttttcattcctgcaaagacagtatttatcctgcagcctgtggaccccaggagtaattaggacttttcaagtcttattattcaagaaatacattttataaggctgaagcggccatagatagtgactgctctgatggatctgggcaaagtcaattgaaaaccttcaaaaaaggattcaccactctagatggcattaagaacattcgtaattcgtgggaggaggttaaaatattaacactaacaggagtttgtaagaagttgattccaatcctcaagaatgactttgaggattttaagacttcacgtggagtaagtaactatagatttggtggaaatagcaagataa

SEQ ID NO: 52139 - DNA, 601 bp, Human
ctggactcaaagcttcaaaggacaggctgagtctctttttaagggctaatacagctgctgacttgaaattcaagccagtgctcatttatcattctaaaatacctggagcccttaagatttatgctaaatgtactctgcctgttttctgtaatgggacagcaaagcctggatgacagcacatctgttacagcatggtttactgaatatttgaagcccattgttgagacctacttctcagaaaaaaaaaaaagattcctttcaaaagatcactgctcattgacaatgcacctggttaccccasagctctgatggatatgtacaaagagatcagtgttttttttcattcctgcaaagacagtatttatcctgcagcctgtggaccccaggagtaattaggacttttcaagtcttattattcaagaaatacattttataaggctgaagcggccatagatagtgactgctctgatggatctgggcaaagtcaattgaaaaccttcaaaaaaggattcaccactctagatggcattaagaacattcgtaattcgtgggaggaggttaaaatattaacactaacaggagtttgtaagaagttgattcc

SEQ ID NO: 52140 - DNA, 601 bp, Human
tagcgtacttaataagtgctgcgtgtgttctgactgctccactgaccagccattccctcatctctctccctctccaagggtctccctaatccctgagatatgacaatattgaacttaggccaactaatatccctacagtagcctttaagtgttcaagtgaaaggaagagctgtctcactttaaaggaaaaaacagaaatgattaagcttagtgaggaaagcacaccaaaaactgagacaggccgaaagctaggcctcttgagctcaacagtgaattgtgaatgcaaaggcaaagttcttgmaagaaattaaaagtgctagtcacgtgaatatacaaatgataaaatagcaaaattacctcattgctaatatgaagaaagttttaatggtcgggattgaagttcaaaccagccacaatattcccttaagccaaagtctaacccaaagcaaggccctaattctcttcaattccatgaagtctgagagaggtgaggaagctgcagaagaaaaatcttaatctagcagaggttggttcatgaggttgaaggaaagaagccatctccatataaaagtataaggttaagaagcaagtgctgaaggag

SEQ ID NO: 52141 - DNA, 601 bp, Human
cagttgtcctgaggcattagctctaaaactacatttctttttgcagttatggatactgcagctccttgtagtaggcagaactgtaagatgacctccaagattcctgggtcctcctgtacatacactttctctcagttattcaataacactgatctaggacctgttctgaagggctttgacagatgaaatttaggtcccaaatagttgaccttacaacaggaggttatccaattgggcttgatatacacacacaagccctgagttttgtttggctggtctcagaagaggaagtcagagagaygtgcatcacctggcctgaaagaaagcacacatctatgagggccacatgggaactgcccataggggcttgacagtggtctccggccaacagctacaaggaaaatggggacctcagttctatggatgcaaggaaatgaattctcccaacaaccagagagcttggaaaagtactctgagcccagatgagaaccacggcccagctgacatctcaatttcagcgtagtgagaccctgaacagaacatccagtcatgctgtgcccagtctcctgccctacaaaaaactgtgagataattaatttgc

SEQ ID NO: 52142 - DNA, 601 bp, Human
acttttttcctggaaatcacaccaattaatgtgatgtcctacaatgctattttcaaaatctgacagtaggggtaagatgccatactaattttccaattttatctcattgactgaacatttaaaaactgctacaatagtgcttgatgcacttcaggaaattttccagaagtagttcttgaatgaagaacacaatgttcttccaccaccagtcttggagaatcagttgtcctgaggcattagctctaaaactacatttctttttgcagttatggatactgcagctccttgtagtaggcagaaytgtaagatgacctccaagattcctgggtcctcctgtacatacactttctctcagttattcaataacactgatctaggacctgttctgaagggctttgacagatgaaatttaggtcccaaatagttgaccttacaacaggaggttatccaattgggcttgatatacacacacaagccctgagttttgtttggctggtctcagaagaggaagtcagagagacgtgcatcacctggcctgaaagaaagcacacatctatgagggccacatgggaactgcccataggggcttgacagtggtctc

SEQ ID NO: 52143 - DNA, 601 bp, Human
ctgaagacttctctaacacatccttcaagaggcaaataaggacacaaagtcagttgtcctttgtcctgcttcctttcacttctttagtttcttgctttgatatttagggtttgttatctgtttagcaatgttattataaaagtattctttctgagaaggtcagcttcatctaaaagagcttcaaaaatgacttttttcctggaaatcacaccaattaatgtgatgtcctacaatgctattttcaaaatctgacagtaggggtaagatgccatactaattttccaattttatctcattgacwgaacatttaaaaactgctacaatagtgcttgatgcacttcaggaaattttccagaagtagttcttgaatgaagaacacaatgttcttccaccaccagtcttggagaatcagttgtcctgaggcattagctctaaaactacatttctttttgcagttatggatactgcagctccttgtagtaggcagaactgtaagatgacctccaagattcctgggtcctcctgtacatacactttctctcagttattcaataacactgatctaggacctgttctgaagggctttgacagatgaaattta

SEQ ID NO: 52144 - DNA, 601 bp, Human
ctaggacattaataatacatcaacagaataaataagtagcaaaggaaagttcttaaacagaaagcaataatgtgtaaaaggttttgcttttaataaataaagccagaatgatcaatgacaacatgacgtaaacctcaaatatatttcttagaagattctctccacatcatttgatcacagcatcagaaagtcctcagaagagtgttatatttttaaaaaggaccagatagcttcacaattcccaggtagtaaaatggttttttacttcccaatgaagcagaggcgaggcacattagaggtrggagaatacagcagagttcacagggagtgaatcatattcatatgtatatactctaatggcatagtatttgctttaatttgctttaaatttcaaaggtgttcagggattttcttctgttcatactgaagatgactgtgaaagtcagacagattaaaattaagcacaaatcccaattccatttagaagtttgtgttctcagaaattcactttacctctctgagcttctctgcctaatctatagctttcaacagggagatgaaatgaaataccatacaaaacacctagcagagtgtccaacat

SEQ ID NO: 52145 - DNA, 601 bp, Human
ccagcccggccaacatggtgaaaccccatctgtcctaaaaatacaaaaattagccaggtgtggtggcaggtgcctgtaatcccagctacttgggtggctgaagcagaagaattgcttgaacctgggaggagaagcctgcagtgagccgagatcacgccactgcactccagcttgggcgagagtgagacttgatctcaaaaaaaaaaagtatatatatatgtatatatgtatataaatgtatatatgtatatatgtgtatatatgtgtagatgtgtatatatgtatgtgtatatatgtatayaaatgtatatatgtatatatgtgtatatatgtatataaatgtatacatgtatatatgtgtatatatgtatatatatgtatatatgtatttacatattattcagctaacttaataaacagttttgaacatatactatgcacaagccacgagtattttggggggaaaaataataaatcaggcataatttcctggcatgcctttatgttttccagttaccttaaaaaatcattaaacaataagtacaacactttacacagtcaataaatttgttattaaaataacaattgtcagttaaacaaa

SEQ ID NO: 52146 - DNA, 601 bp, Human
tgattagaaactccaacagaagagcaaattggaaactccagcacagaggtgaatttccaatttccaacacagttcagtatggtcaatacactaaaccttctccagcttagactcataatgttagaaccaggtcatgtctttgaggtgtaaaataacctctatcagctccatagtagtaagttccattagtacaaaggctcttgtgttcatctctgtatccttagttggctacatcacataggaaacactcaaaaagacaacaggatcttaaaatacagactgtttcttcaatctacattctttttttttttcatttaatttcatctcatgtcaatagctagatccatccacattgtccttttttaagtgtgcatgcttttccatgccatggtatattatagtgtgttcagcaaatcccatgctatcacatatctcaattgcttccaatcttcctccctccctttctctcttccattctcctccctttctccctttccttcctctaatacaatcaatactgtgatgaacatccaagtgtttgatattccttttaacaaaattactacaagtggtcctgatagatttctggcaaacaaagtat

SEQ ID NO: 52147 - DNA, 601 bp, Human
gggatggatggatggatggatggataaaataaaagggtaaatggaaaactttctagagaaaaaaaattcacagcactttgcaagctctttctagcaatgatactattatagaactgggttatgcactttacttctctcatattgtagcttaaatttttttcttgttccactgtcagtgagatgagagaacagattactgttctgtaagagtagtgaaagtgtctgtatttaaaagtgggcagaagtgagtaatattatgttcaatggtgttgcaaactaaccagaattgaattacacttaytaaaatattcagaaaaaaattatttctgttatttacacatggaatataaggcaaatttcggtttcaaatgtacaaaatgtaaagaagtaaaaacaaattggagagggcaggtgggaatattttaaaagctgtgcaagtggatttaaaactctacttaagagactagagataaatattctgtttgctcacaagttataaaagtagcaaaccatgatggtgcaggcttctcccatcagtaagaaaagagaaaaaaattatgggttcccagaatcaagaagacattaaaattaagtgtagaat

SEQ ID NO: 52148 - DNA, 601 bp, Human
ctgactttatgccctaaggagttcttcagttttcggcactagaatcaagtctttcttagtgagacaatgatgaaaagctttctgctatgggaatttcaaaatcattcatgttataagtggcaaatccaaataaaaaaagaagactctaggtttagatgaaatactctgctctatacattttctaaccacagaaaccagggaacattcctttttgtagtatttgtgagtaatgcagggaatttagagtcatttatttccctgctagcatttaaatgaataattttagatcattttaataatytgataatgtgaagtgctgtaaatggcagagttttctgttatatttactgataattgttcacttggattgtcaagatcatagtgttagaacctcagaagttttgttatttaactttgtttaggactataaaaaaaattcactgagaccatgagaaaattctctgggatggatggatggatggatggataaaataaaagggtaaatggaaaactttctagagaaaaaaaattcacagcactttgcaagctctttctagcaatgatactattatagaactgggttatgcactttacttctctc

SEQ ID NO: 52149 - DNA, 601 bp, Human
attcagaagagtagggaagaagaaacaaaaagcaaagcatccttaattaaagcattcaagatgatagctgatctttcacttgtgttgaccaaatggcttatgcttatttcaatcactgccatctatcagtcttaattagcatctatccaataaaacacttcacttctgaaatatattaattactgttttatgtctttggttcctattatcctagctgtacaaccacaaccataaaaacatggcattttccagcacaaagggatagtatatgttatgtatgatttatgtaagtttcattaayatttagaggagtggtctggaataagctgctgttctctgactttatgccctaaggagttcttcagttttcggcactagaatcaagtctttcttagtgagacaatgatgaaaagctttctgctatgggaatttcaaaatcattcatgttataagtggcaaatccaaataaaaaaagaagactctaggtttagatgaaatactctgctctatacattttctaaccacagaaaccagggaacattcctttttgtagtatttgtgagtaatgcagggaatttagagtcatttatttccctgctag

SEQ ID NO: 52150 - DNA, 601 bp, Human
caagactgggcaatttataaaggaaaggggattaattgactcatagttccacatggctgggaaggccttgggaaacttataatcctggtggaaggggaagaaaacatgttcttcttcgcatgatggcgggaaggagaagtgccaagcaaagagggaaatgccccttataaaactatcagatctcatgagaattcactcactatcatgagaacagcagcatgagggtaaccactcctatgattcaattacctcccaccaggtccctcccatgagacttggggattatgggaactgcaatttwagatgagatttgagtgaggacacagccaaaccatatcaggcatgcactacacatcagtttccctgtcaaaaagcagttattattattttttctccatgttttttcatatattcagaagagtagggaagaagaaacaaaaagcaaagcatccttaattaaagcattcaagatgatagctgatctttcacttgtgttgaccaaatggcttatgcttatttcaatcactgccatctatcagtcttaattagcatctatccaataaaacacttcacttctgaaatatattaattactgttttat

SEQ ID NO: 52151 - DNA, 601 bp, Human
catattgttataaagaactgcccaagactgggcaatttataaaggaaaggggattaattgactcatagttccacatggctgggaaggccttgggaaacttataatcctggtggaaggggaagaaaacatgttcttcttcgcatgatggcgggaaggagaagtgccaagcaaagagggaaatgccccttataaaactatcagatctcatgagaattcactcactatcatgagaacagcagcatgagggtaaccactcctatgattcaattacctcccaccaggtccctcccatgagacttgrggattatgggaactgcaattttagatgagatttgagtgaggacacagccaaaccatatcaggcatgcactacacatcagtttccctgtcaaaaagcagttattattattttttctccatgttttttcatatattcagaagagtagggaagaagaaacaaaaagcaaagcatccttaattaaagcattcaagatgatagctgatctttcacttgtgttgaccaaatggcttatgcttatttcaatcactgccatctatcagtcttaattagcatctatccaataaaacacttcacttctga

SEQ ID NO: 52152 - DNA, 601 bp, Human
taggaagttccaaagtttcccacatcttcctgtcttctgagccttccaaactgttccaacctctgcctgttacccagttccaaagtttcttccacatttttcggtgtctttacagcagtgccccactctactggtaccaatttactgtattagtccattctcatattgttataaagaactgcccaagactgggcaatttataaaggaaaggggattaattgactcatagttccacatggctgggaaggccttgggaaacttataatcctggtggaaggggaagaaaacatgttcttcttcscatgatggcgggaaggagaagtgccaagcaaagagggaaatgccccttataaaactatcagatctcatgagaattcactcactatcatgagaacagcagcatgagggtaaccactcctatgattcaattacctcccaccaggtccctcccatgagacttggggattatgggaactgcaattttagatgagatttgagtgaggacacagccaaaccatatcaggcatgcactacacatcagtttccctgtcaaaaagcagttattattattttttctccatgttttttcatatattcagaa

SEQ ID NO: 52153 - DNA, 601 bp, Human
tccctcccaggacatgtgaagattatgggaagtataattcaaaatgagatttgggcagggatatagccataccatatcattctgccctgacccctcccaaatctcatgccctcacatttcaaaacacaatcatgacttcccaacagttccccaatgtcttatccagcattaacccaaaagtccaagtccaaagtctcatctgaaacaaggcaagtcccttctgcctacaagcctgtaaaatcaaaagcaagctagttacttcctagatacaatggaggtgtagccattgggtatatacacrtgttcaaaatggaagaaattggccaaaacaaaattacaggccccatgcaagtccgaaatccactagggcagccaaatatcaatgctctgaaatgatctcttttgactccatgtgtcacaagtaggtcatgctgatgcaagaggtgggctcccatggccttgggcagctccacccctgtggtttgcagggtacagctctgctcccagctgccttcatggtctggcactgagtgtctgcagtttttctaggcaactggtgcaagctgtcagtggatctaccattctggggtctagaggacga

SEQ ID NO: 52154 - DNA, 601 bp, Human
caacaaaaggtaaacaaatgtaaccaaatggataaagggggctgcaaaattaaagttagaaactaacatatcaatgattcatattctctatgccacaagacatgaaaaaaacattagtttttactactctgtattctggggacattcctttaagattgcatttaagatgattttagagacaataagcatttctttagatggagttgatatttagtttctaacttttcagagtttatttctaggcatagagtctttaactgtgggtagcacttatctgtacaacatagtgttctgcttctgygattaacgcaaatatcacgtaaagatggagctgatgtgagccagggtctagagccctcaaaggcactaatgtatttgtttgcagagtgtgatgcaatttcatggggaatcaggtcaatccaacttttcagcacctatctacctcctcctcaggctgtagggtattgtattagtccattcttgtgctgctatacagaagcgcctgagattgggtaatttataaagatcagaggtttaattgactcaaagtttcacagggctggggaggcctcaagaaacttacaattgtggaagaagggga

SEQ ID NO: 52155 - DNA, 601 bp, Human
tttgaaagtgtctggaaaagtaaatctctcaattaatttcataaaaggctattactgaaatcagcatgaatatttccatgtccagccttggatatgctttggtctttgacagcttgactatctctatgattgggcaacaaggacagggttttaaaggacaatgtctttttactctttgcttctctagccacaaggaatactaacttcaagaacttcctaagcacttctctttgatgcatttgccttttttattgttttagcagaattattagcctttctactctcagggtagaacattctrtgaatcagaggacttcaatcatacttgctttatacttaatgtcctttctagtctttgactaagacattgaaataagaaataatgcaatgcacaatcaaaataattctatgcaagatctgatagctatcagaatttgaaaatatgaaatgctgtttgcttatccttgtattccatttatttaaaacatttggtgcatgtttttacatattaagaacataattatatatattagcatataatttcataaaagatcattgcctatcttaccttattgttgccttatttgtgaatgttatgtat

SEQ ID NO: 52156 - DNA, 601 bp, Human
cacatgctgaaccaaacaaaactcccaattgacaagatgaaacagtgtgaagtggcctaagattcttattcacagttgcataacaggctccttgatctgcaatatgtttggcagcaatagcatgaacagatactgtgcaagttacaaattaactagaacatcattaactggtgctaagaagacagaacctggtgttatctttagtaaatgggtaaataaggaatttttttttgagctatggctttgccataatgccacaatgaatgagccacaatcatataattgcttcttctcaaagaayattcaatgggctacagtcaggtttttttgtttttgttttttttgagatggagtctggctctgtcacccaggctcgagtgcagtggcgcgatcccagctcactgcaacttccacctcccgggttcaagtgattctcctgcctcagcctcccaagtagctggaagctcccaagtagcttccaccagataccctaaatcaggcttccgccaccaaacctggctaatttttgtatttttagtagagacggggtttcaccatgttggccaggctggtcttgaactcctgaactcaggtgatctgc

SEQ ID NO: 52157 - DNA, 601 bp, Human
tctctacaaaactaatttaaaaatatccaggcatggtggtacacacctgtggtaccagctacttcgtaggctcaaccagaggattgcttgagcctgggaggttgaggctgcagtaagccattatcttgtcactgcattccagtctgggagacagagtaagaccctgtctcaaaacaaaaacaaaaacaaaaacatacacacacacatgctgaaccaaacaaaactcccaattgacaagatgaaacagtgtgaagtggcctaagattcttattcacagttgcataacaggctccttgatctscaatatgtttggcagcaatagcatgaacagatactgtgcaagttacaaattaactagaacatcattaactggtgctaagaagacagaacctggtgttatctttagtaaatgggtaaataaggaatttttttttgagctatggctttgccataatgccacaatgaatgagccacaatcatataattgcttcttctcaaagaacattcaatgggctacagtcaggtttttttgtttttgttttttttgagatggagtctggctctgtcacccaggctcgagtgcagtggcgcgatcccagct

SEQ ID NO: 52158 - DNA, 601 bp, Human
agtacattacttgtttgcctaaaagccatcagaatttaaggccaggcatggtggctcactcctgtaatccccacactttggggaactgaggacaagagatcatatgaggccaggagtttgagaccagtctgggcaacatagataaacccctgtctctacaaaactaatttaaaaatatccaggcatggtggtacacacctgtggtaccagctacttcgtaggctcaaccagaggattgcttgagcctgggaggttgaggctgcagtaagccattatcttgtcactgcattccagtctgggwgacagagtaagaccctgtctcaaaacaaaaacaaaaacaaaaacatacacacacacatgctgaaccaaacaaaactcccaattgacaagatgaaacagtgtgaagtggcctaagattcttattcacagttgcataacaggctccttgatctgcaatatgtttggcagcaatagcatgaacagatactgtgcaagttacaaattaactagaacatcattaactggtgctaagaagacagaacctggtgttatctttagtaaatgggtaaataaggaatttttttttgagctatggctttgc

SEQ ID NO: 52159 - DNA, 601 bp, Human
gagaaacaagtgaactgcttgttatactgatgttttctccaatcctccacaaagcatatatgcacacaggaagcaattataagctacagaactcataatacattttgaaaaagggatatacatagtacattacttgtttgcctaaaagccatcagaatttaaggccaggcatggtggctcactcctgtaatccccacactttggggaactgaggacaagagatcatatgaggccaggagtttgagaccagtctgggcaacatagataaacccctgtctctacaaaactaatttaaaaatakccaggcatggtggtacacacctgtggtaccagctacttcgtaggctcaaccagaggattgcttgagcctgggaggttgaggctgcagtaagccattatcttgtcactgcattccagtctgggagacagagtaagaccctgtctcaaaacaaaaacaaaaacaaaaacatacacacacacatgctgaaccaaacaaaactcccaattgacaagatgaaacagtgtgaagtggcctaagattcttattcacagttgcataacaggctccttgatctgcaatatgtttggcagcaatagcatg

SEQ ID NO: 52160 - DNA, 601 bp, Human
tctgacaaatcatctgttttattatttctgacatccttacctattctgcttaattaaatgatttatttacataaacgggatatttgcttaatctaatccaggattttaagagggagaaatgctttaggaataaaaataatttcccttgcatatatgaacaaacaaatagtacttctgtgtgaaggttgataaaaattaactcccagaataaagtggaagcaaaactgatgagagggacaggatggaaaaagtaggcagtttccagccttttgtgagtcacatattaactctgtggttaccrtgtctcaagaattttcaggttacagatactctccaatgaacaattaaaacccttgccaaagccaaatgtaaacgactttgaaaaaagttttatactcctcaatggcagacacacacacaaaaaacctgaagagtagaacagagtgactaattcaccagcacagcatttcgagaaacaagtgaactgcttgttatactgatgttttctccaatcctccacaaagcatatatgcacacaggaagcaattataagctacagaactcataatacattttgaaaaagggatatacatagtacatt

SEQ ID NO: 52161 - DNA, 601 bp, Human
aatgactgaggcagcctcctccacagcctttgttttctagatttttcgtgcctacagaaattccccatgaagattccactattccacacttcactgataaggaatgacaaactagagcactgcttttgtttctgagtttcaatttccgaaatacgaatagcatagtaatgtatgtaactgtaactcatcaagttctatatattttttaattcatatttttaaatagtgaattttcaattatcttcaaaggatcatatgccctacagtttatttctgacaaatcatctgttttattatttcygacatccttacctattctgcttaattaaatgatttatttacataaacgggatatttgcttaatctaatccaggattttaagagggagaaatgctttaggaataaaaataatttcccttgcatatatgaacaaacaaatagtacttctgtgtgaaggttgataaaaattaactcccagaataaagtggaagcaaaactgatgagagggacaggatggaaaaagtaggcagtttccagccttttgtgagtcacatattaactctgtggttaccgtgtctcaagaattttcaggttacagata

SEQ ID NO: 52162 - DNA, 601 bp, Human
agtgatattatttccctgtttgattttatacaatggtaggccattggatcaagtgttctgtgacctgtttatcgttgcttattcctggatagaattcagtagagaaaattcagaaactataatgatggacttacatcaaactattgcactcaaactatttaggaaactgtctgaagtctgagagtgtagttcattatttgtgcttgtctcacaagggcacaatattctatgtcattttttatatcatagaaaaggttaggtttgaaaacttagcattacaaatgtcacatttacttccagyaggaaatgtgcaacaatatgtgacaaaactgaataaaatgttgaaacatgttttccttttgttttactttactcatttttgtaatacaacactggttactggaaaatgccttacagctttattcaaaacacatgttcaaagatttgaatgaaaaaacttcgactctctctggaacatctaaccgatacatcatttgtgtgccttaaattttttcttactgtcaggaacacttttatgtctttaagatttatttaaactaggttattatataatgaagcttgtcagatcataggaacaaag

SEQ ID NO: 52163 - DNA, 601 bp, Human
gtggcatcagatctgaagtgaaatcataaaagcagtcactgacatgatctagaaacttaactgtttttttcttagagtgaagccttataaccaagaccatgcgattcaattaagactcagaactgcttttctttaatcaaacgtctaagaagtagtttggacgactaaccaaactttcctccttgccaaaacctttgtagcatgcattcattcaagcaacagccaaccatgtattgatcacatactatattctaatctttgggcatactcatgaataagaaacaatgcctcatattagaaygaatttatctcacagttcaagctcaactatgttacaaataattaaaatatggccaagtaactatagctacagaagtatttacaaggccccacaatagcatagtcactaacagttttgcctgagagcttcacgcaaggtttcacagtctcacaaacatgacagtgataaggttaacaagtagtctggcagaatcacctctgcatgtcatacaatataatgaaaaatctgggaattgtaggtaataatagtcatcatacaaatgttatttattaagaactctctgtgtaccaggcactgtgc

SEQ ID NO: 52164 - DNA, 601 bp, Human
attatgtatgtaatacatatataataatatacttcgataacacactagtgaattcttgtcaaggacaatattaactgctcattaaagattaattgttttcaggcttactattaagttaccagaaagacattgcttagggaggaatctctctcttttttgttactgatatatctcaagtgccaaaatagtgacttacacatagtgttcaataaatgttcagtatattaataaatgagtttcaaataatccatcctgtaacacaatcacctgctcagtaaaatttattacccagattgcagaytgaaaaagttttctttttctgaaatgttagtattttagtttacccagtacatcaagtcacacacacacacacaccccacattaaaaatctgatagcttatttaaagtttaatgaaaagcccatatatcagattaagattgatatttgaatcctaacatcaagtttctctggagttaaaacaaaaaatcagggtttttttcctatataatcttgggatttataaaacccctgaataatagataaatattttatttttattttcagataataaatgtattgaaaattatacttacaaaaata

SEQ ID NO: 52165 - DNA, 601 bp, Human
ggttgtaaaagttaccttttcttagccaggcgtggtggctcatgcctgtaatcccagcactttgggaggccaaggcaggcagatcacgaggtcaggagatcaagaccatcctggctaacacggtgaaaccccgtctctactaaaaatacaaaaaaattagcttggcatggaggcaggtgcctgtaaatcccagctacagaagaatggtgtgaacccgggaggcggagcttgcagtgagcagagatcgcgccactgcactccagcccaggcaacagagcaagactctgtctcaaataataataataataataataataataataatgatgttaccttttcttttttaaccaagtcatatttaaagacagcttgcagtgcactatcttacattttctgaagttccaattgttgatatttctaagatagctcctcatttacctaagttttgagccactcttgaaacaggaaggatatcaccagaatcacatgaggctgagaaaattgagtaattttcaggtttgtagaatgacaaagttaaatgagaaagttagtgagataataaaacgatgatccctaaagactattagactgctgatttagt

SEQ ID NO: 52166 - DNA, 601 bp, Human
taaaaagacaggtttggatgcatcctactgatggcccttttagtctcaatgggctatgattctgtgaataattttgctatactttaaatgtaacaatccccttttaagaaaatcaagcagatgtgactgagaacaagtgtaatgatttgtttaccaaacatgtaggcagcacctgctagtatggcgtccagcaccagggaaatgtattaacacagaacacagaatcagcatggcaggctactgtattccatgaataaaccactggggcatgccgtgttcatagagaaggctcagaattgtkttcttctgtgtctttctgcttcaataggaaaacaaaactgaaaatatttgttgtaattagctttcatttatttgcatccaagttaatattctgcagtacattttgaaattcttaagatcaagacttcaaaaaatcactcattgcatatatgattaaatagctattttgtctttccaaaataactatccacaataacttttaactaaaaaaaataaattttgttcacgtcttggaggttgtaaaagttaccttttcttagccaggcgtggtggctcatgcctgtaatcccagcactttggg

SEQ ID NO: 52167 - DNA, 601 bp, Human
cagttttagggaatccagggtgtacatcaatgcgttattcacaaatttaaacaggtaatactgaactcattttctagattttgaaacagagctgaaagactcaataatatacctagtaagaggccacaactggcttcaaacctgggacttttttcctttttcctccaaagacagaattttttttttctatgccatatggcttttttctttttctttctttctttctttctttttttttttttttttgagacagagtcttgtggagtcttgctctgtcgcccaggctggagtgcagtggtgygatctcagctcactgcaagctccacctcctgggttcacaccattctcctgcctcagcctcccaagtagctgggactacaggcgcccgccactatgcccagctaattttttgtatttttagtagagacagggtttcaccgtgttagccaggatggtctcgatctcctgacctcatgatccgcccgcctaggcctcccaaagtgctgggattacaggtgtgataggtgtgagccacggtgcctggccatggcttctttctaaaagaagaaaatactttcttatacaacatacaaaatataga

SEQ ID NO: 52168 - DNA, 601 bp, Human
gcaaatgaaactgctaggggagaaggtctgatagaagtctaaggatttagactcatgcactgagtccactggactcacgcagttaagacagttttagggaatccagggtgtacatcaatgcgttattcacaaatttaaacaggtaatactgaactcattttctagattttgaaacagagctgaaagactcaataatatacctagtaagaggccacaactggcttcaaacctgggacttttttcctttttcctccaaagacagaattttttttttctatgccatatggcttttttctttttttttctttctttctttctttttttttttttttttgagacagagtcttgtggagtcttgctctgtcgcccaggctggagtgcagtggtgtgatctcagctcactgcaagctccacctcctgggttcacaccattctcctgcctcagcctcccaagtagctgggactacaggcgcccgccactatgcccagctaattttttgtatttttagtagagacagggtttcaccgtgttagccaggatggtctcgatctcctgacctcatgatccgcccgcctaggcctcccaaagtgctgggattac

SEQ ID NO: 52169 - DNA, 601 bp, Human
tgagaaggaaatgggggggtctcttgtttgaaagaaatggtatgtcaaattaattctgtcccataattgatttattctgacagatataagacagtttgcagacaatggcatctttctctttgatgtgataacgttcaaactgctttgttgtagagcggggcaaaggcttgtttgatgccattaactgaaatacaaaggaacttccaagtaccgcagccttgggatgcttggataagactcagatgcctgtaaaattaggcagtcacctgacaagtatttatataaatgagatgacattagyggtgtttcctcgagcacagatgtaacataagaatttatcattttagttgaaactgagaaaacgaatgtctcttttacctaaatcatttcaagagcctgacatataaaatgtcgcatcaccattaataacgctctagatatatcaatgtggaaacagatttttaactaacctaggctaatatcaaacagagcaaaatcaaaaaagctcagtgagcatttgtgaaacagtatagtaataaaataattttgcttgtcctccactttcaatttttttttttttgagatgggttctcactctgtt

SEQ ID NO: 52170 - DNA, 601 bp, Human
ttctctgcaacatattccttttgtaacaatctacagagatgaagagcataatattaaggtgaggttttcttatctgcctgtttaatattcaaatgagattggtaaacaccaactagctatttaacctgatcagtccaataatggcatacataattaatgctgggttcccatcagactgctggaagagaaataatggtcagaagcattcccaaataacaggaaatactttgagcttcacacataacactttaaaatgcatgttgccttctcttggagatgccaaagtaatatgtgatttaaaacacacacacacacacacacacacacacacacacacagacatacacacacagaggaaaatacttggaagaggaaaaaagtgagggaatttcttgcataaacaaattagagtatataggaacgtgatgcaactacacacagtcacatcctgtgcagagccatgaggctgtgtgtaacggagaattaggagaagtactattccagagttttcttacaaaaacctgattaaaaatttaagtaagttatttctgaaatttatttcttgcacccacctatgcagcctgggaaacatctgttctga

SEQ ID NO: 52171 - DNA, 601 bp, Human
ctttatttttcggaccatcaccattaaacaactataacaaaactctgactcctggatatttgatgttattagtttgcccttgacaaaatcataatgtctcctgaaactccttcttagaggccaaatataaaacttcgtcgatcatcttttgaaagtgagttttaaatattaattgttaataatgtcaagcaatcctgattcaacgtaactgtcaatacagacccctttgctgtaggaaaaacacttggaaccacatatattctactttctaatgaatttcctttttaaaaataatatttgwtgatttaaaagaaggatctaacctattataatatttgaaaaggtcattatttgattatattagtcacaattattacaatatgactaatttcctctgttataaagaaaggaaaatatttcagttactttagctgaaataattttaagttacaacttaactattaagaacttctctattctaggtccatttgtatatgcaatcacagatatctttctttttcctgatcacttttccagttctctaaaaaaaaagatttttgctagattttattttgcttttgctgtgcaaaacctatgatgc

SEQ ID NO: 52172 - DNA, 601 bp, Human
aaatctttgttcaggaagactgcaaacagacatcaggttcacagaatttcattagtaatttattcttttctactgaccacattgctcgtattgttttagacattttcattattcttgtgatgtttgagaaatgacaaaattcgagaagaggaatcttacaaagatacagcatggcacaaaagctatatggataattgccttcacaaatgtagttcagctctcatctctcctaattagcctcattaccatactttaagagagactagcagtcactcaagactctgttcttttctgtcagaamgagtgctgacagccaaatggacaacatatggaaaagagctctctttccggctattctttcatgctttaggcctttggtcaaaaacgcaggccacagaagggttcccaaactccatcctcaaataggtgtctctaattccgagatagacaatgcacttgaaatgcattcatctctcactttatcacaactttgagaggctggtcactcatttcaagtatgttctataggaactgaccattttctaaaataacttaaaaagtataagcatactaattctactagacaactttatttttcgga

SEQ ID NO: 52173 - DNA, 601 bp, Human
aatacaagtattttaactgttaacttttgtgattaaatacttaaaaaaacccaaaacttatgttcagtgtcacctactatgaaatcactgtacagagatctaggtccattcttttactttcataactgttgtgaaagttaaagtgcattaaacctttgaaaatagaaatgaaaatgtctcaactttctaaatcacataaaagagaatacattttatgcttgcttagtaagcctctgatgtcttttcctttcaattatactaaattactgacttgccatgatgactaacataaaaggaccaygcaaaatcctgttcacataccaaagaagatatatagattcaatataataaagtgcaaataattttcatttttgtaaactaaacaacaacaacaacacttgtgagtattatcttagccatcctccaaatctttgttcaggaagactgcaaacagacatcaggttcacagaatttcattagtaatttattcttttctactgaccacattgctcgtattgttttagacattttcattattcttgtgatgtttgagaaatgacaaaattcgagaagaggaatcttacaaagatacagcatggca

SEQ ID NO: 52174 - DNA, 601 bp, Human
gtgtcacttaatttgattttttctttaatcctacaaaacaaaaataaaaattatctcctttatgtgttttagaagcttataggctaatgagcttttgagcaaaagatataagatataaaagttataatagacttaaaaacaataaaacattatgtccagatgtaaatgtgagtacaaacaattaccaaccaaatccagttggtattcctattgaattaaatcagcctagtttctttttggaggaaaaaacttcagttacactttagaaagagtttgatgcttttagaatgtcatatttttatatatatataatatgaaatgtcagcaataccattcaaaaataattcagcagattaaaaaatacaagtattttaactgttaacttttgtgattaaatacttaaaaaaacccaaaacttatgttcagtgtcacctactatgaaatcactgtacagagatctaggtccattcttttactttcataactgttgtgaaagttaaagtgcattaaacctttgaaaatagaaatgaaaatgtctcaactttctaaatcacataaaagagaatacattttatgcttgcttagtaagcctctgatgtct

SEQ ID NO: 52175 - DNA, 601 bp, Human
cctatgtgtcacttaatttgattttttctttaatcctacaaaacaaaaataaaaattatctcctttatgtgttttagaagcttataggctaatgagcttttgagcaaaagatataagatataaaagttataatagacttaaaaacaataaaacattatgtccagatgtaaatgtgagtacaaacaattaccaaccaaatccagttggtattcctattgaattaaatcagcctagtttctttttggaggaaaaaacttcagttacactttagaaagagtttgatgcttttagaatgtcatatttttatatatatataatatgaaatgtcagcaataccattcaaaaataattcagcagattaaaaaatacaagtattttaactgttaacttttgtgattaaatacttaaaaaaacccaaaacttatgttcagtgtcacctactatgaaatcactgtacagagatctaggtccattcttttactttcataactgttgtgaaagttaaagtgcattaaacctttgaaaatagaaatgaaaatgtctcaactttctaaatcacataaaagagaatacattttatgcttgcttagtaagcctctga

SEQ ID NO: 52176 - DNA, 601 bp, Human
gaaaagttatggggattacaaaatctgacagactgacttatacattgggcattattcaattggagtcaccaattcagacttcctttctgctctattctgacgtctttttatgtttctagttgagtctccttagcagttttcagtgcttagccttgttctaatatgatgatatttgggatgacacatttcctggtctacaatactgtttttcaaaggtgagggtgacccatatgccaccctcatcagaataacccaggagtacttgtttacaaatatgtttcttttgccctactccaagacscggtgaatcagaatcactatagttataagttccaggaacctgtatttttagccatttttagcagggtctcctgtagtgagtctcagacatgctcaagtttgagagtcacttccagtcttttagctccagctgtactatggccttctgggttctgctacatcttctttatcaaagctactgactatacctttgccctatccttgctccaaaggagcttagtcatgtgattgaaacaagagacaaagcggagttgctcaaatttgctactgaatgtatttaaaagtaataaaatttcatatg

SEQ ID NO: 52177 - DNA, 601 bp, Human
gtgacctgggcctgaggcagaaggctgcttcagttaggagcaagaatcttgcatcaatttagtttcctgcttgttgttcctctaaaattcttagttctccactcttggcctggtttctgatcacttgtatttttccatccctgataggcacatcttcctgattacagtctaccatgcattctcgctctatccatggctattctagaatcctcgaatgttagagctaaagaatttatagataacaatcatgaacccagaaaagttatggggattacaaaatctgacagactgacttatacaytgggcattattcaattggagtcaccaattcagacttcctttctgctctattctgacgtctttttatgtttctagttgagtctccttagcagttttcagtgcttagccttgttctaatatgatgatatttgggatgacacatttcctggtctacaatactgtttttcaaaggtgagggtgacccatatgccaccctcatcagaataacccaggagtacttgtttacaaatatgtttcttttgccctactccaagacccggtgaatcagaatcactatagttataagttccaggaacctgta

SEQ ID NO: 52178 - DNA, 601 bp, Human
tcaaatcatcagtcctcaattaataaaatgaattgtgtctcatcatctcaaaactcaacaatttttttaaatggtattttccaacaaagatgattttcttccccttttcatcattcagtgtgactccaccatcctgaaattggcaccaacttcctccaccatatccaattagtcaccaagtcctgtagattgtttctagtattgaggttttccttctatgaggggatagctccttgcacttgtgtctttgttttccaatccaccaatgatatcatttctaggttaaatttctgaagacaaycttaattatatcatgtcttcgtttataactttcatcttttcacaactcagtggataaattccaaaatcctttgtgccacattcataaggctcttcataacctagattcctcaattacccatcacccttctctgaaccctcccagtcaaactagtttattctaagttccctcaaacagacctcatacactcccagctcagtgcacttcatacattcttctctcccctcctctcaactgtcagaaacctgtgtaaacttcacagctcagctcaagactccacgttccatgaaactttatatg

SEQ ID NO: 52179 - DNA, 601 bp, Human
tctctaagtacatgacacagtgtgggccacaacaaacacttttacccactgattttctgaaggaaaaaatacatttaattttctatttttgcttgcaggaatatggaagaaaggtaagcatgaattgtcacctaaaattggaaactgcagtgaggttgatactactttggaaaattctctaattctgtctatggcaataaatagggggctgcactaatacatatataatgtacatacatactttcttcttgctggcgaacagaggtccatatctgggtagcaagcatccaagtatggtgcgtgtgtgtgtgtgtgtgtgtgtgtgtgtgtatgtgtgtgtgcatgtgtgtgtttgggggaaggaaggggttacacagcatagtgcaaaatgagaatttaagttatcaacatttaaaaattgggtgatttgactgggcgcaggggctcacgcctgtaattccagcactttgggatgctgaggcgggcggatcatttgaagtcaggagtttgagaccagcctgaccaacatggtgaaaccctgtctctactaaaaaaaaaaggccaggcgcggtggctcacgccggtaatcccagcactttgg

SEQ ID NO: 52180 - DNA, 601 bp, Human
tgttttagtaagaaatcatgcttagtttaggtgttcattttgtaatatatttgcctctacataaacctttgggagtataaaaatctccactcatttatttgcatcgcaggcacagattaaaggcaaaaagtaatgtggaaacttaaactatttattttatgaggtaactattttagaatccactgggaaaataatgaaaaatggcctcattatccctcttttttggtgaaccagactttattctaccatgataggtctcccaattgagagtgagagagagagagagagagagagagagagwgtgtgtgtgtgtgtgtgtgtgtgtgtgtgcaggttggaggtgggatggtagcctctggcttttctccacaagtttttgatgttattccctttgaagcaccagcataactttatagttttttattattacaaaacttcttcacaaatacaggggtttctcaccatggttcacaaagcttaagaatgttggatccctgatactttagcttttctgggtaaaactgagtaaaaattattgttgtaaagttcattatttagtctacatgatgtagtgcatgtagatatttaggagtccttggag

SEQ ID NO: 52181 - DNA, 601 bp, Human
ctgttttagtaagaaatcatgcttagtttaggtgttcattttgtaatatatttgcctctacataaacctttgggagtataaaaatctccactcatttatttgcatcgcaggcacagattaaaggcaaaaagtaatgtggaaacttaaactatttattttatgaggtaactattttagaatccactgggaaaataatgaaaaatggcctcattatccctcttttttggtgaaccagactttattctaccatgataggtctcccaattgagagtgagagagagagagagagagagagagagagtgtgtgtgtgtgtgtgtgtgtgtgtgtgtgcaggttggaggtgggatggtagcctctggcttttctccacaagtttttgatgttattccctttgaagcaccagcataactttatagttttttattattacaaaacttcttcacaaatacaggggtttctcaccatggttcacaaagcttaagaatgttggatccctgatactttagcttttctgggtaaaactgagtaaaaattattgttgtaaagttcattatttagtctacatgatgtagtgcatgtagatatttaggagtccttgga

SEQ ID NO: 52182 - DNA, 601 bp, Human
taaaatacaaaatacattacagaataaagattcaaaggcatttgcagagtatatacagtaagacatgaagaatgggaagcaggatgaaaactgacattatcaaaccacaatgcctgaaagttacctagatagtactgtcattttgttgcgtttttcttttgaagtctgctggctaaaatgttttccgacttttggccaattttgggccacactgaatgttaaataaactattatttaatcaaatacaggcatattagtctcactcctgctgacaacttcaattagaatatttttgctttgytaaaaaaaaacctcatgatctttaaactgttaaggcctctgaacaacatctggtaacaatttttgatatatccaaccatcaaacttctatctccatgaagtggtttattcaagatttgttttaattaggccgcctttctaacttcacatagctttcaaaaggcagaatcactcagatgttttaagttgtaaatacaccgaaaggttcagaggctgtaattagagcttcactaaggtggactatttatgtttattagccagataactaggttaattcagttgcctcttaaacaaggacaat

SEQ ID NO: 52183 - DNA, 601 bp, Human
aagaatcctctcctttactgtatacagtgtctcactctctgattagagcccatggcacattgcagagacagcaacagctgttttctgtcttttcattcccttcttctattaatgttatttcaattgtgttatgggctgcactttagatctaaaaagaaacattgagttttatttgaatgtttaaatgattaatggccctctagtgcagttgtcctctcataattgccacagagtttgctgcaatttagtttaaaaatccagacctctgtgtactacggaaagcaaacgctagcttgggaaytggtcacaatgatgaaaattcattttttaaaatgcatttatttcctagtcatctatgtgggcgatttcttaaatttttacgtacaccaagtccaagaaaagtctgaaaaacttattctggaagaaccaaggtattgccacatcattcgggagttaatggctaggtgcatgcctgagaagtagaaaatgtaaggagagagaggctcacgccaataggaagaccgactggctgagacaagcctccctgttcttcaaagggaattcttgcatttcatctgagagcagcacacagctgtacact

SEQ ID NO: 52184 - DNA, 601 bp, Human
aagttccagtcactatacactgaaattctaaggaaaattgtaaattcacagtaaagcaagcattagatttattccttttgctaggctgcgaaaataaagcacctgaggatcatagatgacgaggaccttgctggcttcagtcatgcatttttctataaaccagtgtggagtctactcacctgttctatccctgggacatggggtagtggcggtaattcttacaagatagtgatttgctgtgattttcacttcctggcatagcacagtgagaagtgcagtggggctgggagtttagagaccyacactctagtgtggtcctacctgggactattttttgactagaacaagctaattgattctttctttcatttatttacacctgctttagaaaaggggcggtatgatctctgcactgtcgtttacagtgatgctaaaaggataacagttagagcttgtgaaactgacatggaagtaaaaatcatgttacaaagtcaagggatttaaaagaggattacatggacagacattgagctagtggacatggcagagacaaataaagcaaagtcattatgaagtcattagtttttcaaccaggctgtaa

SEQ ID NO: 52185 - DNA, 601 bp, Human
ctaagttccagtcactatacactgaaattctaaggaaaattgtaaattcacagtaaagcaagcattagatttattccttttgctaggctgcgaaaataaagcacctgaggatcatagatgacgaggaccttgctggcttcagtcatgcatttttctataaaccagtgtggagtctactcacctgttctatccctgggacatggggtagtggcggtaattcttacaagatagtgatttgctgtgattttcacttcctggcatagcacagtgagaagtgcagtggggctgggagtttagagayctacactctagtgtggtcctacctgggactattttttgactagaacaagctaattgattctttctttcatttatttacacctgctttagaaaaggggcggtatgatctctgcactgtcgtttacagtgatgctaaaaggataacagttagagcttgtgaaactgacatggaagtaaaaatcatgttacaaagtcaagggatttaaaagaggattacatggacagacattgagctagtggacatggcagagacaaataaagcaaagtcattatgaagtcattagtttttcaaccaggctgt

SEQ ID NO: 52186 - DNA, 601 bp, Human
tttctacatttaaatgaaagcaagtcaataccatcaacacatacacaagagtcaaatttaaaaaaataggaaactgcaaggttcacttactccctaaagcatgtaaacctagtaccatatagttttataggcacaggactgcataagcatcaaggccatggcacactaaatgagacaaccctgtgatatttacctgtaattcatgtattctttcattcattttaaatgccattcattgagtatctgccctgggcccagcaccatgttggatgctctacctgtaaaaggcataactaggcacacaatggtaaaagacatgacccaaggtctcaagttgctcagcaattatcagggaagccacataagcaaagacctgataggtgctctaataaagtcattttctaggttctgcttcagaggaaaataaaagaagagcaactggtcaatcatgatgaagggtcatgaatatgaagcacatagaatgcctctacctctgccagtcacatggttggtgttcagtaacctagtttcctccttctttctttatatatttagatacagggagggggaaatcagagagcataaacaacaaatgatctct

SEQ ID NO: 52187 - DNA, 601 bp, Human
aacatggcattttttttctacatttaaatgaaagcaagtcaataccatcaacacatacacaagagtcaaatttaaaaaaataggaaactgcaaggttcacttactccctaaagcatgtaaacctagtaccatatagttttataggcacaggactgcataagcatcaaggccatggcacactaaatgagacaaccctgtgatatttacctgtaattcatgtattctttcattcattttaaatgccattcattgagtatctgccctgggcccagcaccatgttggatgctctacctgtaaaargcataactaggcacacaatggtaaaagacatgacccaaggtctcaagttgctcagcaattatcagggaagccacataagcaaagacctgataggtgctctaataaagtcattttctaggttctgcttcagaggaaaataaaagaagagcaactggtcaatcatgatgaagggtcatgaatatgaagcacatagaatgcctctacctctgccagtcacatggttggtgttcagtaacctagtttcctccttctttctttatatatttagatacagggagggggaaatcagagagcataaac

SEQ ID NO: 52188 - DNA, 601 bp, Human
gtgccatctagtatttactttggtttgaataatccttgaaagagtccatcattatctacacttctcatgtaactgttttgacaaaatcaatccaggacattttcttttagttttttacaaaagccacactatgaggaagtagtataatggtcactatactgctgaagagtctgtttagaagaacttggcaaacctttaatgggcacaaaaagcagggatacccccatgacgggtgccatggtccactatttgagatgccatcactgccatttccttagttcacaatgagcatacaggataygctggaaggttcacaataaaagcccttgtggccagctcataggagaatcctcctgaaagtttatctgtacttgaaaggccactagagctcttcagttgtcacaatgatgacaaaggtagcattggattcttttctgaatgcatgtatttactatcctgggtcaaatatcaaaaagtatttaataggctaataattgttcccattggcacatacgtcaaaaaataaataattgacaaaagtgtcatccttgtcttctagaaaggctgaatgtctacacgaacaagaaggaagtttttgcca

SEQ ID NO: 52189 - DNA, 601 bp, Human
tgtccaaaagaggagtcttttataagtagagcattggatagtactgctgaccacatttgagtagtccatccgtgccatctagtatttactttggtttgaataatccttgaaagagtccatcattatctacacttctcatgtaactgttttgacaaaatcaatccaggacattttcttttagttttttacaaaagccacactatgaggaagtagtataatggtcactatactgctgaagagtctgtttagaagaacttggcaaacctttaatgggcacaaaaagcagggatacccccatgaygggtgccatggtccactatttgagatgccatcactgccatttccttagttcacaatgagcatacaggatatgctggaaggttcacaataaaagcccttgtggccagctcataggagaatcctcctgaaagtttatctgtacttgaaaggccactagagctcttcagttgtcacaatgatgacaaaggtagcattggattcttttctgaatgcatgtatttactatcctgggtcaaatatcaaaaagtatttaataggctaataattgttcccattggcacatacgtcaaaaaataaataa

SEQ ID NO: 52190 - DNA, 601 bp, Human
atgggcgtgtaccactgcacttggctaagtttctcaaactctcatctgtgttacaaattaccctgggatcttgtcaaaatgcagatttttatttattgatctgggataggatctcagatctggcatgtctagtaagctcccagtttgagtaacaagaatgtaaggcacacaatttggctttgaatctagggcaaaatcagcttcacctgaactagatgaactaaaaatgaaggggtgtagattcttaagacaaaataaaggaatggtaccagaagtaaagcagtaaaaaataaaaaaaaagtcaatacatttcatagatacagacgtatacatatttcttttcagtcttctacaagttatctgtccaaaagaggagtcttttataagtagagcattggatagtactgctgaccacatttgagtagtccatccgtgccatctagtatttactttggtttgaataatccttgaaagagtccatcattatctacacttctcatgtaactgttttgacaaaatcaatccaggacattttcttttagttttttacaaaagccacactatgaggaagtagtataatggtcactatactgctgaagag

SEQ ID NO: 52191 - DNA, 601 bp, Human
cttttagctgccttctaagttgatttagattttccgtagcaacaaatgcatagcattctctgcccctctatttctttgaatgcttataacctgtcgaaatgttcttggcttttaaaggtagcagacaggaaaggaataaacttataacccaaatgcctgatatttaatcaataaggaagagttttatcctttagggatttactaccttacttataaactctgcctcctcttctctcttaggaaaagagtctgcttcccacaaaatccaaaacctttcatcactataacacatcgaagaacmtaagaaatgtgctcttatttacttatttattataaattattgatctattaacagcatttaatacaagtgctaatcagtttctattaaacaaagatgacaaggcctccgagtttatacttatgtttctacttctaaagcttctcagtggtttatattcaaaatagttattatattctccatcaatcaatttattgacctatctatctagctagctactgaagttctcacagtaatagaagatctactttcctggatgtcaatcgcatttctggaaagaggcaaacttaatcagagtaatgt

SEQ ID NO: 52192 - DNA, 601 bp, Human
gtatcacactaagctttctactgctgttaataagtgaatatgcaaaaggcccatacgctgcatgataattaagcccagggatatccattcagacttacctttgtgtgtatgtatatacataaacatgtattttacataggtgattacaaatggtttgacttaatacaaaagttagacaaatattttacgtagaatgtaacatctattggtagtctgagatataataacaattattaaaatacttggccttatatttatagatctgaaattcatatttcaaaacaaatacattctgaaaacwatattcatttaaaacagagagacttctggaagttgatccatgctattaactttattgtgctatgcaatatgttattgtaacataatccctgaatattagcaaagaggttttactttaatagtctaacagcatcattcataccaaattactgtaacaacagcaatatccttacattttataaaaagttacctttatcacttaaggttcataaaattgattaaaatcaatattcagaaaatataattgagttcatggtttaaatgattggaattccttttattagagaaatagtcattttta

SEQ ID NO: 52193 - DNA, 601 bp, Human
gtgtagccacatagattacacgcacaaaatataaaaatagatatttgattcctagattataaataaagttgactcacttgggtttatacagacccagacatagaaactttgctaattttgagcaaattttgggtggtagctgcacatttatatccataaattttattccatttggaatttgactaacattggctactttataaatatatatgcatgcatttatagttaatacacacacaaacatacatttataatatgtataggcatatacacatatattccttagcttttcaaaaaaagwagcttcaaggtcctctagtttaatatatttaaaaaattcagaggctaatgctcttatcttttaaaatgtcaacttgaaaaaaatggaagtcatacttctctcccaagataaggagttatatctgacttagataattttttctgtaaataaaataaatataaaaatataatggcagaatcagtaaattaatgacacttaaggacccagcagtaggatttaacgaagaattaatttatgcataattttaaaacacgtgcagatactacatgcttcaaaatgtttgtactctctgaaagaaat

SEQ ID NO: 52194 - DNA, 601 bp, Human
ttgcccattcataaatctcatttagaggctaaaagttacctaataatcagaggggttacttcctgtgctcctttgtaaaaacgtgtaacagtttaagtcacttcagaaacaaattaatacttgcttattttcacattagtaataatgtcctatcaatcacattgttctattaattaccaatagagttgacatgacttaatgtgttcatgactgtcagatatgtagttgatattcaataattgttgatattccataattcaataagtgttgaatattattttattcttatctctatcatgcrccactaggagacatcgaaggccatgtccctcccctcttcccctccaaaatagaattaaccagctgttgactacacaccagtagaccctatggaatatactgaattcaggagctaaaacaacttaaaaatagatggtggtttgcaataaacacctttagattaatagccagactcttaccaggagcacaggctggccaacaattgaacaagaccagggaaagcactctgccaacagaaagcaatagtttaccaatatcctggccaacttttgtttcaaataaaattgtgaagaatccgttg

SEQ ID NO: 52195 - DNA, 601 bp, Human
ctctcagactgagggaagactgctcactcacacatgtaaagccgcaaagagtagctgcaatctctgcccctgaacttctctaagttcaccttccacatctacgtggtttgaacagagggcaagagtgaaggaggattggctgaaaacccaaagctacatgaggcagctcaactaaaaattgctacagaaaaaattctggaatcaacaattcgagaaaatgattgtttgcttttcttttaatgctttgagcagtacaatttaggttgcatttgtgttgtctccaggccatttccgttggctkgtaatttcctatgtgaaaaaggatgaataatggtacaaacagttaactgcaaggagtttcgaagccagtgattgcctggcaaatgcttttcagtgataactggcctgtcttttgagcacttgatccctttcggtatttcaaatattatagccacaatactgattttcacagcagcaatgtaggtgatggatctgaacaatcatccaaatagatatagaaaatgacatacctaacttttaatatgaataccctttaaatccagtgtaattttttcctcccctttagagtaaaccaataagt

SEQ ID NO: 52196 - DNA, 601 bp, Human
gttaccaaaggaacgcagagtagaagcctcctgtgccctattttcaaaaacaaagcttggctttaacttaaagaaaaagaaaagcactaacgatcttatttcattcatactttatcctgcatggcagttttaaaatactttgtcactctcctttgcagtaagcctattaaggacagaaatcctgtttcctaatcgtcactgaacattctaaggaataagcacctaggacagtgctctgttaggctaaacattaagaaagttgaaaataatcctgcctgctatttctatcgttatttttagaaaaaaaaaatattttaggaaaaaaagtagtgtttgttttcttaaaatcccttttaaatgtcgtccattcaggctgacaaattaatctggagttgggcagagatggttgatgatatagaagacacattcaagaaaattcattgtccactcctactttccacactttttttttttttttgagatggagcgttgctctgttgcccaggctggagggcagtggcgcgatctcggcccactgccacctccgcctcccgggttcaagtgattctcttgtctcagcttccagagtagctgggattac

SEQ ID NO: 52197 - DNA, 601 bp, Human
ctcctttctctaggaagcaaagcctttaatgataaaatatgcgtgttagataaggagtggaaaaagtcttgctggaacctaattttattataaattaaatattacatgtgccataagtcaaaatttcagggattcataaaatttaggcaatttatttaactcaagtccatactgtagaagagtggtatccctgccaagaaaatacaatggttataattgtactctgatacatttcaaatggaaagctttctgcagacataattttggcttcaagactggaacactttcttggcattgaaarggcatttgattcatcgggtgtttcacaatgtatcactaaaaagacctggtgagcagccagttccctatagggtaatttttccatccagatgcaagtgctatcagaggctctcgtcagctaaactaattatgatcttgcaattgctgatgcctgctcactctaacattcgacatcctccattaatcatcaatacaaggaaaatgaatgaaacgtaaagaaatgagggctggtaagctgcacagccataaaaatctgaaatgagagcaataacttaacaagattgggggaatgtttttagtg

SEQ ID NO: 52198 - DNA, 601 bp, Human
atacgtcaaaaagacagaacatggcaatatgtttaatacactttggaaaggaggagcacatgctacctgagctttaaaatatagtcaagtttggaataaatgtaaatcatttaaaattaaacttgatttgtgtgtttttgtatgtcattcatgtaacgtaagtattacgagaatataagacactcaattctggtctttcgtttgcaattgtaaaatctgaaagattcctctattcctcaaacgtgagagggtttgtagaaacttcagccaattaaaagtacagtattactaatgagaaccyttatgaggtgcccacttaagttaggcaacatagacccttcaatggctatttatttattttatttgacttagacttggaaatcacaagggtttccaaatacaaattgattctagtggcctgagttttgtaatcaacaggttaaaaataacctaagaatatttaaaactagataattagtattgcttgttccattcttgctatcaagtaatgattccattaaacttctcacttaaacaaaagtcaggctgtgtttgtaggcacaaatactaacaggcaggaaatggaattctcttgctgaaa

SEQ ID NO: 52199 - DNA, 601 bp, Human; identical to SEQ ID NO: 37222

SEQ ID NO: 52200 - DNA, 601 bp, Human; identical to SEQ ID NO: 37223

SEQ ID NO: 52201 - DNA, 601 bp, Human
gtaaataaagacttggacggataggcagttgtgtgctggtaatgtttaccaactgactctgtgaggggtggggttggtagtggggaacctgatttatagcctttgcctatatctgtggtgtaaatattctgacgttggccaacttcaaatacactataatagaatatcttcacctcatagatgcagtggatataaataatatcaagagcatagatattagtgaaatgtagtcagatgattaggaagtaatgagttttgagtatttattacctttctttttaatttaatggtttttttttttgagacagagtctcactctgtcacccaggctggagtgcagtggtgcaatctctgctcactgcagcctccgcctcctgggttcaagcaattattctgcctcagcctcccaagtagctgggattacaggcacccgccaccacacccagctaacttttgtatttttagtagaaacgggtttttgccatgttgcccaggctggtctcaatctcctgggctcaagtagtcctcccgtctcagtctcccaaagtgctgggattacaggacaggtgcctaaagatgggatgaggattctctgagatga

SEQ ID NO: 52202 - DNA, 601 bp, Human
ccttgtgctttagtttcaaatgatctttagtttgaacttttgttttactcccacatgttctttttaaaaaattccaaactcatgggtcatgatttgaagaaaatttcccttcctcctgcctggcgcacagaaggtaacgtcaaaagctgggaaagggaacagggcagcagcagacattgacctttacctcccgctcctctctcccaccccttgtctgctgggcatagaggattagaactgcttcctcctgtggtttaccagaaaacgctctgcggctagagcttcagcacaggctgggtckgctgtgccgggtctgtatggggacagctgcacgcctcttccgcttgtgtgagaacaaaggccggaacctggattctgatccaaaccccctggcccccaccttctgggatgttagcagagccttttaactggtaagtctctcccaggatgactcgtaggagcctctcaggattagagttggagacagtgaagggtgcccaggactgggttcacgtgcctgcagtccgccctggctctaagatgagccatcagaagaaggccttttccacctccctacaggatgcccccacagcattttgtt

SEQ ID NO: 52203 - DNA, 601 bp, Human
ttggcttcatattttagttctctgtttccctgcctggctgcagaggtcaaggctcgaagcactcatttgccttatagaaaagtggagggcagttcccggataatagggtgcggatcacctttcctcggaaaacaggacttagggacactaaaagatcacacagatcctttatctcaccctcccatttcctcgatgaggaaactgaggcccagccaggctaaatgacttgtttaaggttatgtggttgtttagaggcagggcgcaggcaagagccaccacacattcgggttcccagtgtaaygccccctccccttacagctgctcaaacttttcactaaagattttctcattgatttgttaattttttgagcagaagtgattcgtagttggataagcttttggaaggctacttccatgctctttggctaacttcaagtatgtaatttcggaaggtttatttcacagcccattcctctcagagcaggcaaggaggcagaggggagaagtgcttcagaagaaaaccttctgaagcagagccgtgcagcatgaggaggaggcttggagcccaggagatgtgttggagccgtgggtgcctctgctc

SEQ ID NO: 52204 - DNA, 601 bp, Human
cctggacctctcgggctcaagcagtcctcagcctcctgagtagctgagactacagacatgtgccaccacgcccagctagtttttaaatattttttgtagagatgggggtctcgctgtgttgcccaggctggtctggaagtcctgggctcaagtgatcctcctgccttggcctcccagagtgccgggattataggcatgagccactgtgcctggcctaattagctgacttaattagatcacgaagttaggcagtggtcttgagcccaggtccttggaccccaatgcttccttcttctgcttracaaaggaagctgtttagcatcgtgactgagggtccaggctttgtggcttgacagtttccttcacctcccagtttcctcgtctgtagaatgagactcctcacagaacctcctccacaagactgttgtgaggaatgattggaaaggtgcgtttaagtcatctggcacacgccgactacttggttaacataggtattattattggattcaggaacaaccagtttttacaaggggatgggcgcatgaaaccatttgagactgtttcgaaacacctgtgttaggacccaccctacacctactgg

SEQ ID NO: 52205 - DNA, 601 bp, Human
ggttggaagctagagagccagagagctgtggaggaagaattcagtgcaggaagccctacaaccttggttagaacagaagggcagaacaaacaaatacttggtgtgtttgtgacccaccttaggcctctacttctcatgcatgtgagtgcctcagtttaggctgaacactagcccaggtggtttgcttacctgggagaggttgtagccactggcccagacactgttgttggtcctcaccttgggttggtcactcactaggaccctcttggacatgaattttgagagagatgaggaagaggctggggcggtgggagggggggtctgacgtcagggtcaagaggcagatttggtcccctctatagcggtgctggagaggtcattgggcatgtcatgcagtggctgcacagtcagtcccagctcccctgctttcttaccctgggaccttcattgacctgagcctcagcttttccatttgcagaatgggaggactgtcacagaaccccatgtggttctttcaggattcttgtctggattcattgagctctaatacacataagtacttagtgccagcactaatcatttgctggtatcactcttccag

SEQ ID NO: 52206 - DNA, 601 bp, Human
ggaagctagagagccagagagctgtggaggaagaattcagtgcaggaagccctacaaccttggttagaacagaagggcagaacaaacaaatacttggtgtgtttgtgacccaccttaggcctctacttctcatgcatgtgagtgcctcagtttaggctgaacactagcccaggtggtttgcttacctgggagaggttgtagccactggcccagacactgttgttggtcctcaccttgggttggtcactcactaggaccctcttggacatgaattttgagagagatgaggaagaggcgggggcggtgggagggggggtctgacgtcagggtcaagaggcagatttggtcccctctatagcggtgctggagaggtcattgggcatgtcatgcagtggctgcacagtcagtcccagctcccctgctttcttaccctgggaccttcattgacctgagcctcagcttttccatttgcagaatgggaggactgtcacagaaccccatgtggttctttcaggattcttgtctggattcattgagctctaatacacataagtacttagtgccagcactaatcatttgctggtatcactcttccaggatg

SEQ ID NO: 52207 - DNA, 601 bp, Human
agagccagagagctgtggaggaagaattcagtgcaggaagccctacaaccttggttagaacagaagggcagaacaaacaaatacttggtgtgtttgtgacccaccttaggcctctacttctcatgcatgtgagtgcctcagtttaggctgaacactagcccaggtggtttgcttacctgggagaggttgtagccactggcccagacactgttgttggtcctcaccttgggttggtcactcactaggaccctcttggacatgaattttgagagagatgaggaagaggcgggggcggtgggasggggggtctgacgtcagggtcaagaggcagatttggtcccctctatagcggtgctggagaggtcattgggcatgtcatgcagtggctgcacagtcagtcccagctcccctgctttcttaccctgggaccttcattgacctgagcctcagcttttccatttgcagaatgggaggactgtcacagaaccccatgtggttctttcaggattcttgtctggattcattgagctctaatacacataagtacttagtgccagcactaatcatttgctggtatcactcttccaggatgacacctacc

SEQ ID NO: 52208 - DNA, 601 bp, Human
ttgagagagatgaggaagaggcgggggcggtgggagggggggtctgacgtcagggtcaagaggcagatttggtcccctctatagcggtgctggagaggtcattgggcatgtcatgcagtggctgcacagtcagtcccagctcccctgctttcttaccctgggaccttcattgacctgagcctcagcttttccatttgcagaatgggaggactgtcacagaaccccatgtggttctttcaggattcttgtctggattcattgagctctaatacacataagtacttagtgccagcactaatcrtttgctggtatcactcttccaggatgacacctaccactcggtgcttaataggtgataggtacaggcctcagctcattataagcatgaactccttttatccttataacaactctgtgctgtaggtaccgctattacccccatttcaggtgagaaaactgaggtacagccaggttaaataattgtgcacttactaaggggttgagctgggattcaaactcaggcagttagtctggagtccatgttttctgtcactatgctgtagcagttattagtcatcacttggtagttggagcccagtgg

SEQ ID NO: 52209 - DNA, 601 bp, Human
tggaggtcacttgcaagtttttggaacctttactggcctgtgagatcgtgaagtccagaactactgctcagagggcatcttctgctctgagcagggaatagaaaggtcagagcccttcccgggagtcagggttcctccttcatcgtgagagtatcctgcagcacgcccagtcttccccccccgacaggctgtggcgcagatcctgcctttccgagaccagaaccgcaaggctttggacggcctctggaaccggcaccatgtggagcgggtggagatcatcatgaaagagaccgtggatgcygaaggtgtgtgagtggccctgcgcactcggtcccccagcctctgcctgcccgctgtctgcggtgaggcatggggcgcttctcagagggaggttttctgtgggtgtgtggtctcccttcgagcctgccgtgtgcctagctctgaaccgggctaaaccccagggtgccggctggcaaagcccaagtagccattgctgcccatgaggagcgtatggtccagagaagtaggcctggcacagaggcgggaaaccactggcacgcggtagaggctggagtctccctgaggtcccccaagtttttga

SEQ ID NO: 52210 - DNA, 601 bp, Human
acccctctctcgcttgttagttctcagctccatggccctccaggaagactttctgagccctgcaggcccactcccctcaccctcacggcgccacacacctccctcccctgccctgcacagtgttacccttgcctcgtccttgtccaccctgtctcttctgccagcctgtaggctccaggaggacaccgcctctcccgcactgccacacacctcagacacactgagtatacacccgggaggcgggggccctgcgtcatgcccaccgctgccttcagctgggtggcctcagcatgtcactccytgcagctgtgagatgagcatgtcctgtcggtgaggacagctaaggtcccttagctggcattctgtgatggtagcaaagttttggagcattgaccgtgaagatgtaaagcactggctcttgcccagtaacgataagagctgaagtttactgtgtccccagtccccagccgccaggtgaggtgggcgctgttactagcctccttacagatgaagatggtggcgagcccacagccccacagtagaaggcggtggagcctgatcctgggggcaacagtctggccccagcactcaggcctggcgc

SEQ ID NO: 52211 - DNA, 601 bp, Human
ctgagccctgcaggcccactcccctcaccctcacggcgccacacacctccctcccctgccctgcacagtgttacccttgcctcgtccttgtccaccctgtctcttctgccagcctgtaggctccaggaggacaccgcctctcccgcactgccacacacctcagacacactgagtatacacccgggaggcgggggccctgcgtcatgcccaccgctgccttcagctgggtggcctcagcatgtcactccttgcagctgtgagatgagcatgtcctgtcggtgaggacagctaaggtcccttwgctggcattctgtgatggtagcaaagttttggagcattgaccgtgaagatgtaaagcactggctcttgcccagtaacgataagagctgaagtttactgtgtccccagtccccagccgccaggtgaggtgggcgctgttactagcctccttacagatgaagatggtggcgagcccacagccccacagtagaaggcggtggagcctgatcctgggggcaacagtctggccccagcactcaggcctggcgccgccgcgctgtgctgccagcgctgcgtcagtggccagctcatccccgcggcc

SEQ ID NO: 52212 - DNA, 601 bp, Human
tgagccctgcaggcccactcccctcaccctcacggcgccacacacctccctcccctgccctgcacagtgttacccttgcctcgtccttgtccaccctgtctcttctgccagcctgtaggctccaggaggacaccgcctctcccgcactgccacacacctcagacacactgagtatacacccgggaggcgggggccctgcgtcatgcccaccgctgccttcagctgggtggcctcagcatgtcactccttgcagctgtgagatgagcatgtcctgtcggtgaggacagctaaggtcccttagctggcattctgtgatggtagcaaagttttggagcattgaccgtgaagatgtaaagcactggctcttgcccagtaacgataagagctgaagtttactgtgtccccagtccccagccgccaggtgaggtgggcgctgttactagcctccttacagatgaagatggtggcgagcccacagccccacagtagaaggcggtggagcctgatcctgggggcaacagtctggccccagcactcaggcctggcgccgccgcgctgtgctgccagcgctgcgtcagtggccagctcatccccgcggccg

SEQ ID NO: 52213 - DNA, 601 bp, Human
gcctcgtccttgtccaccctgtctcttctgccagcctgtaggctccaggaggacaccgcctctcccgcactgccacacacctcagacacactgagtatacacccgggaggcgggggccctgcgtcatgcccaccgctgccttcagctgggtggcctcagcatgtcactccttgcagctgtgagatgagcatgtcctgtcggtgaggacagctaaggtcccttagctggcattctgtgatggtagcaaagttttggagcattgaccgtgaagatgtaaagcactggctcttgcccagtaackataagagctgaagtttactgtgtccccagtccccagccgccaggtgaggtgggcgctgttactagcctccttacagatgaagatggtggcgagcccacagccccacagtagaaggcggtggagcctgatcctgggggcaacagtctggccccagcactcaggcctggcgccgccgcgctgtgctgccagcgctgcgtcagtggccagctcatccccgcggccgctttctgcagctgcagcgggagcacccgaggccactgcccccccagcccccgcagtgcgtgcccgccacagggcagg

SEQ ID NO: 52214 - DNA, 601 bp, Human
cctcgtccttgtccaccctgtctcttctgccagcctgtaggctccaggaggacaccgcctctcccgcactgccacacacctcagacacactgagtatacacccgggaggcgggggccctgcgtcatgcccaccgctgccttcagctgggtggcctcagcatgtcactccttgcagctgtgagatgagcatgtcctgtcggtgaggacagctaaggtcccttagctggcattctgtgatggtagcaaagttttggagcattgaccgtgaagatgtaaagcactggctcttgcccagtaacgrtaagagctgaagtttactgtgtccccagtccccagccgccaggtgaggtgggcgctgttactagcctccttacagatgaagatggtggcgagcccacagccccacagtagaaggcggtggagcctgatcctgggggcaacagtctggccccagcactcaggcctggcgccgccgcgctgtgctgccagcgctgcgtcagtggccagctcatccccgcggccgctttctgcagctgcagcgggagcacccgaggccactgcccccccagcccccgcagtgcgtgcccgccacagggcaggg

SEQ ID NO: 52215 - DNA, 601 bp, Human
tcccgcactgccacacacctcagacacactgagtatacacccgggaggcgggggccctgcgtcatgcccaccgctgccttcagctgggtggcctcagcatgtcactccttgcagctgtgagatgagcatgtcctgtcggtgaggacagctaaggtcccttagctggcattctgtgatggtagcaaagttttggagcattgaccgtgaagatgtaaagcactggctcttgcccagtaacgataagagctgaagtttactgtgtccccagtccccagccgccaggtgaggtgggcgctgttaytagcctccttacagatgaagatggtggcgagcccacagccccacagtagaaggcggtggagcctgatcctgggggcaacagtctggccccagcactcaggcctggcgccgccgcgctgtgctgccagcgctgcgtcagtggccagctcatccccgcggccgctttctgcagctgcagcgggagcacccgaggccactgcccccccagcccccgcagtgcgtgcccgccacagggcagggcccagagccctggacccagggatgggccaggaggtttctcctctttttctctctcccttgc

SEQ ID NO: 52216 - DNA, 601 bp, Human
tggctcttgcccagtaacgataagagctgaagtttactgtgtccccagtccccagccgccaggtgaggtgggcgctgttactagcctccttacagatgaagatggtggcgagcccacagccccacagtagaaggcggtggagcctgatcctgggggcaacagtctggccccagcactcaggcctggcgccgccgcgctgtgctgccagcgctgcgtcagtggccagctcatccccgcggccgctttctgcagctgcagcgggagcacccgaggccactgcccccccagcccccgcagtgcrtgcccgccacagggcagggcccagagccctggacccagggatgggccaggaggtttctcctctttttctctctcccttgctctttctctgggccattttctctttttctttcccccgccccttggtttctcttcagctgcttctcccttcctctctgaatgtgtatttagtgccagaagctctctgcggggccgaggtgccacagtgaggtacaaaactcagcctctcagatatggctccctaatactgcccagattcacgggtgctgtggggggtgatgatctcatcacactggctggt

SEQ ID NO: 52217 - DNA, 601 bp, Human
gacagacaggtggagctctgggcaggtctgtttgccgggacagtctgaggatgttgggtttgaacagcaacacaacagcctgggctggctgtcctcaaggtccaggagggagaggcacctggagccctgttgtcacagctgcagggactaaaggaggcccagccttgcctgccatatggggctctaggggagggtccgccgctcctaagctccagagtccaaggcctttagtacagctgggccctgtaccttcagcccaggggcaaagggagcctcagcgcaggacaggcagtgggagatmcactagtcctggaggcttgcagcctgtcgcggtgagaccagagtggggctagttcagtccacgttccttgtcagaggtggccagcaggactgcaactgtcctggggtttggccctcactggttggcttgtttacctgccatttacaaacaggtccttgatagctcgtagcagggagggacagcctgctgctgagcccagccccccagcaagtgggccttggacacagggtgctttggcaacagaatgagcttgcttgctgcctctctcaattttgtgtgcctgcgtgccaggggacacat

SEQ ID NO: 52218 - DNA, 601 bp, Human
ccagccgccttttagatcatttcatggggtgttgcaccatcccttcagattcagcagatttagaatgaaaaccatcactgcatttttctcatgaaataccaactgtgttttctaacctctttatttcaaatgggaacagtgctctctgagtgaccaggctggtagcccttctcttacagcatctgtcataagaaaaattccaaccagtctttatcagtgtttcctgtgtgctagccactgttccaagccctgtgtggatattaactccttcaggcccacagaagccctgtaagggaggtgcggggattgttgcttgttcgtatgtgaggtgatgtcagttgctggagatcacagggctgaaagatggcagagccggtatttaaaccggggcaggctgggcacgggggcttatacctgtaatcccagcactttgggaggccgagacgggtggatcacttgaggtcaggcgttcaagaccagcctggtcaaatggtgaaaccccatctccactaaaaatacaaaaattatccaggcatggtagtttgtgcctgtaatcccagctactcgggaggctgaggcaggagaattgcttgaacccagg

SEQ ID NO: 52219 - DNA, 601 bp, Human
ttaactgggctctccaacccgctctctgggggtgtcagtttcctcatcttgcagatgataatccctcctaacagagctgctctgtttaaggcaaaacaaagtggcatgcgcttgacaccaatgcctgtttcttcctccctaaactggacccagactgggccagtttaggtcagcactttgggaggccaaggtgagataatcacttgagcccaggggttcgagaccagcctaggcaacacagcaagaccacagctctaaaaaaaaaaaaaaaaaaaaaaaatagcgagtgtggtggcgcatstctgtagttccagctgttccggaggctgaggctgaggtgggaggattgcttgagcccaggaggtcaaggcttcaatgagctatgatggcaccactgccctccagcctgggtgagagtcagaccctgtctcaataaataaataaataggacctaataacagcagcaacttcataaagcagttatgaccatgtcaagtgttcaagacagggcctggtcccaggaagagttcagtaaaaatgtcagctcttttattaaagttaccttacagaccagagttcaaatcctatcttcaccacttac

SEQ ID NO: 52220 - DNA, 601 bp, Human
tctccctaaagctgtctccccattttcaacaactatatatacaagtaactttagtttcttttttatttttaaacattttatttacaaaaaattaatttattttcagaaataaaactcttttaaggtgttgcttgttttgtctccacagatctgctgggaggcagtggaggtgtgcagggacagggcagaggggctgaaggaaaggaggacatcaaagggacagggctgaggcccaaagggatggggtgtggcagactggggatgtaggtggagtgagcctgaggaaggtggctgagatgcrgagtagccttccccccataggaccagcaggcacgcccctggccagggaagcacagagagacggccagatggggacaaggagagaaggtgtcacctccttgagataaggctgagatgtacacatgtgctcacacagggccacgagaaggcaggaagtggggatggaaaaaacagagacaccccaagagctgggtaaagggggaggccaaagggaactgaggcaggcccaaggaaggagggagagcaagaaaatggtagactcagacggagttaccatgcagacgaggagggtccaagagtt

SEQ ID NO: 52221 - DNA, 601 bp, Human
cctgtgtcacctgccggacccccagaaggggtccctgaggaggctcagcccccacggctgggccaagagagaggtaggaccaggtacctcccaggagctctctcctctaagtcctgtcttctccagagtctaacctaccagctcatccctatacctgctccccgtcttgtgcaccctcctcaaggcgccttccgactcctgcagaatctccctgtagctacagtctcattcctctggtctcttagaatctatacagacatatcactgtctgagattttcatgtaaattaattttttactartttatctttctcctcactctcatgtcagtttcctgaatgttgggcccatattgatcctttttttttttttttttttttttttttttgagaaagggtctcgctctgtcacccaggctggagtagtatagtggtgtgatcatagctcactgcagccttgaacttcctgggctcaagcgatcctcccgcctcagcctcccaagtagctgggaccacaggcatatgccaccacacctggctaatttttgtattttttgtagagataaggtttcaccatgttgcccaggctggtctcaaactcac

SEQ ID NO: 52222 - DNA, 601 bp, Human
aacactttacgtggttgggtttttttcttttctctttttcttttctttgagagagtttcgctcttgccaaggctggagtgcgacggcacaatcttggctcactgcaaccttcacctcctgggttcaggcaattctcctgcctcagcctcctgggtagctgggaatataggcatgaaccaccatgctcggctggttttgtatttttagtagagttggggtttcgccatgttggccaggctggtctcaaacgcctgacctcaggtgatctgcccgccttggcctcccaaagtgctgggattaygagccaccacgcccagccttttttttttttttttttgagatgaagtcttgctctgttgcccaggctggagagcagtggtacgatcttggctcactgcaaactctgcctcccaggttcaagcgattcttctgcctcagcctcccatgtagctgggattacaggcatgccaccatgcccggctgatttttgttttttttgtttatttgtttgtttgtttttgagacagagtttcattcttgttgcccagactagagtgcaatggcacaatctcagctcaccgcaacctctgcctcccgggtt

SEQ ID NO: 52223 - DNA, 601 bp, Human
caatgtcagctagccgatgccctccaagtcacccagcaagtgcgccgcccaaggcgccaccgcttacctcgctcgctcaggatgccgtcgatgctgtgtttggccttcttctcgctttcctctgcctccttcctctccaagtcggcctcctcctcttcacctttcccgaatttacttctcaggatgcggctgatggaactcactgggggcgggaggaggaaggaagcaagggagcgcacatggttgagacaagcagggctgtgcgggaaggaccccccacccccaaacaccagccagggcmctagagccgctgccctgcactgctcgcgggtgtctcctcctgcatctctggacatcctcatccttctccagccctctcatcctgccactcaaacccccctccctattatctgtatctcggtactgaaagacggaggctgggaaaaccgtgcctccaagttagggccggatgccatctttgtccctcgattctgggcaggaagcatttcccttcctggactccgaagaccgggctctaggtctgcaatctaagagaattctcccaccagcccaccgggtaccctccttcctccccacctga

SEQ ID NO: 52224 - DNA, 601 bp, Human; identical to SEQ ID NO: 52223

SEQ ID NO: 52225 - DNA, 601 bp, Human; identical to SEQ ID NO: 39461

SEQ ID NO: 52226 - DNA, 601 bp, Human; identical to SEQ ID NO: 39462

SEQ ID NO: 52227 - DNA, 601 bp, Human; identical to SEQ ID NO: 39463

SEQ ID NO: 52228 - DNA, 601 bp, Human; identical to SEQ ID NO: 39464

SEQ ID NO: 52229 - DNA, 601 bp, Human; identical to SEQ ID NO: 39465

SEQ ID NO: 52230 - DNA, 601 bp, Human; identical to SEQ ID NO: 39466

SEQ ID NO: 52231 - DNA, 601 bp, Human; identical to SEQ ID NO: 39467

SEQ ID NO: 52232 - DNA, 601 bp, Human; identical to SEQ ID NO: 39468

SEQ ID NO: 52233 - DNA, 601 bp, Human; identical to SEQ ID NO: 39469

SEQ ID NO: 52234 - DNA, 601 bp, Human; identical to SEQ ID NO: 39470

SEQ ID NO: 52235 - DNA, 601 bp, Human
gggagcgaggggcagccccagcgctgctcaggaggcgagagactccgggggaagtcggcctccgtggccaccggccatcgttaccgagactgagtttctgtggctctttatctcgtcttccatgagaagttttattaaagatgcgctgtgccccttttgagttgtcttccgatttacctgagccaaataagatgtaggcagttgcaggcctgagtcttcgttttgctttcctgagcaagaatttagatgaagctacttccccgaaaatccttttacttgtacgagacttttatttttcctrtgtgtttgtagtgcttaacacaatgtcctgcgtgtagtagacgttcaataaacgaatatggaatatcagttgaatgccaatgatgatttaagatagactgatagctctctctgtaccatttgacgctgctgaccatccatttcttgaaactttcccctgctgcctttcttcatgctatcctcacctgattctttcacatgcttaatttaacaaaatatatacttgttcttggctacaaggatacagaaatgaataacactaactctgccattgagaagctaacgcacataaatacacatt

SEQ ID NO: 52236 - DNA, 601 bp, Human
tcccctgctgcctttcttcatgctatcctcacctgattctttcacatgcttaatttaacaaaatatatacttgttcttggctacaaggatacagaaatgaataacactaactctgccattgagaagctaacgcacataaatacacattatatcaagatgggtaatgagaaacactagttgcatataaagagctgtagaaagctgtgggagagctaaagtgctccttaggtgctttgtgaccctgagccagtttctattccaatctagcctcaatttcctcatctacttaataggcttgttwtgaggaagaaaggagattaggtaagaggtttggtttggtttagtgcctagaatacagcaatcgtggtgccaaaggggagggaaatatttccctcaaatcgctttttctcagttttttgatatggccaactggtattttctaccttaatatagagtactatgcaaaagcatcttcaagtcttccttccagattactcctctgtccccatctatttggaaattctggacctgccacaggattacagtaagataaccataaatgtagctttttaaaaattgattttctcctatgtgccatgga

SEQ ID NO: 52237 - DNA, 601 bp, Human
tgcactgtcttcaccttccttttttttttttttttcactatgacatatgtcatgcatacgaaagtgtataaaagcagtgattgtcagtgcgtttttgagttttgacctctggttgaattttgtgatacaagtaggttaaatttttaaaaggattataagggctgtgagcaatggctcacgcctgtaatcccaatactttgggaggctgaggctggcagattgctttagctcaagagttcgagaccagcttgggtaacatggcgaaactccctgtctcaacaaaagagacaaaaattagccrggcttagtggcgccgcctgtagtcccagctagttggagggataatgaaatgaacatctatgtacacatccttcataaaaagtgaaacattaaaaataatacattaagtccctttgacctcttctctattaactcctctgactttcaaaccaccttccctttttgccttccattcattggttaatggcatcactagccatctggttataaaaactagagatattggaatcatttttgcctcttttttccttcacttgccataaccatttggtcattagattctgcttcatgaattagccct

SEQ ID NO: 52238 - DNA, 601 bp, Human
tgtgatacaagtaggttaaatttttaaaaggattataagggctgtgagcaatggctcacgcctgtaatcccaatactttgggaggctgaggctggcagattgctttagctcaagagttcgagaccagcttgggtaacatggcgaaactccctgtctcaacaaaagagacaaaaattagccaggcttagtggcgccgcctgtagtcccagctagttggagggataatgaaatgaacatctatgtacacatccttcataaaaagtgaaacattaaaaataatacattaagtccctttgacctyttctctattaactcctctgactttcaaaccaccttccctttttgccttccattcattggttaatggcatcactagccatctggttataaaaactagagatattggaatcatttttgcctcttttttccttcacttgccataaccatttggtcattagattctgcttcatgaattagcccttaaccctagtttctttttctctagttcaaggccacatcttgtctcaactagccttatggagtatgggtagtgcatgtagtgtcctggctcttcagttttttccctccaatgtatttgtta

SEQ ID NO: 52239 - DNA, 601 bp, Human
tagtggcgccgcctgtagtcccagctagttggagggataatgaaatgaacatctatgtacacatccttcataaaaagtgaaacattaaaaataatacattaagtccctttgacctcttctctattaactcctctgactttcaaaccaccttccctttttgccttccattcattggttaatggcatcactagccatctggttataaaaactagagatattggaatcatttttgcctcttttttccttcacttgccataaccatttggtcattagattctgcttcatgaattagcccttaacsctagtttctttttctctagttcaaggccacatcttgtctcaactagccttatggagtatgggtagtgcatgtagtgtcctggctcttcagttttttccctccaatgtatttgttacactgtatctaaagatgtttctaaggtatagaacagatttctcattctgttgttttctttgggacatgttattaaatacttaatatagtgattatgaacccttgctgcacatcaatatagctagtgaaagttttcaaaacataaatgtcttgttttgcactccagattaagaatttagatgaagc

SEQ ID NO: 52240 - DNA, 601 bp, Human
tgatgcataatttatcttttgaagggagtcttgtgttaaactgttatatttgattaggaattagaacttctctcatgctgggacaatttctggagtacatagtaggtgtttaatgaatgagtaaatgaatacaagtggcagctccatcccaacctctagtctgttgactagttgcactctaattctcacaaggaacgctttggaaaataattttcccttgacttaaaaaataatgttctcagtcattactaaaaaattggaaattagaaaaagatataagaaaataaaaattgctggtcgyggtggctcacgcctgtaatcccagcactttgggaggctgaggcgggtggatcatgatgtcaggagttcaagaccagcctggccaagatagtgaaaacccatctctactacaaatataaaaaattagctgggtgtggtggcaggcacctgtaatcccagctacttgggaggccaaggcaggagaatcgcttgaactcggagggcagaggttgcagtgagccgagattgtgccactgcactccagtgggcacagagtgagactctgtctcaaaaaaaaaaaattgctagttattcatcatcc

SEQ ID NO: 52241 - DNA, 601 bp, Human
actagttgcactctaattctcacaaggaacgctttggaaaataattttcccttgacttaaaaaataatgttctcagtcattactaaaaaattggaaattagaaaaagatataagaaaataaaaattgctggtcgtggtggctcacgcctgtaatcccagcactttgggaggctgaggcgggtggatcatgatgtcaggagttcaagaccagcctggccaagatagtgaaaacccatctctactacaaatataaaaaattagctgggtgtggtggcaggcacctgtaatcccagctacttgrgaggccaaggcaggagaatcgcttgaactcggagggcagaggttgcagtgagccgagattgtgccactgcactccagtgggcacagagtgagactctgtctcaaaaaaaaaaaattgctagttattcatcatccagagataacaaatgttattttaacagtttattaaaatataattcttggctgggtgcggtggcttaagcctgtcccaacactttgggaggccaaggcaggcagatcacaaggtcaggagatccagagcatcctggctaacaaggtgaaaccccatctctactaaaaa

SEQ ID NO: 52242 - DNA, 601 bp, Human
tgtctctgtagatttatgtattctgaacaattcatgtggaaccataatatgtggtcttttgtgactgggttttttcacttatgtttcgaagattaatccatgttgtggcatatgttcagtacttcatttctttttattgcctagtgatatacctttgtattttattctacattttacttatccgttcataagttgaaggatatttgggttgtttctactttttggctattatgaataatgctgctctgaccattcatgtacaagtatttggatgatatcttattaagattttgatttacarttccctgatggctaatattttttaatacttgtttttagactgtgtttaacaaaatatggattatactacatatgcagttttgtagtctgccttttgcatttaagcctgtttttagcattagcaagcatattttacaaaagaattttcctaatttttgctcccctctttactccccgccaaaaccataaattcttgggaaaccttgcttaaattaatatacctagaaaatacaatccatattaatatataccagattattattggttgttaccatggtatgggagtgggtagaattagggg

SEQ ID NO: 52243 - DNA, 601 bp, Human
ccatggttgtgaagccccagatacagaaggctgactgtactatgtagaagtaatttttctaagtatatttagttcttgaggctaatattgattcaaaaagtcattgacaaggacttagaagaaaggacttttggccaggcgcagtggctcatgcctgtctataatccgagcactttgggaggccacggtgggtggatcacctgaggtcaggagttcaagaccagcctgaccaacatggtgaaaccctgtctctactaaaaatacaaaaaattacctgggcgtggtggtgggcacctgtaaycctagctgctcgggaggttgcagtgagctgagattgccccattgcactccagcctgggcaacaagagcaaaactctgtctcaaaaaaaaaaagaacttttttgtagggattatgttgtaataggatttgacatagctaatcattagactctgtttatataatctcagatcaggcaaatctggcaggaatatttataattgtttatgtagagaaaggtgggtttttggacactgcagcttctgttgaataataatctggcagttgtaattgccactaaattttaaagattccaggagtggt

SEQ ID NO: 52244 - DNA, 601 bp, Human
tgcctgtctataatccgagcactttgggaggccacggtgggtggatcacctgaggtcaggagttcaagaccagcctgaccaacatggtgaaaccctgtctctactaaaaatacaaaaaattacctgggcgtggtggtgggcacctgtaatcctagctgctcgggaggttgcagtgagctgagattgccccattgcactccagcctgggcaacaagagcaaaactctgtctcaaaaaaaaaaagaacttttttgtagggattatgttgtaataggatttgacatagctaatcattagactcwgtttatataatctcagatcaggcaaatctggcaggaatatttataattgtttatgtagagaaaggtgggtttttggacactgcagcttctgttgaataataatctggcagttgtaattgccactaaattttaaagattccaggagtggttcctgaatgatgggacagacacttctgtaagattgttcagaaaatttccagcttacttacactccatataatacagagagagatagttggtatcattaaaaaaagaaaggaagttaatagttaatatgctaggtttttgaagacagcttta

SEQ ID NO: 52245 - DNA, 601 bp, Human
ttaatatgctaggtttttgaagacagctttatatgtattgtctcatttaatcctcacaacagcccttcagggtaactaccttggtaatggtatcttcattttgcaagtgaggaaagtgaggctcagagagattaagtaacttgcccaaagtaacacagccagtatgtaacagagctaggatttgaatctaagtctgtcagactccaaaatctatgctctttccagtacttcacactgcagcaagtaagtgtgatacttggccctgtgattgccttacttagggcacccaaaacttcagccwgtttctattgcttactatccaaatcctagtcagaccccagttagaagaccctgtgactcgagccaggatcagtccttgtatgtactggtctgattgcagtgatagttatcatttctttctgaacgttgcaattactcctccacaaagaggaatatacatctttaaatatgattaaaatgtgatttcttctattatagcatagcagcaaaatttgtccttgcagtttccagcaggtgtattcaaccctataatttaaagcttcattcatactctagccaaaggactatgggaagtcatttt

SEQ ID NO: 52246 - DNA, 601 bp, Human
taacagagctaggatttgaatctaagtctgtcagactccaaaatctatgctctttccagtacttcacactgcagcaagtaagtgtgatacttggccctgtgattgccttacttagggcacccaaaacttcagcctgtttctattgcttactatccaaatcctagtcagaccccagttagaagaccctgtgactcgagccaggatcagtccttgtatgtactggtctgattgcagtgatagttatcatttctttctgaacgttgcaattactcctccacaaagaggaatatacatctttaawtatgattaaaatgtgatttcttctattatagcatagcagcaaaatttgtccttgcagtttccagcaggtgtattcaaccctataatttaaagcttcattcatactctagccaaaggactatgggaagtcattttgcttttttttggcagggaacggctgttctattccctatcctgcttatatcataaaattgttgtaagagtgaaatgagataatagatgttcaactgtaagaaagtactgtgtggtaatctcttacctttctaaaagccccatctaagtagagattcttcctttgtga

SEQ ID NO: 52247 - DNA, 601 bp, Human
attcataatgttcatttttattaaggatttactgtataaggctgaggatagataaagcagtgagctcacaggagaaagcaaaagaggcaaaaatccctgcccttgtgcaggttaaatttcttttcttttttttttttttttttttgttgttgttgttgttgttgagatggagttttgctctttcacccaggctggagtgcagtggcacgatctgggctcactgtaacctccacctcctgggttcaagcgattctcatgcctcagccttctgagtacctgggattacaggcatctgccaccrcgcctggctaatttttgtattttcagtagagatggggtttcaccatgttggccaggctggtctcgaactcctgacctcaggcaatccactcacctcggcctcccaaagtgctgggattacaggcatgagccaccacacctggccacagcttacatttcaatagtgagattatagatgacaaataatataaataagccatatgtcagttgataatagaacaataggaaaaaataaagggaagagggttgcagttttaaataagtgattagggaagacctcattgagaaatggcatctggac

SEQ ID NO: 52248 - DNA, 601 bp, Human
tgctctttcacccaggctggagtgcagtggcacgatctgggctcactgtaacctccacctcctgggttcaagcgattctcatgcctcagccttctgagtacctgggattacaggcatctgccaccgcgcctggctaatttttgtattttcagtagagatggggtttcaccatgttggccaggctggtctcgaactcctgacctcaggcaatccactcacctcggcctcccaaagtgctgggattacaggcatgagccaccacacctggccacagcttacatttcaatagtgagattatagrtgacaaataatataaataagccatatgtcagttgataatagaacaataggaaaaaataaagggaagagggttgcagttttaaataagtgattagggaagacctcattgagaaatggcatctggacaaatctgaaggaaatgagggagggagttatgttgtcaagcagaggaagagcatgctggctagtaccgagacactgaggtggaaatgtgtagcagcaatagcaaggaggtcagtatgattaaaatcagtcatgcgtgtgtgttgggggtggggggtggagggggccttacagtcca

SEQ ID NO: 52249 - DNA, 601 bp, Human
aaaaatgttttaaaatacacactgccagtaactacttgcagaaggaaaagtatattggaaaacctcacagaagtttttaaaatttttaaatttaaaacaaccagttaacatggaaagttagatttatatttaagaatttactaggcagccataaaaagaatgaaatcatgtcctttgcagcaacatggatggagcaggaggccattatcctaagagaactaattcagaaacagaaaatcaagtatctcatgttctcacttataagtgagagctaaacataggtacccatggacataaagaygaaagtagtagacacagaccattccaaaatggaagagtttgggagaagactgaggattgaaaaagtacctcttgggttcaaggttcaatatttgggtcatgtgtgtataagtccagtccccaccattacacagtataccagtgtaacaaacatacacatgtaccctctgaatctaaaataaattaattaaaaaaattaaagacacttcctaaagtttgcccccccaaaaagttaactagtatggcttatttatttatttatttatttatttatttggagatggagtctcactccatctca

SEQ ID NO: 52250 - DNA, 601 bp, Human
ttggaaaacctcacagaagtttttaaaatttttaaatttaaaacaaccagttaacatggaaagttagatttatatttaagaatttactaggcagccataaaaagaatgaaatcatgtcctttgcagcaacatggatggagcaggaggccattatcctaagagaactaattcagaaacagaaaatcaagtatctcatgttctcacttataagtgagagctaaacataggtacccatggacataaagacgaaagtagtagacacagaccattccaaaatggaagagtttgggagaagactgargattgaaaaagtacctcttgggttcaaggttcaatatttgggtcatgtgtgtataagtccagtccccaccattacacagtataccagtgtaacaaacatacacatgtaccctctgaatctaaaataaattaattaaaaaaattaaagacacttcctaaagtttgcccccccaaaaagttaactagtatggcttatttatttatttatttatttatttatttggagatggagtctcactccatctcatcacagtgatgtgatctcggctcattgcaacctccacctcctgggttcaagtga

SEQ ID NO: 52251 - DNA, 601 bp, Human
cataaaaagaatgaaatcatgtcctttgcagcaacatggatggagcaggaggccattatcctaagagaactaattcagaaacagaaaatcaagtatctcatgttctcacttataagtgagagctaaacataggtacccatggacataaagacgaaagtagtagacacagaccattccaaaatggaagagtttgggagaagactgaggattgaaaaagtacctcttgggttcaaggttcaatatttgggtcatgtgtgtataagtccagtccccaccattacacagtataccagtgtaacaracatacacatgtaccctctgaatctaaaataaattaattaaaaaaattaaagacacttcctaaagtttgcccccccaaaaagttaactagtatggcttatttatttatttatttatttatttatttggagatggagtctcactccatctcatcacagtgatgtgatctcggctcattgcaacctccacctcctgggttcaagtgattctcctgcctcacactcctgagtagctgggactaccggagtgcaccaccatacccggccaagttttgtatattttgtagagatggggtttcacc

SEQ ID NO: 52252 - DNA, 601 bp, Human
attatcctaagagaactaattcagaaacagaaaatcaagtatctcatgttctcacttataagtgagagctaaacataggtacccatggacataaagacgaaagtagtagacacagaccattccaaaatggaagagtttgggagaagactgaggattgaaaaagtacctcttgggttcaaggttcaatatttgggtcatgtgtgtataagtccagtccccaccattacacagtataccagtgtaacaaacatacacatgtaccctctgaatctaaaataaattaattaaaaaaattaaagayacttcctaaagtttgcccccccaaaaagttaactagtatggcttatttatttatttatttatttatttatttggagatggagtctcactccatctcatcacagtgatgtgatctcggctcattgcaacctccacctcctgggttcaagtgattctcctgcctcacactcctgagtagctgggactaccggagtgcaccaccatacccggccaagttttgtatattttgtagagatggggtttcaccatgttggctagactggtcttgaactcccaacctcaagcaatctgcctgccttgg

SEQ ID NO: 52253 - DNA, 601 bp, Human
aactagtatggcttatttatttatttatttatttatttatttggagatggagtctcactccatctcatcacagtgatgtgatctcggctcattgcaacctccacctcctgggttcaagtgattctcctgcctcacactcctgagtagctgggactaccggagtgcaccaccatacccggccaagttttgtatattttgtagagatggggtttcaccatgttggctagactggtcttgaactcccaacctcaagcaatctgcctgccttggcctcccagagtgctgggattataggcgtaarccaccatgcctggcttagtatagctttttaaaatgaaagatgatctgtttatgacatgacctctaaaaaagttaattgtggtgtcataaataggattctatcactcccagtaccaccatggtgaaggatataaactgaaacatctgaatcttatttcttaaatgaagaatattaatttaaggatcaataattattttgtataatgggtatggcataagaaataaaaagtcctggatcttttccatgaggtggttggctctcaggttaagtaacaatgtaattgtaaaaaaatcttatggt

SEQ ID NO: 52254 - DNA, 601 bp, Human
aataaaaagtcctggatcttttccatgaggtggttggctctcaggttaagtaacaatgtaattgtaaaaaaatcttatggtaagcaatttttttttcaatttcatcaagtattggtagtaagttttttttaagttctaaattaccaaattgtacttgagtgaaagtgtagtgtttaatttgtagctcagcctgggatatctgtttgccagtgataggtcctcaaatgcattttcccttcctgcctttttatgattcctctcacctctttactttctctatggtgaatgagtcagctatttyatcttcctgtttgtcttaaaattaattaattaatttatttatttattgagatggagtttcactcttgttgcccaggctggagtgcaatggcatgatctccagctcaccgcaatctccacctcccgggttcaagcgattcacctgtctcagcctcccaagtagctggcattacaggcatgtgccaccatacctggctaattttgtatttttagtagagacggggtttctccattttggtcagggtggtctcgaactcccaacctcaggtgatccgcctgcctcggcctcccaaagtgctga

SEQ ID NO: 52255 - DNA, 601 bp, Human
catcttcctgtttgtcttaaaattaattaattaatttatttatttattgagatggagtttcactcttgttgcccaggctggagtgcaatggcatgatctccagctcaccgcaatctccacctcccgggttcaagcgattcacctgtctcagcctcccaagtagctggcattacaggcatgtgccaccatacctggctaattttgtatttttagtagagacggggtttctccattttggtcagggtggtctcgaactcccaacctcaggtgatccgcctgcctcggcctcccaaagtgctgrgattacaggcatgagccaccgcacctggcccaaaatttattttttttaatacggactttctctcttgttgcccaggctgagtgcagtggcgcgatctcagctcactgtaacctctgcctcccatcttcaagcgattctcctgcctcagccttctgagtagctggaattaaaggtgcctgccaccatgcccagctaattttttttttgtatttttagtagagatagggttttgccatgttggccaggctggtctcgaactcctgacctcagatgatccacccacctcggcctcccaaagtg

SEQ ID NO: 52256 - DNA, 601 bp, Human
ggcccaaaatttattttttttaatacggactttctctcttgttgcccaggctgagtgcagtggcgcgatctcagctcactgtaacctctgcctcccatcttcaagcgattctcctgcctcagccttctgagtagctggaattaaaggtgcctgccaccatgcccagctaattttttttttgtatttttagtagagatagggttttgccatgttggccaggctggtctcgaactcctgacctcagatgatccacccacctcggcctcccaaagtgctgggattacaggcgtgagccaccackcctggtgctgtttctcttatttttaatctcctgtgtattctgtagaagggatctagtctggataatcttggttgactaaattagactacattagtttggaagggttaccaaaacagttgttttgaagagttaccttttctgctaatattgttcatattggaaaattgatattccccagaccgtgtttttagagccctttgaaatctctgtttccttctaactgtatacacctctgtcctaagcagaatgttttgtttcctgtcccctaaataatgctcagtgatccataagtacagtgca

SEQ ID NO: 52257 - DNA, 601 bp, Human
tgtctcaaaaaaaaaaaaaaaagagtaaaataatatacctctttcctttgtggttagaagaataaaatgaaataatgtatgtggaatcacttagtatagcgcttcgatatagctgatagctgaacagttgctttttttgtactagaaaagttattaaaaccttttttcttttttttgcttaggagcaagaatcaaaatagtttgcagagtcctttaatgtgggaaattaggcagtattcctggagatttcacctttttctcctcttttaatttaaaaatgtgcatgatacataattcagtyattcataagtattgtgccaaaaaaagaacatatttaatgtgagattatgtcattatttcctcaaagtatgttatttgacatgttaaatttgctgattcatatacaagattccaattaagtattcaaatataaggcatcataaccaagtagcagttttatctttatgacatgactgtatttaagcacaggttgaggctatggaaggtgatcttacagtatctaaacactagagtaatttgaacttaaatactctttagaactcttcagtcatgggaagtgaaattgattattctcacttaa

SEQ ID NO: 52258 - DNA, 601 bp, Human
gaactgtacttttgttttctttattgatatagacctaaaatttcattactctgcttctttcttcttggctaggcctgtgcttatctgtccttttctttgtgacttttatttagcatttttataaaaggctagcatttccatcttgtctgttttgattcattttctttgaaatcttcagttttttggagattttgtaagccactccttagatgatattaaaatacttttcttcccggctatattattttaagatatttctttgttccatttgtcccccacagattgtatcttagtggtttaktaattgaaaaagttgactgtggttcacaagtatactttatattttgtatcaacaatggaaaagtactgaatttggtgttagaagacattggttagtcccactgtagctatttagcagctgtacgatgtaaattggggcaactaaaccttagattccttagtgtataaaataggaaaaatagcatttaccatagaaaatggttttaagtttcaaataaactttctaacttggaggttagaaaacttacgtagaattcttacatggaatttgatctcaatactaagctaacggaattaaata

SEQ ID NO: 52259 - DNA, 601 bp, Human
agcagctgtacgatgtaaattggggcaactaaaccttagattccttagtgtataaaataggaaaaatagcatttaccatagaaaatggttttaagtttcaaataaactttctaacttggaggttagaaaacttacgtagaattcttacatggaatttgatctcaatactaagctaacggaattaaataattttgagaccatcttagagatcatttagttcagcctcttatttaacagaaccaaagtcagtttcatgtgattatttatttggaagaaccaggattagaacctttttttcctrgttcctcatacagggctttttctaatactgcttattaaaaaataaatcataacttaaatcattgtttggtcttgtaattccaaatatataaaacgactttccaaacagttttccctgttgtgtagcccttatgttctttgtgtttatagtagaaaggaaaggaaaccaggggaggagttcttggtgggaggtagagtaacagctgttgcttaaattggcagcttctctgttcttgatactgtgctgctagctaattaacaaggagaaagccctctagtgaaagatcagttcgaattttag

SEQ ID NO: 52260 - DNA, 601 bp, Human
tctcttattttgacaaaatgactaaacatttaataaaattatctctccaagaactaactgaaaaacccagtagtgtggtattactaagctgtggttatgtaagtgatcaacaattgtttttatggaactgaaatgaaacattgggtgctttaaatttcatttatttctttattttcaggtattgaatgctatgctaaaagaagtctgtaccgctttgttggaagcagatgttaatattaaactagtgaagcaactaagagaaaatgttaagtaagttaaatcaatcaggtaaaacacaggsacagtttagtttagtttactggaaagaggtgctaactggaagtgtttgctgtatcaggaatcatttctgctctgcaccactggaaaagtgctgtgttggagctcatatgttgggcgagagcatgtgtagtacgtttccataatgatggttcaaagaataaactacatgtgattttcatttaattacatatttttttctattttactagtcttttatttgaatggatttgattaaatactgtatagtattttaatatataaagccttttaacaattcaggctcttcatagaaaagtactgc

SEQ ID NO: 52261 - DNA, 601 bp, Human
ttttgacaaaatgactaaacatttaataaaattatctctccaagaactaactgaaaaacccagtagtgtggtattactaagctgtggttatgtaagtgatcaacaattgtttttatggaactgaaatgaaacattgggtgctttaaatttcatttatttctttattttcaggtattgaatgctatgctaaaagaagtctgtaccgctttgttggaagcagatgttaatattaaactagtgaagcaactaagagaaaatgttaagtaagttaaatcaatcaggtaaaacacaggcacagttwagtttagtttactggaaagaggtgctaactggaagtgtttgctgtatcaggaatcatttctgctctgcaccactggaaaagtgctgtgttggagctcatatgttgggcgagagcatgtgtagtacgtttccataatgatggttcaaagaataaactacatgtgattttcatttaattacatatttttttctattttactagtcttttatttgaatggatttgattaaatactgtatagtattttaatatataaagccttttaacaattcaggctcttcatagaaaagtactgccatttta

SEQ ID NO: 52262 - DNA, 601 bp, Human
tcaatcaggtaaaacacaggcacagtttagtttagtttactggaaagaggtgctaactggaagtgtttgctgtatcaggaatcatttctgctctgcaccactggaaaagtgctgtgttggagctcatatgttgggcgagagcatgtgtagtacgtttccataatgatggttcaaagaataaactacatgtgattttcatttaattacatatttttttctattttactagtcttttatttgaatggatttgattaaatactgtatagtattttaatatataaagccttttaacaattcaggytcttcatagaaaagtactgccattttattctttttaggcttaagatgatcttaatcaaccttcattattggaggactgtattctcttttgttctccttttggtttctctgtttcatatttgaatgaagaattaatgtgtttggtctcagttatcatattcattgggagaggcactgagttggtaggacacacagagcaatacaggtagctcagttaactgcttgagtcttatctcttaccatgctttagacatctctccttgtattgttagactgagattagttgtgggactaccagcat

SEQ ID NO: 52263 - DNA, 601 bp, Human
tttgtatggcaaagtcacatatagcaagtattcttttctacactgttcgttgtgtaaggaattccctttgcaaagaccatgtatcccaattcttgcctagattatgagcaattttgaattagtgaaagttttattttcaaatagtaaatatagccagttgccctgcctcaccttattgctgatcatgcaaattatggtgaaaatcttagagcttaaaaaatatatatgggctcagttgtagaaaaaaaaagaaaggagctgttaaaaaaattattttagtccaggcatggtggctcatgcytgtaatcacagtgctttgggaggcggaggtgggaggattgcttgaggccaggagtttgagaccaaccagggcaacatagtgagaaccagtctctataaaaaaaaaaaaaattgataaaaatagctggtgcaggccgggcgcagtggctcacatctgtaatcccagcactgtgggaggctgagatgggtaaccacctgaggtcaggcgttcgagaccagcctggccaacatggtgtaaccccatctctgctaaaaatacaaaaattagccgggcatggtggtgcacatctgtagttccagc

SEQ ID NO: 52264 - DNA, 601 bp, Human
tcaagtgctttattaagaagcatttattgagtacctactttatttcaggaagtatgccaaatgctgctgatagcagaaataaatgagactggttcttatactcagatgcttatggtctagaggaatggtgtacaaagcaaggtcaaaattattttcataatactaagacattatttgacttttgtactatgttgacatttgcactgaaaacaatggtaggtaaaactccctggtatgaatcaaggcagtggcaccagatgatactagtagtttctggactctctatttatttatttatttwtgaagacagagtccctgtcattcaaactagagtgcagtggcgtgatcagagctcactgcggcctcaaattcctgggctcgagcgatcttctctcctcagcctccagagaagctaggactacaggcatgcaccaccatgttttttgtttgtttgttttttgtttttttggtttttttggtttttttttttttgagacagggtcttactctgttgcccaggctggagtgcagtggtgtgatcatggcttgctgcagcctcatcctccctgggctcaggtgatccctacacctgagcctccta

SEQ ID NO: 52265 - DNA, 601 bp, Human
ttgacatttgcactgaaaacaatggtaggtaaaactccctggtatgaatcaaggcagtggcaccagatgatactagtagtttctggactctctatttatttatttatttttgaagacagagtccctgtcattcaaactagagtgcagtggcgtgatcagagctcactgcggcctcaaattcctgggctcgagcgatcttctctcctcagcctccagagaagctaggactacaggcatgcaccaccatgttttttgtttgtttgttttttgtttttttggtttttttggtttttttttttttgagacagggtcttactctgttgcccaggctggagtgcagtggtgtgatcatggcttgctgcagcctcatcctccctgggctcaggtgatccctacacctgagcctcctagtagctgggactactactctttgagcccaggagtttgagaccagcctgagcaacatggtgaaaccccatcactacaaaaaatacaaaaattagctgggaacgatggcttacacctgtaaaccgagttactcgggagggtaaggtgggagaatcgcttgaatccgggaggtggaggttgcagtgagccgaga

SEQ ID NO: 52266 - DNA, 601 bp, Human
agcctaggccacgagagcgaaactccatctaaaataaaaataaaaaggacttgtatctatcatctgtctctatcatgagtttgacagtatcccagtacttagttttctgatgagggtcagtattgatattaatgaataaagttttttgattatgtatagtgaaatatgtcaatgacgagagatctgcctaactcagtgaaccaatgttttgtgaatagctagtgcgtgatgttacaagatcatttaccagtataagattcatttaaaatgcaagatggaatcacagattttaatgtaacgrgtataaaagtttatatggtttcagattctacattgcagctaacctttacaaactaccatgattataaagaagccctgagaccaagaagttgaaaactgctgttcttgatggtgggaggaagagaagacaaatttataaaattatttactaaaacatatatgttccaaataatgggtccatagagagctgggagtttttgccatgacatgtagaaaatggagatgaatgtggagcagcatcagtgtactgaaaggatctatgaggaagggaagtggatttatgtttaagacagattttgcc

SEQ ID NO: 52267 - DNA, 601 bp, Human
taatttttatggatggcttggcagactttctctcaaaggtttagactttgtggaccacgtgatttctattgcaactactcagctctgctgttgtggcacaaaagcagtaaatgggtcaggcacagtggcttatacctgtaatctcagcacttcaggaggccaaggctggaggattacttgaggccaagagttcaaaaccagtctgggcaacatagcaatactccatctctacaaacaaatactaaagttagccagacatcatggcatatgcctgtagttccagctactcaggaggctgagwtggtaggatcgcttgagtccaagagttcgagactgcagtaagccatgattgattgtaccagtgcattctagcctgggtaacagagtaagaccctgtctcaaaaaaacaaaaaaagtggtaaatgaatgggcatgactgtattagattgaaatttttttcaatgtaataactagaaatgtaataactttacagcctgttgcccaggccggagtacagtggcctgatgatagctcattgcagtctcaaactcctgggctcaagcaatcttactgcctcagcctccttgattagctgggacca

SEQ ID NO: 52268 - DNA, 601 bp, Human
atgcttttttaatttggagactgtccctatatgaacctcagttttccactgactgattttaaagttgattattattttttactagccctctaaatgtagtaactttacagtaaatatttggcattggagaatttacagtttgacctggaaaatctttcacatataatctgtaattttgttaagtaaatatttgtcaaattgaatatggacattagcactctcgagtatggcatccactagccacatgtggttattgagcatttgtaatgtggctagtccaaactgagatgtgttttacatrtaaaatacacaccaggttttcggacttggtatgggaaaagaaatgtaaaatatctcattaattttttatatagattacatatgaaaatgataattttttagatgtattggggtagatactaaaattagtatcacctgctttttaaatgtcagtactggaaattttaaaattcatgtgtagccttcatatacatttttgtattacatttctgtagtgctgatgtagattcctcctgtggcttaaatttggtttcacattttatactccagcttgttctaaaaaatgctgtgagatctttac

SEQ ID NO: 52269 - DNA, 601 bp, Human
gtccctatatgaacctcagttttccactgactgattttaaagttgattattattttttactagccctctaaatgtagtaactttacagtaaatatttggcattggagaatttacagtttgacctggaaaatctttcacatataatctgtaattttgttaagtaaatatttgtcaaattgaatatggacattagcactctcgagtatggcatccactagccacatgtggttattgagcatttgtaatgtggctagtccaaactgagatgtgttttacatgtaaaatacacaccaggttttcrgacttggtatgggaaaagaaatgtaaaatatctcattaattttttatatagattacatatgaaaatgataattttttagatgtattggggtagatactaaaattagtatcacctgctttttaaatgtcagtactggaaattttaaaattcatgtgtagccttcatatacatttttgtattacatttctgtagtgctgatgtagattcctcctgtggcttaaatttggtttcacattttatactccagcttgttctaaaaaatgctgtgagatctttacctctgaattggtttggagtata

SEQ ID NO: 52270 - DNA, 601 bp, Human
ctgtggcttaaatttggtttcacattttatactccagcttgttctaaaaaatgctgtgagatctttacctctgaattggtttggagtatagacttgattatgacttcttaaatttatgttcttaaattttactctgtctttacaaaggggaataattgtattataatagcttatggtagcttttacatgaaaatgtccttatttatataatttaaaagttgtggcagcacagtggctcacgcctgaaatcccagcactttgaggctgagacagaaggattgcttgaacccagaagttggaraccagcctgggcaacatggcaagaccctgtctctacaaaaaaaaatttttttagttaactaggtgtggtggcgtgtgcctgtagtcccagttacttgggaggctgaagtgggagcatcatttgagcccaggaggttgaggctgcagtgagctctgattatgccactgcactccagcctgggtgacaagagtgtgaccctgtctcaaaaaaggaaaaaaaagttgtggggaaggggttttgaatttatatgtatgttaacctgattttatttttaatttatttttggtatttagcttgtag

SEQ ID NO: 52271 - DNA, 601 bp, Human
caggaagtgagtgtgtgatttttggagaagagaacatggagtttactttatcctctatggctcaggactcctttttcaggttcccacccagcatactatagatcttcattttgtgtatccttatgccatatttttttagacagagtcttacttttattgcccaagcttgagtgcagtggcacgcaaacatagcttactgtagccttgaccgctttatgctaatttttaattcagtttaccactcctttctcccaaattgcatgtctcaacaatattacaagatttttccacaagcttcacrtatgttacagtttgagagggaaaaagagaaaaggatgatttttagatcgttttgttgttgtttgtttttaattaacattaatagtagttaacattttttgctatgatcatttgctacttgatcattttatatttgaatgctactgcatgacaattagaatataaaactttgtaggaaatttgccacattcaaaaatctttaataatattttcaggagaattataagcagttttattttactccttaggtaaataataaggaaaaacagaaaaaattatatgtataatttgttatatttta

SEQ ID NO: 52272 - DNA, 601 bp, Human
tttttaaatcttttctcacccagctagcatattattaccagaggaaaggttggaagacctgtttaatatgtgcagacacattcagagcaggtaatgtcttgaaatttgaaaattgttttatataatttttattttcaagtttgaggattcatgaactctttatcttccaggggcttttgaccaactaaaacagaatgctaccaaagcaagaattccattttatggaaggtaggttactgttttttattttaacacttatatccctcttcttgtctgtcagcttttttttttttttttttttgagacggagtctccctctgtcacccaggctggggtgcaatggtgcgatcttggctcactgcaaccaccacctcctgggttcaagtgattctcctgtctcagcttcctgagtaactgggattacaggtgcccaccaccatgcccatctaaatttttgtatttttagtagagacagggttttaccatgttggccaggctggtctcgaactcctgacctcaggtgatccacctgcctcagcctcccaaagtgctggaattacaggcatgagccaccatgcctgaccatgccctgctaattttt

SEQ ID NO: 52273 - DNA, 601 bp, Human
cccaggctggggtgcaatggtgcgatcttggctcactgcaaccaccacctcctgggttcaagtgattctcctgtctcagcttcctgagtaactgggattacaggtgcccaccaccatgcccatctaaatttttgtatttttagtagagacagggttttaccatgttggccaggctggtctcgaactcctgacctcaggtgatccacctgcctcagcctcccaaagtgctggaattacaggcatgagccaccatgcctgaccatgccctgctaatttttttaaaaactttttgtaaagaccytgtcttataaaatatcctttgttgcccaggctggtcccaagctcctgggctcaaatgatcctcccacctcagcctcccgaagggctgggattacaggcttgagccactgtatgcagccacacacatattcttattaagtgtatttctatctgagtttttggtggtggttcttaatttaggggaaaaactttttttgtaacattatgtgtctttatttgataatagtgatctgcatataaaaagttgccactaatcagaagagtgcaaattaaaatatctcatttcttgattttcaagttg

SEQ ID NO: 52274 - DNA, 601 bp, Human
ctcaggaggctgaggcaagagaattgcttgaacccgggaggcagaggttgcggtgagctgagatggcatcattgcactccaccatgggcaacaagagcaaaactgtgcctcaaaataaataaataaataaatttaaaaaagaaattggaggccaggcatgatggctcatgcatgtgatcccagcattttgggaggccaaggcgggcatatcatgaggtcagaagtttgagaccatcctgaccaacatggtgaaaccccgtctttactgaaaatacaaaaattagccaggcctggtggcagkcgcctgtaatcctagctacttgggaggctgaggcacgagaatcccttgaacccaggaggcagaagtggcagtgagccgagatcgcaccactgcactccagcctgggcaacagagtgaaactttgtctcaaaaataaataaataaatacataaaaattaaaaaaaaaattggaaaaacgtcaaatgtctaatagtagggcgttatttaataaatgatacagccatctgatagaatgctgtataacctcaaggttatgtgttacagaaatattttttcttttttcacccgtgttaattttta

SEQ ID NO: 52275 - DNA, 601 bp, Human
tttttttttttttttttttgagatggagtttcactcttgtcgcccaggctggagtgcagtggcatgatctcagctgactgcaacctctgcctcccgggttcaagtgattctcctgcctgagcctctcaagtagctgggattacaggcactcgccaccatgcctggctaatttttgtatgctaatttttgtatttttagtagagacggggttttcaccatgttggccaggctggtcttgaactatctcaggtgatccacctggctcggcctcccaaagtgctgggattacaggcatgagccrctgcacctggctctaaatattgttttatagcttctaatgatgacatttgcttaggatcaataaaaatcttttctaaagtatcttttctatttaaactttctagcaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcgtaagtatcattgatactgttgtcctctgtcttgggattatatgggga

SEQ ID NO: 52276 - DNA, 601 bp, Human
gcttaggatcaataaaaatcttttctaaagtatcttttctatttaaactttctagcaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcgtaagtatcattgatactgttgtcctctgtcttgggattatatggggaaggatatgtgtttatagctttcatattgatcatttaaaatatgtttcartagtgagcctaatatggtttataaagaaagtttaaatagaaacaattttggagcctgtctgatataggtctattataacttgtgaaatgaaacttgagttttgtacctttgtctaattagctttggaggcggattcacttcgaatttcagatctgctggaaatttgtggggttcttttgaggttattttatattttctttttttttccagagtcgctgccacaaaaagtccgattattttcattggtacaggggaacatatagatgactttgaacctttcaaaacacagccttttattag

SEQ ID NO: 52277 - DNA, 601 bp, Human
acatcatttctttctgtgacttagtttccttacctgtaaaatagagataatggttatctgccctctgtggtgaaagtggtaaaatgaggtatctagtagaaagttctttggaaaagttttagagcacagtacaaaaacaagtggttttaataatagtggatgtaagggcagtaatactttggcaatgtctcaaggtggtatagttagagagcatggaatttggagttaaaccctgggctgcagtccttgctttgccacttgtttgttgccacttaactttttttttttttttttttgagayggagtttcgctcttgtcacccaggctggagtgcaatggcgggatctcagttcactgcaccttcagcctcccgggttcaagcgattttcctgccttagcctcccaggtagctgggattacaggcgtgcaccaccaggtccagctaatttttttttatttttagtagagacggggtttcaccatgttggccaggctagtctcaaactcctgacctcaggtgatccacccaccttggcctcccaaagtgctgggattacaggcatgagccaccgctcctggccatgccacttaactttcttag

SEQ ID NO: 52278 - DNA, 601 bp, Human
caaatgtacattcctgtctctcacatctgggctgttgcctttgccagtccctctatctctcttcttacctctgccatcatctcctctggccaagatggctaactgctacttacacttcagatttctccttaaatgtccttcttcagggacatttcacctgaaccctagactgagttggaaccttctgacagatgtttctatcacttcctacaattaatttttatattattcagcacaattatttgatgtctgtttttcctgcttgaaggtgaaggtagaggtcatagctgggttactcatyttttatgttcacagtacctagcacagtgtctggcacatagtaggccttcagcaactattgaatgaatgaatttatcctttgttgcctgtctctttgccccttttttttctttttttttttttttttttcttctttttttgagacagagtttcactcttgttgcccaggctggagtgcattggcacaatctcagctcagtgcaacctccgcctcccagtttgaagcagttctcctgcctcagcctccccattagctgggactacaggcatgcactgccacgcccggctaatttttgcattt

SEQ ID NO: 52279 - DNA, 601 bp, Human
gttcctaatatttaagtgttttctgccttttctgttttcagactctaagttctatgtctgtggatttcttatattattctagctttaattatcacttctgtataaatggccaaatatgtatttcaaccttaatcctctcttccactgtttaattctgcgtttctagttgactgctataacatttcttttaagatactgtactgccacttcacattcagaatgcctgaaccaaataccttttctctttttatctttaggacataaatagaaaatactttctcttttggcttgttccatcccygtttttaaaccttaggttagtatacatacaatgaaatgctcaaatcctaaggatacctttctttttttgacaaatgcacagtaacccacacccaatcaagaaacagaacatttccattactctaaaaggtttgcttgtgccctttcccggtaatacttcatattatagaagtcctgggctgtgcatggtggctcacactgtaatcctagtgctttaggaggccaaggtgggaggatcatttgaggtcaggagtttgagaccagcctgggcaatgtagtgagacccatatctcttagaaaa

SEQ ID NO: 52280 - DNA, 601 bp, Human
ttaattctgcgtttctagttgactgctataacatttcttttaagatactgtactgccacttcacattcagaatgcctgaaccaaataccttttctctttttatctttaggacataaatagaaaatactttctcttttggcttgttccatccctgtttttaaaccttaggttagtatacatacaatgaaatgctcaaatcctaaggatacctttctttttttgacaaatgcacagtaacccacacccaatcaagaaacagaacatttccattactctaaaaggtttgcttgtgccctttccyggtaatacttcatattatagaagtcctgggctgtgcatggtggctcacactgtaatcctagtgctttaggaggccaaggtgggaggatcatttgaggtcaggagtttgagaccagcctgggcaatgtagtgagacccatatctcttagaaaaatccagtggcatgcatccatagtcataactactctggagactgaggcaggcggtcacttgagctcaagagtttgaggctaccagtgtgtgatgactgtaccacttcaatccagtctcagtgatagagcacaaccctcttaaaaaaata

SEQ ID NO: 52281 - DNA, 601 bp, Human
tcattaaattttctaaaatagatacacttgctttaattatttttacattcgggtaaaaatatatctaagacttagtgtcaatattaaacctaatagttaaatgtggacattttgaaccattaatcttaagctactattgactttatgtttaaatctgttgtaggggatgatccctggttttgggacagattttatgagcaaaggaaatgaacaggagtcaatggcaaggctaaagaaattaatgacaataatggatagtatgaatgatcaaggtaagatggcagattattttcctcaggcraaaatgttctgagtatcagtaagatgagagtttcactgtattcttgtggacaagatggggagaaatttagcctgaaagattatttttaggtagatttgtaatagcttgaaagctcttactcaaagggttatgattattggattgccttcatcgttgagagaaatgtctagtataatacttctccaaatgagttacaaggaaagaacactagttcttcatgatgttcatagagttaacttaaaaggagaactctgagtcaaatgtggtggaatgctagtttttaaagagttaaatttggct

SEQ ID NO: 52282 - DNA, 601 bp, Human
gcaagaccctgcctctatgaaaaaaaattatttactgaaagtctcttcacggagctttaatattgctaacatacattgggaaactaagaaatggatagcttaagcaatgcttagaaaattctttctgtctgaaacataagaattcagttttctcagtatactgctctgttcccctgaccctataaaggcatgcctcagagatactgtgggtttggttctagaccactgcagtaaaggaaatatcatgcaataaagtcagtcatacagattgttttggttttccagtgtatataaaagttaygtttacaaatacatatactgtagtctattaagtgtgcaagagcattatatctaaaaaacaatgtatataccttaatttaaaaatagttgattgttggccgggcgcagtggctcacgacgcctgtaatcccagcactttgggaggctgaggcgggcggatcacctgaggtcaggagtttgacaccagcctggctaacatggtaaaaccccgtttctactaaaaatacaaaaaaattagccgggcgtggtggcacacacctgtaatcccagctacttgggaggctgaggcaggagaatcgct

SEQ ID NO: 52283 - DNA, 601 bp, Human
aaattctttctgtctgaaacataagaattcagttttctcagtatactgctctgttcccctgaccctataaaggcatgcctcagagatactgtgggtttggttctagaccactgcagtaaaggaaatatcatgcaataaagtcagtcatacagattgttttggttttccagtgtatataaaagttacgtttacaaatacatatactgtagtctattaagtgtgcaagagcattatatctaaaaaacaatgtatataccttaatttaaaaatagttgattgttggccgggcgcagtggctcaygacgcctgtaatcccagcactttgggaggctgaggcgggcggatcacctgaggtcaggagtttgacaccagcctggctaacatggtaaaaccccgtttctactaaaaatacaaaaaaattagccgggcgtggtggcacacacctgtaatcccagctacttgggaggctgaggcaggagaatcgcttgaacccgggaggcggaggttgcagtgagccgagattgtgtcattgcactccagcctgggtgacagagtgagactctgtctcaaaagaaaaaaataaaaaaatatagtttattgc

SEQ ID NO: 52284 - DNA, 601 bp, Human
gtcagtcatacagattgttttggttttccagtgtatataaaagttacgtttacaaatacatatactgtagtctattaagtgtgcaagagcattatatctaaaaaacaatgtatataccttaatttaaaaatagttgattgttggccgggcgcagtggctcacgacgcctgtaatcccagcactttgggaggctgaggcgggcggatcacctgaggtcaggagtttgacaccagcctggctaacatggtaaaaccccgtttctactaaaaatacaaaaaaattagccgggcgtggtggcacrcacctgtaatcccagctacttgggaggctgaggcaggagaatcgcttgaacccgggaggcggaggttgcagtgagccgagattgtgtcattgcactccagcctgggtgacagagtgagactctgtctcaaaagaaaaaaataaaaaaatatagtttattgctaaaaatgctaatgatcatctaagccttcagtgcattataatctttttgctggtggagggccttagcttgatgttgatgactgctaactgattacagtgatggttgccaaaggtcaaggtggctgtgacaatttcttaa

SEQ ID NO: 52285 - DNA, 601 bp, Human
atgtatataccttaatttaaaaatagttgattgttggccgggcgcagtggctcacgacgcctgtaatcccagcactttgggaggctgaggcgggcggatcacctgaggtcaggagtttgacaccagcctggctaacatggtaaaaccccgtttctactaaaaatacaaaaaaattagccgggcgtggtggcacacacctgtaatcccagctacttgggaggctgaggcaggagaatcgcttgaacccgggaggcggaggttgcagtgagccgagattgtgtcattgcactccagcctgggygacagagtgagactctgtctcaaaagaaaaaaataaaaaaatatagtttattgctaaaaatgctaatgatcatctaagccttcagtgcattataatctttttgctggtggagggccttagcttgatgttgatgactgctaactgattacagtgatggttgccaaaggtcaaggtggctgtgacaatttcttaaaacacaagaatgaaatttgccccattgattgactcttcttttcacaaaagatttctctgtagtattcgatgctgttcgatagcattttacccacagtagaacgtctt

SEQ ID NO: 52286 - DNA, 601 bp, Human
ttggccgggcgcagtggctcacgacgcctgtaatcccagcactttgggaggctgaggcgggcggatcacctgaggtcaggagtttgacaccagcctggctaacatggtaaaaccccgtttctactaaaaatacaaaaaaattagccgggcgtggtggcacacacctgtaatcccagctacttgggaggctgaggcaggagaatcgcttgaacccgggaggcggaggttgcagtgagccgagattgtgtcattgcactccagcctgggtgacagagtgagactctgtctcaaaagaaaaaaataaaaaaatatagtttattgctaaaaatgctaatgatcatctaagccttcagtgcattataatctttttgctggtggagggccttagcttgatgttgatgactgctaactgattacagtgatggttgccaaaggtcaaggtggctgtgacaatttcttaaaacacaagaatgaaatttgccccattgattgactcttcttttcacaaaagatttctctgtagtattcgatgctgttcgatagcattttacccacagtagaacgtcttccaaaattggagtcagttctgtcaaaccctgct

SEQ ID NO: 52287 - DNA, 601 bp, Human
catggtaaaaccccgtttctactaaaaatacaaaaaaattagccgggcgtggtggcacacacctgtaatcccagctacttgggaggctgaggcaggagaatcgcttgaacccgggaggcggaggttgcagtgagccgagattgtgtcattgcactccagcctgggtgacagagtgagactctgtctcaaaagaaaaaaataaaaaaatatagtttattgctaaaaatgctaatgatcatctaagccttcagtgcattataatctttttgctggtggagggccttagcttgatgttgatgastgctaactgattacagtgatggttgccaaaggtcaaggtggctgtgacaatttcttaaaacacaagaatgaaatttgccccattgattgactcttcttttcacaaaagatttctctgtagtattcgatgctgttcgatagcattttacccacagtagaacgtcttccaaaattggagtcagttctgtcaaaccctgctgctgctgctttatcaactaagtttatgtaatattctaacaatttgaacaatttttcatatctgtgctttatctactatctgatttattgttatttttttgta

SEQ ID NO: 52288 - DNA, 601 bp, Human
atttattgttatttttttgtagtctctttttcctgagctccaggttttcatagtagcccaaataagactgtctttttcttttaaggttgttttttttcctcactgtctttaacactgcaaaaatgtttgcatgtagaattcataattgcagcatatctaaagtatccattctgtgccaggcactgtcctgagcactttaaatatattaattcattttatcatcataacaactcctatggcatattcagttattatctgcctttttcaaattaggaaactgggatacagggaagttgagtartttgcccagtatagaacctttcctgacttccttccttctttgaattaacgccccttcctctatttgcttaactctgtcgtattacttgccacgatgtgctgctattagtttatcttctttcatttgatttgagctgttggaaggaatataatatatatgtttcataaatcttttataaggaagatgtggcttaaaagctgcatttatgaaatggatttggaggttttgatcgtgactttattttgagatattgtatctttgttagtattgcattgataattagacttcacctggatttca

SEQ ID NO: 52289 - DNA, 601 bp, Human
agctggccaggtgcggtggctctcaactgtaatcccagcattttgggaggctgaggtcggtggatcacttgaggtcaggagttcgagaccagcctgggcaacatggtgaaaccctgtctttactaaaagtacaaaaaaaattagctggctgtggtggcgtgtgcctatagttccagctactcaggagcctgaggtgggagaatcgcttgaaccctggaggtggtggttgcagtgagcgaagcttgcaccactgcactccagcctgagggacagagcaacactctgtctcaaaaaaaaaaaagattttgaaagccttattttttatgcgtagcaaggagacatatacatgaataggaatggaagtgccacgtaaatggatttcaatttaatatgtgtaaagaaaagatttttccctaagtataacagaatggcatagacagccttacattagatagcaggtcatctctcctggggatattaagaccaaggctagataaccatttatttgggggatattgcagagggaatgcagacataatggacattttgactaaagtccatcccattcctgagattgcatgcaactgaagctagaagaaat

SEQ ID NO: 52290 - DNA, 601 bp, Human
tgctttcttttatgagtacagctgttgtctaaagggtgtttttatctattctggctcagagtgcatttattttttgttgttttttgtttgtttgttttgttttgttttgagacagggtctcgctgtgtcacccaggctgggggctgaagtgcaatggcatgatcatggctcactgcagccttgacctcccaagctcaagcgatcctccaatctgaggcccccaagtagctgagactacagacgcatgctatcacactgagctaatgcttttttttgttttttttgtagagacagggtttcsccatgttgcccaggctgatcttgaactcctgggctcaagtaatcagcctaccttcgccacccgaagtgctgggattacaaatgtgacccacctcacccaggctgcatctctttcattgactgccctttttactatggtgttttgacatagtgtagaaattccttgacaagtgaagttgcattatttgtctttgtattctctgaaggttttcattacttaaagaaaacttctggccaggcgctgtggcctacgcctgtaatcccagcactttgggaggccaaggcgggcagatcatgaggt

SEQ ID NO: 52291 - DNA, 601 bp, Human
gtggagacggggtttcaccacgttggctaggctggtctcgaactcctgacctcaagtgatctgccagcctcggcctcccagagtgctaggattatagttgtgagccaccacagccagcccaacagactcatactttcatattcatctaccagccatccagtctctttgctaattaacccatgtctataaactcagctttttgtccagcattcccctgtatcactattaagccgttgttatagcttactattaaaaactgctggctgaccaggtacggtgtctcacacctgtaatcccagcmctctgggaggctgaggtgagtgggtcacgaggtcaggtgtttgagaccagcctggccaagatggtgaaaccctgtctctactaaaaatacaaaaattagctgggtgtggtggcgggcacctgtaatcccagctacttgggaggctgaggcaggagaattacttgaacctgggaggtggaggttgcagtgagccgagatcacgccactgcactctagcctgggtgacagagcaagactccatctcaaaataaataaaaaataaaacactgggtacaattttgctaatagtggcttattcac

SEQ ID NO: 52292 - DNA, 601 bp, Human
gaacctcactttccccttcggtaaaatcacagatcatatctcatcaagaaattgtgacaattaaatgagataatatatatgaagacattcagtacaattctgggcatatagtagatgttcaataaatgaattattttctttttgtaagtcctatgaaataatcccctattgattattttttatgtaacttagagtaagacccttttggatttataagaaaaaaattttttgtttagatttattgactatgtgaccggtagtatcctaagatctttttatgtatcacctcatttattcctcrcaataactccgtaagataggctattcattctcttttattgatgaagataactggtgataatacaaatttttaggtggtacgttctttaaggctgatgactaaattgcaatcagaattcagtatttttagaagtacttattaggcaaaagtaataaatgtttccagttctgcttaataattctctgtttttaactctacttccctacttttgctctaggtggtatggcaggacttcagtcaatgatgaggcagtttcaacagggtgctgctggcaacatgaaaggcatgatgggattcaat

SEQ ID NO: 52293 - DNA, 601 bp, Human
ttccccttcggtaaaatcacagatcatatctcatcaagaaattgtgacaattaaatgagataatatatatgaagacattcagtacaattctgggcatatagtagatgttcaataaatgaattattttctttttgtaagtcctatgaaataatcccctattgattattttttatgtaacttagagtaagacccttttggatttataagaaaaaaattttttgtttagatttattgactatgtgaccggtagtatcctaagatctttttatgtatcacctcatttattcctcgcaataactcygtaagataggctattcattctcttttattgatgaagataactggtgataatacaaatttttaggtggtacgttctttaaggctgatgactaaattgcaatcagaattcagtatttttagaagtacttattaggcaaaagtaataaatgtttccagttctgcttaataattctctgtttttaactctacttccctacttttgctctaggtggtatggcaggacttcagtcaatgatgaggcagtttcaacagggtgctgctggcaacatgaaaggcatgatgggattcaataatatgtaaa

SEQ ID NO: 52294 - DNA, 601 bp, Human
tcatatctcatcaagaaattgtgacaattaaatgagataatatatatgaagacattcagtacaattctgggcatatagtagatgttcaataaatgaattattttctttttgtaagtcctatgaaataatcccctattgattattttttatgtaacttagagtaagacccttttggatttataagaaaaaaattttttgtttagatttattgactatgtgaccggtagtatcctaagatctttttatgtatcacctcatttattcctcgcaataactccgtaagataggctattcattctcwtttattgatgaagataactggtgataatacaaatttttaggtggtacgttctttaaggctgatgactaaattgcaatcagaattcagtatttttagaagtacttattaggcaaaagtaataaatgtttccagttctgcttaataattctctgtttttaactctacttccctacttttgctctaggtggtatggcaggacttcagtcaatgatgaggcagtttcaacagggtgctgctggcaacatgaaaggcatgatgggattcaataatatgtaaagaaaatgccttaatataaactga

SEQ ID NO: 52295 - DNA, 601 bp, Human
agtgcaaatgagcaggttggggacccactgccgccccagcagaaatacagtaaaaccattagcgtcaaaaggggcagtacacagcagattgtctgtagaggaaaggcggaggtttgtccagacagcccccgcgggggttgcggtgggatatgctaatagtgcctggccactggggccggcctccctcccgaaagaatatataaagaaccccaaccccagcttgtctacccaggccaacaggcgtctgcccttgttaattaccggagcgacagactagggagctccgcccgggatttgcccrtcggcggaggcgccaggctcccgtttctccccatccctctcgctgccgtccaggtgcaccgcctgcctctcagcaggatggacgtgatggatggctgccagttctcaccttctgagtacttctacgacggctcctgcataccgtcccccgagggtgaatttggggacgagtttgtgccgcgagtggctgccttcggagcgcacaaagcagagctgcagggctcagatgaggacgagcacgtgcgagcgcctaccggccaccaccaggctggtcactgcctcatgtgggcctgcaaagcct

SEQ ID NO: 52296 - DNA, 601 bp, Human
ggtgtggtggggagagtggggtggaggcagatgctgagttgctttaaaagaagagaggggtccacatttagaaagactccccaaaccgctgctgaacaagattttagtttaactttctagcaggttctaggtgtacactgtaatcgagtgttgacatggaagatgggtggctgtgaatgatcactcagatgttttctccattcctgaatttattttcaaaatatgccatctgtggatcatgccctacgctaatatctaaaggcaccgtttctaacttaatgaggaaatggaaagaaatacscacacggccccagttcctgctccaatgaggcctggctgaaagatgttgatgcattctttttagagggcgtttgctccaaggctgccaggttttaatgtgtttttgccctgggaaagtgttctttccctgaattagtgtggctttcttctactccaatccattttgcatggttaacccaatgcacattgctgctgaattccaccccctcttccctttgctgctgctctcctcttcttcaagcacagagattgacctcagtgccctgggaatttggagagggctagcccttcctaaatcaag

SEQ ID NO: 52297 - DNA, 601 bp, Human
ccctgaattagtgtggctttcttctactccaatccattttgcatggttaacccaatgcacattgctgctgaattccaccccctcttccctttgctgctgctctcctcttcttcaagcacagagattgacctcagtgccctgggaatttggagagggctagcccttcctaaatcaaggcagtgaaggtgattgacagtgttcggttacagagctggtgggcaagcacagcctcacctttggtcagaacatcttttgccaagacctgaaaacaaactttgttgtgtgtcttgtattatagccygaatgtaacagtcctgtctggtccagaaagagcagtacttttgacagcatctactgtcctgatgtatcaaatggtaagaattgataacttcacaggagtttaaagaccagttcaacctaacaattcagcctataagattctgttcttgctgatagtattggggaagggagaatggaagtgatggttcttatagggaggctttggtaaagcaaaataaacacatcttctgctccaaatccccctagcagacacgcacgcacacatgcatacacacatgcacacacaatgttgcttgaaata

SEQ ID NO: 52298 - DNA, 601 bp, Human
cctatggccaggcgagaaactgtttactttctccaccccaccccagatgcacacaatggagttgatggctttggagatgagaagcgccaccggactgttaaccccgaagggaagaaaaacaagcaaccctaaaccacgctctgggcagggctgttaattgtgccggtgacaaatccgatgattaatgggcaggggcaggaggcgcggggagacggcacgtccgttctgagctggctccggggcagcggcgcagcttcccaccccggggctgggccgccgaccacgcaacggttggaggggrctgaggaaaggggacgtcgaacccaccccagccccacggctcctttgtccccaaatccgccgacggtcctcggaccgcagctcccgcctcggtgggcttaagtttctttgttgtgcgtgttgtcttctcctctccgttttgccagctggggggaagggggcgccctccgtccagcccctaaagcctcgcggggaaccgctgttagcggccacccagcgcaaccacaccggtcccgcggcggggcccaagcgcgaccggccccggggcgctgccgaggttcccgcagccccgacggccgga

SEQ ID NO: 52299 - DNA, 601 bp, Human
gtactaccatgtttaaaacgtttaactttcctattaaaagctgccgaaaaggttaacaataacaactttcaagtgtaatagtgcaaattcccctgcgagatttactgcagagaaagattctttgaaatacagattttctttaaaaggattgatgtaaaaatttaggtatgtctgggagaaactgaaaccaccctaggacttccctccctagcaaataaagtgatcatttacttggactcacaggctattaaaattaatcattgaaaggtactgtccaaactatggcactgtcacttaaaattttttttttttttaccattctatcttgtgccagatcttcacagctgtgacatggtttaaattccataatccatccccaagaggagcccacccaaagcaaaaatcaaatttatccatcatcatcagatgatccatccacagactatatcttaacctgatacagtcatcatattgtagtttttggaagggctcgttctgcccaagagaagttcctccttacagctgattcggctgtctaccatttgcacgttggtgctgttttgagtgctacctcctgctggtgaggcttcatacagcacac

SEQ ID NO: 52300 - DNA, 601 bp, Human
gaagggtggagctgggatatagatgtgttgtttcttttcaaatcaaacctgctttaggtcgtcactcgagggtgtctagcgattatgggcagtgggggcctgggattagggatttctaaaggcgtttgatttgaaaaggataacattacatgatgtaggtggtttgctcccctctttcttcccattttttcaatcccccttcccctcgtctctgggttttggggttgttgtggggtggttttttttcttttttgcctgttcggctacttctggggcccggactgaaaagctaaccatgaccaaccattaaactgtggaatagtctctccacgtgaagaaagcccatcgtttgagaccattaaaactggattcttcatagccctggagcatgactgtagggatgacctctgagctggccagaatggacacattaatgaccaaataggcctttttccatccctgacgtttccttttggaattagagctcgaaaacgagaactggtgaagggagggccgcggaatcagatcatgtctggatctgatggctccgtgctgtgctcaagcgtgctgtgccttcacaccatggtttatattgaatgtg

SEQ ID NO: 52301 - DNA, 601 bp, Human
ggattatttatttctcattgattcgggtaacagaattactcattcaggattatttgtttctagattggtaacatgttcattaatatcctcagggattcattcttgaggcagtgaaagaataggtgttaactgggataagttaacatcaccgccctctcactgacctgcttccccatatccctccacaactgagacagtgacacatgcccagtggaaggacacagtgagggagtttctactccccagaaaacagcacagcttcctggtagccttgatgccacctagggcatatacttaccasagtattttaaattaaagatttggaatttatgcttttctggattaacatgggaaactttgaatataaaaaatagtgctgctgaaaaacctgggctcgtgtagtatagacacaaatatcctcaatcacttcactaagcgtcgagagctccactaccatagcgctgcatcatggtcagtcgttaattagcagtaatgctaacatgaacctgacaccttaaagacgggtcagtatattcaggatattctgtttaaaaagaagaagaacattaacttagaaacattcaaatgtttacattacatc

SEQ ID NO: 52302 - DNA, 601 bp, Human
tcactgacctgcttccccatatccctccacaactgagacagtgacacatgcccagtggaaggacacagtgagggagtttctactccccagaaaacagcacagcttcctggtagccttgatgccacctagggcatatacttaccacagtattttaaattaaagatttggaatttatgcttttctggattaacatgggaaactttgaatataaaaaatagtgctgctgaaaaacctgggctcgtgtagtatagacacaaatatcctcaatcacttcactaagcgtcgagagctccactaccayagcgctgcatcatggtcagtcgttaattagcagtaatgctaacatgaacctgacaccttaaagacgggtcagtatattcaggatattctgtttaaaaagaagaagaacattaacttagaaacattcaaatgtttacattacatcaaatggagatttaattgtagagctaatttaatctgttattctgaacttcatcggtttctccttaagtaacactttttatctttttaaatttttttattaaaatacacaataatttaaaaaaagagatggggtctcactgtgttgcccaagctagtc

SEQ ID NO: 52303 - DNA, 601 bp, Human
gcgataccaattaaatacatacatacctgaaagagcagcggaggggaaaaggaacatggattgagcacctgctaagtgtggaggattatggtagagatgttcacatgggctatctcacctaagccccacttggccctgggagtggatgtgatgacttcacaaccagtgaggaaacagagaacagcagaatcccggagctaacaagcggcagggcaggagtttaactacagttaacccttgaacaacacaggtttgaattgcgtaggtccgcttgtatgaggatttttttcagccaaacackgatcagattgagggatgtgagacccgcatatatggagggtcagcttctttatatatgtgggttcaaatggaccaaatgcagaattcgagcacgtgtggatattggtgtctgcaagggtcctagaaccagtcccctgcgtataccaagggaataccgtgcagtctgaccctatacacactccttctgctgcaccccacctccccccaccaccccacctcatttggaattttgtaaagtgagtttcacttgcgttgtgggtagaagagaaagctgaagatggcttctaggagtaacaacaga

SEQ ID NO: 52304 - DNA, 601 bp, Human
ctaacaaccctataagcgaactactgtttactatccctcttgtgccagtgaagaaactgagacttaggaaagtcaagaatttggctaataaatagcaactgggaacgttggtcttaactatgatgccatcttcagtcaccgtgctttatgggatttttatatgtttactgggaaggttgaaaatctttttgttgtgtgtgtatacttgggaaggactcttaagtgttcgtgcctagcaggaagttttttcttggacattttcgtaactggattgcaagtggcatcgatgcaggcattctcrattcttgtttgtgtcccacatcctgaatcactcactgcatggtagatgccgggaaagctccgcacagagagagcatctctcacctcccactgcgatcactcgctgccactctaattgagttcagcgtgaatttgatggttcttacccttcattaatctgatgaagggcaatataaaaatagcccttttaattcctgcctccaacgctttccttctcttcccttattcatttacatatcctctccctctcttttattctttcaaatatgggtaaaataactttttggattttgcctagtat

SEQ ID NO: 52305 - DNA, 601 bp, Human
cctcattttgcccacttaacatttcatagagaaaacagttatatatcctctcttggattattcaagtaccacagtgttcagggctgtatagctcaattatacatggccacaaaagtgaaaattttacttggattatctattttaagctattatttttataacagtgtctctattttggagttcttactgccaaagccagttagctgtattttgaataaagatggtattttgacaagtctattcatatatatgtatatatatacacacacacacacatcttccattgaatttttttttttttaattggcgacagagtctcgctcttgtcgcccaggctggagtgcaatggcgtgagcgcgatcttggcttactgcaacctccgcctcccgggttcaagcaattctcatgcctcagcctcccgagtagctgggatcgtgggcacgtgccaccacgcccggctaatttttgtatttttagtagagacaaggtttcaccatgttggccaggctggtctcaaactcctgacctcaggtgatccacccgcctcggcctcccagagtgctgggattacaggcgtgagccactgtgcccggcccttcca

SEQ ID NO: 52306 - DNA, 601 bp, Human
ggattggattttataggtgatcagaatatatgcatcttcgagtcctatgttaccatcatagattgtttttaaataaatattttcacttctaattctcccctcatctgtgtgaagaaaccactcagcattatcttgtggttaattcacaccactctgccattcgcgacataaaaaacaggagtctattagatttaagcatctggttttcagcagttgtgcattgtgggtgaccttttgtgggaatgattgctgattgattggactggaaaagctattggtgattaaaaatcagaaactcctrtaaggaaagacagtttcaaattttgcatggggttagacattcacactttaattggtgtcaaactagtcttagttgttcgtctgtccttttcttggtagttattttggaaattgaaaccctgtgttcactcagttcctctgagacagccagctggggcatttggccacaactcgttaggacctccatgggtgcgtgcatgtgtgtgttttttctaaggcatgtacactgagtcctaaaggtgagccttttgcagcagaagagttctgcatggttcagaatattgaatgctaaggctgtgtc

SEQ ID NO: 52307 - DNA, 601 bp, Human
gaaagtgtttgacgttggttccagcgtcaggtctttctgtaattgttttattcagaggttaaatatggaatgaggaagctttagcagagccgaggaaccacctgctgagtctgcttcccaggcagctctggtaccctgactccatttgtaaagcttatctccttcagttcagccggagatgaattgttaaaacatcagctcctctttatttgggacaagcttttgtaaacatcacagctgtgttctttgcacttcccttttagcactggcacatactaaacgtttttagactttaaaaaaytagttactagagtgaactttctgcatgtgtccccccaaaaaccttttaaagctgagaatgtctttaaatgattaaatcaagtcatatcaaatttcactgaatgttcaaatcagaggtcagctctactgctacagaggtgcgtgttcaatagtgtaggcagccagctgtctgaggtgctctgtagatcactcctaacgcccagtcctcactgcatggatttttggatagacggccgcacacctttaagtcttgagccccactcggcagcctgtgaagctcccgccctggagtcatggggcg

SEQ ID NO: 52308 - DNA, 601 bp, Human
gtgaactttctgcatgtgtccccccaaaaaccttttaaagctgagaatgtctttaaatgattaaatcaagtcatatcaaatttcactgaatgttcaaatcagaggtcagctctactgctacagaggtgcgtgttcaatagtgtaggcagccagctgtctgaggtgctctgtagatcactcctaacgcccagtcctcactgcatggatttttggatagacggccgcacacctttaagtcttgagccccactcggcagcctgtgaagctcccgccctggagtcatggggcgctgtgctctgcmcaggatgcctgcccactgagggaccatccctctgcttcctcctttccttttccaagcctgtcgttgagtttgcttgaaccaaatgcattgtccgtgcacgtccaccagatccctgaagctgctgcaaagcagaggactagaaattcagggcgggctgaccttgattatttgctgtgctaatcactggtggaagaacagccatgtgcagaccccgcaggaccaggcaggatggtggagccggctggtagtggccgttctgtgacacacagcatcccctggtctggtgggaatgtgatctga

SEQ ID NO: 52309 - DNA, 601 bp, Human
ggccccgtggggtctggaaaagggcggggctagtgtccttggagcacgtcagcttccacagcacccagttacttttcctgaggacagaggagttgcatgtgagggaggaggcgtgatttaaagcatgaagagaatcatgccccacaatgaaaccagagccctgtggcccgcgtttcagaccactgccaaccatggacaccagagacaagacaaaggacattttggccatggacttgaaacgtcagctgtatgagagcgggcgggggatggcgcggtctccctggtacttactgggcaggtrcgtatcgtcaggagctcctcaccctgccctgtgagaactttcgtatgtgtgtctctgccatctcctcctcctcccattcctgacctgttgagccaggggtggattggcaggcctataaggcgcctttcacattgagggtcttaggatttgcagtccagctttgcagggagcggcagtttgtcatttgtaggaggaaatttcacgatcataaagcacggcatgcatcctgagagccaggcagcgacgctgcctgcactgccccaccgctcagcgggccacaggagcagggcttcctccttg

SEQ ID NO: 52310 - DNA, 601 bp, Human
cggtctccctggtacttactgggcaggtgcgtatcgtcaggagctcctcaccctgccctgtgagaactttcgtatgtgtgtctctgccatctcctcctcctcccattcctgacctgttgagccaggggtggattggcaggcctataaggcgcctttcacattgagggtcttaggatttgcagtccagctttgcagggagcggcagtttgtcatttgtaggaggaaatttcacgatcataaagcacggcatgcatcctgagagccaggcagcgacgctgcctgcactgccccaccgctcagmgggccacaggagcagggcttcctccttgcctctgagcagtggagccaaggctggaggtgggcgcagctccatgttctcgggggatttcttcactgtgtttcttgggggctcaccgactgcagccgtattcctggagagagaaggaggcctgtcacagcatctgtgacagcccggaaggaaacagcagtccatacagtcccctcaggacaggcacagaggactccaccctggagtcacaggcttggtgaggtgggggacaggcaggggtgggccccgaggtgtgcagagtgtgtgttcagg

SEQ ID NO: 52311 - DNA, 601 bp, Human
gacaggtcaggccggaagcgactgtccgtgaaggtgacgctcataccgtaaccttagcagcaggctgttgccacacagtcacaaaagtgggaggcagcagcagagcaatgtggccacaggcactcggactccagagagctggcgagaggctttcctggctgaaagcagtgacaagtatctgggtctgggggacaagggaaacttggaaatgacagaaaagcccaaaaatcaagtccccacaacctcccccagcgatgagagccgtcgtagccatgggctgtgcatcatccctacacgcccrcgcctgaagatttatgcgcgctttctgacgaacagcctttgcagttgggctttgttgtggctggatgactctgagccctttgctttgcttctctaggcctcagttttcccatttgtaccattagggtattaatttaaataacagaagcactctatcgtattctgaatgggacaccagttaattctggaacattttggaggtttcccattgtttcctgtgaaccccagagagagtttgagaaacagatgataaagggaagacaagatcgtaaagtgtgatactgccatcgaaggtctcgag

SEQ ID NO: 52312 - DNA, 601 bp, Human
gtctcgagcctcatagttggcgctttaagcaaaataggcggttaaaaacaggtctacacatgctgtgtgtggacccaaaccatgaacacatgctgggccccagcccgtctgttgctgttcccttggtcttggcgtcctgtggtcctcacgtgagctgcacgcagcgagcagagccctgacttccagtctggatttctgtaaagtgatgccgggcttatattatttcaaggacttcatggttacttctccctcctggagttgctctatggctttttaaagcagctgactttttatccatctkctcaaagtattcagcttcattttcacagaaatgataattctcatctctcactcaaattttatgtttgcataaattttcatcaaacacataattacagtaagtttaactggaaaaaataagagagactctactgttaaaagcaaaaaggcccaggcttctgaagagacgcgccttctcccctggtgtttgtcatggcaccagccaacacagcaagatggagccaccagtccagccagggagcttctgcagtgtttcaaacaaggcggcaccagcacagaaatccacaggccctgcagtggg

SEQ ID NO: 52313 - DNA, 601 bp, Human
tgactcacctgcccgtttgcgctgcttgcattttttcagcgtgactcgtcaccctctcaaaacatgcagattgacgtggtacttattttgagactaaactggtatcctgagttaattccttacaactctgtattttaataatacgtgcttttatcattttgtttcatcagctcagtgtgtttttgtttaggcggaagtggcccccgtaacatctttcccccgtagagacttgcatacccagtactgctgtgtctcgtgggaggctgctgggtcactaagcttttctggctttcatacgctrggtatttaataatcaccttaggatatactcagtcgttctttcttatttacttcctactgatggagattttcctacattttggcagcctgggaagaaaagcatctatttttttccttaaagtccagcagaattttatatatatataaaatatgtgtataaaataatttttctagaagctcattaaatatagatgtgtaaaactaacaatttatttcatttattaattttcctgacaatgaactacttttcatgctctttatttttcattacttgtcttctgctatttagctataaatcctt

SEQ ID NO: 52314 - DNA, 601 bp, Human
ctagccaggatggtctcaatctcctgacctcgtgattcacctgccttggcctcccaaagtgctgggattacaggcatgagccactgcgcccagcccccagttgcttacttttagttttatggttgactggattcgttttttccctacagcttctccttttgagttatttattcgattcatcttttcttgatcatttgaatttcataaacaagtacgtttttacaagggctgtagttcatgaattctgcctgtcgaaaaatgcctgcctttgacctttatgtgaacaggacggcttgtctgkgtataaaactcttgggtaatgctgtgggcctctcagatctctgggaactagaatctgacactgtcctttccactgcagggtggcccggggtagctggatgggtcatgactacctatttgggtttgttcattggttggtttgctttcattgctcctatgctgctctctgagttttttcacgcttgaaaatctttctcagctgccttttaacataaatagcaatttgcagggaacgatgcaccgagtcgcttgcctaggattcagaagtggaattgaacgttgctgtggaaagggcgaggcc

SEQ ID NO: 52315 - DNA, 601 bp, Human
tttcttgatcatttgaatttcataaacaagtacgtttttacaagggctgtagttcatgaattctgcctgtcgaaaaatgcctgcctttgacctttatgtgaacaggacggcttgtctgggtataaaactcttgggtaatgctgtgggcctctcagatctctgggaactagaatctgacactgtcctttccactgcagggtggcccggggtagctggatgggtcatgactacctatttgggtttgttcattggttggtttgctttcattgctcctatgctgctctctgagttttttcacgcwtgaaaatctttctcagctgccttttaacataaatagcaatttgcagggaacgatgcaccgagtcgcttgcctaggattcagaagtggaattgaacgttgctgtggaaagggcgaggccagccctgtcttccctacctgccctgggaggtggatgctctttctgacccaacacatctgaggaagtcttgctttacccttaacttttattaacttaattgcccatttttcatggactatattgtatacctttcagtcagagattcagttctcatttctgggaagttcttttctgttgtgcct

SEQ ID NO: 52316 - DNA, 601 bp, Human
atccacctgcctcggcccctcaaagtgctgggattacaggcgcaagccaccgtgcccagcctagggttttaatttcatacaattttgatgtcataaaatattattttgtttgtttgtattttttcaaccatttaaaaatgtaaaaaccaggccagccatggtggctcacacctgtagtcccagcactttgggaggccaaggtgggtggatctcttgagctcaggaggtcaagaccaggctgggcaacatagtgagactgtctctacaaaaaaaattaagaaaattaagtgaccataatggygcacacctgtggtcccagctgctggggagagtgaggtgtgggggttggcagaggggagggcatcgaggagttccatgctgcagggagcaatggttgtgccactgtactccagcctgggcaacacagcgagactctgtccaaaaaaaaaaaaaaaacagtaaacaccattctgctgatggctgtacaagaacagggagagcgcctgctggaccctgcctcacagcctccccctctgttgcatttggttatgttaccttatttttgtgctttgttgaattcctgtcttcccagattcatctg

SEQ ID NO: 52317 - DNA, 601 bp, Human
acatcggttatggtctgggaaatttgctacatattgcatgttctgtatgacacactaatacatgtacatgcgtagtattacagatgactgcatatattggtgaaccattagcctgaattggagaggagatctcaggtgagtattgggaacatgcacatcatctttgcagtgcagcccaccttgtatctctgagaagtcagtgtgcatgtggagaaagaatggaagggaatgcaggcaagttaagatcacccttgagaggtggttctcagatggagctgtgccgccttcctagctgaggacstacagcgttgttgcagtgtagactcatgtaatggtgccatcttttaagcaagtcttgacttttgatgcctcatttgctgctgctagacccaggcggagcaagcttctctggcatgtgggtcgtttgtttgcagtgtgcatttggtgaaattgacagctgggtttccctgtcccccgtccccgcctggaacatcactgttctgagcctgtagccagtgcttttctgtgacttctctttctttcctgtgttcattcctgttcttgttgcttgtatgtttacttctgtattttgctggagcac

SEQ ID NO: 52318 - DNA, 601 bp, Human
aagaaagggtacataggaacacaaagttttttaaattcttggatatctgaaaatgccttaattttgccttcccatttgacaggtagtttggaagcacctagaattgcggggtgggtatgactttccctaagaatgtgggtgctggatgccgccatctgcaggagcctttgctgccatggagaagctcatgctggccgggcatgctggctcacgcctataatcccagcactttgggaggccaaggcgggcagatcatgaggtcaggagatcgagaccatcctggctaacacggtgaaacccsgtctctactaaaaatacaaaaaattagccgggtgtggtggcgggtgcctgtagtcccagctactcgggaggctgaagcaggagaatggcatcaacccgggaggcagagcttgcagtgagccgagatcgcaccactgcactccagcctgggcaacagagcgagactctgtctcaaaaaaaaaaaaaaaagctcatgccatgctcgttaccattctctcctgtgtaacttgtacaggtgttgagcgatttgcatcatgctctgccatgccaggaacacagtggacaaacctccttctgccat

SEQ ID NO: 52319 - DNA, 601 bp, Human
ctcacgcctataatcccagcactttgggaggccaaggcgggcagatcatgaggtcaggagatcgagaccatcctggctaacacggtgaaacccggtctctactaaaaatacaaaaaattagccgggtgtggtggcgggtgcctgtagtcccagctactcgggaggctgaagcaggagaatggcatcaacccgggaggcagagcttgcagtgagccgagatcgcaccactgcactccagcctgggcaacagagcgagactctgtctcaaaaaaaaaaaaaaaagctcatgccatgctcgttmccattctctcctgtgtaacttgtacaggtgttgagcgatttgcatcatgctctgccatgccaggaacacagtggacaaacctccttctgccatggagcttatgttctggagggcagagccagacagtgacagtggacatgtgactaagagcgatggagaaagtggccatgacaaggggaccagggttctggggaggccagcagtgctggcatcatggggacagggaggcctcctgtgaccagagaccagaggaagtgcaggtgagcccagcaattaccatgtgcaggatgggggatggga

SEQ ID NO: 52320 - DNA, 601 bp, Human
ggccaaggcgggcagatcatgaggtcaggagatcgagaccatcctggctaacacggtgaaacccggtctctactaaaaatacaaaaaattagccgggtgtggtggcgggtgcctgtagtcccagctactcgggaggctgaagcaggagaatggcatcaacccgggaggcagagcttgcagtgagccgagatcgcaccactgcactccagcctgggcaacagagcgagactctgtctcaaaaaaaaaaaaaaaagctcatgccatgctcgttaccattctctcctgtgtaacttgtacaggygttgagcgatttgcatcatgctctgccatgccaggaacacagtggacaaacctccttctgccatggagcttatgttctggagggcagagccagacagtgacagtggacatgtgactaagagcgatggagaaagtggccatgacaaggggaccagggttctggggaggccagcagtgctggcatcatggggacagggaggcctcctgtgaccagagaccagaggaagtgcaggtgagcccagcaattaccatgtgcaggatgggggatgggacagcaatgggacatgaggtaggagaagca

SEQ ID NO: 52321 - DNA, 601 bp, Human
agcttatgttctggagggcagagccagacagtgacagtggacatgtgactaagagcgatggagaaagtggccatgacaaggggaccagggttctggggaggccagcagtgctggcatcatggggacagggaggcctcctgtgaccagagaccagaggaagtgcaggtgagcccagcaattaccatgtgcaggatgggggatgggacagcaatgggacatgaggtaggagaagcaggcaggtgggtttgcaggagggcttcccagacaagggacttagcttgaccctggttgagagaggtckccatgggagggattcaggcagaaactgtggaggcaagggtggaaaacccggggcaggcagcagccaagaggctgtacacatggagggcaggaggtgctgcagctggagggcaggactcagagctgaatcatcgggcgtcagccttggggtctgccagatgaactggatggatgaggggtgtggccacctcctgcattgggggactacagaggagaggcatggggagaaatcaggggctctgttctggacacattcggcttgaaatatgtacgagacatcccagtgggaatgttgagtagg

SEQ ID NO: 52322 - DNA, 601 bp, Human
ggatgagtctctgagcagtctgccattttgccggcactgctattttttttaacacttcgtttttatttaacaagatggaaggctcaggaaggtcatatagactaacagtctgcgtgttctttaaaggaatggcgctcagctttgaaaacagtttcttcatctctgttgtgttccagtgtgattgcactttacacagttacataaagaatgcaggtatcaggttggagctgcataatatgtactactagttgaaataattataaaccgttttgttttgtttgtttttgtgaattcagatccygtcctttgtggccccagtttaaaacatgtttggacactttttaggggtgagactgactgtccagagcaggacatggggtttccgtccttcctgctgaggtgggaggctggagacctgacagtagccagtcggtagtggggtcagttccgcctggccctccccagagctaagcacacactgggctgcactctctcccctggagtgctggcttcgccctggctgagaggaagcatccatacatagtagcctgatggctccagcagggagtgggtggaagcagcagctccccccttccaggga

SEQ ID NO: 52323 - DNA, 601 bp, Human
ttttgataggaagcctatgttggaccatcaggtcagttcgttggtccagcacatactctgctcaatgcagaggctgcagagacagtgaagacaggacctgccgctgcaggagcctcagagacggtgcctgccctgctgtcagcctcccattgacatccaagggtctcatcccctgctcccggccttttctcagaaatgttgctcagatatatctgtgttgacgataatgtggagcacatcgaacccacttatcttattttgaaaatttggagtattactgtttctgtgtcatggtggttgrtgtgtaacatggagctagagaacaacggtttaggagttcatcatgtataattaatttaaataagtcattagcagctggggaatatgcctacagcacataggaattatgctgcctcgccaatctaagatggaaaggtcaagatagtctaagttgtacttctgaaatttttctctgcatagcatacattactggaaaccatagttaagcttttactgtttttcaatgttattgttttaaggtgaattgattgaaagtgaagataaaagttcttaattcgaaaaatatttttgccatctccta

SEQ ID NO: 52324 - DNA, 601 bp, Human
cactgtctgtgatggaaaggtccagacacagcctcagtgcccctgggaacttttatttactgaataaattcctgcacagcctgtgttgctggggccgggggctgacgccagggttgccaggagcagctgccttactgaggggatggtttccggattaacgtgtgaatggagggagcagcgtgcctggggaatgaaagcaggtgtcagcgcggggagctagccaaaggcatttcctcacatgtgcatttaggagcataggtggccttcgtgggccgtgtgagcaaagggatgactggttgcmgctagagaggagactgttcccaacctgcacattttgaagttaaggaggacattaatttgtctagagagtattcatatctggtgcctttgaatgtcctcatgccattcgctttccatctgtctttggatgcgtgttgtggctttgcctggttcttttaaattgcatattgtgcagacaactttttgtatcagaaaaatctagaaaacagcatggttggaagtgagcagaggcaaggctgcatcttgccgggggaagggctcttgtggctgcattgtggactcatggaccagcctgtggccg

SEQ ID NO: 52325 - DNA, 601 bp, Human
gatttgagttcctgcagccgtggcaccagtataatgcttattatgagtttaagaagcagttcttcctccagaaagaagggggcgatagcatgcaggtacgtgtctgaatgcagggaggctgtgaagctcttagaggtggctccgccttccagatcagaagtcgctttctgtttcttctcctacaggtgaaagggctgggtgattcttcacctttttttaatgtgtgtctggcatactccatctttcacgtcccccttagctctggaacctgatctgttgaaagcatctgcccacgttcacrgcattgatgattgtttgtccagcacgttctaaacaaacaaaaaaaatcctgttccttcaactgttcgatgttttggccgtctacagttactagctacctttcatgacagctgggtaccttgcttctgttgtgttaacatgtatgaaatatataaaatataagtgggcgcctcatgcctggccagctggtgctgggggtgtcctgcagcacggcctctgcctgtgcctgcacgcccttccccctcaccagatccccagcgtggtgctggcgcacttggaagtgctttttgtcctacagccc

SEQ ID NO: 52326 - DNA, 601 bp, Human
agacccttatctccaatggcccacactgaaagaaactgactcctctgtaggtgatggggataatttggtatttttaaagaattctgagtaatcagtgtccaaagaaaagatactgaaaattggttcccaaggcagtattagggcttcaaagagtatagtgttttttcagacaggagaaaatcttccattcctctttgatacattccattgtaagaaaaaacagcagatctggatttggaagtctgttcccagtgctgcttgggcagtaatgtacaattgccgttgtccagtgaaacatattccgtatacatctctctttttttaaaatttctgtataatttcctgctgacagtttatagtgacatttaatctctaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaaggtatgctgccacttgcatgttggccttgcacattccaccgtaagttggcaagc

SEQ ID NO: 52327 - DNA, 601 bp, Human
aggggccagcacatctgacaggctttaggtcagcggaataactttatccagtctggtgactttgtgatgcggttaagccactggagcgacttcagagatttctggtggcattggtggcctggaatggagtgtgacaggtgtggcagtggggtgaggtgtggcagtggggcgaggcgacagctcttgggtcagaaggaaaggcagagtggagacaagagattgaggaagtgggctggggtgataagaggaccgtcctttgcataaagatgccttgttgtatgagaatggtgatcattcagcraaaccaaatccatgtggatgaaccgctaactaggcaattcactatatgtgtctttgggcctctcattcgagtaggttacctgagcacaagtgatccagctctcacccttcccggccacccgcatactctcactgggataatcaaaggaatgtaataagtagaggaggaaaatggttactgctctagaaacccggggagaggtactgtctataggtcagggtaaggcagcatacctggagcttgcagagaagtacccttgagactcagggcagtgactccaggggagtcgactgtcagcca

SEQ ID NO: 52328 - DNA, 601 bp, Human
ataggtatctttttaagtacacaagctacaactagaagttaacactagaaaataaagtatatgagaacatatattattttaaatttgaatgaatttgaaaatcagtgaaaaatatcgctttctaagaaaacataagtgctgaaattatttcatgaagaaatcaggaaccaacatagacctatagacctgaaagaattttgaaaataattggttagtgaaatacctctcaacccaggcagtcagccaagacaaattaaaggtcaagttaattcaccctcaagaaatagaatgcctacatcaytaaagccactccagagcattaagaaggatggaaaagtatgaagctctcaaagcttggcaatctgtagaccacgatcacttacaagtatagatgttaaaatattaaactgaattcagctatgtatgaaaatagtaggccgggcgcggtggctcacgcttgtaatcccagcactttgggaggccgaggcgggtggatcacgaggtcaggagatcgagaccatcctggctaacacggtgaaaccccgtctctactaaaaataaaaaaaaaattagccgggcgtggtggcgggcgcctgtagtc

SEQ ID NO: 52329 - DNA, 601 bp, Human
acttctgcctgggaatccactgattatgttcagatgattttttttccatattggaattgcaattgatctatttgctcatatgttttcaaaatctcccacagaaaatgtatattacttttgaagttagaagttagcaataagagttgttagctaaaaaacagaaacctatttgctatggaagatggcgggttcactcaggggtgcccgatgccatgttagccatgcatctgtccccgcatggtcccgtcctccaccgcctaggagatagtggaccatcagtgcctgaatgcaaatcatagtsagtggtgtgcaggaaagaggttgggcagggcctgtctgaggaggcatcgtgggggccgatccttgaagaatgtgaaagggacaggagaagagcaggcagctctcaggcagaggtgaggggcagtgcaaacgtggagcagtggccccgatcactcagggacgtggcagccttgggaaggaactgggtttattctgaatgcagcgtgagacctactcactgaagctgtaggacatgctttccatgtgctgtgacgtgatctgcaaggaagattctaggcagaagcaacaattttgtgattga

SEQ ID NO: 52330 - DNA, 601 bp, Human
gttgggcagggcctgtctgaggaggcatcgtgggggccgatccttgaagaatgtgaaagggacaggagaagagcaggcagctctcaggcagaggtgaggggcagtgcaaacgtggagcagtggccccgatcactcagggacgtggcagccttgggaaggaactgggtttattctgaatgcagcgtgagacctactcactgaagctgtaggacatgctttccatgtgctgtgacgtgatctgcaaggaagattctaggcagaagcaacaattttgtgattgaaaaattccacataaagaagyaattcctgattccctgtactgacctgaggtacctggagaaacttagttaatcttttcagcctcggttttcccatctgtaaaatgggaagcctctcagtgtccatcctgtggagctgtaaaggctgagtaagggaggcctgtgggctgtgtgccataggccactcttagagtgagtagctgtggttttggctttgtgtttggtttgcatagatactagctttaaaatgtctacttgacaggccggacaaggtggatcacctgaggtcaggagttcgagaccagcctggccaacatggtgaa

SEQ ID NO: 52331 - DNA, 601 bp, Human
gaagctgtaggacatgctttccatgtgctgtgacgtgatctgcaaggaagattctaggcagaagcaacaattttgtgattgaaaaattccacataaagaagtaattcctgattccctgtactgacctgaggtacctggagaaacttagttaatcttttcagcctcggttttcccatctgtaaaatgggaagcctctcagtgtccatcctgtggagctgtaaaggctgagtaagggaggcctgtgggctgtgtgccataggccactcttagagtgagtagctgtggttttggctttgtgttwggtttgcatagatactagctttaaaatgtctacttgacaggccggacaaggtggatcacctgaggtcaggagttcgagaccagcctggccaacatggtgaaacccatctctactaaaaatacaaaaaattagctgggcatggtggcgagcacctgtaatcccagctactcaagaggctgaggcaggagaatcgcttgaacctgggaggcagaagttgcagtgagctgagatcgcgcctttgcacttcagcctgggcgacagagcgagactccgtctccaaaaaaaaaacaaaaaaaaagt

SEQ ID NO: 52332 - DNA, 601 bp, Human
aaaatacaaaaaattagctgggcatggtggcgagcacctgtaatcccagctactcaagaggctgaggcaggagaatcgcttgaacctgggaggcagaagttgcagtgagctgagatcgcgcctttgcacttcagcctgggcgacagagcgagactccgtctccaaaaaaaaaacaaaaaaaaagtctacttgaggctgggcacggtggctcatgcttgtcatcccagcacttcaggaggctcaggcaggaggattgcttgaggccaggaagtcaaggctgcaataagctatgattgcaccrctgcactgcagcctgggcaacacagtgaaaccctttctcaaaaaaaataaaataaaatgtaaaatgaaataagcattgctagaaggtgttctggaagctttcatcttaatactcttatttgttgattgcgtatttttctaatttggggagatggtttggaaataattgttattaaatcattttgtgatatattttagtccagccccttgtttgttttgttttgttttttgttttttttgagatagaatctcactctgtcacccaggctggagtagtgcagtggcgtgatctcagcccact

SEQ ID NO: 52333 - DNA, 601 bp, Human
ctcaaacatgtacgaaaacagaatatcacataatgaccactcacgccccacacacgtgctcatcatctggcttcagctgccggccctgctgctttttattttgatgttataaaatactgctgtcccggtatcagtatctttgtgtgtgccctgtcccctgaggcagttgttgatgaaaagtggttatatttcagagggtctgggctatcacatgcttaactgtctacttcacatcacacgcgggtttggagccataaaatgctaaagcggaaggacctccgccaggggccagccaggtagyccaccctgtgctacagaggtggcatcacaaacataagttgcagcccttccagaagcggccttgtttacccagaacccacttccctctcagtcacctggtttgcggtgcacttagcatccccttcattgtgggtgccttgaatattcttcataaataacaactgatggttttttaaaatactgtatcttattgcaaccagttagctcttgtcaagagccatttatcacagcatctgaaagagaaagggactctgtgttcattgagtggtggggcgggaaagatgattttttctttagggcc

SEQ ID NO: 52334 - DNA, 601 bp, Human
tatttcagagggtctgggctatcacatgcttaactgtctacttcacatcacacgcgggtttggagccataaaatgctaaagcggaaggacctccgccaggggccagccaggtagcccaccctgtgctacagaggtggcatcacaaacataagttgcagcccttccagaagcggccttgtttacccagaacccacttccctctcagtcacctggtttgcggtgcacttagcatccccttcattgtgggtgccttgaatattcttcataaataacaactgatggttttttaaaatactgtatsttattgcaaccagttagctcttgtcaagagccatttatcacagcatctgaaagagaaagggactctgtgttcattgagtggtggggcgggaaagatgattttttctttagggcctccatatttcccttaaatttaagccttctggatattctaagaggagggattgcttctaaacttttgtcacgctgggtttgacattttcttacaggtgtggaaaatggtctaacataatgcctgtcacaaagtaggtaaaaatgtttgctgaataaaggcatggattctgtaatttttgctttgtaa

SEQ ID NO: 52335 - DNA, 601 bp, Human; identical to SEQ ID NO: 22564

SEQ ID NO: 52336 - DNA, 601 bp, Human; identical to SEQ ID NO: 22565

SEQ ID NO: 52337 - DNA, 601 bp, Human; identical to SEQ ID NO: 22566

SEQ ID NO: 52338 - DNA, 601 bp, Human; identical to SEQ ID NO: 22567

SEQ ID NO: 52339 - DNA, 601 bp, Human; identical to SEQ ID NO: 22568

SEQ ID NO: 52340 - DNA, 601 bp, Human; identical to SEQ ID NO: 22569

SEQ ID NO: 52341 - DNA, 601 bp, Human; identical to SEQ ID NO: 22570

SEQ ID NO: 52342 - DNA, 601 bp, Human; identical to SEQ ID NO: 22571

SEQ ID NO: 52343 - DNA, 601 bp, Human
ttactctgcagttccttattctgatcttccaccccagtgaggggaagaggatgtgatcatgcgaccgccagcagaagggaaattgtgaaagcgacctgctgtagaaaaggcggcccacagccacctcagcatgcagaggaggcccagctgctgagaggagttgcctgagagtgacctttgcatctgcctgtccagccagcatggaaccaaagcggatcagagagggctaccttgtgaagaaggtgagcgaaggtgccacttaccagggtgtcagtggacatgggctggggagacttgggtycagctccaccggctacctgctcatcttaggaatgtttcctgttcaaccagttgggttgaaataggggagcgtggtagcacatagaatgttggagtggggttaggggagtggggatactcatccagccccggcttccttacagtttgatattacgggtctgagaattccagatggcagggcctggaaggtggggatctaagctaactccctccagatttagaatatcctttttaagaggcacacagatgtgttctgtcagaagatatactcctcttctatggaggtttcttggagggacta

SEQ ID NO: 52344 - DNA, 601 bp, Human
acagccacctcagcatgcagaggaggcccagctgctgagaggagttgcctgagagtgacctttgcatctgcctgtccagccagcatggaaccaaagcggatcagagagggctaccttgtgaagaaggtgagcgaaggtgccacttaccagggtgtcagtggacatgggctggggagacttgggtccagctccaccggctacctgctcatcttaggaatgtttcctgttcaaccagttgggttgaaataggggagcgtggtagcacatagaatgttggagtggggttaggggagtggggatrctcatccagccccggcttccttacagtttgatattacgggtctgagaattccagatggcagggcctggaaggtggggatctaagctaactccctccagatttagaatatcctttttaagaggcacacagatgtgttctgtcagaagatatactcctcttctatggaggtttcttggagggactattcattttttatttaaattccacttcccctcagttctttttttgggaggcaaggggaaaaaagtgattaaagagttgatataatgatagagtaattacggcttatttcttgggcca

SEQ ID NO: 52345 - DNA, 601 bp, Human
aagttaggatttgtagtgtatttgtgatggtgagagctatgagttggtactggagaataagtgggccctcagctgctaatctctgtagccagctgtgcttcgaaacatcctttggaaaagacacacttatacatagaagtgtaaaagattacttgcaataggcaccaataataattggcgagacctggtaataattaatattgacttattcctttcctgatcacttgtgctagtatcctgagaagagcaagtgaataggaacatttctgcaagtttttgtttgtttttttaaacaattaaraacatcttgcaatgaaaattgctgttataaagtttgtatgctcatattttaatctccctaaattacaaaaatatgaagactaaatttctaataagtgaagctgtctcactaaaaattggggatgatagagtcagggttgtcaagcatgtggatttaaattaataaatagtttttaattagtgagagtagttctctcagattgtaaaagccaatctagaaaatgtgcctggaattaaatagtgaaattttgtattgatagttttacaatttatatcttccataattttcatgtttacaagt

SEQ ID NO: 52346 - DNA, 601 bp, Human
tctctgtttagggggtttctttctggccaataaacatgtttggaaggtactcgaatacctactactgaattagatatgttcatcatcataactggaaaaaatgagagaagagcaaattatatgctctgcataacctagactcctccaagtcatgtctcaaaccagcctaattcctagaggtttatggagcaagctgttgtttccaggacaaccaacctcacaagcacttggcgcagcagcgctgactcagaaagtggctgagggatttggatgtcctttgaggctgggagaaagcataggwatcagggtgatgggaaagggaagggcaagcagcagggacaggaaaggaaagggctgcagaaagctgtggtagaagtggaagagagcccgagagtcagggtcctggcccaggagttctttcctggatctaccttgtcttctaggcagcatgaaataatctgaagcgatttgtgcctactgattcatcatcactgtaacagctaacgcatgtggtgtttaccctgaagcaggaacagttccaagcatttcatgccttaatgcatttatacagcatacttaagacaactcaacaaaatgggga

SEQ ID NO: 52347 - DNA, 601 bp, Human
ctaccttgtcttctaggcagcatgaaataatctgaagcgatttgtgcctactgattcatcatcactgtaacagctaacgcatgtggtgtttaccctgaagcaggaacagttccaagcatttcatgccttaatgcatttatacagcatacttaagacaactcaacaaaatggggacaattattatccttacttaacagataaggagattgaagtacagagaggcaaatggccttgtccaaagtcacacagttaataagtggcagagctggtttgcaacccagcagtgtggccccagtatcaygcagagcctaaccactttctatgtggccctcgtgggctcgtactgcagtgacattcttttccaaagcactgtcaccatgatgaggggtacccaggggaacattatgccagagcgactccacagtgttgcctacaaaaccgtactcttttttttttttttttttgagatggagttttgctcttgttgcccaggctggagtgcaatggtacgatctcggctcactgcaacctccgcccccaaaaccgtacttttacctgtttctatggtcgccatttttcaaatgtatactacatgctggcc

SEQ ID NO: 52348 - DNA, 601 bp, Human
atgaacgtgtcccaaataaagaaacttgcctaaaatagacttcatagagaccaaagtaacttcttaagtcttaagaaaaagtaatttcaacgggggtagtcatttttagatgatcatgtagaatatatttcaaagatttattattattttttggctttcaagcaagcccaagggttagcagggacacctggaaatagaagactaaagggggaaaagagggacagcaggcaccttggaatagatgtgtaggatctcagggtagaaagagatgttacagatttaatacagcttctcatctgcrgcttgcatttcttttattcatctgttaacaagcatgcttgaatacttctcttgttagggaactcactaattacattttctcccttaagttatgcagaaaactgttttcctgaaacctccaccggctgggacctcaaaacaatccaggcattcacacctgctctacctgttcctttatgggctaaaacctagttagttcctccaacagttagagagatgataccatcttggtgttctgctttgaacaggctctggtttacctgcagctttgaggtcacttgaacttagtatagttctccag

SEQ ID NO: 52349 - DNA, 601 bp, Human
tcatagagaccaaagtaacttcttaagtcttaagaaaaagtaatttcaacgggggtagtcatttttagatgatcatgtagaatatatttcaaagatttattattattttttggctttcaagcaagcccaagggttagcagggacacctggaaatagaagactaaagggggaaaagagggacagcaggcaccttggaatagatgtgtaggatctcagggtagaaagagatgttacagatttaatacagcttctcatctgcagcttgcatttcttttattcatctgttaacaagcatgcttgratacttctcttgttagggaactcactaattacattttctcccttaagttatgcagaaaactgttttcctgaaacctccaccggctgggacctcaaaacaatccaggcattcacacctgctctacctgttcctttatgggctaaaacctagttagttcctccaacagttagagagatgataccatcttggtgttctgctttgaacaggctctggtttacctgcagctttgaggtcacttgaacttagtatagttctccaggagcacctgataagcatagaactgtaaggaataggtactat

SEQ ID NO: 52350 - DNA, 601 bp, Human
ttcgtttaaagacagaattatcattttccttgctttcgatcttacacttctctgtatacaaccacaacgagtttagtttttttttgacagcccacatcaaattgctgactcatagagctccttttttcccacatgctcatttcccacaccttataagtctttacaaaatattattaaagagaaaggctgtatcttatttaatttcaatttgcatttctttgattgcagttgaagcaatcaattatgttttattggacccagcttttattcgtttgagaattgcttatttatattatttgcycatttaaaaaattgggagtgttgatatatttcttattggttctaaagtgtttaaagaattaaggatattaatttttaatcatatgatgatacaaatatctatgcattttcatttgcttttcagttgttgcagttttttaaatatagagaagttcatttttttttttcttgagatgaagtcttgctctgttgcccaggctggagtgcagtggtgtgatctaggctcactgcaatctccacctcttgggttcaagtgattctcctgcctcagcctcccaagtagctgggaccgtaggtgtgc

SEQ ID NO: 52351 - DNA, 601 bp, Human
agtcttgctctgttgcccaggctggagtgcagtggtgtgatctaggctcactgcaatctccacctcttgggttcaagtgattctcctgcctcagcctcccaagtagctgggaccgtaggtgtgcatcaccacacccagctaatttttgtatatttttagtagagactggctttcatcatgttggccaggctggtctcaaactcctggcctcaagtgatccacccacctcagcctcttaaagtgctgggattacaggcatgagccactgcgcccagccgagaagtttatttttaatatggtyaaatctgccgttctttatgatttcttcttttgatgtcatgcaatgtcagactcttaggtgctaaattataccagtcccatgatgatgaacaggtatttaccagaaaacttcaaatctgactcagcatcccattgtggacatgtacaggttttggcatataatgggtgaaaacacatatatgctacacacacacatgcacacacacacacagacacacatacacacagcatatggatatatatgtgtgtgtgtgtatatatatctccattgaagtgaaatagctagctaagtggtctaaag

SEQ ID NO: 52352 - DNA, 601 bp, Human
catgttggccaggctggtctcaaactcctggcctcaagtgatccacccacctcagcctcttaaagtgctgggattacaggcatgagccactgcgcccagccgagaagtttatttttaatatggtcaaatctgccgttctttatgatttcttcttttgatgtcatgcaatgtcagactcttaggtgctaaattataccagtcccatgatgatgaacaggtatttaccagaaaacttcaaatctgactcagcatcccattgtggacatgtacaggttttggcatataatgggtgaaaacacayatatgctacacacacacatgcacacacacacacagacacacatacacacagcatatggatatatatgtgtgtgtgtgtatatatatctccattgaagtgaaatagctagctaagtggtctaaagaaatcgatacagattccagaatgactcagtgttatacaagaaccaaaatgaaaatgacatctgaggggaagggaaaaaacataaaattgagaatcaggagacatggattctacattaactggtcagatgtactaggccaatcacttaacattaattgttcagatgtggtaggccaa

SEQ ID NO: 52353 - DNA, 601 bp, Human
ggccaggctggtctcaaactcctggcctcaagtgatccacccacctcagcctcttaaagtgctgggattacaggcatgagccactgcgcccagccgagaagtttatttttaatatggtcaaatctgccgttctttatgatttcttcttttgatgtcatgcaatgtcagactcttaggtgctaaattataccagtcccatgatgatgaacaggtatttaccagaaaacttcaaatctgactcagcatcccattgtggacatgtacaggttttggcatataatgggtgaaaacacatatatgytacacacacacatgcacacacacacacagacacacatacacacagcatatggatatatatgtgtgtgtgtgtatatatatctccattgaagtgaaatagctagctaagtggtctaaagaaatcgatacagattccagaatgactcagtgttatacaagaaccaaaatgaaaatgacatctgaggggaagggaaaaaacataaaattgagaatcaggagacatggattctacattaactggtcagatgtactaggccaatcacttaacattaattgttcagatgtggtaggccaatcactt

SEQ ID NO: 52354 - DNA, 601 bp, Human
acaggcatgagccactgcgcccagccgagaagtttatttttaatatggtcaaatctgccgttctttatgatttcttcttttgatgtcatgcaatgtcagactcttaggtgctaaattataccagtcccatgatgatgaacaggtatttaccagaaaacttcaaatctgactcagcatcccattgtggacatgtacaggttttggcatataatgggtgaaaacacatatatgctacacacacacatgcacacacacacacagacacacatacacacagcatatggatatatatgtgtgtgtrtgtatatatatctccattgaagtgaaatagctagctaagtggtctaaagaaatcgatacagattccagaatgactcagtgttatacaagaaccaaaatgaaaatgacatctgaggggaagggaaaaaacataaaattgagaatcaggagacatggattctacattaactggtcagatgtactaggccaatcacttaacattaattgttcagatgtggtaggccaatcacttaactgggcctccacttttttttatcaatatggtgacagtgttggtagatgatcctaaatttctctgtca

SEQ ID NO: 52355 - DNA, 601 bp, Human
aggcatgagccactgcgcccagccgagaagtttatttttaatatggtcaaatctgccgttctttatgatttcttcttttgatgtcatgcaatgtcagactcttaggtgctaaattataccagtcccatgatgatgaacaggtatttaccagaaaacttcaaatctgactcagcatcccattgtggacatgtacaggttttggcatataatgggtgaaaacacatatatgctacacacacacatgcacacacacacacagacacacatacacacagcatatggatatatatgtgtgtgtgtrtatatatatctccattgaagtgaaatagctagctaagtggtctaaagaaatcgatacagattccagaatgactcagtgttatacaagaaccaaaatgaaaatgacatctgaggggaagggaaaaaacataaaattgagaatcaggagacatggattctacattaactggtcagatgtactaggccaatcacttaacattaattgttcagatgtggtaggccaatcacttaactgggcctccacttttttttatcaatatggtgacagtgttggtagatgatcctaaatttctctgtcatt

SEQ ID NO: 52356 - DNA, 601 bp, Human
agagtcagaccccggaggctgcacttgatttagaaaagcacaacgtgaaggttagttacatatgtatacatgtgccatgttgttgtgctgcacccattaactcgtcatttaacattaggtatatctcctaatgctatcccaacatggcacgtgtatacataggtaactaaccttcacgttgtgcacatgtaccctaaaacttaaagtataataaagaaaataaaaaaaaaaaaagaaaagcacaaactcatattggacagttggctccagaggctttgtctactgaaggcatgcaatgccrgcttatcgctactgatgcatcccaatttcaaagtcaaaagccctgagtgatgatggcagttaataatctcagctattcctgaggttgaatattaaatgttaggtttaaaagggattctggcaatcatctagtgcaacttttcatttctagctctgagaacatgtctttcttttcttatttccaggtatttttaaaattttttattaaatagatttgtctatgtatttcactaaaagtatattctaaattttaatacatagcagagtcatatgttactcattcatttaataattttcccaa

SEQ ID NO: 52357 - DNA, 601 bp, Human
gttaataatctcagctattcctgaggttgaatattaaatgttaggtttaaaagggattctggcaatcatctagtgcaacttttcatttctagctctgagaacatgtctttcttttcttatttccaggtatttttaaaattttttattaaatagatttgtctatgtatttcactaaaagtatattctaaattttaatacatagcagagtcatatgttactcattcatttaataattttcccaagttattttaaaagttaagcccacagaaaaatgaggaaactagtaccattattcatatascctttacctagattaatcaattgataatggatgggcacatttgctttgtctctccctatctctgaatttctgtataaataaacacacatatcatattaggttgagatagttgagagtaatttgcagacatcacgctacctcactccaaaatacttcaacatacatcttccaagaaaaaggacattttcctatataatcacaatgccattatcacatctaagaaatttattactaataaaatgaccttatctaatacaccttttacattcaaatgatgccagatcactcaataatattctg

SEQ ID NO: 52358 - DNA, 601 bp, Human
gcaacttttcatttctagctctgagaacatgtctttcttttcttatttccaggtatttttaaaattttttattaaatagatttgtctatgtatttcactaaaagtatattctaaattttaatacatagcagagtcatatgttactcattcatttaataattttcccaagttattttaaaagttaagcccacagaaaaatgaggaaactagtaccattattcatatagcctttacctagattaatcaattgataatggatgggcacatttgctttgtctctccctatctctgaatttctgtrtaaataaacacacatatcatattaggttgagatagttgagagtaatttgcagacatcacgctacctcactccaaaatacttcaacatacatcttccaagaaaaaggacattttcctatataatcacaatgccattatcacatctaagaaatttattactaataaaatgaccttatctaatacaccttttacattcaaatgatgccagatcactcaataatattctgcatagcggctttgaaaagaatccatgattcaatcgaggacaattcattgcatgaatatgctgtttttccagtga

SEQ ID NO: 52359 - DNA, 601 bp, Human
tgagaacatgtctttcttttcttatttccaggtatttttaaaattttttattaaatagatttgtctatgtatttcactaaaagtatattctaaattttaatacatagcagagtcatatgttactcattcatttaataattttcccaagttattttaaaagttaagcccacagaaaaatgaggaaactagtaccattattcatatagcctttacctagattaatcaattgataatggatgggcacatttgctttgtctctccctatctctgaatttctgtataaataaacacacatatcatwttaggttgagatagttgagagtaatttgcagacatcacgctacctcactccaaaatacttcaacatacatcttccaagaaaaaggacattttcctatataatcacaatgccattatcacatctaagaaatttattactaataaaatgaccttatctaatacaccttttacattcaaatgatgccagatcactcaataatattctgcatagcggctttgaaaagaatccatgattcaatcgaggacaattcattgcatgaatatgctgtttttccagtgattaagtgagagaagtaactaa

SEQ ID NO: 52360 - DNA, 601 bp, Human
gctgtttttccagtgattaagtgagagaagtaactaatgtggaatagtttccttctatagaagcaacttgaagggtggtgttactataatcactgtatacccctccatggagttaactaacaggacctggagttaacaactttgttttttaattgaaggataacttacaataaggtacatgaagggtgtcataattttttacatacctatacctcatgtaatcaacacacagataaagacagagacatttctagtatgctataaagttccattgttcccttcctagtctatactcccatcstcggtaaccattattgtaatattttctcataagctatgcctgttgttgaacgtcatatgaatgtaatcatactctaagcacatgttttgcctgtttgcttttcactcaacatctatgagatttatttataatgttccaggtactagcggttcattttttaaaaattgctaggttgttttccatagtatacatttactgtgttaataatggatttatatattatattatacagtttacttattccttctcctgttgatgggcatttgggttagtctttgtttctggctatgatgaataaag

SEQ ID NO: 52361 - DNA, 601 bp, Human
tagtttccttctatagaagcaacttgaagggtggtgttactataatcactgtatacccctccatggagttaactaacaggacctggagttaacaactttgttttttaattgaaggataacttacaataaggtacatgaagggtgtcataattttttacatacctatacctcatgtaatcaacacacagataaagacagagacatttctagtatgctataaagttccattgttcccttcctagtctatactcccatcgtcggtaaccattattgtaatattttctcataagctatgcctgtkgttgaacgtcatatgaatgtaatcatactctaagcacatgttttgcctgtttgcttttcactcaacatctatgagatttatttataatgttccaggtactagcggttcattttttaaaaattgctaggttgttttccatagtatacatttactgtgttaataatggatttatatattatattatacagtttacttattccttctcctgttgatgggcatttgggttagtctttgtttctggctatgatgaataaaggtgtcatgaacattcttgatgaaacctttatgacaatatgcatt

SEQ ID NO: 52362 - DNA, 601 bp, Human
ttaattgaaggataacttacaataaggtacatgaagggtgtcataattttttacatacctatacctcatgtaatcaacacacagataaagacagagacatttctagtatgctataaagttccattgttcccttcctagtctatactcccatcgtcggtaaccattattgtaatattttctcataagctatgcctgttgttgaacgtcatatgaatgtaatcatactctaagcacatgttttgcctgtttgcttttcactcaacatctatgagatttatttataatgttccaggtactagcrgttcattttttaaaaattgctaggttgttttccatagtatacatttactgtgttaataatggatttatatattatattatacagtttacttattccttctcctgttgatgggcatttgggttagtctttgtttctggctatgatgaataaaggtgtcatgaacattcttgatgaaacctttatgacaatatgcattcatttctctcagatctttgcccaggagtgaaattgctggtgcaaaggacatatatgtgtttagctttagcataaaaccaccagatattttttctgcactggatg

SEQ ID NO: 52363 - DNA, 601 bp, Human
aaggtacatgaagggtgtcataattttttacatacctatacctcatgtaatcaacacacagataaagacagagacatttctagtatgctataaagttccattgttcccttcctagtctatactcccatcgtcggtaaccattattgtaatattttctcataagctatgcctgttgttgaacgtcatatgaatgtaatcatactctaagcacatgttttgcctgtttgcttttcactcaacatctatgagatttatttataatgttccaggtactagcggttcattttttaaaaattgctargttgttttccatagtatacatttactgtgttaataatggatttatatattatattatacagtttacttattccttctcctgttgatgggcatttgggttagtctttgtttctggctatgatgaataaaggtgtcatgaacattcttgatgaaacctttatgacaatatgcattcatttctctcagatctttgcccaggagtgaaattgctggtgcaaaggacatatatgtgtttagctttagcataaaaccaccagatattttttctgcactggatgtgatattctgcactcctgccagc

SEQ ID NO: 52364 - DNA, 601 bp, Human
agtttacttattccttctcctgttgatgggcatttgggttagtctttgtttctggctatgatgaataaaggtgtcatgaacattcttgatgaaacctttatgacaatatgcattcatttctctcagatctttgcccaggagtgaaattgctggtgcaaaggacatatatgtgtttagctttagcataaaaccaccagatattttttctgcactggatgtgatattctgcactcctgccagctatgtttggtacttccagttattctacctccttgtcaagtcttattcttctctgactttkaaaatgctaggtactctagcaggtgtgtagaggtatctcattgtgatttgaatctgcattttcctgataaataatgatgttgaacactttttcataagcatttggatgttttctttactaaagtgcctgctcgatactttttgctcatttaaaaataggattatttgtacttttcttattgatttgcaggagttctttgtattctagatatgtttcagttgtaaaacagaaaggcattttactggaattatttcatgtgttggcacagtgtctgatcttgctcatttttaaaaggggaaa

SEQ ID NO: 52365 - DNA, 601 bp, Human
gtttcagttgtaaaacagaaaggcattttactggaattatttcatgtgttggcacagtgtctgatcttgctcatttttaaaaggggaaataatccagtgttcgtctggaatagttattctgcccatgcagaaaagagatagggtattttaatttagaaaattattttagtaactagaacaaaggaaatgtttggacaagcaaagtgatagtcccacaagtatttatctttgcataaatagtcttccttttggtcaactggacctttatatagaggccctttgtattttgagataagcagcrgggtctcttgggaactggatgataattctattttgtggtagtcatgacagggtgatatcatgggttaaagaatagacctttgccaaattcttccaaaatatagaccagaaatagagacttccctgttttaatcagaatggtcaacttattgctaaaggggcagctggcatgaacccaaactgaaaacattttaagtaaggatttttttaagggctacattaatgtggatagcctcattctggcattatagaccttttgcaagtgattttcatacaacttagccatgcctgcacacaaggc

SEQ ID NO: 52366 - DNA, 601 bp, Human
ttctgcccatgcagaaaagagatagggtattttaatttagaaaattattttagtaactagaacaaaggaaatgtttggacaagcaaagtgatagtcccacaagtatttatctttgcataaatagtcttccttttggtcaactggacctttatatagaggccctttgtattttgagataagcagcagggtctcttgggaactggatgataattctattttgtggtagtcatgacagggtgatatcatgggttaaagaatagacctttgccaaattcttccaaaatatagaccagaaatagasacttccctgttttaatcagaatggtcaacttattgctaaaggggcagctggcatgaacccaaactgaaaacattttaagtaaggatttttttaagggctacattaatgtggatagcctcattctggcattatagaccttttgcaagtgattttcatacaacttagccatgcctgcacacaaggctgctgtctgagtttctttttgacattcatattcagataaaatctgattagcccaagagatggaagcaactgcagggtgcatgccaccacttatgactgctttgtctatgggagaca

SEQ ID NO: 52367 - DNA, 601 bp, Human
tcagaatggtcaacttattgctaaaggggcagctggcatgaacccaaactgaaaacattttaagtaaggatttttttaagggctacattaatgtggatagcctcattctggcattatagaccttttgcaagtgattttcatacaacttagccatgcctgcacacaaggctgctgtctgagtttctttttgacattcatattcagataaaatctgattagcccaagagatggaagcaactgcagggtgcatgccaccacttatgactgctttgtctatgggagacacggctgttggatcacracacttttccactgagtccagcctcaagcatccactactactcagtctgaattgacacttgagatagattctacttgccattcttgagttgaactgaactcaatgggcaggtttgggagcagaaaacaaaccacataaagtcagcctgaaatgtaccaggggagcttatgggttgactgtcactgtatatacattttatcttaattaaaaaaaattccagtagaatgacagtcctcctttcccctgaaggcatccttcctgcgcagccttgtgcaaatgtggaccacctgcctccacact

SEQ ID NO: 52368 - DNA, 601 bp, Human
gagtccagcctcaagcatccactactactcagtctgaattgacacttgagatagattctacttgccattcttgagttgaactgaactcaatgggcaggtttgggagcagaaaacaaaccacataaagtcagcctgaaatgtaccaggggagcttatgggttgactgtcactgtatatacattttatcttaattaaaaaaaattccagtagaatgacagtcctcctttcccctgaaggcatccttcctgcgcagccttgtgcaaatgtggaccacctgcctccacactggccaaagctgagytacatattgtcctgcagaggtctataggatcattttaggaaatattgtcacacttattgtgtctattcttatgttaatcatttcattatgtcttatttattcagtcttatctattaataatgtgatcttatttttaatttttaatttttaaaatttaaatttttgtgggtgcatagtaggtatatgtatttatagggtacatgagatgttttgatacaggcatgcaatgagtaataataacaccatggagaatggggtatccatccccactaagcatttatcctttgtgttacaaacaat

SEQ ID NO: 52369 - DNA, 601 bp, Human
agaaaacaaaccacataaagtcagcctgaaatgtaccaggggagcttatgggttgactgtcactgtatatacattttatcttaattaaaaaaaattccagtagaatgacagtcctcctttcccctgaaggcatccttcctgcgcagccttgtgcaaatgtggaccacctgcctccacactggccaaagctgagttacatattgtcctgcagaggtctataggatcattttaggaaatattgtcacacttattgtgtctattcttatgttaatcatttcattatgtcttatttattcagtcytatctattaataatgtgatcttatttttaatttttaatttttaaaatttaaatttttgtgggtgcatagtaggtatatgtatttatagggtacatgagatgttttgatacaggcatgcaatgagtaataataacaccatggagaatggggtatccatccccactaagcatttatcctttgtgttacaaacaatccaattacgctcttttagttattttaaaatatacaattaagttggcaatagtcacactgttgtgctatgaaatcataggtctcatttattctttctgttttcttgtt

SEQ ID NO: 52370 - DNA, 601 bp, Human
caaaccacataaagtcagcctgaaatgtaccaggggagcttatgggttgactgtcactgtatatacattttatcttaattaaaaaaaattccagtagaatgacagtcctcctttcccctgaaggcatccttcctgcgcagccttgtgcaaatgtggaccacctgcctccacactggccaaagctgagttacatattgtcctgcagaggtctataggatcattttaggaaatattgtcacacttattgtgtctattcttatgttaatcatttcattatgtcttatttattcagtcttatctattaataatgtgatcttatttttaatttttaatttttaaaatttaaatttttgtgggtgcatagtaggtatatgtatttatagggtacatgagatgttttgatacaggcatgcaatgagtaataataacaccatggagaatggggtatccatccccactaagcatttatcctttgtgttacaaacaatccaattacgctcttttagttattttaaaatatacaattaagttggcaatagtcacactgttgtgctatgaaatcataggtctcatttattctttctgttttcttgtttttggt

SEQ ID NO: 52371 - DNA, 601 bp, Human
taatcatttcattatgtcttatttattcagtcttatctattaataatgtgatcttatttttaatttttaatttttaaaatttaaatttttgtgggtgcatagtaggtatatgtatttatagggtacatgagatgttttgatacaggcatgcaatgagtaataataacaccatggagaatggggtatccatccccactaagcatttatcctttgtgttacaaacaatccaattacgctcttttagttattttaaaatatacaattaagttggcaatagtcacactgttgtgctatgaaatcrtaggtctcatttattctttctgttttcttgtttttggtacccattaaccatccccacctccctgcagtcccccacttcccttcctggcctctggtaaccatccttctactctctgtgtccatgagttcagttgttttgatttttagatctcacagatatgtgagaacatgtgatgtctgtctttctgtgcctggctcatttcactcaacataatgatcttcgggtccatccatgttgttgcaaatgacaggaccttcttttttatggcaaagtagccctccattgtgtatatgtactaca

SEQ ID NO: 52372 - DNA, 601 bp, Human
ttatctcattgtagttttgatttgcatttctctgatgatcagtgatgttgagcaccttttcatatgcacacttgccatttgtatgtctgcctttgagacatgtctattcaaatattttgaccattttttgaatggtttattagatttttttcctctagagttgtctgagctcctgatatattctggctatcaatcctttgtcagatgggtagtttgcaaatattttctgtcattctgtgggttgtctcttcacttcgttgcctgtttcctttgctgtgcaaaagctttttaccttgatgtratcacatttgcttatttttgctttggttgtctgtgcttatagggtattgctcaagaaatttttggccagaccaatgtcttgtagattttccccaatattttcttacagtcataatgtgattttaattaccaccgttcattccacaaattattgattgaacacctgacaatatgatggtgaagtaagttcttgcccccctggaacatatagttgggtggcaatagttgacagagtgattttacacactttatatataaaacatgtgtatacatatgtatttaaagatatatacactgtata

SEQ ID NO: 52373 - DNA, 601 bp, Human
ttcaaatattttgaccattttttgaatggtttattagatttttttcctctagagttgtctgagctcctgatatattctggctatcaatcctttgtcagatgggtagtttgcaaatattttctgtcattctgtgggttgtctcttcacttcgttgcctgtttcctttgctgtgcaaaagctttttaccttgatgtgatcacatttgcttatttttgctttggttgtctgtgcttatagggtattgctcaagaaatttttggccagaccaatgtcttgtagattttccccaatattttcttayagtcataatgtgattttaattaccaccgttcattccacaaattattgattgaacacctgacaatatgatggtgaagtaagttcttgcccccctggaacatatagttgggtggcaatagttgacagagtgattttacacactttatatataaaacatgtgtatacatatgtatttaaagatatatacactgtataatgtatatgtacattattcacatataagcatatggcatgcattatacacttatatatacatattttatacatgatctaaatctaaactatgctttaagatggaatt

SEQ ID NO: 52374 - DNA, 601 bp, Human
tttgtcagatgggtagtttgcaaatattttctgtcattctgtgggttgtctcttcacttcgttgcctgtttcctttgctgtgcaaaagctttttaccttgatgtgatcacatttgcttatttttgctttggttgtctgtgcttatagggtattgctcaagaaatttttggccagaccaatgtcttgtagattttccccaatattttcttacagtcataatgtgattttaattaccaccgttcattccacaaattattgattgaacacctgacaatatgatggtgaagtaagttcttgcccycctggaacatatagttgggtggcaatagttgacagagtgattttacacactttatatataaaacatgtgtatacatatgtatttaaagatatatacactgtataatgtatatgtacattattcacatataagcatatggcatgcattatacacttatatatacatattttatacatgatctaaatctaaactatgctttaagatggaattattatctctctcttagcaaacaaaaagccatggctcagaaatattaaacattttacccaaagacatgtacaactaataagtggttgacat

SEQ ID NO: 52375 - DNA, 601 bp, Human
agctttttaccttgatgtgatcacatttgcttatttttgctttggttgtctgtgcttatagggtattgctcaagaaatttttggccagaccaatgtcttgtagattttccccaatattttcttacagtcataatgtgattttaattaccaccgttcattccacaaattattgattgaacacctgacaatatgatggtgaagtaagttcttgcccccctggaacatatagttgggtggcaatagttgacagagtgattttacacactttatatataaaacatgtgtatacatatgtatttamagatatatacactgtataatgtatatgtacattattcacatataagcatatggcatgcattatacacttatatatacatattttatacatgatctaaatctaaactatgctttaagatggaattattatctctctcttagcaaacaaaaagccatggctcagaaatattaaacattttacccaaagacatgtacaactaataagtggttgacatgaggctcaaatgtaggttcgagttttgaccccaaatcatagcatacactgaagtatcctaaatacttcaagcatcattggatgaca

SEQ ID NO: 52376 - DNA, 601 bp, Human
taattaccaccgttcattccacaaattattgattgaacacctgacaatatgatggtgaagtaagttcttgcccccctggaacatatagttgggtggcaatagttgacagagtgattttacacactttatatataaaacatgtgtatacatatgtatttaaagatatatacactgtataatgtatatgtacattattcacatataagcatatggcatgcattatacacttatatatacatattttatacatgatctaaatctaaactatgctttaagatggaattattatctctctcttagmaaacaaaaagccatggctcagaaatattaaacattttacccaaagacatgtacaactaataagtggttgacatgaggctcaaatgtaggttcgagttttgaccccaaatcatagcatacactgaagtatcctaaatacttcaagcatcattggatgacatgtcatacaataatggaggaggcctgcaagtctgaggcaggccggattcttcacaatcccaaaccttattccaccagaagagaaaccaaagggaagtgtgtttcctcacaaatacattcatgcagatcctcagggccttca

SEQ ID NO: 52377 - DNA, 601 bp, Human
cattcttatcattttagtgctgggaactgagccttagagagggcaagtggcttacacaagtgtgggcagtaagaaagtcatagaaccagctgggcgcgatggctcacacctgtaatcccagcactctgggaggctgaggcagaaggaacacgagatcaggagttcaagaccagcctggccaacacggtgaaaccccgtctttactgaaaaaaataacataaatattagctgggtgtggttgtgcacacctgtaatcccagctacctgggaggctgaggtgggagaattgcttgaacctgasaggcggagcttgcagtgagctgagatcatgcaattgcactccagcctgggtgacagagggagaacctgtctcaaaaaaataaaaataaaaataaaatttaaaaaaagagacagagagagagtgcttgagctagatcatctaagattcagccaaccatctcagcagtgttaccagagcttgtaagtgaaggcagatttggggtaaaaccagcttttatttatatgtgtcttcagtgagtcagattagttggtttgcaggccatattttgaaaaccactaggctttagaatatttaattctt

SEQ ID NO: 52378 - DNA, 601 bp, Human
tctcagcagtgttaccagagcttgtaagtgaaggcagatttggggtaaaaccagcttttatttatatgtgtcttcagtgagtcagattagttggtttgcaggccatattttgaaaaccactaggctttagaatatttaattctttctccaattctgactaaccctcccaagaattgaaatgttctaaaaccctgaaaaatgaaaacccttccaaccgaacaccaataattatcatttttgtatttttctcctcaaaataggcaattaaacatgtaaaaataaataaagacttcaaaaaaaraaagaactatactctaagatcatgtgtcagatgtagtttcagaagcaagatctgccggcagttcttacacatagcgggggtgagaatgtttctgtgaggtgggtcctttgtggttcttaatggtgtgaacccgacatgaaaagggaggtgcaggggaaatcatagcaggaaagggtttgggtggggatgaagtagataataagaaggattggttgctcttttcaatgaagtgtgatagctgctagcatttggcagtttgggaaatgatcttcttttgtattattttaatgaacatcccct

SEQ ID NO: 52379 - DNA, 601 bp, Human; identical to SEQ ID NO: 25591

SEQ ID NO: 52380 - DNA, 601 bp, Human; identical to SEQ ID NO: 25592

SEQ ID NO: 52381 - DNA, 601 bp, Human; identical to SEQ ID NO: 25593

SEQ ID NO: 52382 - DNA, 601 bp, Human; identical to SEQ ID NO: 25594

SEQ ID NO: 52383 - DNA, 601 bp, Human; identical to SEQ ID NO: 25595

SEQ ID NO: 52384 - DNA, 601 bp, Human; identical to SEQ ID NO: 25596

SEQ ID NO: 52385 - DNA, 601 bp, Human; identical to SEQ ID NO: 25597

SEQ ID NO: 52386 - DNA, 601 bp, Human; identical to SEQ ID NO: 25598

SEQ ID NO: 52387 - DNA, 601 bp, Human; identical to SEQ ID NO: 25599

SEQ ID NO: 52388 - DNA, 601 bp, Human; identical to SEQ ID NO: 25600

SEQ ID NO: 52389 - DNA, 601 bp, Human; identical to SEQ ID NO: 25601

SEQ ID NO: 52390 - DNA, 601 bp, Human; identical to SEQ ID NO: 25602

SEQ ID NO: 52391 - DNA, 601 bp, Human; identical to SEQ ID NO: 25603

SEQ ID NO: 52392 - DNA, 601 bp, Human; identical to SEQ ID NO: 25604

SEQ ID NO: 52393 - DNA, 601 bp, Human; identical to SEQ ID NO: 25605

SEQ ID NO: 52394 - DNA, 601 bp, Human; identical to SEQ ID NO: 25606

SEQ ID NO: 52395 - DNA, 601 bp, Human; identical to SEQ ID NO: 25607

SEQ ID NO: 52396 - DNA, 601 bp, Human; identical to SEQ ID NO: 25608

SEQ ID NO: 52397 - DNA, 601 bp, Human; identical to SEQ ID NO: 25609

SEQ ID NO: 52398 - DNA, 601 bp, Human; identical to SEQ ID NO: 25610

SEQ ID NO: 52399 - DNA, 601 bp, Human; identical to SEQ ID NO: 25611

SEQ ID NO: 52400 - DNA, 601 bp, Human; identical to SEQ ID NO: 25612

SEQ ID NO: 52401 - DNA, 601 bp, Human; identical to SEQ ID NO: 25613

SEQ ID NO: 52402 - DNA, 601 bp, Human; identical to SEQ ID NO: 25614

SEQ ID NO: 52403 - DNA, 601 bp, Human; identical to SEQ ID NO: 25615

SEQ ID NO: 52404 - DNA, 601 bp, Human; identical to SEQ ID NO: 25616

SEQ ID NO: 52405 - DNA, 601 bp, Human; identical to SEQ ID NO: 25617

SEQ ID NO: 52406 - DNA, 601 bp, Human; identical to SEQ ID NO: 25618

SEQ ID NO: 52407 - DNA, 601 bp, Human; identical to SEQ ID NO: 25619

SEQ ID NO: 52408 - DNA, 601 bp, Human; identical to SEQ ID NO: 25620

SEQ ID NO: 52409 - DNA, 601 bp, Human; identical to SEQ ID NO: 25621

SEQ ID NO: 52410 - DNA, 601 bp, Human; identical to SEQ ID NO: 25622

SEQ ID NO: 52411 - DNA, 601 bp, Human; identical to SEQ ID NO: 25623

SEQ ID NO: 52412 - DNA, 601 bp, Human; identical to SEQ ID NO: 25624

SEQ ID NO: 52413 - DNA, 601 bp, Human; identical to SEQ ID NO: 25625

SEQ ID NO: 52414 - DNA, 601 bp, Human; identical to SEQ ID NO: 25626

SEQ ID NO: 52415 - DNA, 601 bp, Human; identical to SEQ ID NO: 25627

SEQ ID NO: 52416 - DNA, 601 bp, Human; identical to SEQ ID NO: 25628

SEQ ID NO: 52417 - DNA, 601 bp, Human; identical to SEQ ID NO: 25629

SEQ ID NO: 52418 - DNA, 601 bp, Human; identical to SEQ ID NO: 25630

SEQ ID NO: 52419 - DNA, 601 bp, Human; identical to SEQ ID NO: 25631

SEQ ID NO: 52420 - DNA, 601 bp, Human; identical to SEQ ID NO: 25632

SEQ ID NO: 52421 - DNA, 601 bp, Human; identical to SEQ ID NO: 25633

SEQ ID NO: 52422 - DNA, 601 bp, Human; identical to SEQ ID NO: 25634

SEQ ID NO: 52423 - DNA, 601 bp, Human; identical to SEQ ID NO: 25635

SEQ ID NO: 52424 - DNA, 601 bp, Human; identical to SEQ ID NO: 25636

SEQ ID NO: 52425 - DNA, 601 bp, Human; identical to SEQ ID NO: 43808

SEQ ID NO: 52426 - DNA, 601 bp, Human; identical to SEQ ID NO: 43809

SEQ ID NO: 52427 - DNA, 601 bp, Human; identical to SEQ ID NO: 43810

SEQ ID NO: 52428 - DNA, 601 bp, Human; identical to SEQ ID NO: 43811

SEQ ID NO: 52429 - DNA, 601 bp, Human; identical to SEQ ID NO: 43812

SEQ ID NO: 52430 - DNA, 601 bp, Human; identical to SEQ ID NO: 43813

SEQ ID NO: 52431 - DNA, 601 bp, Human; identical to SEQ ID NO: 43814

SEQ ID NO: 52432 - DNA, 601 bp, Human; identical to SEQ ID NO: 43815

SEQ ID NO: 52433 - DNA, 601 bp, Human; identical to SEQ ID NO: 43816

SEQ ID NO: 52434 - DNA, 601 bp, Human; identical to SEQ ID NO: 43817

SEQ ID NO: 52435 - DNA, 601 bp, Human; identical to SEQ ID NO: 43818

SEQ ID NO: 52436 - DNA, 601 bp, Human; identical to SEQ ID NO: 43819

SEQ ID NO: 52437 - DNA, 601 bp, Human; identical to SEQ ID NO: 43820

SEQ ID NO: 52438 - DNA, 601 bp, Human; identical to SEQ ID NO: 43821

SEQ ID NO: 52439 - DNA, 601 bp, Human; identical to SEQ ID NO: 43822

SEQ ID NO: 52440 - DNA, 601 bp, Human; identical to SEQ ID NO: 43823

SEQ ID NO: 52441 - DNA, 601 bp, Human; identical to SEQ ID NO: 43824

SEQ ID NO: 52442 - DNA, 601 bp, Human; identical to SEQ ID NO: 43825

SEQ ID NO: 52443 - DNA, 601 bp, Human; identical to SEQ ID NO: 43826

SEQ ID NO: 52444 - DNA, 601 bp, Human; identical to SEQ ID NO: 43827

SEQ ID NO: 52445 - DNA, 601 bp, Human; identical to SEQ ID NO: 43828

SEQ ID NO: 52446 - DNA, 601 bp, Human; identical to SEQ ID NO: 43829

SEQ ID NO: 52447 - DNA, 601 bp, Human; identical to SEQ ID NO: 43830

SEQ ID NO: 52448 - DNA, 601 bp, Human; identical to SEQ ID NO: 43831

SEQ ID NO: 52449 - DNA, 601 bp, Human; identical to SEQ ID NO: 43832

SEQ ID NO: 52450 - DNA, 601 bp, Human; identical to SEQ ID NO: 43833

SEQ ID NO: 52451 - DNA, 601 bp, Human; identical to SEQ ID NO: 43834

SEQ ID NO: 52452 - DNA, 601 bp, Human; identical to SEQ ID NO: 43835

SEQ ID NO: 52453 - DNA, 601 bp, Human; identical to SEQ ID NO: 43836

SEQ ID NO: 52454 - DNA, 601 bp, Human; identical to SEQ ID NO: 43837

SEQ ID NO: 52455 - DNA, 601 bp, Human; identical to SEQ ID NO: 43838

SEQ ID NO: 52456 - DNA, 601 bp, Human; identical to SEQ ID NO: 43839

SEQ ID NO: 52457 - DNA, 601 bp, Human; identical to SEQ ID NO: 43840

SEQ ID NO: 52458 - DNA, 601 bp, Human; identical to SEQ ID NO: 43841

SEQ ID NO: 52459 - DNA, 601 bp, Human; identical to SEQ ID NO: 43842

SEQ ID NO: 52460 - DNA, 601 bp, Human; identical to SEQ ID NO: 43843

SEQ ID NO: 52461 - DNA, 601 bp, Human; identical to SEQ ID NO: 43844

SEQ ID NO: 52462 - DNA, 601 bp, Human; identical to SEQ ID NO: 43845

SEQ ID NO: 52463 - DNA, 601 bp, Human; identical to SEQ ID NO: 43846

SEQ ID NO: 52464 - DNA, 601 bp, Human; identical to SEQ ID NO: 43847

SEQ ID NO: 52465 - DNA, 601 bp, Human; identical to SEQ ID NO: 43848

SEQ ID NO: 52466 - DNA, 601 bp, Human; identical to SEQ ID NO: 43849

SEQ ID NO: 52467 - DNA, 601 bp, Human; identical to SEQ ID NO: 43850

SEQ ID NO: 52468 - DNA, 601 bp, Human; identical to SEQ ID NO: 43851

SEQ ID NO: 52469 - DNA, 601 bp, Human; identical to SEQ ID NO: 43852

SEQ ID NO: 52470 - DNA, 601 bp, Human; identical to SEQ ID NO: 43808

SEQ ID NO: 52471 - DNA, 601 bp, Human; identical to SEQ ID NO: 43809

SEQ ID NO: 52472 - DNA, 601 bp, Human; identical to SEQ ID NO: 43810

SEQ ID NO: 52473 - DNA, 601 bp, Human; identical to SEQ ID NO: 43811

SEQ ID NO: 52474 - DNA, 601 bp, Human; identical to SEQ ID NO: 43812

SEQ ID NO: 52475 - DNA, 601 bp, Human; identical to SEQ ID NO: 43813

SEQ ID NO: 52476 - DNA, 601 bp, Human; identical to SEQ ID NO: 43814

SEQ ID NO: 52477 - DNA, 601 bp, Human; identical to SEQ ID NO: 43815

SEQ ID NO: 52478 - DNA, 601 bp, Human; identical to SEQ ID NO: 43816

SEQ ID NO: 52479 - DNA, 601 bp, Human; identical to SEQ ID NO: 43817

SEQ ID NO: 52480 - DNA, 601 bp, Human; identical to SEQ ID NO: 43818

SEQ ID NO: 52481 - DNA, 601 bp, Human; identical to SEQ ID NO: 43819

SEQ ID NO: 52482 - DNA, 601 bp, Human; identical to SEQ ID NO: 43820

SEQ ID NO: 52483 - DNA, 601 bp, Human; identical to SEQ ID NO: 43821

SEQ ID NO: 52484 - DNA, 601 bp, Human; identical to SEQ ID NO: 43822

SEQ ID NO: 52485 - DNA, 601 bp, Human; identical to SEQ ID NO: 43823

SEQ ID NO: 52486 - DNA, 601 bp, Human; identical to SEQ ID NO: 43824

SEQ ID NO: 52487 - DNA, 601 bp, Human; identical to SEQ ID NO: 43825

SEQ ID NO: 52488 - DNA, 601 bp, Human; identical to SEQ ID NO: 43826

SEQ ID NO: 52489 - DNA, 601 bp, Human; identical to SEQ ID NO: 43827

SEQ ID NO: 52490 - DNA, 601 bp, Human; identical to SEQ ID NO: 43828

SEQ ID NO: 52491 - DNA, 601 bp, Human; identical to SEQ ID NO: 43829

SEQ ID NO: 52492 - DNA, 601 bp, Human; identical to SEQ ID NO: 43830

SEQ ID NO: 52493 - DNA, 601 bp, Human; identical to SEQ ID NO: 43831

SEQ ID NO: 52494 - DNA, 601 bp, Human; identical to SEQ ID NO: 43832

SEQ ID NO: 52495 - DNA, 601 bp, Human; identical to SEQ ID NO: 43833

SEQ ID NO: 52496 - DNA, 601 bp, Human; identical to SEQ ID NO: 43834

SEQ ID NO: 52497 - DNA, 601 bp, Human; identical to SEQ ID NO: 43835

SEQ ID NO: 52498 - DNA, 601 bp, Human; identical to SEQ ID NO: 43836

SEQ ID NO: 52499 - DNA, 601 bp, Human; identical to SEQ ID NO: 43837

SEQ ID NO: 52500 - DNA, 601 bp, Human; identical to SEQ ID NO: 43838

SEQ ID NO: 52501 - DNA, 601 bp, Human; identical to SEQ ID NO: 43839

SEQ ID NO: 52502 - DNA, 601 bp, Human; identical to SEQ ID NO: 43840

SEQ ID NO: 52503 - DNA, 601 bp, Human; identical to SEQ ID NO: 43841

SEQ ID NO: 52504 - DNA, 601 bp, Human; identical to SEQ ID NO: 43842

SEQ ID NO: 52505 - DNA, 601 bp, Human; identical to SEQ ID NO: 43843

SEQ ID NO: 52506 - DNA, 601 bp, Human; identical to SEQ ID NO: 43844

SEQ ID NO: 52507 - DNA, 601 bp, Human; identical to SEQ ID NO: 43845

SEQ ID NO: 52508 - DNA, 601 bp, Human; identical to SEQ ID NO: 43846

SEQ ID NO: 52509 - DNA, 601 bp, Human; identical to SEQ ID NO: 43847

SEQ ID NO: 52510 - DNA, 601 bp, Human; identical to SEQ ID NO: 43848

SEQ ID NO: 52511 - DNA, 601 bp, Human; identical to SEQ ID NO: 43849

SEQ ID NO: 52512 - DNA, 601 bp, Human; identical to SEQ ID NO: 43850

SEQ ID NO: 52513 - DNA, 601 bp, Human; identical to SEQ ID NO: 43851

SEQ ID NO: 52514 - DNA, 601 bp, Human; identical to SEQ ID NO: 43852

SEQ ID NO: 52515 - DNA, 601 bp, Human
tgaaggagtgtgtcaggcattccctgcttacatacacctttacacagtcacaattcatggacattcctttcccaggatgcagcaggggctacattgtttcatgttgcaaactagggaaactctcaggtgacttagaaaagtagttattttatccattgccagttgatatttgtaagctaaatatctttatttacaatataatacactagaatctttaccaaagggctttccaaactaggttttactaggggaaacacactaaagggtataaactgcttcatgattggttagttcactttgrtccgatggaattaagttttgaagtatttgggccaggtgtgatggctcatgcctgtaatctcagcactgtgggaggccaaggcagttggatcacctgaggtcaagagttccagaccagcctggccaacatggcgaaacccgtctctactaaaaatacaaaacctcatctctactaaaaatacaaaaattagctaggcatggtggcgcgtgcctgtgatcccagctacttggggttgggggctgaggcaggagaatcgcttgaacccgggaggcagaggttgcagtaagccgagattgtgcc

SEQ ID NO: 52516 - DNA, 601 bp, Human
ctgagaacttatggttctcaatatgttgtttaaattcagcagaagaatgaattagcagttctcgaatcaaaggttgtgttcacttgaaatatgtgttaagctttacttagcaaagaaagctcactctataccttgggaggctgcttctctctggaggggtttactatccacttgaatcaatgtgtgaactgtgtgacataaagatgtgttggacttatgcttgatagcaataaaatatttctttatggacaatgactttgtctaatggcagtaacctttgcctctggttttcaatatgttrttatataaaaattataaatatagtaaaagtaaatagtcttaaatataaaaattaagaattatataaaaataattttggttaggtgttgtgctgtaggcactgatgaacattttcaggtgttcctttcacagttacccacattttctcacaaccatagtttctccctccaccacccccatagtcagttttaagtcccggaattttcagctcagaccagttttacagatgactgtatctcagtgtgaatatctcgcaggtcatgtttttaacctctttcctgtgttcatcagaaactggtgg

SEQ ID NO: 52517 - DNA, 601 bp, Human
ttgcctctggttttcaatatgttattatataaaaattataaatatagtaaaagtaaatagtcttaaatataaaaattaagaattatataaaaataattttggttaggtgttgtgctgtaggcactgatgaacattttcaggtgttcctttcacagttacccacattttctcacaaccatagtttctccctccaccacccccatagtcagttttaagtcccggaattttcagctcagaccagttttacagatgactgtatctcagtgtgaatatctcgcaggtcatgtttttaacctctttyctgtgttcatcagaaactggtggggcctgatgtccactgacaagccacacaggctgttgatggctgagcatttgcagctgcttttgcaacccttctcatgcaaaagaatgtggctgtcattcttctaatcaccagccctctattcacagcctctccacctctctattctgtgactctggccaagagaataatcctaatatggcaaaccatacgaggtacctggacttctctttcttcctaaaattctataatgttagattttagaactggtgactacataaccgaattcatggctggtgt

SEQ ID NO: 52518 - DNA, 601 bp, Human
aaactgtcttggcacttacttcatcactgtaattacatatttcccgaaaagttgaacaatagctgttgtgaaatagttctacactagtattgtataggatgtgacaagataaggttagcttctgggcatgttagcactaagaggggaagagagagctcattatattgtaggttctaatcagcagttttgcttctgccacatcggtgaaatgaggctgatgaacttgactctgaagaaatcaacctgaatgcaagttgaggtttattttcttttcccctgtgactaatatatcttaagagtrcttgtatagttgaagagttaagtgcttaaaaattgtctattttgtctgtatgtgttagtttcaaaaacctaagtcagaggaattcatattttgtaatttggaatatccttaaaaaacatcttatactcattttgattactgcagtgtaaatatcctaagcttttgattggtgtactggaattttggtctgtagttgaatttctagaaagaagaaaacataggagagaataaattagtagcagaatattaggtatgatttatttaagtagagtccaggatccgctttgaggtcactatatt

SEQ ID NO: 52519 - DNA, 601 bp, Human
aagagctattgttatgtcactgtacccgtgaatatacttttttaacttagccacctgtctccagctttgtaactgtcagagatcatgaaccctgtgagaaatagaggaggaggaagggactaatgtgttatatgtatgcaggcttgtatgctggtcattttacctactttttcacttatttctcaacagtcctgtgaggtaggcattcatacatccattcatataacaaatattaattgagagcctgctatctagctagcactggggacctgccattggtacagttcagggcagcagcttscctgatgtctctgagctaggcaaagtcaggtctgaaccagggtccttctcaactctggttgggttatgtgttgtggtggggtgggtggtggtggtgggtggtttttccattcccaattctctcatatggcagcattcttgagtatgtatcctgagaataatacgggatggaggaagatccctattaccttggctttatgacagatgaattaagtaatttctctgagtagacagagcagctggtatattcctcattttacaaatgaaggaatggaggctcaagtcttctatctctattgct

SEQ ID NO: 52520 - DNA, 564 bp, Human
ttttgtgtttttagtagaaatggggtttcaccatgttggccaggctggtcttgaactcctgagctcaggtgatccacccacctcggcctcccaaagtgctgggattacaggtgtgagtcaccgtgcctggacttttactttatttactttgtccatctgtccctttttggattttgaagtatctgagagttggaacctatctgaatcttcctattatgtgaataccaaatttataaaatgttagacattttttatagaaatgayatttttaaaagttattatcctttgttataataaagaagtcgttcttcaaaagactctagtacttctcaaatttaatatgcagacaaattccctagggattaagatgtggcttctgattctgtaggtctggggtggggctcaacagtttgcatttctgtcaagctcccaggtgatgcccatgctgctggaacccgggccacagtttgaggagcactattatagggggaacattcctttggctgagatgctggggctcatgtctaaaccagaattaactcactgccctgttatccacagtag

SEQ ID NO: 52521 - DNA, 601 bp, Human
ctttgagggatcagcagctctgactcctgtttcccaggctcatgcaggtcggatttggaagttctactttacaactacgatttaggcctctgtggaattagatttctttactgcattatgggtagctgttagtcattttaagtggaattgcttcagttaaagaaggtgttataatgtccaggttctcaaattggataaatgtgtagagttttattattaatatcctttataacctacacatatattttttttttggtagtatacttcataataaaaattaaaagtaaagagtatttagaamgaaaagatctaagcacagttctcattcttgcccccagttgtattactaatattttagcattaaaagaataataggaaaaagaggggggaaggaacatctattacaccaatcccctaatgcaattactattattttatttactttcttgtaatataaatgttaattaatgtttatgttcttagttataatcacaatgtatgtagctgtatatattacacagtgtactgatgttgtctttatagacattagttttaattgctgaatcatattccatgagtagttagtattaatatactaacc

SEQ ID NO: 52522 - DNA, 601 bp, Human
ttactcagatttcaccagttttatatgtattcccttttctgtgtgtatgtgtatatgtatatgcacttttggtttttatgcaactttatcacatgggtagattggtgtgactaccaccatagtcaagatgcagagtagttccatcacaaggacccttcatcatattcttttttttttttttttttttgagaccgagtctcactctgtcaccctgccttgagtgcggtggcgtgatctcagctcactgcaacctctgcctcccgggttccagctgttcttctgcctcagcctcccaagtagstggaactataggcgcgtgccaccatgcccggctaatttttgtatttttagtagagacggggtttcaccatattggtcaggctggtcttgaactcctgaccttgtgatccacccacctcggcctcccaaagtgctgggattacaggcgtgagccactgcgcctggcccatcatattcttttacagccacaactacatctgtcattctttccctctcccctggcaaccattaatttgcttcctatctctatacttttattatttgatgttatataaatgaaattacatagtatataactttg

SEQ ID NO: 52523 - DNA, 601 bp, Human
ctactcgggaggcttagacaggagaattgcttgaacccaggaggcagaggttgcagtgagctgagatcgtgccactgcactccagcttgggtgacagagcgagactccgtctcaaaaaaaaaaaaaaaatggaattagtgtctatttttaaaggtccagttatgtgctcctataaaattattaaactgtctagagatctgttaactaatttatatatttttttcttttaggtggggaccaaggcatactgaacacattttttagcagctgggcaacaacagatatcagaaaacacctgccrtttatttataacctaagcagcatctctatatactcctacctcccggcatttaaagtgtaagtgcagatggtttaactattgttggagatgttgagggcagagaattggggtgtacaattttggggctgcttcattgtcattccgagggaaataacagatagacactttgaggaaagtttctcttgtaagaaccgtggctgcaatggggagaggccttgatgttatcggttgcctcatgcttgaccctagggtccttagttgcctttgggacaaggttcccatcagtttctggggttcatg

SEQ ID NO: 52524 - DNA, 601 bp, Human
ggcatttaaagtgtaagtgcagatggtttaactattgttggagatgttgagggcagagaattggggtgtacaattttggggctgcttcattgtcattccgagggaaataacagatagacactttgaggaaagtttctcttgtaagaaccgtggctgcaatggggagaggccttgatgttatcggttgcctcatgcttgaccctagggtccttagttgcctttgggacaaggttcccatcagtttctggggttcatggccctctggtaagttattaatatgtcatggtcaaaaacacagackcttaagctctgcagacttacaacttggaggagctgagtttgtgccctaactcaatgtcttccccatactggctgctgagctttggtttccttcacctgcaaaaaggtgttaaaagctccctcataattgttgtggggattaagccagatgcaggcagcagtgtgctgctgtggctaagaataagggctctggagctggatgacctcacttcacatcctgcagtgaccacttcctggcctacttactgaacttctttctgcctccatgtcttcatagggttattgtgggtagtaagggagg

SEQ ID NO: 52525 - DNA, 601 bp, Human
tgttagtcatttttatttgagagaagcaatatagtgttcagagtaattcgtaaaccagaaaggcagggcatatgtcctcactctgtcatttatctgctacatgacttaagacttggtgcctcagctcctccatatgtaaaacgaggaggaaaatagtacctacctcatagggttgtcaggaggatgaaacaaattaatacatataaagtgctcagtggacatttgttgtttttggtaacgtgcttgtttagcacgcacagtccctggtgcagttcttttttttttttttttttgagacgamgtctcactttgttgcccaggctggagtgcagtggcatgatcttggctcactgcaacctccacctcctggttcaagtgattctcctgcctcagcctccctagtagctgggattacaggcacgtgccactacacacggctaatttttgtatttttagtggagatggggtttcaccgcattgtccaggctggccttgaactcctgacctcaggtgatctgcccaccttgccttcccaaagtgctaggattacaggcatgagccactgctcccggcccctggtgcagttctgatacaccttaca

SEQ ID NO: 52526 - DNA, 601 bp, Human
ttttcatttattctactcttttaaacagttctgaggatattaatatttctttcttttttaagaatcagactcattcactaagaccttatcaaacctatttatcagtattttccccaaagaaattaaaccttcagtgttgtgaattctatcgtccctgtgtagttctgatttggttatttttcttcgctccctgagacacctccttggctccaactctccacgtaactattgttattggaagccgtagtctattttcatttcttttcacactcatacatattcactcaaccctgaggctgastcagaaagagtttgggtcactctttttttccagccatttgttggcctgctgatcgttcattcagttggcaaacctggagcgtgtaccttgtgccacactttctgctcactcaaggcctcagagatgaataagggagcttggagtctaatccacttagccactgcttaggtgtacagtttcttgtatggcacatggcacagtctgtcatggtttgagtgttaagaagaagaatcaagcagtggttgcacagatgtcttgttccctctttctcggtgatagtgatgcctcttggggccccat

SEQ ID NO: 52527 - DNA, 601 bp, Human
ctggccaacatgctgaaaccctgacactactaaaaaaaaaaatacatatatataaatacataaaaattagctgggcgtagtggtgcatgcctgtaatcccagctactcagaaggctgaggcagaagaatggcttgaaccagggaggcagaggttggagtgagctgagattgcaccactgcactccagcctgggtgacagagcaagactctgtctcaaaaaaaaaaaaaaaaaggcataacttcctcagaagtctcaaatctgtgggccccagactgtatttatcacacaagtatgttttgyttgtgctacacagaattttttttaacttaattgtcaatgctttaaaaattagggaatttcacataaaacccaggtttccaatttctttggaaaaatcaggtatttggtaggatatgtcaaatgtgactgttacaggtttgtggtctaagtgactggaatgatagagttgccatttcctgaaataggaaagaacatgggggaagcaagttcgtaggggtagggattggtcagaaatgaacggaatgtattaggttttagatgtatgaagtctgaggtgcatattagcatcctagtgaaagt

SEQ ID NO: 52528 - DNA, 601 bp, Human
tgcatgcctgtaatcccagctactcagaaggctgaggcagaagaatggcttgaaccagggaggcagaggttggagtgagctgagattgcaccactgcactccagcctgggtgacagagcaagactctgtctcaaaaaaaaaaaaaaaaaggcataacttcctcagaagtctcaaatctgtgggccccagactgtatttatcacacaagtatgttttgtttgtgctacacagaattttttttaacttaattgtcaatgctttaaaaattagggaatttcacataaaacccaggtttccaatktctttggaaaaatcaggtatttggtaggatatgtcaaatgtgactgttacaggtttgtggtctaagtgactggaatgatagagttgccatttcctgaaataggaaagaacatgggggaagcaagttcgtaggggtagggattggtcagaaatgaacggaatgtattaggttttagatgtatgaagtctgaggtgcatattagcatcctagtgaaagtatgaaatagctaagtagagataaaagtcaggagctccagagagaagtctggaacatatgagagttgtcagcatataaatgata

SEQ ID NO: 52529 - DNA, 601 bp, Human
atcgtgccactgctctccagcctgggtgacagagcaagactccgtctcaaaaaaaaaaaaaaaacaaaaaagaaaaaaaaaaaagagccaggacagtttatccttggtaacatgaaggaaggcaaagtgtatgggcacagatgcttgtaggcaggtgttatgttttggctgaatgaatgaatgagcaatcagccaatagaggctaagaatgacatgctgcctccaggagagtctccctagtggcctggtgttgtaagtccttccctgacctggtctgtgaagagaggccagcctagaagakaatgttgttgactaggtcctagtgtaggttattaaagtctgggttcgagtgctgacattgttctgatttccagggtattattgggaggattagtttgcaaggcaaagaaattgggtgggtgtctggtcagttgtttgctgggggtagcagctatcttctagtgatgggatatgcaccctttgtgttcctcaggccccacctcagcaagtccattcctcctctccatgatcaggcccactccttggttacttgggtttgtgactcctaacttagattgtgagtgcgtgagagaggagaggt

SEQ ID NO: 52530 - DNA, 601 bp, Human
atgcttgtaggcaggtgttatgttttggctgaatgaatgaatgagcaatcagccaatagaggctaagaatgacatgctgcctccaggagagtctccctagtggcctggtgttgtaagtccttccctgacctggtctgtgaagagaggccagcctagaagataatgttgttgactaggtcctagtgtaggttattaaagtctgggttcgagtgctgacattgttctgatttccagggtattattgggaggattagtttgcaaggcaaagaaattgggtgggtgtctggtcagttgtttgctgggggtagcagctatcttctagtgatgggatatgcaccctttgtgttcctcaggccccacctcagcaagtccattcctcctctccatgatcaggcccactccttggttacttgggtttgtgactcctaacttagattgtgagtgcgtgagagaggagaggtgtgcagttggttgtgggagaagggcttgtgtgtggctctgcccatgtgggcaagtgagtctgagaaggtgcatgagtgagtcgcaatataatagagaacatgagccacagaagtgggcaagaggatgcttgacattgctg

SEQ ID NO: 52531 - DNA, 601 bp, Human
gggaggattagtttgcaaggcaaagaaattgggtgggtgtctggtcagttgtttgctgggggtagcagctatcttctagtgatgggatatgcaccctttgtgttcctcaggccccacctcagcaagtccattcctcctctccatgatcaggcccactccttggttacttgggtttgtgactcctaacttagattgtgagtgcgtgagagaggagaggtgtgcagttggttgtgggagaagggcttgtgtgtggctctgcccatgtgggcaagtgagtctgagaaggtgcatgagtgagtcrcaatataatagagaacatgagccacagaagtgggcaagaggatgcttgacattgctgccacgattcccagagaagtgtcgcacaagcagtgccgtctttctcggtatctgactgaacaatgcacgtaaagagcttagtgaggactaaaattgctcctgtgtgtgctgtcataaaccagttccttttctgttctaaacagttctgtagtctcatccacatgttactggctgtttctcaactactaaactagtcatgaaaattctatctgatcttttggtaacatcaggtcacagggataat

SEQ ID NO: 52532 - DNA, 601 bp, Human
gtagcagctatcttctagtgatgggatatgcaccctttgtgttcctcaggccccacctcagcaagtccattcctcctctccatgatcaggcccactccttggttacttgggtttgtgactcctaacttagattgtgagtgcgtgagagaggagaggtgtgcagttggttgtgggagaagggcttgtgtgtggctctgcccatgtgggcaagtgagtctgagaaggtgcatgagtgagtcgcaatataatagagaacatgagccacagaagtgggcaagaggatgcttgacattgctgccaygattcccagagaagtgtcgcacaagcagtgccgtctttctcggtatctgactgaacaatgcacgtaaagagcttagtgaggactaaaattgctcctgtgtgtgctgtcataaaccagttccttttctgttctaaacagttctgtagtctcatccacatgttactggctgtttctcaactactaaactagtcatgaaaattctatctgatcttttggtaacatcaggtcacagggataattttaacggctcacataagcagtattattgctggcttgtgttcaaactatgtcttgtgatct

SEQ ID NO: 52533 - DNA, 601 bp, Human
tgactaaagggtaaattgattatgatagaaaatgatcttttaaagacatttctcagagaacgtaattgagacataaaaataattacttgaaattaatatctagattgaaactctagatatgaaaacagactagtgttcaagacctgttgctcattctttttgtgtatgatgtgtcttatgaaagcttatagagcaagcccttcaggttcctttgctgtgtaaataactgtttagttgtacagttagagcataatgggagttaaaaggactcctgaaccttcatataaggtggccattgttsggtccaggcagagatccctcatatcaagccaagtgctgccctagatgagttctaggaacattcttgtgatatgactgccttacacaaagttgcaaaatctggcttcacttctctctcaccctcctatccaagccccatttttcccccacttaacagctgccttatttctcacttttctgccctcttcccacccccaaagggctcttgggctggtctaaaccttccgtgttcagtgacttatccaggcctgctcttctcataaaaagctggtcctctaaaacctctgaccattcactacca

SEQ ID NO: 52534 - DNA, 601 bp, Human
tcttgtgatatgactgccttacacaaagttgcaaaatctggcttcacttctctctcaccctcctatccaagccccatttttcccccacttaacagctgccttatttctcacttttctgccctcttcccacccccaaagggctcttgggctggtctaaaccttccgtgttcagtgacttatccaggcctgctcttctcataaaaagctggtcctctaaaacctctgaccattcactaccactatccatttccatagatagtaggtgtgtaacagtttgattaaagtagtgtcaggccgggcmcgtaatgtcaggcccacacctgtaatcccagcactttgggaggcagaggcaggtggatcgcttgaatagcctgggcaacatggtgaaacctcgtctctacaaaaaataaaaataaaataaaaatacgaaaactagccagtcatagtggcctgtgcctgtagtcccagctacttgggaggctgaggtgggagaattgcttgcacttcagaggttgaagtgcagtgagctgagattgtaccactagactccagcctgagtgagagagtgagacactgtcttaaaaaaaaaaaaaaaaaaaga

SEQ ID NO: 52535 - DNA, 601 bp, Human
tacctaatgcatctaaaagcatttccattccttactggacagaaacagggctgagcatacctatgatatctgaatcctttgcgtgatttctgtatgccccagaatctttcttacctcctcgctcatgcttctctgtgccttcacacttctgagtctgtttcaagtttgccactcagtaaactggccccaactaatttgtaaagaaacctacttacatcctaacactttgtgatttgtttcattgcaatgtgggtagctgttgggaggctacatcactgtgcagtactgccctccacagtcytgctcacctctcccatctctccccactcaccccctgtcttgctggcacccaagggatttcttgccttagggcagaaaaagcagtctcacccacatttaggaccccttaagatcccagtttctactttaaacagccttaccaagggatttcttaaaatgaaaactgccctgtctatgaaaggactatccagtggatacagttttttcactttgttagggtagaataggtaaagaaggtaatttgaggaaggaggatccttcccctgactacagggagtaacagatttagaattaaagagat

SEQ ID NO: 52536 - DNA, 601 bp, Human
gagtaagcttggggatatcaaatatcctcttcatttatcagaagaaacaaaccgtggaatgatcaattaaccttaagaggaaagagctttacaaataggctgtatttttcttgcatgctttttggagcagcagcagcatggtaggatggtaagtgctcatgccttagaggtaaaaccatgtcaaaccccatctctgccacttagttgtgtgaccttgggcatctcacttcagtctctcacagcctcaattatcacattagtaaaatttaccttgtagaaatattattattccccatcatgyccttaaagaatttggtctccaaatatagtaaactctgatgatagctttttaaccagttcctaactttttttttttttaataaactttaggggataggaaaggttacacgagtttgtattattttgaacggtatatcatgctcaaatatcttggttgcctgtaatataaatctactgaaatctaacacttgagcccagtacctgaggttctgtcccattttacttttctttccctactcaaagcctcctctctggctctaacagaggatacctggtctagcacacaggtgctcacctgata

SEQ ID NO: 52537 - DNA, 601 bp, Human
taatttttgtattattagtagagacagggtttcaccatgttggccaggatggtctccatctcctgacctcgtgatttgcctgcctcagcctcgcaaagtgctgggatgacaggtgtaagccaccgtacccggcctgttttgactttatgtaagtggaatcatatatatgtaattgtttgacccgttgcctttttcaacagaaatgttttaaaaattcatctttttgctgcatgatgtgtatagctatagttcattcattttagattgtattccatgctgtgaatatagcagaacttttcctttaaaaaagatggctatataactataaaatctcagtcatattcaacaataagcaaatatttcttacatatatgttggtgggttggctaggacagctctgatgatctcagcagggtttggagctaggctacaggtttggtccagatctgttccatgtttcttttttctggaaacagcaagcacccagggcatattctgctggcagaagttgtaacttctcagagggtgaacagaaataagcaatgcttctgtaaggcacaatgtcacttctgctcatattgcattagtcaagtcaagccaa

SEQ ID NO: 52538 - DNA, 601 bp, Human
tataaaatctcagtcatattcaacaataagcaaatatttcttacatatatgttggtgggttggctaggacagctctgatgatctcagcagggtttggagctaggctacaggtttggtccagatctgttccatgtttcttttttctggaaacagcaagcacccagggcatattctgctggcagaagttgtaacttctcagagggtgaacagaaataagcaatgcttctgtaaggcacaatgtcacttctgctcatattgcattagtcaagtcaagccaagccataggacatgtccaacatcrggtgggaaagtgtcctccccctgaggaggctgggagtaatgtatacttgctgagcagaaatctaatacagacatttgggttgtttccagtttttgactatttcaaatagtgctggtgctgctgtgaacattttgattatatctcttgttgcacatacacaagcatttctttagggtatatgcttaggagctgagctgctggattgtacagcatgagcatttttaactttactaggtaataccaaatactttccaagtggtgtgcctgttctgtccacaatggattggtgcttcagtgttg

SEQ ID NO: 52539 - DNA, 601 bp, Human
atattaagtattatatctccttttataggtaaattaactgaggcttaaagaagttatataacttgtcttagttatgtaatagactagtcaagcagcagaatgggcctcaaacgcaggtctgaagagacttatccttatgaaaatttgagatggactatgcttaaaagtagccatctacagcccagaattaagaaagtaccttttatggcaggtgaagggagagttacactttaaatgctaaactattttaagttatgtccagtatacttggcttgacctcaggggcctctcttttagggtrtaaattcacagcccccatattgtgaacagagaggactctggaaatgcctctgtatcattactgttgccaagtgcaaggcaaaggcaggactaatccaatggaaggacttccttatgttgcctcagctataatgcagtcctatacccaaacatcttaaagttccactgtatttaaatacatacctatatgcttacgtatatacgtaattatgaaccaaggaaaggtgaagatgggaattgaaagttgttcaaaactaagcaaattaacagaagctacaagaacagatgctacttggtaatc

SEQ ID NO: 52540 - DNA, 601 bp, Human
atttttgaaattgtcagctagaggaagagaaaggaaaaaaaaaatctgcacctgttaactgtcttcatgccccagacctcagacctatttcacaatcttcacaacacttcccagtggaccctcatttgccccattatttcaggagagaggagtaaaatttaaagagtcctagtaacttgcccaaggacatattgctagaaaaatgactttgctgggggtctatgccaactgtttgatacaatatcttgtatcaggatttccagagtttatagggacatcaggttttgaggactaactaacyagatatttaacttaaatttccaattagaggcagattctgtggctagatgaattgtgatcccattcaatcccaaaattgtggaagaaaaaaattaaccaaaagatctgcccatcctttttaacttgatagacctgaagtccttaaaaaaaaaaaaagtgatcaggcactaggaaggtttctttcctcctccctaatattcaacagttcttaaatatatttgcaaaaatcccataaacttattaaaagaagggtctgtatcttagttatgctgagccccaaattcctttcatggtgtatgag

SEQ ID NO: 52541 - DNA, 601 bp, Human
cagtgactctgccttcctgaaacatctttccccagtgcatgcaggggggcacacgcgcacacacacacacacacacacaccccagagcctacgatagtcacatatattggcccatagttctccagtcctttgttgctttctaaaagcagcaaaggatgggagccttgaaactgtcaaagtagaatttatctcatctcttctctgaacctcttacttgctccctgaccttgggacacagacttccatgagagttggttgattgggccaactgtgcaccaacctccgaagactaaggagagtrcagatctgacggcaatacccaaggatttcactctcatgatgaaggcactattgtacaatggctcacagctacggtgctgatgtcagaccctccaggttcaaattccaacttctgtattttaacagttgtgtccattttggaaactggccaaaccttcataaaaacaagagctgataatggtacccagttaatcatgttgagtgataaaatgtaaatacagtgctgagaaaagtgcctggcacataagaaaggttcagtaaacattaaacatttgtattattcaatactcagtgataatta

SEQ ID NO: 52542 - DNA, 601 bp, Human
acccaaggatttcactctcatgatgaaggcactattgtacaatggctcacagctacggtgctgatgtcagaccctccaggttcaaattccaacttctgtattttaacagttgtgtccattttggaaactggccaaaccttcataaaaacaagagctgataatggtacccagttaatcatgttgagtgataaaatgtaaatacagtgctgagaaaagtgcctggcacataagaaaggttcagtaaacattaaacatttgtattattcaatactcagtgataattatttatcctttcacctawatttaggaattttcttaaacaaattaagcaaattttggagctcaaaataatatttgagaaaaagtaatttggtttcatttgtttatgcctggctgctggttagtagaagggcttgtgaaaataacatctggccccagttcttaatttccagccttaggcttaatttctagtccctatcagcaacaatctggcaccgttctgatgttctcatgcagctacatcatttgtggaaaggttgtacttcaactcacactgttttttttgctttgttttgtttggttttgttttgctgctgttatc

SEQ ID NO: 52543 - DNA, 601 bp, Human
tctgaaggtaaaaataactcaagaaccactaattcttattactgttgaaaaacatgaatttaaaagttactttgtaacacaactaagctaattctgagctaatacatattatctctgaaagaatatttaagctctagacatccattaaagaatagaaatgacaagcggttttggtggaaccaagaaagtgtctggataaacatttgtcagagattgcacagtggacaaacccaaacaaatatttcatcccacagctttattacaagagtccatgatgtctctggtataaaaaaaccctcaycccttaaaatgcagtgaaactgatgaatgaatgtcatgaagggaatttaaatatcatagcatcataggactgtagaacagtgtgttaggcatttcaaccatggattgcttgagggttccctatatcagagccaacaatttccactccattgctgctggatttttgcacatccaaagatactgctccctgaagcagccacttaacaagtgagaagcccatccacatcccaaacccccattcattcattatctccaaccactcaaaacaaacctgcactctcttcaaaatgacagccattca

SEQ ID NO: 52544 - DNA, 601 bp, Human
acgcaattccacttagctagaagagcccatacttggtgctgtcagggaagaaacgctctgaattttactcatcattacagtttttatgaaattgacaacttccctccaaacaattcttaaactcaagctaagagtttatgaaactcacacttttcttgggctatcacatgaaagtttttactgtagtcaagtatggaaaatctgaaacaaccttcacataacctacaaatgtaacttttcttcaatgagctcaaaacatagatatttaattttaattcctctttagataatacattggccrcacatgtacttggaattttaatatttaagtttcctttctgagtgaaaaataactcacttttttcttttttttttttttgagatggagtctcactctgtcacccaggctggaatgcagtggtgcaatctcgtctcactgcaacctccgcctcctgggttcaagcaattctactacctcagtctccaaagtagctggaactacaggcatgcgccaccatgcctggctaatttttgtatttttagtagagactggattttgccatgttggccaggctgttatcaaactcctgatcccaagtaa

SEQ ID NO: 52545 - DNA, 601 bp, Human
tactcatcattacagtttttatgaaattgacaacttccctccaaacaattcttaaactcaagctaagagtttatgaaactcacacttttcttgggctatcacatgaaagtttttactgtagtcaagtatggaaaatctgaaacaaccttcacataacctacaaatgtaacttttcttcaatgagctcaaaacatagatatttaattttaattcctctttagataatacattggccacacatgtacttggaattttaatatttaagtttcctttctgagtgaaaaataactcacttttttcttttttttttttttgagatggagtctcactctgtcacccaggctggaatgcagtggtgcaatctcgtctcactgcaacctccgcctcctgggttcaagcaattctactacctcagtctccaaagtagctggaactacaggcatgcgccaccatgcctggctaatttttgtatttttagtagagactggattttgccatgttggccaggctgttatcaaactcctgatcccaagtaatctgtccccctcggcctcccaaagtgctgggataacaggtatgagccaccacactgggcctacaa

SEQ ID NO: 52546 - DNA, 601 bp, Human
ttcccctttaaactatatggattgtttatttttgttcattttagggaaaatatgcttgaaaacatgtgaccttgggaagtgactcaagttattactattataaccacagctttccacataatagctaaacttcataccaatagcttaattttttttcacctccgacaggcaaccaaaacttatgggagaaacaaaattatgaccaaactcttggaccgaatgaatttttacattcttcctgtgttcaatgttgatggatatatttggtcatggacaaaggtactgctctctactctcttgyttgcatttagatattatttgctggctttaatacacaatgttatgcattcagcttagggtttaggtaactagttaattctaattcagaaaagtatattttttaaaatctcagtttcaaattaagtatgatttcttggttgcataggtatccttgaaataatataaaatttttgctgctgaagctagttatgtgggaaaatgaaataaagtagtaattacagaggaaatgtatgattgcattatatgatatggcatatctagctaagaataaagccaattaattgattttaaaacaaaaacc

SEQ ID NO: 52547 - DNA, 601 bp, Human
tgtgagctttaaaaaaaaagtctgcatatgggttccaatgaatcacaggaagtgacagagtgaatgggtgcatagagggataaatattttgaattgctatagaagaaaataaataaaacagaaaaagtttagtggcccagatcccatggtgattggcaaatatagcactttcagtaatagctgtggtccaaatactgcctcataaaatattttaaaatttttaagaggttacaattttcattctgacctcagtccattgtatttagcacaacagcatttaatgttaattggagcagagacytgaatcagtcattaaaatcatctccatatatacaacaaagaagacataccagcaatatatggcccatagtcatttattatccaatgtaggtgataatctgagggcgtgagttcaattaatgcataccaatgtacagcactgtgatttcaatccactgttaggaaaatgatattatgggttaaaaaaaatacatatccacaaaaaaaaaaaccactttgagtaaaatgagagttcttgcatagcaactaaattgattaagaaaaaaattatttattggttatatacgttatatgtatagtc

SEQ ID NO: 52548 - DNA, 601 bp, Human
cacaggaagtgacagagtgaatgggtgcatagagggataaatattttgaattgctatagaagaaaataaataaaacagaaaaagtttagtggcccagatcccatggtgattggcaaatatagcactttcagtaatagctgtggtccaaatactgcctcataaaatattttaaaatttttaagaggttacaattttcattctgacctcagtccattgtatttagcacaacagcatttaatgttaattggagcagagacctgaatcagtcattaaaatcatctccatatatacaacaaagaaracataccagcaatatatggcccatagtcatttattatccaatgtaggtgataatctgagggcgtgagttcaattaatgcataccaatgtacagcactgtgatttcaatccactgttaggaaaatgatattatgggttaaaaaaaatacatatccacaaaaaaaaaaaccactttgagtaaaatgagagttcttgcatagcaactaaattgattaagaaaaaaattatttattggttatatacgttatatgtatagtcttttaaaaatctttgtgagtgcaaatatgttagtaactatatt

SEQ ID NO: 52549 - DNA, 601 bp, Human
cataaaatattttaaaatttttaagaggttacaattttcattctgacctcagtccattgtatttagcacaacagcatttaatgttaattggagcagagacctgaatcagtcattaaaatcatctccatatatacaacaaagaagacataccagcaatatatggcccatagtcatttattatccaatgtaggtgataatctgagggcgtgagttcaattaatgcataccaatgtacagcactgtgatttcaatccactgttaggaaaatgatattatgggttaaaaaaaatacatatccacaaaaaaaaaaaccactttgagtaaaatgagagttcttgcatagcaactaaattgattaagaaaaaaattatttattggttatatacgttatatgtatagtcttttaaaaatctttgtgagtgcaaatatgttagtaactatattccattaaaattcattctgacaatcactctcatagcacaaaacactaacgtgtattaaaaggtcatgacaaaatgccactctgaaagagacaccctaattaacaactattttaaaaagcggtcaaccacccttcttcccttggtatgctgaagtcaga

SEQ ID NO: 52550 - DNA, 601 bp, Human
taattaacaactattttaaaaagcggtcaaccacccttcttcccttggtatgctgaagtcagatgagtagagaagatcctgtagcaatatgagcctgttagggaccaaggaatgtaaaacatggaagaaaatggagaaactgtcagaagagacaattatctgaagccaaaaaaattgacaggaaaaataatgtatattttatattttagaagaaaggaatgaggagagagagagaaagaagagtagaaacacaaaatgagatatggcattactgtatataatcgactgcatatttaagtctttttttttttttttttttttttagacggagtctcgctctgtcaccaggctggagtgcagtggcgcaatcttggctcactacaacctccgactccctggttcaagcgattctcctgcctcagcctcccaagtagctgagactacaggcacatggcaccacccccagctaattttttgtatttttagtagagacggggtttcaccatgctagccaggatggtctccatctcctgacctcatgatctgcccacctcagcctccgcaagtgctgggattacaggcgtgagccaccgtgcccggc

SEQ ID NO: 52551 - DNA, 601 bp, Human
cttccaccaccaaagatacactcatatttttattacacttttagaatctgtgcattaaaaaatacatatgtgcatatgaattcaggattccttgcaacaattttacctgaccacagtttttaagtcactttcgtattccaagctgaaagtataaactttgaactgaaagtctacatcctcagcaattgcgatggaatttgaaaatgccggaatcaacatatacagtttctaggacttacttattagatgcttctttggcagaactggaaaatgactaaaaaatggacaagtccctttcctygagcacattcattaacaatcacctatcaaccagtcactgttaaggtgctgaagaaaaagtgtagtgatacagatgatccccagcatccacatagatcttgctacaacctagccatgctggggactcattacacatacaggtggatgaccacaagatttcaaaatacatgttatgtacccagctatgtgagtggacaaaaagtaagcaaagtaaagaacaagaagacagactagaagatcagtttaaaatggcagcccacttagtagatactaataaatagcagggccagattggccaccc

SEQ ID NO: 52552 - DNA, 601 bp, Human
attagaatcatcaggaagctggccaggcctggtggctcacttttgtaatcctagcactttgggaggctgaggagggcggatcacaaggtgaggagtttgagaccagtctggccaacatggtgaaaccccatctctactaaaaatacaaaaattagctgggcgtaatggtgggcacctgtaatcccagctactcagaaggctgaggcaggagaatcacttgaaaccagaaggcggaggttgcagtgagccaagatcacgccactgcacttcagcctgggtgaaagagcaaaactccatctcaaaaaaaaaaaaaaaaaagaatcatcaggaagcttttaaaatacatgaatgattatacccccagcccccagagattctgatttcatcagtctgaggaggagctcggcactcaatttttttttaagtaccttaagtgattctaagatgaaactagggttgagaatcgctgatctaagcaaaacttctcatttatagactgaaattcagatacagaaatatttcatcactttagggcagaagaaaaacaaaaatcagcattcaagaccagagttaaaatggtatacctaccactttgccccaa

SEQ ID NO: 52553 - DNA, 601 bp, Human
aggagtttgagaccagtctggccaacatggtgaaaccccatctctactaaaaatacaaaaattagctgggcgtaatggtgggcacctgtaatcccagctactcagaaggctgaggcaggagaatcacttgaaaccagaaggcggaggttgcagtgagccaagatcacgccactgcacttcagcctgggtgaaagagcaaaactccatctcaaaaaaaaaaaaaaaaaagaatcatcaggaagcttttaaaatacatgaatgattatacccccagcccccagagattctgatttcatcagtytgaggaggagctcggcactcaatttttttttaagtaccttaagtgattctaagatgaaactagggttgagaatcgctgatctaagcaaaacttctcatttatagactgaaattcagatacagaaatatttcatcactttagggcagaagaaaaacaaaaatcagcattcaagaccagagttaaaatggtatacctaccactttgccccaaagcagcaatattgagatggcacaaaaaagtaaatagtaatgtttaatgtgaaatgattatatttgcatataaacagcatatccaatcctt

SEQ ID NO: 52554 - DNA, 601 bp, Human
atgtgaaatgattatatttgcatataaacagcatatccaatccttcatcatcttagaaataactaaacatagtacctagtgagcaagaatagttatttgagttgataagaaccaagattgcattagtaataaaattcatctgtgagtcacatcatgaattaaaaagttaatttcaaagtacatttcttgtagcttcctttgtgtaccaaaattgctagatctaccactgattctcaacccagtgctctttttccatattctacatattctactttttcaaaatttacattctgaaaaagacaagttaagacttgtagttcataacaccagatctctacttactaagagacattcaaactgatattacagagaaaatatttcagtgtatgcccatgtatctctggcttcagctcttgcttctaatataattttcacttagtattaatataaaagtacaggttattatattgaatacatttaaataatattttttaaaacgatacaatttttcagaaaacactgtatcaagtaagcaataaatgcagcacacattaagtcaccaacgtcactttatatggatccctttgggctgaaatcagat

SEQ ID NO: 52555 - DNA, 601 bp, Human
aagttaatttcaaagtacatttcttgtagcttcctttgtgtaccaaaattgctagatctaccactgattctcaacccagtgctctttttccatattctacatattctactttttcaaaatttacattctgaaaaagaaaagttaagacttgtagttcataacaccagatctctacttactaagagacattcaaactgatattacagagaaaatatttcagtgtatgcccatgtatctctggcttcagctcttgcttctaatataattttcacttagtattaatataaaagtacaggttatyatattgaatacatttaaataatattttttaaaacgatacaatttttcagaaaacactgtatcaagtaagcaataaatgcagcacacattaagtcaccaacgtcactttatatggatccctttgggctgaaatcagatttctagtttggtacggtttcattttgatttgttctcattgaatttgttgcaaccaatattgtgccttgaaataagtaggaaatattttcttaatgttgaacatactcagaatatgctgtcaacaaaaacaaaattatcttatagaactgagtaaagacttggt

SEQ ID NO: 52556 - DNA, 601 bp, Human
aagacaccacctgggcttgaatcctgattcgaccatctactagctatgtgtttttcagcaagttgcttaatctctctgagcctaggtttcttcttcggtaaaatggtaattgttacttacatttgggataggaattaattaaatgagttaacatgcataaagcacatagaagggtacttggtatttagcaagtgattattactgtattttataaatgcatacacatgttttagtaggtacacatggagataaagaaaaggctaagtatcatgttaaacaaattaagttctggccaggcacrgtgatgcacacctgtagtcccagctactcaggaggctgaggtggaagtatcacttcagcctgggacgtcgaggatacagtgagccatgatcatgccaccgcactccagccaaggtaacagagcaagaccctgtcacatacacacacacacacacacacacacacacatacacacacacacacacacaaattctatatttttttctcaaagtaaaaacttgcaatgttgtatttactttatgacttgatatagttttgtttgcaaatttaagatctagaagatatgaaatgtattctactt

SEQ ID NO: 52557 - DNA, 601 bp, Human
ttcctcctcctcctttttttctactctcccactgactgcttctaaaagtagacattttccaaaaaatagggtacaatatatggatacttcctcaggttctctcctcaggtccctcctcttacttctgactctcctcatcaagaaataacctctatccccacaggctggaatccctcatttgttacctagggcaccaggcaatcaccttttacccactaagtgaaccaaccagaccaaaatagcaatgcaaaggctttgaaaactatattgtcagctgagcacggtggctcatgcctgtaaycttagcactttgggaggccaaggtgggaggatcacctgagaacaggagtccgagaccagcctggccaacatggtgaaacccggtctctactaaaaatacaaaaattagctaggtgtggtggtacgcacctgtagtcccagctactcaagaggccgaggcaggagaattgcttgaacctggaaggcagaggttgcagtgagctgaaatcgtaccactccacttcagtctgggcaacaaagtgagactctatctcaaaaacaacaacaacaacaacaacaaaaaaccaaagcaaaactgtct

SEQ ID NO: 52558 - DNA, 601 bp, Human
ataacctctatccccacaggctggaatccctcatttgttacctagggcaccaggcaatcaccttttacccactaagtgaaccaaccagaccaaaatagcaatgcaaaggctttgaaaactatattgtcagctgagcacggtggctcatgcctgtaatcttagcactttgggaggccaaggtgggaggatcacctgagaacaggagtccgagaccagcctggccaacatggtgaaacccggtctctactaaaaatacaaaaattagctaggtgtggtggtacgcacctgtagtcccagctaytcaagaggccgaggcaggagaattgcttgaacctggaaggcagaggttgcagtgagctgaaatcgtaccactccacttcagtctgggcaacaaagtgagactctatctcaaaaacaacaacaacaacaacaacaaaaaaccaaagcaaaactgtctgggtgtggtggcacatgcctgtaatcccagcactttgggaggccgaggtaggcagattgcctgaggtcaggagttcaagaccagcctgaccaatatggtgaaaccctgtctctactaaaaatacaaaagttagccaggtgtggt

SEQ ID NO: 52559 - DNA, 601 bp, Human
gagggaataagacattctcatacaaagggaaatcagcagatgtgtgccccgcacacctactcttaatggctaaaagaaccctctgaacaagaaggaaataatcacagcaaaaggcttggaactgcagagaggaaggaagaaaaatggattcagtataaataaataaattaaataatagactatctttctccacatgatgattgaatcaaaaattgtaagtctgtttgatgtgatgttcaatgtatgtagagaagtactcaagacaattgtactttaaaagtgggaagggaaaaaggatctraaaggaagtaaagtttctacacctcacttgacatagtaaaatgtcaataccattagactgtggtaagttatgtatgtgtattatagtacctggagcaaccattaagaaaactaagcaagtgagactataaatcaatcaaatggaatcctaaaaatgtcatgtaaccaagaggaaggtgtaaagcaagaaaaaaaagataaagggataaaaacagaaagaacaaaaaaaaaaaaagaaataatggcatgtttaagtcatatcaataatttacctacacgcactaattaaagacacatgggc

SEQ ID NO: 52560 - DNA, 601 bp, Human
aatatgctgtttataagaaactcatttccaatataacaacacagataagttgaaatgagaatgatggaaaagatatactatgccataggaagaatagctacattaagtatcagataaagtgaatttcagagcaaagaaatttgctagtgacagagacattaacaatgataaaaggatccatcccaccaagaaaataatgatcctaaatgtgtgcacaccaatttcacctatgatgtctatgccaataatttaaacattcatttttccaagctctttcttgaatgtctgattgatgttaaaygtatcactttgtcttcctttgccttttctttttcccatcccaatgctctctgagttcccatttaacagtatgttttttccagctacccagattgaaacatcaatcatttttatgaaatcccaatgtttcttatgtagaatccctcagttgtttctaatgtggtgactctaccctagtcaggctttcatttcacactacttcataactggtttctattcttttcaatccagattaacaaacctaaagtactagaaggcctccaaaagaaaatctaaacacctagtcccgattcacaaggtt

SEQ ID NO: 52561 - DNA, 601 bp, Human
ggggaaacatcctcttaaaatgggcccttgtgcttgccttctggggaggcggtcctgagcaggggaatcataaggcatttgtgcatatgttatacgcagactgcacccaccccttccccccagcctttgcctcttgggttgttgtgctgctttccccttactttgctacatttctatagttgttggttttacttgaatgattcatgtttagggggaaaatgaaaatctcccttaaaattggtttcaactcctcctgcaaataaaataaatgaagtggcagatgtaacaaaaaaaaaaaaaagacagcccaggcaagcagcaccttcagctgactccttccgtactctgtatttgtcatctgtgtacctgtgatgaaaggtgatttgctgggctgatgacagcagtcatcagtcatatttgtattatagaatggaaaagtttgccatatactagcaagaataagcatatgattcctcttggtatgtatgaaatgtgccctacattaaacaatgaacactgtacaaacaatatgcaagtgttatgaatgttgtctgtctcagaatggcaggctggctcaatgcagagattctgggttttggag

SEQ ID NO: 52562 - DNA, 601 bp, Human
tcagcattttggtcacaaccatttaaccagccttgaagcagttccaaaccttctctcatcttcctgtcttcttctgagccctccaaactcttccaacctctgcctgtgacccagttccaaagccatttctacatcttcaaatatctttatagctacaccccactcatcagtaccaattttctgtatcagtccactttcgcattactataaaggtataccagagactgggcaatttataaagaacagaggtttaactggctcacggttctgctgactatacaagcgtagcaccaacacctaytcagcttctggtgagggcttcaggaacttttggttatggcagaaggcaaagtgggagcaggcacatcacatggtgacagtggaagcagtagcttatctatttactttttaaaacttcttcacttggctgagcaaggtggcttaggcctgtaatcccagcactttgggaggctgaggtgggaagactgcttgagcccaggagttcaagaccagccttgggcaacacagtgagatcctatccctaattaaagaaaaaaaattaataaaaaaaagaaaacccctccactagactgacaggaag

SEQ ID NO: 52563 - DNA, 601 bp, Human
tctatcagcattttggtcacaaccatttaaccagccttgaagcagttccaaaccttctctcatcttcctgtcttcttctgagccctccaaactcttccaacctctgcctgtgacccagttccaaagccatttctacatcttcaaatatctttatagctacaccccactcatcagtaccaattttctgtatcagtccactttcgcattactataaaggtataccagagactgggcaatttataaagaacagaggtttaactggctcacggttctgctgactatacaagcgtagcaccaacayctactcagcttctggtgagggcttcaggaacttttggttatggcagaaggcaaagtgggagcaggcacatcacatggtgacagtggaagcagtagcttatctatttactttttaaaacttcttcacttggctgagcaaggtggcttaggcctgtaatcccagcactttgggaggctgaggtgggaagactgcttgagcccaggagttcaagaccagccttgggcaacacagtgagatcctatccctaattaaagaaaaaaaattaataaaaaaaagaaaacccctccactagactgacag

SEQ ID NO: 52564 - DNA, 601 bp, Human
gggattataggcatgtgccaccatgcccggctaattttgtatttttagtagagatggggtttctccatgttggtcaggctggtcttgaactcccaacctcaggttatctgcctgccttgacctcccaaagtgctgggattacaggcatgagccaccgtgctcagccagtcatcactcttaagttcaaactcccacagacccctagggcatgaacacaataaagccaagctctttgttagggcataacatgagtaacctgtactgcagttcccaacagtttccccatttccatctgagaccygatcagcctggactttactgtcaatatctctatcagcattttggtcacaaccatttaaccagccttgaagcagttccaaaccttctctcatcttcctgtcttcttctgagccctccaaactcttccaacctctgcctgtgacccagttccaaagccatttctacatcttcaaatatctttatagctacaccccactcatcagtaccaattttctgtatcagtccactttcgcattactataaaggtataccagagactgggcaatttataaagaacagaggtttaactggctcacggttc

SEQ ID NO: 52565 - DNA, 601 bp, Human
acttgcatgttttccaggaagaaggtgcaagctgccagtgaatctatcattctggaatatggaggatggtgggtgatgtggtttggctctgtgtccccacccaaatctcatcttgaattgtaataatccccatgtgtcaagggcaggcctaggtgaagataattgaatcatgagggcagttccccccatactgttctcgtgatagtgagtgagttctcacgagatctgatagttttctaaggggcttcctccttcacttggttttcacttctctcacctgccaccatgtaagacgtgcctrtttcacttctgccatgattgtaagtttcctgaggactccccagccatgttgaactgtgagtcaattaaacctctttcctttataaattacccattttcaggcatgtctttattagcagtgtgagaacagactaatacagtgggcccccaccaacagctccatgaggcagtgccctggtggggacactgtggtggggactggaatccacatctcccctaggcattgccttagtagagtttctctctaggggctccacccctgtggcaggcttctgcctggacacccaggcttttccatata

SEQ ID NO: 52566 - DNA, 601 bp, Human
ctcagtcttcagtttacccctccccagtcaccttgggcacactcccacaacagttccagtcaccctgaaagcctcccaaaacatcaggcttaagattactcttctgtccatcctctaacattttccccttcacctggctaactcctagctcattcctgatgtcttagcacggaggtcactttttctaacagctttcctcagtgctacaagttgagttgatggtgctccagtaagaaccacagcacatgatagatgttttagtttatttttatattgctataaaggaatacctaaggctggkgaatttataaataaaagaggtttaattggctcacaattcaacaggctgtacaagcatggcaccaacatctgctcagcttctggtgagggcctcaggaagcttataatcatagcagaaggtaagtgggagcaggcatgtcatgtggcaagagtgggagcaagagagaggggaaaggtgccacagtcttttaaacaaacagatctcatgtaaaataccagagtgagaactcactcatcacccaggggatgatgctaagccattcacgagggatcatgacaactataaaacattgatgaaaaa

SEQ ID NO: 52567 - DNA, 601 bp, Human
tagttcttatgatgaccttacaaggtaagtactaatagtatccccattttgaccccatttttactcccatcttgcaaattagaaaagtgatatttaaaaaggttataacaatgccctgtacaatatcacaagcaattcaatgtccaatggttctgctatcaggaaacaacagagcaaagattcctggtggttacagaatctattctcatgatcattgctgcataccagtccctgaaggtcttttgcttctgcttcccaaatacctcagcattgaccttgactcaggctgctatgggttctyccctgtggcagcctctcaacgagcatggcgtttttgaattcattctccatcccatagttagaatgtgatcacatcactcccctactaaatcctcacaggctttacaatatctgaactactcagtcttcagtttacccctccccagtcaccttgggcacactcccacaacagttccagtcaccctgaaagcctcccaaaacatcaggcttaagattactcttctgtccatcctctaacattttccccttcacctggctaactcctagctcattcctgatgtcttagcacggaggtcacttt

SEQ ID NO: 52568 - DNA, 601 bp, Human
tacacctgtaatcacagcactttgggaggccaaggcaggcgaatcacttgaggtcaggagtttgagatcagcctggccaacatggtgaaaccccatctctactaaaaatacaaaaattctctgggcatgatggcaggcgcctgtaatcccaggtacctgggaggctggggcaggagaattgcttgaactcaggaggcagaggctgcagtgagccgagatcataccactgcactccagcctgggcgacagagcaaggctccatctcaaaaaaaaaaaaaacaagaaaagaaaagaaaaaaawatatatatatatatttaaaaaagatcacacaggaggccggacgcagtggctcatgcctgtaatcccagcactttgggaggccgaggcgggtggatcatgaggtcaggagattgagactatcctggctaacatggtgaaatcccgtctctaccaaaaaatacaaaaaattagccgggtgtggtggtgggcgcctgtagtcccagctactcgggaggctgaggcaggagaatggcgtgaacccaggaggtggagcttgcagtgagccgagatcacgccactgcactccagcctgggcgacag

SEQ ID NO: 52569 - DNA, 601 bp, Human
agggatgggcgcagtggcttacacctgtaatcacagcactttgggaggccaaggcaggcgaatcacttgaggtcaggagtttgagatcagcctggccaacatggtgaaaccccatctctactaaaaatacaaaaattctctgggcatgatggcaggcgcctgtaatcccaggtacctgggaggctggggcaggagaattgcttgaactcaggaggcagaggctgcagtgagccgagatcataccactgcactccagcctgggcgacagagcaaggctccatctcaaaaaaaaaaaaaacawgaaaagaaaagaaaaaaatatatatatatatatttaaaaaagatcacacaggaggccggacgcagtggctcatgcctgtaatcccagcactttgggaggccgaggcgggtggatcatgaggtcaggagattgagactatcctggctaacatggtgaaatcccgtctctaccaaaaaatacaaaaaattagccgggtgtggtggtgggcgcctgtagtcccagctactcgggaggctgaggcaggagaatggcgtgaacccaggaggtggagcttgcagtgagccgagatcacgccactgc

SEQ ID NO: 52570 - DNA, 601 bp, Human
gatggttaatacatacaaaaatataggtagatagaaagaataagatctagtatttgacagcacaacagggtgactacagccaacaataatttattgtacattttaaaataagaatataatctgaatgtttatatcacagagaaatgataaaagcttgaggtgatgataccccatttaccctgatgggattattgttcattgtatgcctgtatgaaaatatttcacccacttcataaatatatgtacctactatgtactcataaaaattaaaaataaaaaaattattaaagggatgggcgcrgtggcttacacctgtaatcacagcactttgggaggccaaggcaggcgaatcacttgaggtcaggagtttgagatcagcctggccaacatggtgaaaccccatctctactaaaaatacaaaaattctctgggcatgatggcaggcgcctgtaatcccaggtacctgggaggctggggcaggagaattgcttgaactcaggaggcagaggctgcagtgagccgagatcataccactgcactccagcctgggcgacagagcaaggctccatctcaaaaaaaaaaaaaacaagaaaagaaaaga

SEQ ID NO: 52571 - DNA, 601 bp, Human
agaacagtatggtggtgtctcaaaaaactaaaaaactaccatatgatccagcaatcccactgctaggtatacacgcaaaataaagaaaatcattatatcgaagagatgtctgcactccatgttcactgcagcactattcataatagccaagatttggaatcaacctaagtgttcatcagtagatgaatggatagagaaaatatggtacacatacacaatagagtactgttcagccataaaaagaataagatcctgtcatttgcaacacagatggaattggaacacattatggtaagtgaartaagccaggcacagaaggacaaactttgcatgttctcaatcatttgtgaaaggtaaaaattaaaacacttgaatgcatggagatagagtgtagaatgatgattaccagaggctgggaaagatagtgaaggtggatgcaagtggggatggttaatacatacaaaaatataggtagatagaaagaataagatctagtatttgacagcacaacagggtgactacagccaacaataatttattgtacattttaaaataagaatataatctgaatgtttatatcacagagaaatgataaaagctt

SEQ ID NO: 52572 - DNA, 601 bp, Human
aattagaactaataaacaaatttcataaagttgcaggatacaaagccaacatacaaaaatcagtagcatttctatatgccaacagcaaacaatctgaaaaagaaatcaagataatatcccatgtacaataactataaataaaattagatacctggaaataagcttaacgaaagaagtggtgatctataccatgacaactataaaacattgatgaaaaaagttgaaaaggacacaaataaatggaaatatattccatgttcatggattggaagaatcagtattgttaatatgcctacactaygcaaagcaatctacagatttaatgaaagctttatcaaaataccaatgacattcttcacataaacagaaaaaaaaaatcctaaaatgtatatggaaccaccaaagacctagaatagtcatagccattttgagcaaaaagaacaaaactggaggaatcacattacttgacttcaaattatatcacagagctatagtaactgaaacagcaaggtactggcataaaacagaaacacagaccaatgggacagaatagagaacccagaatagagaacccagaaatcaatctatacatctacagtga

SEQ ID NO: 52573 - DNA, 601 bp, Human
aaaattcaatatcccttcatgatgaaaaccctcaacaaactgggtaatgtgttgaggaatatacctcaacacgataaaagccatatatgacagacccacagttagtgtcacacttaatgggaaaaaactgaaagcctttcctctaagattgggaatacaacaaggatgcccactttcaccactgtttgtttgtttgtttgtttgtttgtttgtttgagacggagtttcattcttgtcgcccaggctggagtgcaatggtgcgatctcagctcactgcaacctctgcctctcaggttcaagygattttcctgcctcagcctcccaagtagctgggattacaggtgccggccactgcacacagctaatttttgtattttttagtagagatgggtttttaccatgttggccaggctggtcgtgaactcctgacctcaggtaatccacccacctagtcctcccaaagtgctgggattacaggtgtaagccaccgtgcatggctccactttcaccactgttattcaacatactactggaagttctagctagagcaatcataaaagagaaaaacataaagggcatacaaattggaaaagaagaagtc

SEQ ID NO: 52574 - DNA, 601 bp, Human
tacatcatatcaacagaagataaaaaccatctgatcatttcaattaatcttgaaatactatttgataaaattcaatatcccttcatgatgaaaaccctcaacaaactgggtaatgtgttgaggaatatacctcaacacgataaaagccatatatgacagacccacagttagtgtcacacttaatgggaaaaaactgaaagcctttcctctaagattgggaatacaacaaggatgcccactttcaccactgtttgtttgtttgtttgtttgtttgtttgtttgagacggagtttcattcttrtcgcccaggctggagtgcaatggtgcgatctcagctcactgcaacctctgcctctcaggttcaagcgattttcctgcctcagcctcccaagtagctgggattacaggtgccggccactgcacacagctaatttttgtattttttagtagagatgggtttttaccatgttggccaggctggtcgtgaactcctgacctcaggtaatccacccacctagtcctcccaaagtgctgggattacaggtgtaagccaccgtgcatggctccactttcaccactgttattcaacatactactggaa

SEQ ID NO: 52575 - DNA, 601 bp, Human
aatcaaagaatgtgatacatcatatcaacagaagataaaaaccatctgatcatttcaattaatcttgaaatactatttgataaaattcaatatcccttcatgatgaaaaccctcaacaaactgggtaatgtgttgaggaatatacctcaacacgataaaagccatatatgacagacccacagttagtgtcacacttaatgggaaaaaactgaaagcctttcctctaagattgggaatacaacaaggatgcccactttcaccactgtttgtttgtttgtttgtttgtttgtttgtttgagayggagtttcattcttgtcgcccaggctggagtgcaatggtgcgatctcagctcactgcaacctctgcctctcaggttcaagcgattttcctgcctcagcctcccaagtagctgggattacaggtgccggccactgcacacagctaatttttgtattttttagtagagatgggtttttaccatgttggccaggctggtcgtgaactcctgacctcaggtaatccacccacctagtcctcccaaagtgctgggattacaggtgtaagccaccgtgcatggctccactttcaccactgttattc

SEQ ID NO: 52576 - DNA, 601 bp, Human
attagccgggcgtggtggcaggcgcctgtagtcccagctcctcgggaggctgaggcaggagaatggcgtgaacctgggaggcagagcttgcagtgagccgagatcacgccactgcactccagcctgggtgacagagcgagactccgtctcaaaaaaaaaaatcatttaaaaagaaaagctaatactaatgctactcacactattccaaaaaatagaggaggagtgaattcttccaaactcattctatgaagtcagtattaccctgataccaacaccagacaaagacacattaaaaaaaaaragagagaaagaaaaggaaaaaggaacaaaaagaaaaaagaacactataggccaatatctctgatgaacattgatgcaaaaatccttaacaaaatactagcaaactgaattcaacaacacattaaaaaataattcaccatgaccaagtggaatttatctcaaggatgcaagaatgattcaacatatgcaaatcaaagaatgtgatacatcatatcaacagaagataaaaaccatctgatcatttcaattaatcttgaaatactatttgataaaattcaatatcccttcatgatgaaaaccc

SEQ ID NO: 52577 - DNA, 601 bp, Human
tagaaacacacaacctaccaagatggaaccacaaagagattcaaaacctgaagagaccaaaacaatgagatcaaagctataataaaaagtatgccagcaaaaaaaaacctgggactctatggcttcgctgctaatttttacaaaacatttaaaaagaaggccgggcgcggtggctcatgcctgtaatcccagcactttgggaggccgaggtgggtggatcacgaggtcaggagatcgagaccatcctggccaacacggtgaaaccccgtctctactaaaaatacaaaaaattagccgggcrtggtggcaggcgcctgtagtcccagctcctcgggaggctgaggcaggagaatggcgtgaacctgggaggcagagcttgcagtgagccgagatcacgccactgcactccagcctgggtgacagagcgagactccgtctcaaaaaaaaaaatcatttaaaaagaaaagctaatactaatgctactcacactattccaaaaaatagaggaggagtgaattcttccaaactcattctatgaagtcagtattaccctgataccaacaccagacaaagacacattaaaaaaaaaaagagagaaaga

SEQ ID NO: 52578 - DNA, 601 bp, Human
atatgccaataaattggaaaacctagaagaaatgaataaattcctagaaacacacaacctaccaagatggaaccacaaagagattcaaaacctgaagagaccaaaacaatgagatcaaagctataataaaaagtatgccagcaaaaaaaaacctgggactctatggcttcgctgctaatttttacaaaacatttaaaaagaaggccgggcgcggtggctcatgcctgtaatcccagcactttgggaggccgaggtgggtggatcacgaggtcaggagatcgagaccatcctggccaacacrgtgaaaccccgtctctactaaaaatacaaaaaattagccgggcgtggtggcaggcgcctgtagtcccagctcctcgggaggctgaggcaggagaatggcgtgaacctgggaggcagagcttgcagtgagccgagatcacgccactgcactccagcctgggtgacagagcgagactccgtctcaaaaaaaaaaatcatttaaaaagaaaagctaatactaatgctactcacactattccaaaaaatagaggaggagtgaattcttccaaactcattctatgaagtcagtattaccctgata

SEQ ID NO: 52579 - DNA, 601 bp, Human
tataaacacatggaaattaaacaatgctcctgaatgaccagtgaatcaatgaagaaatcaagaaacaactttaaagatttcttgaaattctggcatggcattgattgagaaaaaatttaaaatttaaaaatttttttttaaaagaaaaaatttcttgaaacaaataaaaataaaaacacaacataccaaaacctatgggatacagcaaaagcagtagtaagaggaaagtttatagcaataaatgcctacatcaagaaagaggaaaaacttcaaataaacaacttaatgatgcatcttaaaraaccagaaaggcaagagcaaaccaaacccaaaattagtagaataaataataaagatcagagcagaaataaacaaaaatgaaatttaaaaaacaatacaaaggaacaataaaatgaaaatttcttttttttttgaaaagataaaatcaacaaacctttagccagactaggaaaaaaagaaagaagactcagataaataaaatcagagatgaaaaaggagacattataactgataccacagaagttcaaaagatcattagagactactatgagcaactatatgccaataaattggaaaacct

SEQ ID NO: 52580 - DNA, 601 bp, Human
aacatttcatccaatggctacagaattaacattcttctcctcaagacatggatcattctcaagaacagaccatttattaggctatgaaaacactgcaatcattttaagtattttctctgttcacaatggaataaaacgagaaatcaataacataaggaactttgaaaactatataaacacatggaaattaaacaatgctcctgaatgaccagtgaatcaatgaagaaatcaagaaacaactttaaagatttcttgaaattctggcatggcattgattgagaaaaaatttaaaatttaaaawtttttttttaaaagaaaaaatttcttgaaacaaataaaaataaaaacacaacataccaaaacctatgggatacagcaaaagcagtagtaagaggaaagtttatagcaataaatgcctacatcaagaaagaggaaaaacttcaaataaacaacttaatgatgcatcttaaagaaccagaaaggcaagagcaaaccaaacccaaaattagtagaataaataataaagatcagagcagaaataaacaaaaatgaaatttaaaaaacaatacaaaggaacaataaaatgaaaatttcttttttt

SEQ ID NO: 52581 - DNA, 601 bp, Human
taatataataatagctagagactttagcaccctgcttttagcattgcacagatcatccagacagcaaatcaacaaagaaacatcagacttaatctgcactatacaccaaatggacctagtagatgtttacagaacatttcatccaatggctacagaattaacattcttctcctcaagacatggatcattctcaagaacagaccatttattaggctatgaaaacactgcaatcattttaagtattttctctgttcacaatggaataaaacgagaaatcaataacataaggaactttgaaaastatataaacacatggaaattaaacaatgctcctgaatgaccagtgaatcaatgaagaaatcaagaaacaactttaaagatttcttgaaattctggcatggcattgattgagaaaaaatttaaaatttaaaaatttttttttaaaagaaaaaatttcttgaaacaaataaaaataaaaacacaacataccaaaacctatgggatacagcaaaagcagtagtaagaggaaagtttatagcaataaatgcctacatcaagaaagaggaaaaacttcaaataaacaacttaatgatgcatctta

SEQ ID NO: 52582 - DNA, 601 bp, Human
atagagatagatcctaatataataatagctagagactttagcaccctgcttttagcattgcacagatcatccagacagcaaatcaacaaagaaacatcagacttaatctgcactatacaccaaatggacctagtagatgtttacagaacatttcatccaatggctacagaattaacattcttctcctcaagacatggatcattctcaagaacagaccatttattaggctatgaaaacactgcaatcattttaagtattttctctgttcacaatggaataaaacgagaaatcaataacatarggaactttgaaaactatataaacacatggaaattaaacaatgctcctgaatgaccagtgaatcaatgaagaaatcaagaaacaactttaaagatttcttgaaattctggcatggcattgattgagaaaaaatttaaaatttaaaaatttttttttaaaagaaaaaatttcttgaaacaaataaaaataaaaacacaacataccaaaacctatgggatacagcaaaagcagtagtaagaggaaagtttatagcaataaatgcctacatcaagaaagaggaaaaacttcaaataaacaactt

SEQ ID NO: 52583 - DNA, 601 bp, Human
gatttcaagtcaaaaactataaaaataggcaaagaaggtcattatataatgataaaggcatcaattcagcaagataatacaacaattataaatatatacatgcactcaacaatggagcatccagatatataaagcaaatattattagagctaaagatagagatagatcctaatataataatagctagagactttagcaccctgcttttagcattgcacagatcatccagacagcaaatcaacaaagaaacatcagacttaatctgcactatacaccaaatggacctagtagatgtttacaraacatttcatccaatggctacagaattaacattcttctcctcaagacatggatcattctcaagaacagaccatttattaggctatgaaaacactgcaatcattttaagtattttctctgttcacaatggaataaaacgagaaatcaataacataaggaactttgaaaactatataaacacatggaaattaaacaatgctcctgaatgaccagtgaatcaatgaagaaatcaagaaacaactttaaagatttcttgaaattctggcatggcattgattgagaaaaaatttaaaatttaaaa

SEQ ID NO: 52584 - DNA, 601 bp, Human
tctacagcagaatggcttaaacagaagaaagtattagtgagcttcaagacaggctatttgaaaatacatgggcatgcttggagtggtggctcatgcctataatcctagctctttgagaggctgaggtgggtggatcacttgagctcaggagttcaagactagcctcggcaacatggtgaaaccccatctctccaaaaccacaaaaattagtggggcatggtggtttgcacctgtagtcccagctacttgggaggctgaggcaggaagattgcttgagcccaggaggtggaggttgcagtgrgctgagatcatgccactgcactccaacctgggtgacagagtgagaacctatctcaaaaaaaaaaaaaaaaaaaaaagcaaagaagacagaaaaaaaaaaagaataacccaaataagaccatatcaagacatttaataatcaaactcccagaggtcaaggataaagaaaggatcctaaaagcagcaaaagaaaagaaacaagtaacacataaaggagttccagtgggaaccttgcaggccgggaaacaatggcatgacatatttaaagtactgaaagaaaaaaatgtttatcttagaaaac

SEQ ID NO: 52585 - DNA, 601 bp, Human
caatgaacttcaaggtaacacagaaaaggaattcaaaatcctattagataagtttaacagaaattgaaataaattttaaaaatcaaggagaaattctggagctgaagaattcaattgagaaactgaagaatgcatcagagtctctctacagcagaatggcttaaacagaagaaagtattagtgagcttcaagacaggctatttgaaaatacatgggcatgcttggagtggtggctcatgcctataatcctagctctttgagaggctgaggtgggtggatcacttgagctcaggagttcaaractagcctcggcaacatggtgaaaccccatctctccaaaaccacaaaaattagtggggcatggtggtttgcacctgtagtcccagctacttgggaggctgaggcaggaagattgcttgagcccaggaggtggaggttgcagtgagctgagatcatgccactgcactccaacctgggtgacagagtgagaacctatctcaaaaaaaaaaaaaaaaaaaaaagcaaagaagacagaaaaaaaaaaagaataacccaaataagaccatatcaagacatttaataatcaaactcccagaggtca

SEQ ID NO: 52586 - DNA, 601 bp, Human
acattgtgaagattagaataaatacctaactcctcagtacccagacattgatgaatattcacaagcatcaagaccatccagaaaaacaggacctcaccaaatgaactaaataagaaaccagtaaccaatcccagagtgaccgagacatgcgaccttttagagacagaattcaaaatagctgttttgaggaagctcaatgaacttcaaggtaacacagaaaaggaattcaaaatcctattagataagtttaacagaaattgaaataaattttaaaaatcaaggagaaattctggagctgaaraattcaattgagaaactgaagaatgcatcagagtctctctacagcagaatggcttaaacagaagaaagtattagtgagcttcaagacaggctatttgaaaatacatgggcatgcttggagtggtggctcatgcctataatcctagctctttgagaggctgaggtgggtggatcacttgagctcaggagttcaagactagcctcggcaacatggtgaaaccccatctctccaaaaccacaaaaattagtggggcatggtggtttgcacctgtagtcccagctacttgggaggctgaggcag

SEQ ID NO: 52587 - DNA, 601 bp, Human
ccctcccccaactccaggcagctcagaatggagagagagattctatttgagggaaagtagggaagagaatagaagactgcctggtaatccagggaatcctcccagttcttatctaagactaccaaggcagtacttctacaagtctgcaagagtcatggcattactgggattggggtgcctcctaatgcatatatggcttcagtgaccaaagacttagatcacaacactcaatttcctttgagtacttggaaaacattctcgagaaatgtgagtgcaaacaagcccacattgtgaagattakaataaatacctaactcctcagtacccagacattgatgaatattcacaagcatcaagaccatccagaaaaacaggacctcaccaaatgaactaaataagaaaccagtaaccaatcccagagtgaccgagacatgcgaccttttagagacagaattcaaaatagctgttttgaggaagctcaatgaacttcaaggtaacacagaaaaggaattcaaaatcctattagataagtttaacagaaattgaaataaattttaaaaatcaaggagaaattctggagctgaagaattcaattgagaaa

SEQ ID NO: 52588 - DNA, 601 bp, Human
gcatttgtagatctgccctaggtctgaaggaaacccactgtcctgaagggagatacaaagacctgacaggattcacctgcttactaaagggtccttgtgccttgaataaacatcagcagtagccaggcagttgttgccatggacctggggctcatggtggtggtggacatggggagagacttctgcttgaggaaaagagagacttctgcttgaggaaaggagagggaagaataaaaaggtcattttcttgcaatgtgggtaccagcttagccacagtaaaataaagtactaaatagattcctaaagttcccaattccaggtcctagcttccagacagcatatctagacccaccctgggccagaagggaacccactgccctgaagggaaagacgcaagcctggcaggattcatcacctcttgactaatgagcccttaggccttgagtaaacataagcaatagccaggcaataattgacacaggccttgggcgagacccagtactttactggctttaggtgtgatccagcacagtcccagcaatggtggccacaagagtgcttgtgtcacccctcccccaactccaggcagctcagaatggag

SEQ ID NO: 52589 - DNA, 601 bp, Human
actctgtcgtccaactacctcaccctaaggtcagttaccttttgccctcaggaatatgtttgaaggagccacagactgcaggaactgaaaataagcattacttttattgttgcctctaggccccaggttcactactgacagtctcccccaggccttccctctcattgagttctaccagcagcaattatcttacccatattaccttttacctactgcaattttagagcttacctacttcaactgcaattttagagcctgggttcccctagcaacttgccccgcgtgcttatctgtaagatarctgcatcatagcctctagaactaactggaactcactactgagttgctctcctggtgaatcctgccctgactctgatcatttcttcatcctgtagccagagcaatctctcatttcttctttaataatgtttttagtttaaatctatttgaaaagagatggcatgcctgacattcaacctgtaatattagaggcaaaaagattttttaaaaagtgtaccattaggtatatccagacttttacaaccaattacagtagctaataatataccaggttcacatgttaactcatttaatccttata

SEQ ID NO: 52590 - DNA, 601 bp, Human
tgccccacaatgacataaatgactccagtttgttctatctctgctctaccattcttggagtattcgagcttggttttcaggctagatccattcatggtcacaacatagtagccctatttccaggcatcacatctcagacatcaacatcagtggaagaaaagagactgactattccttaggtatcctttaagagtgaagaaaccagctagggatggtggccagtagctgaagtccaaggctataaggaggctgaggctggaggatcccttgaggccaggagttcaaggctatggtcataccwatgaatacctatgaatagccactgcactccagcctgggcaatacatacagcaagacaccatctctctctatatatatataaataatagagtgaagaaatctttcccaaagacctcctaggcaacttttctctatgtctcattgactacactgggttacacacacacacctaaaccaatgctaggaaatgaaatagattattatgattggtgtagactatcaggatttacccctgagctaggaatagggtcatattccctgagggatagataaatactaagcaggcactaaaaagaggctg

SEQ ID NO: 52591 - DNA, 601 bp, Human
ataacatatggtatttgttatatcatgggacaaaatcaacttggggtacatttaaatgttaaaattatagtgaatttatttgacagactgcttagtccacaatgcaaaaaaatgctattgtcacttcttgcttaaagatctttttttgatctcatgttccctacatgataaggctaagtttctttgcatgttgtttcaattaccatgccttcagccacaaataacagaaagccctatctcagattggcttaaacaataggaaacatttattatctcaaatagcaagaggttaccaagtagrgcacctttatgtttggctgatgcagtgccccacaatgacataaatgactccagtttgttctatctctgctctaccattcttggagtattcgagcttggttttcaggctagatccattcatggtcacaacatagtagccctatttccaggcatcacatctcagacatcaacatcagtggaagaaaagagactgactattccttaggtatcctttaagagtgaagaaaccagctagggatggtggccagtagctgaagtccaaggctataaggaggctgaggctggaggatcccttgaggcc

SEQ ID NO: 52592 - DNA, 601 bp, Human
tatgtaatataacatatggtatttgttatatcatgggacaaaatcaacttggggtacatttaaatgttaaaattatagtgaatttatttgacagactgcttagtccacaatgcaaaaaaatgctattgtcacttcttgcttaaagatctttttttgatctcatgttccctacatgataaggctaagtttctttgcatgttgtttcaattaccatgccttcagccacaaataacagaaagccctatctcagattggcttaaacaataggaaacatttattatctcaaatagcaagaggttascaagtagagcacctttatgtttggctgatgcagtgccccacaatgacataaatgactccagtttgttctatctctgctctaccattcttggagtattcgagcttggttttcaggctagatccattcatggtcacaacatagtagccctatttccaggcatcacatctcagacatcaacatcagtggaagaaaagagactgactattccttaggtatcctttaagagtgaagaaaccagctagggatggtggccagtagctgaagtccaaggctataaggaggctgaggctggaggatccc

SEQ ID NO: 52593 - DNA, 601 bp, Human
tccagtttgtaaatttacttcaaactaaatggcatatgtaatataacatatggtatttgttatatcatgggacaaaatcaacttggggtacatttaaatgttaaaattatagtgaatttatttgacagactgcttagtccacaatgcaaaaaaatgctattgtcacttcttgcttaaagatctttttttgatctcatgttccctacatgataaggctaagtttctttgcatgttgtttcaattaccatgccttcagccacaaataacagaaagccctatctcagattggcttaaacaatasgaaacatttattatctcaaatagcaagaggttaccaagtagagcacctttatgtttggctgatgcagtgccccacaatgacataaatgactccagtttgttctatctctgctctaccattcttggagtattcgagcttggttttcaggctagatccattcatggtcacaacatagtagccctatttccaggcatcacatctcagacatcaacatcagtggaagaaaagagactgactattccttaggtatcctttaagagtgaagaaaccagctagggatggtggccagtagctgaagtc

SEQ ID NO: 52594 - DNA, 601 bp, Human
agagatactcctgtatccttccttagctagcttgattaggtttctggtcactgcaaccaaaaccttcttcaggctcttctcctggtaaatagagccctggaaatccaagcccaacattttggaatcattttgtaatcctccccttttaccaccagtcatcactaagtccagatgatattgcttcttgattcatcaattcctcctcattaaagttctcattacttctcatggacttaactgatcatttttcttcactctcacttcctctagtacatactcaacatcattagcagagtagacrttatcattttaaattccagtttgtaaatttacttcaaactaaatggcatatgtaatataacatatggtatttgttatatcatgggacaaaatcaacttggggtacatttaaatgttaaaattatagtgaatttatttgacagactgcttagtccacaatgcaaaaaaatgctattgtcacttcttgcttaaagatctttttttgatctcatgttccctacatgataaggctaagtttctttgcatgttgtttcaattaccatgccttcagccacaaataacagaaagccctatctcagat

SEQ ID NO: 52595 - DNA, 601 bp, Human
ctgggctctgagagatactcctgtatccttccttagctagcttgattaggtttctggtcactgcaaccaaaaccttcttcaggctcttctcctggtaaatagagccctggaaatccaagcccaacattttggaatcattttgtaatcctccccttttaccaccagtcatcactaagtccagatgatattgcttcttgattcatcaattcctcctcattaaagttctcattacttctcatggacttaactgatcatttttcttcactctcacttcctctagtacatactcaacatcattagyagagtagacgttatcattttaaattccagtttgtaaatttacttcaaactaaatggcatatgtaatataacatatggtatttgttatatcatgggacaaaatcaacttggggtacatttaaatgttaaaattatagtgaatttatttgacagactgcttagtccacaatgcaaaaaaatgctattgtcacttcttgcttaaagatctttttttgatctcatgttccctacatgataaggctaagtttctttgcatgttgtttcaattaccatgccttcagccacaaataacagaaagccc

SEQ ID NO: 52596 - DNA, 601 bp, Human
gaggaattgccttacaaaccactaatttagctgttcaaccagaactctcaggacaaagaatgggcacctgatcgaagatggactatttagagtctctctcccgagagtttggaactgaaacatagaagacctgagttagtctctgctgggtccaagaaagctggggctgggataactataagatcaccacgcccaacagagaaaaccagtctggagaaaatgaggctgatgtgctgagagaagcagaaatgacagaccatatgccatcacccagaacaggtagaatccagttccctagggytcagtctactctggctgaggcccagtgaaacttcttgctctgggctctgagagatactcctgtatccttccttagctagcttgattaggtttctggtcactgcaaccaaaaccttcttcaggctcttctcctggtaaatagagccctggaaatccaagcccaacattttggaatcattttgtaatcctccccttttaccaccagtcatcactaagtccagatgatattgcttcttgattcatcaattcctcctcattaaagttctcattacttctcatggacttaactgatcatttttct

SEQ ID NO: 52597 - DNA, 601 bp, Human
ggaaactctttataaataccatttcaagattctaaaaattgaactattcattactttaaaagtagataaaataaaaacaaatcagtgtgtctggtagcacaaaccttgactctcctcttctcagtctatgtgatccttctgataggtctgtctcatatctcattattcttttttttttttcctttttgagacagtgtctcactctgtcacccaggctggagtgccatggggcgatcctggctcactgcaggcccaacctcctggggtcaagaaatcctcccacctcagccactcgagtagstgggactatagttgtgtgctatcacacccagctaatttttgtattttttgtagagacggggtttcaccatgttgctcaggctgctttcgaactcctgggctcgagcaatcctcccacctctgcctttcaaattgttgggattacaggtgtgctccactgtacccagccttctttctttttttattcccacctacattctgatggtgtcacctttccaacttcagttcagatctctgcttaaaagacattttccactgatggtcccttgagctccacaaaattaatatattcaaattttaa

SEQ ID NO: 52598 - DNA, 601 bp, Human
tatattactatttgtgtttgaaaaatatggggggtgtagaaataataaaggtatttactggtacatgcatagattatcattttttaacattttttatttagaaaatatatatatatataatcacataagtagagacagggtctcgctatgttgcccagggtggtcttgagttcctgggttcaaatgcccttccgcctcagcctcccaaagtgttaggattacaggcgtcagccaccacgcccagctgatctttgaaaagatataaatgatgatatcgcctacagggaagggaaatgtatgrctgggacacgggtgggaaggaaactctttataaataccatttcaagattctaaaaattgaactattcattactttaaaagtagataaaataaaaacaaatcagtgtgtctggtagcacaaaccttgactctcctcttctcagtctatgtgatccttctgataggtctgtctcatatctcattattcttttttttttttcctttttgagacagtgtctcactctgtcacccaggctggagtgccatggggcgatcctggctcactgcaggcccaacctcctggggtcaagaaatcctccca

SEQ ID NO: 52599 - DNA, 601 bp, Human
gttcataatagcaaaagttgaaaacactttaaacatccatcactaaggaattgtttaaataagttaagtaaatggtatattactatttgtgtttgaaaaatatggggggtgtagaaataataaaggtatttactggtacatgcatagattatcattttttaacattttttatttagaaaatatatatatatataatcacataagtagagacagggtctcgctatgttgcccagggtggtcttgagttcctgggttcaaatgcccttccgcctcagcctcccaaagtgttaggattacaggygtcagccaccacgcccagctgatctttgaaaagatataaatgatgatatcgcctacagggaagggaaatgtatggctgggacacgggtgggaaggaaactctttataaataccatttcaagattctaaaaattgaactattcattactttaaaagtagataaaataaaaacaaatcagtgtgtctggtagcacaaaccttgactctcctcttctcagtctatgtgatccttctgataggtctgtctcatatctcattattcttttttttttttcctttttgagacagtgtctcactctgt

SEQ ID NO: 52600 - DNA, 601 bp, Human
cagctactcaggaggctgaggcaggagaatctctggaacctgggaggtggaggttgcagtgagctgagattgcaccactgcacttcagcctgggcaatagaacaagattctgcctttaaaaaaaaagaaaaagaaaaagaacaggatagatttagacaagagccaggggtctggcaaagagtagataagcgagtggaaaaccaatgggaagggggtgtgacagccaagggagaagcatgacagcatgcaatgtccaagagagacgagctggggtggagattatggatggctcctgttactrtagtttgagtggcactgtgggagcaagagccattgacgacctcctcaaggctcttcattagtttatcttcttcacccatttctttaaaaaaaattgcactccagttattcattgttgttttgttcataatagcaaaagttgaaaacactttaaacatccatcactaaggaattgtttaaataagttaagtaaatggtatattactatttgtgtttgaaaaatatggggggtgtagaaataataaaggtatttactggtacatgcatagattatcattttttaacattttttatttagaaa

SEQ ID NO: 52601 - DNA, 601 bp, Human
gctctatattagctgaaatgcaatgagctgttactatgaaatgcttttcattatcttctgcaaagagtgcgactgccaagtattatttctgagtgcttacatacatcttttcatttcatcctcacaaccaccctatgaaagggatactattattcttttgattttacaagtgaggaaagtaaggctcagaaaggtcaatgagtttgtccaaggtcacatggctagtaaatattgaggaatgatattaatgtatccctattagtgagattgttagttttcataatgggtttacacttaaagscctttctagattccagaggtgtaaccacagaataacttcttgcagttgccctgcctcacttaggatatttaggctgggtacaggggctcatgcctgtaatcccagcactttgggaggtcaaagcggatggatcacttgaggtcaggaattctataccagcctggccaacatggtgaaaccccgtctctactaaaaatacaaaaattagctgggcatggtggcatgcgcctgtaatcccagctactcaggaggctgaggcaggagaatctctggaacctgggaggtggaggttgcagtgag

SEQ ID NO: 52602 - DNA, 601 bp, Human
cacttattagttttaaggttaactccccaggatagtgaaaactgtcatccctaaagtcagatgtttttgaaggcagataataatagtaagtgaatgtattaaattgataaaagcaaaaaaaatgtattgaggtcttttgactttaaaattggccatgggaaccaaggactgcaaagaatttctttgttaagaggctggtttttctactttggtgaagttggagttggttgctttgagtgctccagaatgaacaaacctctctggtctagaagagaagcatactcctctacaaaagcctatwttccccagcttggactgcatcattcaacatacaatatcgaatagactgtaaataagcctaaatttcaaatgattgcaatcttaaccctgttattagtgtttctgtctctcttctcttcactaccaaggtttcaaaaagtatagtctacttttacattatctgcctccttacttagtccttatccttcaagctattgtattaaactgcagggagacagagatctccccaccctaggtagaaagaggataatttagtataaaagtggattgaagtagatttatttgtctgcagaaaccgcca

SEQ ID NO: 52603 - DNA, 601 bp, Human
acaggaaaaacctaaaatagtcaaatttatagaagcagaaggaggggaagagaaaatagggagttgctaaagtttcagttatgtgagatgaataagttctagaaagctgctgtacaacattgtgcctatagttgacaatatggtattgcatacttaaaaatctgttaagagggtagctctcatgttaaatgttcttactacagtaaaataaaaattaaatttaaatgaaaaaaagatcaactttctgacttgctgtcaggaagtaagtactgtagactgatccaccatcttccaccctaayatttaagacccctgggagtgaggtctcttagtgattagtggttaaacaaagaccaaccatcattggtatctgcagacttcagtctggctttgtaactttggctgcaccatagagacacttattagttttaaggttaactccccaggatagtgaaaactgtcatccctaaagtcagatgtttttgaaggcagataataatagtaagtgaatgtattaaattgataaaagcaaaaaaaatgtattgaggtcttttgactttaaaattggccatgggaaccaaggactgcaaagaatttcttt

SEQ ID NO: 52604 - DNA, 601 bp, Human
tcatcaatagatgaatggataagaaaatgtggtgtatatacacaatagaatattattcagctttaaaacagaaggaaatcctgaatatgtgacaacatagatgaaacttaaggacattatgctaagtaaaataagccagccacagaaggacaaatattgcatgattccacttacaggaaaaacctaaaatagtcaaatttatagaagcagaaggaggggaagagaaaatagggagttgctaaagtttcagttatgtgagatgaataagttctagaaagctgctgtacaacattgtgcctayagttgacaatatggtattgcatacttaaaaatctgttaagagggtagctctcatgttaaatgttcttactacagtaaaataaaaattaaatttaaatgaaaaaaagatcaactttctgacttgctgtcaggaagtaagtactgtagactgatccaccatcttccaccctaacatttaagacccctgggagtgaggtctcttagtgattagtggttaaacaaagaccaaccatcattggtatctgcagacttcagtctggctttgtaactttggctgcaccatagagacacttattagttt

SEQ ID NO: 52605 - DNA, 601 bp, Human
tcctgatgattagtggaattgaacattttttaatatacctattggccatctgtatgtctttatttggagaaatgtatattcaaatccttagtccattttaaaatcaggtgttagtttttttgctgttgagttgtgggagttctttatttcagaaattttatccaatagaattgacatcaggatctcaaagaaatatttgcactcctatgttcattgcagcactattcataatagccaagatgtggaaacaatttaaatgttcatcaatagatgaatggataagaaaatgtggtgtatatamacaatagaatattattcagctttaaaacagaaggaaatcctgaatatgtgacaacatagatgaaacttaaggacattatgctaagtaaaataagccagccacagaaggacaaatattgcatgattccacttacaggaaaaacctaaaatagtcaaatttatagaagcagaaggaggggaagagaaaatagggagttgctaaagtttcagttatgtgagatgaataagttctagaaagctgctgtacaacattgtgcctatagttgacaatatggtattgcatacttaaaaatctgttaag

SEQ ID NO: 52606 - DNA, 601 bp, Human
agaagtagatggctgattatatgttatatttttcactttttgaagaacctccatgctgttttccacagtggctgtaccattttacatttccaccaacagtgaacaagtgttccaattttaccacatcctcactaacacctcttatcttttgtctttttggtaacagtcatttcaacaggagtgaggtgatacctcactgtggttttgatttatattttcctgatgattagtggaattgaacattttttaatatacctattggccatctgtatgtctttatttggagaaatgtatattcaartccttagtccattttaaaatcaggtgttagtttttttgctgttgagttgtgggagttctttatttcagaaattttatccaatagaattgacatcaggatctcaaagaaatatttgcactcctatgttcattgcagcactattcataatagccaagatgtggaaacaatttaaatgttcatcaatagatgaatggataagaaaatgtggtgtatatacacaatagaatattattcagctttaaaacagaaggaaatcctgaatatgtgacaacatagatgaaacttaaggacattatgcta

SEQ ID NO: 52607 - DNA, 601 bp, Human
attttgtctaacttcgggttgtcaatcaagatcaactttttaaataaatactcagaagtagatggctgattatatgttatatttttcactttttgaagaacctccatgctgttttccacagtggctgtaccattttacatttccaccaacagtgaacaagtgttccaattttaccacatcctcactaacacctcttatcttttgtctttttggtaacagtcatttcaacaggagtgaggtgatacctcactgtggttttgatttatattttcctgatgattagtggaattgaacatttttwaatatacctattggccatctgtatgtctttatttggagaaatgtatattcaaatccttagtccattttaaaatcaggtgttagtttttttgctgttgagttgtgggagttctttatttcagaaattttatccaatagaattgacatcaggatctcaaagaaatatttgcactcctatgttcattgcagcactattcataatagccaagatgtggaaacaatttaaatgttcatcaatagatgaatggataagaaaatgtggtgtatatacacaatagaatattattcagctttaaaacag

SEQ ID NO: 52608 - DNA, 601 bp, Human
tgccatccaatgagactgaatgtgtggtgtaagagttttcccacattttgtctaacttcgggttgtcaatcaagatcaactttttaaataaatactcagaagtagatggctgattatatgttatatttttcactttttgaagaacctccatgctgttttccacagtggctgtaccattttacatttccaccaacagtgaacaagtgttccaattttaccacatcctcactaacacctcttatcttttgtctttttggtaacagtcatttcaacaggagtgaggtgatacctcactgtggtwttgatttatattttcctgatgattagtggaattgaacattttttaatatacctattggccatctgtatgtctttatttggagaaatgtatattcaaatccttagtccattttaaaatcaggtgttagtttttttgctgttgagttgtgggagttctttatttcagaaattttatccaatagaattgacatcaggatctcaaagaaatatttgcactcctatgttcattgcagcactattcataatagccaagatgtggaaacaatttaaatgttcatcaatagatgaatggataagaaaa

SEQ ID NO: 52609 - DNA, 601 bp, Human
aataaactgccatccaatgagactgaatgtgtggtgtaagagttttcccacattttgtctaacttcgggttgtcaatcaagatcaactttttaaataaatactcagaagtagatggctgattatatgttatatttttcactttttgaagaacctccatgctgttttccacagtggctgtaccattttacatttccaccaacagtgaacaagtgttccaattttaccacatcctcactaacacctcttatcttttgtctttttggtaacagtcatttcaacaggagtgaggtgatacctcaytgtggttttgatttatattttcctgatgattagtggaattgaacattttttaatatacctattggccatctgtatgtctttatttggagaaatgtatattcaaatccttagtccattttaaaatcaggtgttagtttttttgctgttgagttgtgggagttctttatttcagaaattttatccaatagaattgacatcaggatctcaaagaaatatttgcactcctatgttcattgcagcactattcataatagccaagatgtggaaacaatttaaatgttcatcaatagatgaatggat

SEQ ID NO: 52610 - DNA, 601 bp, Human
ttgactcttatttttctttttaacatatgtattatgtaatattggtggctgtattatataaaaccagttccatacttacaaacattttggttgctttcagttttatttttagtgaaagatggatacatttatcaaacaatgctgcaaagaacatacatctgtagtaccttgtacatacatcttgtacttacagctttcaatacaagaagtagaattgctgggtcaaaacaatttgatacatctaaataaactgccatccaatgagactgaatgtgtggtgtaagagttttcccacattttstctaacttcgggttgtcaatcaagatcaactttttaaataaatactcagaagtagatggctgattatatgttatatttttcactttttgaagaacctccatgctgttttccacagtggctgtaccattttacatttccaccaacagtgaacaagtgttccaattttaccacatcctcactaacacctcttatcttttgtctttttggtaacagtcatttcaacaggagtgaggtgatacctcactgtggttttgatttatattttcctgatgattagtggaattgaacattttttaatat

SEQ ID NO: 52611 - DNA, 601 bp, Human
cctgaatgacagagcaaggccctgtctctgaaataaaaattgactcttatttttctttttaacatatgtattatgtaatattggtggctgtattatataaaaccagttccatacttacaaacattttggttgctttcagttttatttttagtgaaagatggatacatttatcaaacaatgctgcaaagaacatacatctgtagtaccttgtacatacatcttgtacttacagctttcaatacaagaagtagaattgctgggtcaaaacaatttgatacatctaaataaactgccatccaawgagactgaatgtgtggtgtaagagttttcccacattttgtctaacttcgggttgtcaatcaagatcaactttttaaataaatactcagaagtagatggctgattatatgttatatttttcactttttgaagaacctccatgctgttttccacagtggctgtaccattttacatttccaccaacagtgaacaagtgttccaattttaccacatcctcactaacacctcttatcttttgtctttttggtaacagtcatttcaacaggagtgaggtgatacctcactgtggttttgatttata

SEQ ID NO: 52612 - DNA, 601 bp, Human
ggaggattgcttgagcccaggagtttggggctgcagtgagctatgaccatgccacttcactccagcctgaatgacagagcaaggccctgtctctgaaataaaaattgactcttatttttctttttaacatatgtattatgtaatattggtggctgtattatataaaaccagttccatacttacaaacattttggttgctttcagttttatttttagtgaaagatggatacatttatcaaacaatgctgcaaagaacatacatctgtagtaccttgtacatacatcttgtacttacagcttycaatacaagaagtagaattgctgggtcaaaacaatttgatacatctaaataaactgccatccaatgagactgaatgtgtggtgtaagagttttcccacattttgtctaacttcgggttgtcaatcaagatcaactttttaaataaatactcagaagtagatggctgattatatgttatatttttcactttttgaagaacctccatgctgttttccacagtggctgtaccattttacatttccaccaacagtgaacaagtgttccaattttaccacatcctcactaacacctcttatcttt

SEQ ID NO: 52613 - DNA, 601 bp, Human
ggctggggtaggaggattgcttgagcccaggagtttggggctgcagtgagctatgaccatgccacttcactccagcctgaatgacagagcaaggccctgtctctgaaataaaaattgactcttatttttctttttaacatatgtattatgtaatattggtggctgtattatataaaaccagttccatacttacaaacattttggttgctttcagttttatttttagtgaaagatggatacatttatcaaacaatgctgcaaagaacatacatctgtagtaccttgtacatacatcttgtayttacagctttcaatacaagaagtagaattgctgggtcaaaacaatttgatacatctaaataaactgccatccaatgagactgaatgtgtggtgtaagagttttcccacattttgtctaacttcgggttgtcaatcaagatcaactttttaaataaatactcagaagtagatggctgattatatgttatatttttcactttttgaagaacctccatgctgttttccacagtggctgtaccattttacatttccaccaacagtgaacaagtgttccaattttaccacatcctcactaacacc

SEQ ID NO: 52614 - DNA, 601 bp, Human
ccaggagtttgagaccagcctaggcaacatagagagacaccatttctaaaaaaaaaaaaatgaaaaaagaattaaccaggcttaatgccatgcacctgtagtcccagctactcaggaggctggggtaggaggattgcttgagcccaggagtttggggctgcagtgagctatgaccatgccacttcactccagcctgaatgacagagcaaggccctgtctctgaaataaaaattgactcttatttttctttttaacatatgtattatgtaatattggtggctgtattatataaaaccagttmcatacttacaaacattttggttgctttcagttttatttttagtgaaagatggatacatttatcaaacaatgctgcaaagaacatacatctgtagtaccttgtacatacatcttgtacttacagctttcaatacaagaagtagaattgctgggtcaaaacaatttgatacatctaaataaactgccatccaatgagactgaatgtgtggtgtaagagttttcccacattttgtctaacttcgggttgtcaatcaagatcaactttttaaataaatactcagaagtagatggctgattatat

SEQ ID NO: 52615 - DNA, 601 bp, Human
ctgtaatcccagcactttgggaggccgaggcaggcagatcacctgaggtcaggagttcaagaccagcctggccaacatggcgaaaccctgtctctactcaaaatacaaaaattagcccagtgtggtggcaggcacctgtaatctcagctacttgggaggctgaggcagaagaattgcttgaacccaggaggcggaggttgcagtgagccaacgttgtgccactgcactccagcctgggtgacaaagtgagaccctgtctcaaaaaaaaccaaccaaccaaacaaacaaacaaacaaaaaaacgtatttgggaggctgagatgggaggatcacttgaggccaggagtttgagaccagcctaggcaacatagagagacaccatttctaaaaaaaaaaaaatgaaaaaagaattaaccaggcttaatgccatgcacctgtagtcccagctactcaggaggctggggtaggaggattgcttgagcccaggagtttggggctgcagtgagctatgaccatgccacttcactccagcctgaatgacagagcaaggccctgtctctgaaataaaaattgactcttatttttctttttaacatatgtat

SEQ ID NO: 52616 - DNA, 601 bp, Human
ccgggcacagtggctcatgcctgtaatcccagcactttgggaggccgaggcaggcagatcacctgaggtcaggagttcaagaccagcctggccaacatggcgaaaccctgtctctactcaaaatacaaaaattagcccagtgtggtggcaggcacctgtaatctcagctacttgggaggctgaggcagaagaattgcttgaacccaggaggcggaggttgcagtgagccaacgttgtgccactgcactccagcctgggtgacaaagtgagaccctgtctcaaaaaaaaccaaccaaccaamcaaacaaacaaacaaaaaaacgtatttgggaggctgagatgggaggatcacttgaggccaggagtttgagaccagcctaggcaacatagagagacaccatttctaaaaaaaaaaaaatgaaaaaagaattaaccaggcttaatgccatgcacctgtagtcccagctactcaggaggctggggtaggaggattgcttgagcccaggagtttggggctgcagtgagctatgaccatgccacttcactccagcctgaatgacagagcaaggccctgtctctgaaataaaaattgactcttatt

SEQ ID NO: 52617 - DNA, 601 bp, Human
cccttagaactgtggagtcccaagtcagcctcccttcatctggaacacaaactcccctggcagttctgcaggccctttttccataatggccagtagtacattctgcttaattgtcatgttctgttaatcacaggaagcagtgagtggcagacattactcaccatgctcactacctactctgcagggaccacagtctatgccattagatcccacactctggagccctttgatccacagcctgaggcaagtcgccaagccctaccctgccactgtgaaggcttacagtatcaatttctttatrtaccagctgccagtgacacacaagtttggaatttctccctcatctaccaaattctatctccgttatcagaaatggatttacagatttttcatgaaactaataaatcttaaacatcaggaccctcaattcatgggaactttccaaggtcctggaggaattatattaacgtgttcacaagtatttttttttttttttttttgatggagtttcgctcttgttgcccaagctggagtgcaatggtgcaatggcgtgatctcggctcactgcaacctccgcctcccagttcaaatgattttcctg

SEQ ID NO: 52618 - DNA, 494 bp, Human
aggtcatccgcccatctcagcctcccaaagtgctgggattacaggagtgagccaccgcacccggctgagactcttaaatggagagggcacagtccctaggcaacttgatactcccctacaggagcaatttcatatttgctaaaaatgctttcctcccaaatacatttatgaaagaaaccactgtatatacaaacagctctggcacgtaatattaaagtagtgatcccaaaattctgttgttggctctattgtcttcccattatccagtgtcttggtcaaactcatccattcccatgacttkgactacctttcatacactgacaagctccaaatgtatatctacagagcactttccagtattagacaccacttaatgtctcctacggtgttcccacaggaacctaaaactcaatctatctaatgtatcacgcctgtaatcccagcactttgggaggccgagacgggtggatcaactgaggtcagcagtttgagac

SEQ ID NO: 52619 - DNA, 601 bp, Human
gggagagcagggaaagcaatgggattggcagtgtgcatgcttttcaatagtgaaagtcagcaaaagagtcagagaaggagcaaccagaaagattatgttaaatcctgaagtctgtcaccaccatccaccctcctcagtcaactagataaccttgagactcttttttttttttttagacggagtttccctcttgttactcaggctggagcaatggggcgatcttggctcactgcaacgtctgcctcccaggttcaagcaattctcctgcctcagcctctggagtagctggcattacaggcaygcgccaccacgcccagctaattttgtatttttaggagagacggggtgtcaccatgttggtcaggctgatcttgaactccttacctcaggtcatccgcccatctcagcctcccaaagtgctgggattacaggagtgagccaccgcacccggctgagactcttaaatggagagggcacagtccctaggcaacttgatactcccctacaggagcaatttcatatttgctaaaaatgctttcctcccaaatacatttatgaaagaaaccactgtatatacaaacagctctggcacgtaatatta

SEQ ID NO: 52620 - DNA, 601 bp, Human
gcctattttcaaggtacatgccctgcttgccacacaccactgactttttaagggagacaataaagggagagcagggaaagcaatgggattggcagtgtgcatgcttttcaatagtgaaagtcagcaaaagagtcagagaaggagcaaccagaaagattatgttaaatcctgaagtctgtcaccaccatccaccctcctcagtcaactagataaccttgagactcttttttttttttttagacggagtttccctcttgttactcaggctggagcaatggggcgatcttggctcactgcaacstctgcctcccaggttcaagcaattctcctgcctcagcctctggagtagctggcattacaggcatgcgccaccacgcccagctaattttgtatttttaggagagacggggtgtcaccatgttggtcaggctgatcttgaactccttacctcaggtcatccgcccatctcagcctcccaaagtgctgggattacaggagtgagccaccgcacccggctgagactcttaaatggagagggcacagtccctaggcaacttgatactcccctacaggagcaatttcatatttgctaaaaatgctt

SEQ ID NO: 52621 - DNA, 601 bp, Human
accgggtctgcctattttcaaggtacatgccctgcttgccacacaccactgactttttaagggagacaataaagggagagcagggaaagcaatgggattggcagtgtgcatgcttttcaatagtgaaagtcagcaaaagagtcagagaaggagcaaccagaaagattatgttaaatcctgaagtctgtcaccaccatccaccctcctcagtcaactagataaccttgagactcttttttttttttttagacggagtttccctcttgttactcaggctggagcaatggggcgatcttggctyactgcaacgtctgcctcccaggttcaagcaattctcctgcctcagcctctggagtagctggcattacaggcatgcgccaccacgcccagctaattttgtatttttaggagagacggggtgtcaccatgttggtcaggctgatcttgaactccttacctcaggtcatccgcccatctcagcctcccaaagtgctgggattacaggagtgagccaccgcacccggctgagactcttaaatggagagggcacagtccctaggcaacttgatactcccctacaggagcaatttcatatttgcta

SEQ ID NO: 52622 - DNA, 601 bp, Human
catctgcttaaagaaaaaggagagagatgtccttgtcaacctatttttaagataaagatctacttacatttcagaacaggaattctgatttccccaaaaagagaagggaaagagacaaaaaaaaatcttcagtattgattctttatcagcaaaatttagtaagaatctttccagataatttaaggattttagcatctctggttttaaaggggagtcctcatcatctcttcaacaatatgaaaatccagtctcatttttattgaatcagggcaaaatccttgtcagactagattctttgtgttttttttgcggaaagaaggaacaagaaaaaaaatcctttagggtagatgacctgtctgatgatggtaagcacagcttcagtacatcaggttttttgcagggtgcttttacatactgtttccagtccttacagcaaccctgcctggcagatattgttagttcagatttatgatgagaaaaacagaggattagagagactaagtaatttgcccatgcgcacagttagctgggattctaaaccgggtctgcctattttcaaggtacatgccctgcttgccacacaccactgactttttaaggg

SEQ ID NO: 52623 - DNA, 601 bp, Human
aaaaaaaaaaaaaaattagctgggcatggtaggcgcaggcctgtggtcccagctactggggaggctgaggtggaaggattgcttgagctgaggaagccaaggcagcagtgagccatgatcatgccactgcacttgagcctgggtgacagagcaagacactgtctctctctctctgtctctgtctctctctctctctctgtctgtctttctttatctctttctctctcacacacacacacataaaaattgtaggcccaggcatggtggctcatgcctgtaatctcagaactttgggaggccraggcaggcggatcacgaggtccggagttcgagaccagcctggccaatatggtgaaaccccatctctactaaacatacaaaaattagccaggcatggtggtgcgtgcctgtagtcccagctacttgggaagctggggaagaagaatcacttgaacctgggaggcggaggttgcagtgagccgtgatcataccactgcactccatcttgggtgacagagagagattccatctaaaaaaaaaaaagaatttgtatgaaacttaaggctagccttcagagagaacaagccaaaattgattctct

SEQ ID NO: 52624 - DNA, 601 bp, Human
gaagaccggcctaggcaacatagtaagacctcgtctctacaaaaaaaaaaaaaaaaaaattagctgggcatggtaggcgcaggcctgtggtcccagctactggggaggctgaggtggaaggattgcttgagctgaggaagccaaggcagcagtgagccatgatcatgccactgcacttgagcctgggtgacagagcaagacactgtctctctctctctgtctctgtctctctctctctctctgtctgtctttctttatctctttctctctcacacacacacacataaaaattgtaggcccrggcatggtggctcatgcctgtaatctcagaactttgggaggccgaggcaggcggatcacgaggtccggagttcgagaccagcctggccaatatggtgaaaccccatctctactaaacatacaaaaattagccaggcatggtggtgcgtgcctgtagtcccagctacttgggaagctggggaagaagaatcacttgaacctgggaggcggaggttgcagtgagccgtgatcataccactgcactccatcttgggtgacagagagagattccatctaaaaaaaaaaaagaatttgtatgaaa

SEQ ID NO: 52625 - DNA, 601 bp, Human
gtccctttgtttccccctcccctattccccagaggtctcaagattttggaggtaccaaggtaagagtcaagacaggtaaggagaagataggctgttttgcaatggaaggtgaaaataaagaatttggctggatatgatggctcatgtttataatcccagcgcactttggaaggctgaggtgagaatattgcttaagcctaggcaacatagtagaagaccggcctaggcaacatagtaagacctcgtctctacaaaaaaaaaaaaaaaaaaattagctgggcatggtaggcgcaggcctgtrgtcccagctactggggaggctgaggtggaaggattgcttgagctgaggaagccaaggcagcagtgagccatgatcatgccactgcacttgagcctgggtgacagagcaagacactgtctctctctctctgtctctgtctctctctctctctctgtctgtctttctttatctctttctctctcacacacacacacataaaaattgtaggcccaggcatggtggctcatgcctgtaatctcagaactttgggaggccgaggcaggcggatcacgaggtccggagttcgagaccagcctggcc

SEQ ID NO: 52626 - DNA, 601 bp, Human
cagagacattttttccagctaatggcccctcctaggttttgagaattttgttttgaaaataagtgaaaacaaaaagcagactccatttttagcatttgaagtgttctttactttgctgtcatgggtctctctctccagagttatgcattctttgacaataaccagagaggccagggatgggaggagccaatacttcaaatggtccctttgtttccccctcccctattccccagaggtctcaagattttggaggtaccaaggtaagagtcaagacaggtaaggagaagataggctgttttgmaatggaaggtgaaaataaagaatttggctggatatgatggctcatgtttataatcccagcgcactttggaaggctgaggtgagaatattgcttaagcctaggcaacatagtagaagaccggcctaggcaacatagtaagacctcgtctctacaaaaaaaaaaaaaaaaaaattagctgggcatggtaggcgcaggcctgtggtcccagctactggggaggctgaggtggaaggattgcttgagctgaggaagccaaggcagcagtgagccatgatcatgccactgcacttgagcctgggt

SEQ ID NO: 52627 - DNA, 601 bp, Human
atcagcatcagtatctggcactgcatctgctgctcagagacattttttccagctaatggcccctcctaggttttgagaattttgttttgaaaataagtgaaaacaaaaagcagactccatttttagcatttgaagtgttctttactttgctgtcatgggtctctctctccagagttatgcattctttgacaataaccagagaggccagggatgggaggagccaatacttcaaatggtccctttgtttccccctcccctattccccagaggtctcaagattttggaggtaccaaggtaagaktcaagacaggtaaggagaagataggctgttttgcaatggaaggtgaaaataaagaatttggctggatatgatggctcatgtttataatcccagcgcactttggaaggctgaggtgagaatattgcttaagcctaggcaacatagtagaagaccggcctaggcaacatagtaagacctcgtctctacaaaaaaaaaaaaaaaaaaattagctgggcatggtaggcgcaggcctgtggtcccagctactggggaggctgaggtggaaggattgcttgagctgaggaagccaaggcagcagtg

SEQ ID NO: 52628 - DNA, 601 bp, Human
agttgagaattgactatcactggaaaaatattcaatgacgtaatttcatagaagtaggttttaattactttattcaatgatgtgtacgttatgtaaaaaaatcaggtgaatttttaatccatgaattctatcttgtgtagtagagaatgtagtaacctcagaaaacattccatttaaatttaaaactatttttatgttacccccaattttagagggatcattcacactgcattctacaaaaggtgaatgacactcggaaaggcatgtgaaaatttggtatgtgcttggtatggatgcatcrctcagccctgaatcagcatcagtatctggcactgcatctgctgctcagagacattttttccagctaatggcccctcctaggttttgagaattttgttttgaaaataagtgaaaacaaaaagcagactccatttttagcatttgaagtgttctttactttgctgtcatgggtctctctctccagagttatgcattctttgacaataaccagagaggccagggatgggaggagccaatacttcaaatggtccctttgtttccccctcccctattccccagaggtctcaagattttggaggta

SEQ ID NO: 52629 - DNA, 601 bp, Human
agttaaaagaagaaataagttgagaattgactatcactggaaaaatattcaatgacgtaatttcatagaagtaggttttaattactttattcaatgatgtgtacgttatgtaaaaaaatcaggtgaatttttaatccatgaattctatcttgtgtagtagagaatgtagtaacctcagaaaacattccatttaaatttaaaactatttttatgttacccccaattttagagggatcattcacactgcattctacaaaaggtgaatgacactcggaaaggcatgtgaaaatttggtatgtgsttggtatggatgcatcactcagccctgaatcagcatcagtatctggcactgcatctgctgctcagagacattttttccagctaatggcccctcctaggttttgagaattttgttttgaaaataagtgaaaacaaaaagcagactccatttttagcatttgaagtgttctttactttgctgtcatgggtctctctctccagagttatgcattctttgacaataaccagagaggccagggatgggaggagccaatacttcaaatggtccctttgtttccccctcccctattccccagaggtc

SEQ ID NO: 52630 - DNA, 601 bp, Human
ttactttgtgttaataggagtaaaaataaatgttttaaaagaagaaataggccaggtacagtggctcacgcctgtaatcccagcactttgggaggctgaggtaggatgattacttgagcccaggagtttgaggccagtctgggcaatatagtgagaccctgtctctgttttttaaaaaaaataaaaattaaaaatcagttaaaagaagaaataagttgagaattgactatcactggaaaaatattcaatgacgtaatttcatagaagtaggttttaattactttattcaatgatgtgtacrttatgtaaaaaaatcaggtgaatttttaatccatgaattctatcttgtgtagtagagaatgtagtaacctcagaaaacattccatttaaatttaaaactatttttatgttacccccaattttagagggatcattcacactgcattctacaaaaggtgaatgacactcggaaaggcatgtgaaaatttggtatgtgcttggtatggatgcatcactcagccctgaatcagcatcagtatctggcactgcatctgctgctcagagacattttttccagctaatggcccctcctaggttttga

SEQ ID NO: 52631 - DNA, 601 bp, Human
ctggcagctggcatataatgttactttgtgttaataggagtaaaaataaatgttttaaaagaagaaataggccaggtacagtggctcacgcctgtaatcccagcactttgggaggctgaggtaggatgattacttgagcccaggagtttgaggccagtctgggcaatatagtgagaccctgtctctgttttttaaaaaaaataaaaattaaaaatcagttaaaagaagaaataagttgagaattgactatcactggaaaaatattcaatgacgtaatttcatagaagtaggttttaattamtttattcaatgatgtgtacgttatgtaaaaaaatcaggtgaatttttaatccatgaattctatcttgtgtagtagagaatgtagtaacctcagaaaacattccatttaaatttaaaactatttttatgttacccccaattttagagggatcattcacactgcattctacaaaaggtgaatgacactcggaaaggcatgtgaaaatttggtatgtgcttggtatggatgcatcactcagccctgaatcagcatcagtatctggcactgcatctgctgctcagagacattttttccagctaa

SEQ ID NO: 52632 - DNA, 601 bp, Human
aaaaagtatgaattgctaaaaatgaagtctggcagctggcatataatgttactttgtgttaataggagtaaaaataaatgttttaaaagaagaaataggccaggtacagtggctcacgcctgtaatcccagcactttgggaggctgaggtaggatgattacttgagcccaggagtttgaggccagtctgggcaatatagtgagaccctgtctctgttttttaaaaaaaataaaaattaaaaatcagttaaaagaagaaataagttgagaattgactatcactggaaaaatattcaatgacrtaatttcatagaagtaggttttaattactttattcaatgatgtgtacgttatgtaaaaaaatcaggtgaatttttaatccatgaattctatcttgtgtagtagagaatgtagtaacctcagaaaacattccatttaaatttaaaactatttttatgttacccccaattttagagggatcattcacactgcattctacaaaaggtgaatgacactcggaaaggcatgtgaaaatttggtatgtgcttggtatggatgcatcactcagccctgaatcagcatcagtatctggcactgcatct

SEQ ID NO: 52633 - DNA, 601 bp, Human
ttcctatctacttaatgaaaaagaaaaagtatgaattgctaaaaatgaagtctggcagctggcatataatgttactttgtgttaataggagtaaaaataaatgttttaaaagaagaaataggccaggtacagtggctcacgcctgtaatcccagcactttgggaggctgaggtaggatgattacttgagcccaggagtttgaggccagtctgggcaatatagtgagaccctgtctctgttttttaaaaaaaataaaaattaaaaatcagttaaaagaagaaataagttgagaattgactaycactggaaaaatattcaatgacgtaatttcatagaagtaggttttaattactttattcaatgatgtgtacgttatgtaaaaaaatcaggtgaatttttaatccatgaattctatcttgtgtagtagagaatgtagtaacctcagaaaacattccatttaaatttaaaactatttttatgttacccccaattttagagggatcattcacactgcattctacaaaaggtgaatgacactcggaaaggcatgtgaaaatttggtatgtgcttggtatggatgcatcactcagccctgaatcag

SEQ ID NO: 52634 - DNA, 601 bp, Human
gcgatcctcccgcctcagcctctgaggagctgggactacaggcgcatgctaccacatccagctgtttttagaacttttattgttaacttttcctatctacttaatgaaaaagaaaaagtatgaattgctaaaaatgaagtctggcagctggcatataatgttactttgtgttaataggagtaaaaataaatgttttaaaagaagaaataggccaggtacagtggctcacgcctgtaatcccagcactttgggaggctgaggtaggatgattacttgagcccaggagtttgaggccagtctrggcaatatagtgagaccctgtctctgttttttaaaaaaaataaaaattaaaaatcagttaaaagaagaaataagttgagaattgactatcactggaaaaatattcaatgacgtaatttcatagaagtaggttttaattactttattcaatgatgtgtacgttatgtaaaaaaatcaggtgaatttttaatccatgaattctatcttgtgtagtagagaatgtagtaacctcagaaaacattccatttaaatttaaaactatttttatgttacccccaattttagagggatcattcacact

SEQ ID NO: 52635 - DNA, 601 bp, Human
aaaaatatcaaagtgacccacatacatgttaaattaatataaataacttaaaaagaaacattttattagagatatagttcttaataagatgaatgggactattttcaattagttcatgtatctcaacttagagtactaattttatgcctactttttatttttataaatgtttatataaaaaatctttctataaaaagatatataagaggatggatggtaatggaagaagttttttcctttttttttttttttttaagaaatagggtctcacttggtcacccaaactggagtacagtgataycatcacagctcattccagccttggactcctgggctcaagcgatcctcccgcctcagcctctgaggagctgggactacaggcgcatgctaccacatccagctgtttttagaacttttattgttaacttttcctatctacttaatgaaaaagaaaaagtatgaattgctaaaaatgaagtctggcagctggcatataatgttactttgtgttaataggagtaaaaataaatgttttaaaagaagaaataggccaggtacagtggctcacgcctgtaatcccagcactttgggaggctgaggt

SEQ ID NO: 52636 - DNA, 601 bp, Human
attattacaattattattggtgtaaaaatatcaaagtgacccacatacatgttaaattaatataaataacttaaaaagaaacattttattagagatatagttcttaataagatgaatgggactattttcaattagttcatgtatctcaacttagagtactaattttatgcctactttttatttttataaatgtttatataaaaaatctttctataaaaagatatataagaggatggatggtaatggaagaagttttttcctttttttttttttttttaagaaatagggtctcacttggtcwcccaaactggagtacagtgataccatcacagctcattccagccttggactcctgggctcaagcgatcctcccgcctcagcctctgaggagctgggactacaggcgcatgctaccacatccagctgtttttagaacttttattgttaacttttcctatctacttaatgaaaaagaaaaagtatgaattgctaaaaatgaagtctggcagctggcatataatgttactttgtgttaataggagtaaaaataaatgttttaaaagaagaaataggccaggtacagtggctcacgcctgtaatc

SEQ ID NO: 52637 - DNA, 601 bp, Human
cctatttttgtgtgctctgggagctaagaatagatttacatctttaaaaggctacaaaaaaacaaaaaacaaacaaacaaacaaacaaaaaaacaaccagtagaatgtgcatcagaggctttatgtggccgcaaagcccaaaatagttactgtctggctttttaccaaagttcgccaaccgctttcctagagcctcattctcaattcgtgtagctggtagaaggagaaaaagcaaagaaaagcacagaagatatttcatgggaccaggcctggaagtgacatacatgatttccactcacawgttgttgccagaacaattacatgactacatgttacagcaaggatgatggggaaaagtaggctacctacgtacccgaaggagggtggaacaaattgtgggagccaggtaatagtttctaccatggccaagcctctaaagagtcaaaaacttattattattacaattattattggtgtaaaaatatcaaagtgacccacatacatgttaaattaatataaataacttaaaaagaaacattttattagagatatagttcttaataagatgaatgggactattttcaattagttcatgtatctc

SEQ ID NO: 52638 - DNA, 601 bp, Human
tccccaggtaagcaaagtgctccccaccacatagtgatgaggggaacctaattcctttcatcttatggcttccctgtctcctagaaaaagggtttagcttgtgggcctatttttgtgtgctctgggagctaagaatagatttacatctttaaaaggctacaaaaaaacaaaaaacaaacaaacaaacaaacaaaaaaacaaccagtagaatgtgcatcagaggctttatgtggccgcaaagcccaaaatagttactgtctggctttttaccaaagttcgccaaccgctttcctagagcctyattctcaattcgtgtagctggtagaaggagaaaaagcaaagaaaagcacagaagatatttcatgggaccaggcctggaagtgacatacatgatttccactcacatgttgttgccagaacaattacatgactacatgttacagcaaggatgatggggaaaagtaggctacctacgtacccgaaggagggtggaacaaattgtgggagccaggtaatagtttctaccatggccaagcctctaaagagtcaaaaacttattattattacaattattattggtgtaaaaatatcaaagtgaccc

SEQ ID NO: 52639 - DNA, 601 bp, Human
cagaatagtcctgggtgaggtccccaggtaagcaaagtgctccccaccacatagtgatgaggggaacctaattcctttcatcttatggcttccctgtctcctagaaaaagggtttagcttgtgggcctatttttgtgtgctctgggagctaagaatagatttacatctttaaaaggctacaaaaaaacaaaaaacaaacaaacaaacaaacaaaaaaacaaccagtagaatgtgcatcagaggctttatgtggccgcaaagcccaaaatagttactgtctggctttttaccaaagttcgcyaaccgctttcctagagcctcattctcaattcgtgtagctggtagaaggagaaaaagcaaagaaaagcacagaagatatttcatgggaccaggcctggaagtgacatacatgatttccactcacatgttgttgccagaacaattacatgactacatgttacagcaaggatgatggggaaaagtaggctacctacgtacccgaaggagggtggaacaaattgtgggagccaggtaatagtttctaccatggccaagcctctaaagagtcaaaaacttattattattacaattattattggtg

SEQ ID NO: 52640 - DNA, 601 bp, Human
tcacagaatagtcctgggtgaggtccccaggtaagcaaagtgctccccaccacatagtgatgaggggaacctaattcctttcatcttatggcttccctgtctcctagaaaaagggtttagcttgtgggcctatttttgtgtgctctgggagctaagaatagatttacatctttaaaaggctacaaaaaaacaaaaaacaaacaaacaaacaaacaaaaaaacaaccagtagaatgtgcatcagaggctttatgtggccgcaaagcccaaaatagttactgtctggctttttaccaaagttygccaaccgctttcctagagcctcattctcaattcgtgtagctggtagaaggagaaaaagcaaagaaaagcacagaagatatttcatgggaccaggcctggaagtgacatacatgatttccactcacatgttgttgccagaacaattacatgactacatgttacagcaaggatgatggggaaaagtaggctacctacgtacccgaaggagggtggaacaaattgtgggagccaggtaatagtttctaccatggccaagcctctaaagagtcaaaaacttattattattacaattattattg

SEQ ID NO: 52641 - DNA, 601 bp, Human
aaaagagcagaggcaaaccagaaaaacccctgcttgtacattcagcccagggaatctacgaagctttcaaaagaggtttggttctgagtctataagggttctttgaagcctcttcaaaagtttctgctggcatatcccctaacagaatgttttaaaaccatgtactccttcacaaaattttcagttgacatctaaaatattacatcgtatgtttgaataattgcaaaggttgtaattttcatgatgttattaatatagatattttaaaataaactattgcaatttgctttgaaatatccarttgaatctaaatccaagcgatttgatgcccaccacatccattttaaaagtctacaaatgagctcttttttaacagtcagatgttttttccctaagctcctatttttattctacttctacatatttatcttaatgtactatattattatgcttaaaggtcttattattcattttttatattatacttctctgcattaaaaatgtttgtaatttttttatttcctgtgttattatgaagctgatttgtaataacaaataggtccagcatgtaactgctcaacacaatcaaagcctatttctt

SEQ ID NO: 52642 - DNA, 601 bp, Human
tctcaacaccgctggcaggactcctgacaagcaaggacattcctgtgtatgaacactgtctaaggtgacctagacacaggatttcgaaaagagcagaggcaaaccagaaaaacccctgcttgtacattcagcccagggaatctacgaagctttcaaaagaggtttggttctgagtctataagggttctttgaagcctcttcaaaagtttctgctggcatatcccctaacagaatgttttaaaaccatgtactccttcacaaaattttcagttgacatctaaaatattacatcgtatgtttraataattgcaaaggttgtaattttcatgatgttattaatatagatattttaaaataaactattgcaatttgctttgaaatatccaattgaatctaaatccaagcgatttgatgcccaccacatccattttaaaagtctacaaatgagctcttttttaacagtcagatgttttttccctaagctcctatttttattctacttctacatatttatcttaatgtactatattattatgcttaaaggtcttattattcattttttatattatacttctctgcattaaaaatgtttgtaattttt

SEQ ID NO: 52643 - DNA, 601 bp, Human
ggcgtgaacccgggaggcggagcttgcagtgagccgagatcatgccaccgcactccagcctgggcgacagagcgagactccgtctcaaaaaaaaaaaaaaagaaaagaaaagaaaagaaaatgaggcaagaggtgaagtgacttgtccagggcctgatgagtagacagaaacagataaaaaaaagaagtcaattctctttttttactcactgcccaagagcttcctctctccagtcaccggactcctgctgcaacaggaccagctaaggaatatcgatccagtctgggaaaaaagttatcmcactgcttaggcagatacacattctgaagaaaaggagaaagtgcaaatcctcttgcaggagtcctttcaactcagtttgtggctggttatgtaaatgaggaggccgtgcaagagaatggggtcatgagctgcctggggattaagcatgacaacgccgtctgtcctgggaagaaatgatactttgcacttgtataatacctttcatccatccagcaataataaataagacttcgtactttcagccaaatattgcaaaaacttaacaaatatttaactcatgaatcctcagaaccaccaaga

SEQ ID NO: 52644 - DNA, 601 bp, Human
gcggacccctgtagtcccagctactcgggaggatgaggcaggagaatggcgtgaacccgggaggcggagcttgcagtgagccgagatcatgccaccgcactccagcctgggcgacagagcgagactccgtctcaaaaaaaaaaaaaaagaaaagaaaagaaaagaaaatgaggcaagaggtgaagtgacttgtccagggcctgatgagtagacagaaacagataaaaaaaagaagtcaattctctttttttactcactgcccaagagcttcctctctccagtcaccggactcctgctgcarcaggaccagctaaggaatatcgatccagtctgggaaaaaagttatcccactgcttaggcagatacacattctgaagaaaaggagaaagtgcaaatcctcttgcaggagtcctttcaactcagtttgtggctggttatgtaaatgaggaggccgtgcaagagaatggggtcatgagctgcctggggattaagcatgacaacgccgtctgtcctgggaagaaatgatactttgcacttgtataatacctttcatccatccagcaataataaataagacttcgtactttcagccaaatattgc

SEQ ID NO: 52645 - DNA, 601 bp, Human
caaaccacagcccctaccgctgtagttggtcttgaggccataactgctatttatcctcttcctccttcactatctactctaagttttccatatccagtgctatcccctctacaggtgctgatgtccaacctggtggcggacccctgtagtcccagctactcgggaggatgaggcaggagaatggcgtgaacccgggaggcggagcttgcagtgagccgagatcatgccaccgcactccagcctgggcgacagagcgagactccgtctcaaaaaaaaaaaaaaagaaaagaaaagaaaagaraatgaggcaagaggtgaagtgacttgtccagggcctgatgagtagacagaaacagataaaaaaaagaagtcaattctctttttttactcactgcccaagagcttcctctctccagtcaccggactcctgctgcaacaggaccagctaaggaatatcgatccagtctgggaaaaaagttatcccactgcttaggcagatacacattctgaagaaaaggagaaagtgcaaatcctcttgcaggagtcctttcaactcagtttgtggctggttatgtaaatgaggaggccgtgcaagagaatg

SEQ ID NO: 52646 - DNA, 601 bp, Human
gagggcgattaatgagacaaaccacagcccctaccgctgtagttggtcttgaggccataactgctatttatcctcttcctccttcactatctactctaagttttccatatccagtgctatcccctctacaggtgctgatgtccaacctggtggcggacccctgtagtcccagctactcgggaggatgaggcaggagaatggcgtgaacccgggaggcggagcttgcagtgagccgagatcatgccaccgcactccagcctgggcgacagagcgagactccgtctcaaaaaaaaaaaaaaaraaaagaaaagaaaagaaaatgaggcaagaggtgaagtgacttgtccagggcctgatgagtagacagaaacagataaaaaaaagaagtcaattctctttttttactcactgcccaagagcttcctctctccagtcaccggactcctgctgcaacaggaccagctaaggaatatcgatccagtctgggaaaaaagttatcccactgcttaggcagatacacattctgaagaaaaggagaaagtgcaaatcctcttgcaggagtcctttcaactcagtttgtggctggttatgtaaatgagga

SEQ ID NO: 52647 - DNA, 601 bp, Human
acccacatggtttttatcacagtgcgtacagactgcatcacacaggctgacttctccatttttcagggcgcagttcatccaaggttgctgtgggcctttcctcctcaggggaatcttagaagagggcgattaatgagacaaaccacagcccctaccgctgtagttggtcttgaggccataactgctatttatcctcttcctccttcactatctactctaagttttccatatccagtgctatcccctctacaggtgctgatgtccaacctggtggcggacccctgtagtcccagctactcgrgaggatgaggcaggagaatggcgtgaacccgggaggcggagcttgcagtgagccgagatcatgccaccgcactccagcctgggcgacagagcgagactccgtctcaaaaaaaaaaaaaaagaaaagaaaagaaaagaaaatgaggcaagaggtgaagtgacttgtccagggcctgatgagtagacagaaacagataaaaaaaagaagtcaattctctttttttactcactgcccaagagcttcctctctccagtcaccggactcctgctgcaacaggaccagctaaggaatatcgatcca

SEQ ID NO: 52648 - DNA, 601 bp, Human
actctattgaagaaagtcctaagcatttacccacatggtttttatcacagtgcgtacagactgcatcacacaggctgacttctccatttttcagggcgcagttcatccaaggttgctgtgggcctttcctcctcaggggaatcttagaagagggcgattaatgagacaaaccacagcccctaccgctgtagttggtcttgaggccataactgctatttatcctcttcctccttcactatctactctaagttttccatatccagtgctatcccctctacaggtgctgatgtccaacctggtrgcggacccctgtagtcccagctactcgggaggatgaggcaggagaatggcgtgaacccgggaggcggagcttgcagtgagccgagatcatgccaccgcactccagcctgggcgacagagcgagactccgtctcaaaaaaaaaaaaaaagaaaagaaaagaaaagaaaatgaggcaagaggtgaagtgacttgtccagggcctgatgagtagacagaaacagataaaaaaaagaagtcaattctctttttttactcactgcccaagagcttcctctctccagtcaccggactcctgctgca

SEQ ID NO: 52649 - DNA, 601 bp, Human
gctggtgaagatgtcagctcactgctgtcctcacagtgactctattgaagaaagtcctaagcatttacccacatggtttttatcacagtgcgtacagactgcatcacacaggctgacttctccatttttcagggcgcagttcatccaaggttgctgtgggcctttcctcctcaggggaatcttagaagagggcgattaatgagacaaaccacagcccctaccgctgtagttggtcttgaggccataactgctatttatcctcttcctccttcactatctactctaagttttccatatccartgctatcccctctacaggtgctgatgtccaacctggtggcggacccctgtagtcccagctactcgggaggatgaggcaggagaatggcgtgaacccgggaggcggagcttgcagtgagccgagatcatgccaccgcactccagcctgggcgacagagcgagactccgtctcaaaaaaaaaaaaaaagaaaagaaaagaaaagaaaatgaggcaagaggtgaagtgacttgtccagggcctgatgagtagacagaaacagataaaaaaaagaagtcaattctctttttttactcactgccc

SEQ ID NO: 52650 - DNA, 601 bp, Human
tcaatagtgaaggaggagggtaggaaggagggctggccaggaaaagtctcagccccgaccaggccagtgcttccaaggcaacagctgacccttaggggcgtcccgcgatgggcagcaatggctcagctctagcacccagctgggctcaacccttggtagacaagaaaccacggccttcagtgtgaacagtgcaagcaattttacaggtgtggctggtgaagatgtcagctcactgctgtcctcacagtgactctattgaagaaagtcctaagcatttacccacatggtttttatcacagtscgtacagactgcatcacacaggctgacttctccatttttcagggcgcagttcatccaaggttgctgtgggcctttcctcctcaggggaatcttagaagagggcgattaatgagacaaaccacagcccctaccgctgtagttggtcttgaggccataactgctatttatcctcttcctccttcactatctactctaagttttccatatccagtgctatcccctctacaggtgctgatgtccaacctggtggcggacccctgtagtcccagctactcgggaggatgaggcaggagaatggcg

SEQ ID NO: 52651 - DNA, 601 bp, Human
atccaccaggaagcagatgccaagataagagtcagatgagcagagatgtattggggaaaatgcctgcaaaagttaaagaggagaaagaaggtgagtaagctaggagagtattcagattgcaatgcacgtctgtcaatagtgaaggaggagggtaggaaggagggctggccaggaaaagtctcagccccgaccaggccagtgcttccaaggcaacagctgacccttaggggcgtcccgcgatgggcagcaatggctcagctctagcacccagctgggctcaacccttggtagacaagaaacyacggccttcagtgtgaacagtgcaagcaattttacaggtgtggctggtgaagatgtcagctcactgctgtcctcacagtgactctattgaagaaagtcctaagcatttacccacatggtttttatcacagtgcgtacagactgcatcacacaggctgacttctccatttttcagggcgcagttcatccaaggttgctgtgggcctttcctcctcaggggaatcttagaagagggcgattaatgagacaaaccacagcccctaccgctgtagttggtcttgaggccataactgctatttat

SEQ ID NO: 52652 - DNA, 601 bp, Human
aaaacagacaaaggtagacctctgcttccctgctacaatttctagaaaaagcaaaaccatcctgaaacccctctggagagttcaattacagcaaattggccaacaatgatatctatatttatacagtaaatgtgtttaatatcatgttcaaactaccaatcaagaaaaaaaaatgaataaaaatagatgattacctggaaaatcactagtaagcgtggcttatgggtcagttcagatccaccaggaagcagatgccaagataagagtcagatgagcagagatgtattggggaaaatgcctrcaaaagttaaagaggagaaagaaggtgagtaagctaggagagtattcagattgcaatgcacgtctgtcaatagtgaaggaggagggtaggaaggagggctggccaggaaaagtctcagccccgaccaggccagtgcttccaaggcaacagctgacccttaggggcgtcccgcgatgggcagcaatggctcagctctagcacccagctgggctcaacccttggtagacaagaaaccacggccttcagtgtgaacagtgcaagcaattttacaggtgtggctggtgaagatgtcagctcact

SEQ ID NO: 52653 - DNA, 601 bp, Human
caaggtccccagtactagagtccagtgggagggaaaaggaaaggaaacattaaaagtaatccagggaaactctgaaggtaaacttgcccttctgaaaacagacaaaggtagacctctgcttccctgctacaatttctagaaaaagcaaaaccatcctgaaacccctctggagagttcaattacagcaaattggccaacaatgatatctatatttatacagtaaatgtgtttaatatcatgttcaaactaccaatcaagaaaaaaaaatgaataaaaatagatgattacctggaaaatcacyagtaagcgtggcttatgggtcagttcagatccaccaggaagcagatgccaagataagagtcagatgagcagagatgtattggggaaaatgcctgcaaaagttaaagaggagaaagaaggtgagtaagctaggagagtattcagattgcaatgcacgtctgtcaatagtgaaggaggagggtaggaaggagggctggccaggaaaagtctcagccccgaccaggccagtgcttccaaggcaacagctgacccttaggggcgtcccgcgatgggcagcaatggctcagctctagcacccagc

SEQ ID NO: 52654 - DNA, 601 bp, Human
atttcacttgaacttgcacttctatcgtttaaagaagacaaacaaggtccccagtactagagtccagtgggagggaaaaggaaaggaaacattaaaagtaatccagggaaactctgaaggtaaacttgcccttctgaaaacagacaaaggtagacctctgcttccctgctacaatttctagaaaaagcaaaaccatcctgaaacccctctggagagttcaattacagcaaattggccaacaatgatatctatatttatacagtaaatgtgtttaatatcatgttcaaactaccaatcaagaaaaaaaaatgaataaaaatagatgattacctggaaaatcactagtaagcgtggcttatgggtcagttcagatccaccaggaagcagatgccaagataagagtcagatgagcagagatgtattggggaaaatgcctgcaaaagttaaagaggagaaagaaggtgagtaagctaggagagtattcagattgcaatgcacgtctgtcaatagtgaaggaggagggtaggaaggagggctggccaggaaaagtctcagccccgaccaggccagtgcttccaaggcaacagctgacccttagggg

SEQ ID NO: 52655 - DNA, 601 bp, Human
ctgttatcacatacccatctgaactcaaaagggcttcacttaaataagaaatttccattcttctagaaatgtcatttcacttgaacttgcacttctatcgtttaaagaagacaaacaaggtccccagtactagagtccagtgggagggaaaaggaaaggaaacattaaaagtaatccagggaaactctgaaggtaaacttgcccttctgaaaacagacaaaggtagacctctgcttccctgctacaatttctagaaaaagcaaaaccatcctgaaacccctctggagagttcaattacagyaaattggccaacaatgatatctatatttatacagtaaatgtgtttaatatcatgttcaaactaccaatcaagaaaaaaaaatgaataaaaatagatgattacctggaaaatcactagtaagcgtggcttatgggtcagttcagatccaccaggaagcagatgccaagataagagtcagatgagcagagatgtattggggaaaatgcctgcaaaagttaaagaggagaaagaaggtgagtaagctaggagagtattcagattgcaatgcacgtctgtcaatagtgaaggaggagggtagga

SEQ ID NO: 52656 - DNA, 601 bp, Human
caatatacccccacatatacaagaaccccacatcttacaagggaacctcctttgtgaccacataatcttaccaaggaaaatcccaaatgagttcctgcaccagtcccattactctgcagcctgggcagcagtgggtagctagtctgggaacaagagtgctcttctctttctgttatcacatacccatctgaactcaaaagggcttcacttaaataagaaatttccattcttctagaaatgtcatttcacttgaacttgcacttctatcgtttaaagaagacaaacaaggtccccagtactrgagtccagtgggagggaaaaggaaaggaaacattaaaagtaatccagggaaactctgaaggtaaacttgcccttctgaaaacagacaaaggtagacctctgcttccctgctacaatttctagaaaaagcaaaaccatcctgaaacccctctggagagttcaattacagcaaattggccaacaatgatatctatatttatacagtaaatgtgtttaatatcatgttcaaactaccaatcaagaaaaaaaaatgaataaaaatagatgattacctggaaaatcactagtaagcgtggcttat

SEQ ID NO: 52657 - DNA, 601 bp, Human
ggaacaagaaataagaaccccacatatacaaggttatacacatatacaagaacccccacatatacaagaacaatacacatatacaatatacccccacatatacaagaaccccacatcttacaagggaacctcctttgtgaccacataatcttaccaaggaaaatcccaaatgagttcctgcaccagtcccattactctgcagcctgggcagcagtgggtagctagtctgggaacaagagtgctcttctctttctgttatcacatacccatctgaactcaaaagggcttcacttaaataagraatttccattcttctagaaatgtcatttcacttgaacttgcacttctatcgtttaaagaagacaaacaaggtccccagtactagagtccagtgggagggaaaaggaaaggaaacattaaaagtaatccagggaaactctgaaggtaaacttgcccttctgaaaacagacaaaggtagacctctgcttccctgctacaatttctagaaaaagcaaaaccatcctgaaacccctctggagagttcaattacagcaaattggccaacaatgatatctatatttatacagtaaatgtgtttaat

SEQ ID NO: 52658 - DNA, 601 bp, Human
tcattctgtttggctggaaagacaagcataatctagtggtaaatttcaaccttgctaatgaatcctccctttgactttctggtcagctttgctaaatgagtaactttacagcctccaacacaagccattggcgtgggagagacttggccttttttacccaaaatcaccaaaggcctttgtacagagtccaagtttttacctttagtcagtcttttctatttcaccactgccaggggttttgtttttgtggaacaagaaataagaaccccacatatacaaggttatacacatatacaagaayccccacatatacaagaacaatacacatatacaatatacccccacatatacaagaaccccacatcttacaagggaacctcctttgtgaccacataatcttaccaaggaaaatcccaaatgagttcctgcaccagtcccattactctgcagcctgggcagcagtgggtagctagtctgggaacaagagtgctcttctctttctgttatcacatacccatctgaactcaaaagggcttcacttaaataagaaatttccattcttctagaaatgtcatttcacttgaacttgcacttctatcgt

SEQ ID NO: 52659 - DNA, 601 bp, Human
ggaacgggggatcccttttaataaattctctgacaacactgaggcaatagttacattgatttctccacataagctccctcagacactccactcaccaaaaagtcaccttggtttcaaattttttttcattagtgtttgaacaccccacaaaaagactgccatgaagtctcattctgtttggctggaaagacaagcataatctagtggtaaatttcaaccttgctaatgaatcctccctttgactttctggtcagctttgctaaatgagtaactttacagcctccaacacaagccattggcrtgggagagacttggccttttttacccaaaatcaccaaaggcctttgtacagagtccaagtttttacctttagtcagtcttttctatttcaccactgccaggggttttgtttttgtggaacaagaaataagaaccccacatatacaaggttatacacatatacaagaacccccacatatacaagaacaatacacatatacaatatacccccacatatacaagaaccccacatcttacaagggaacctcctttgtgaccacataatcttaccaaggaaaatcccaaatgagttcctgcacca

SEQ ID NO: 52660 - DNA, 601 bp, Human
gaggcagtggttgcagtaagccgagatggcgccactgcactccaggcagggcaacagagcaagattgtgtctcaaaaaaaacaacaaaaaactgagtcttcattgcttcacatcacaactcaaggtctaaaatttgaagtgttggatcccattcttagaaaaaaataagtagttaccaatggggaacgggggatcccttttaataaattctctgacaacactgaggcaatagttacattgatttctccacataagctccctcagacactccactcaccaaaaagtcaccttggtttcaaawtttttttcattagtgtttgaacaccccacaaaaagactgccatgaagtctcattctgtttggctggaaagacaagcataatctagtggtaaatttcaaccttgctaatgaatcctccctttgactttctggtcagctttgctaaatgagtaactttacagcctccaacacaagccattggcgtgggagagacttggccttttttacccaaaatcaccaaaggcctttgtacagagtccaagtttttacctttagtcagtcttttctatttcaccactgccaggggttttgtttttgtgga

SEQ ID NO: 52661 - DNA, 601 bp, Human
ggaggcagtggttgcagtaagccgagatggcgccactgcactccaggcagggcaacagagcaagattgtgtctcaaaaaaaacaacaaaaaactgagtcttcattgcttcacatcacaactcaaggtctaaaatttgaagtgttggatcccattcttagaaaaaaataagtagttaccaatggggaacgggggatcccttttaataaattctctgacaacactgaggcaatagttacattgatttctccacataagctccctcagacactccactcaccaaaaagtcaccttggtttcaawttttttttcattagtgtttgaacaccccacaaaaagactgccatgaagtctcattctgtttggctggaaagacaagcataatctagtggtaaatttcaaccttgctaatgaatcctccctttgactttctggtcagctttgctaaatgagtaactttacagcctccaacacaagccattggcgtgggagagacttggccttttttacccaaaatcaccaaaggcctttgtacagagtccaagtttttacctttagtcagtcttttctatttcaccactgccaggggttttgtttttgtgg

SEQ ID NO: 52662 - DNA, 601 bp, Human
gttctttgtctaatcctgatttaaatacattatcatgtgaaaaatctctctcttctatctgccctaaggatagatttttggggctgtcaagagctgactcttggccaggcgtgtaatctgagcactttgggaggctaaggcgggcagatcacctgaggtcaggagtttgagaccagcctggccgacatggtgaaaccccgtctctactaaaaatacaaaaaattagccgggcatggtggcgggcgcctgtaatcccagctgcttaggaggttgaggcaggagaatcacttgggcctgggakgcagtggttgcagtaagccgagatggcgccactgcactccaggcagggcaacagagcaagattgtgtctcaaaaaaaacaacaaaaaactgagtcttcattgcttcacatcacaactcaaggtctaaaatttgaagtgttggatcccattcttagaaaaaaataagtagttaccaatggggaacgggggatcccttttaataaattctctgacaacactgaggcaatagttacattgatttctccacataagctccctcagacactccactcaccaaaaagtcaccttggtttcaaattt

SEQ ID NO: 52663 - DNA, 601 bp, Human
tcaacactagagatgataataattcagagtctggttagttggcattaaatctataaaaataatactggttaatggcttttagggaaagaagcctctagatttttaggtatccacttctctcataagtgtaaaagactgcctttttccaattaaatatgacaacttgtatctttcagcaaggaaggatgaagttctttgtctaatcctgatttaaatacattatcatgtgaaaaatctctctcttctatctgccctaaggatagatttttggggctgtcaagagctgactcttggccaggcrtgtaatctgagcactttgggaggctaaggcgggcagatcacctgaggtcaggagtttgagaccagcctggccgacatggtgaaaccccgtctctactaaaaatacaaaaaattagccgggcatggtggcgggcgcctgtaatcccagctgcttaggaggttgaggcaggagaatcacttgggcctgggaggcagtggttgcagtaagccgagatggcgccactgcactccaggcagggcaacagagcaagattgtgtctcaaaaaaaacaacaaaaaactgagtcttcattgcttcacat

SEQ ID NO: 52664 - DNA, 601 bp, Human
tccctcgtatagattgtacagcctggagttcaacactagagatgataataattcagagtctggttagttggcattaaatctataaaaataatactggttaatggcttttagggaaagaagcctctagatttttaggtatccacttctctcataagtgtaaaagactgcctttttccaattaaatatgacaacttgtatctttcagcaaggaaggatgaagttctttgtctaatcctgatttaaatacattatcatgtgaaaaatctctctcttctatctgccctaaggatagatttttggrgctgtcaagagctgactcttggccaggcgtgtaatctgagcactttgggaggctaaggcgggcagatcacctgaggtcaggagtttgagaccagcctggccgacatggtgaaaccccgtctctactaaaaatacaaaaaattagccgggcatggtggcgggcgcctgtaatcccagctgcttaggaggttgaggcaggagaatcacttgggcctgggaggcagtggttgcagtaagccgagatggcgccactgcactccaggcagggcaacagagcaagattgtgtctcaaaaaaaacaa

SEQ ID NO: 52665 - DNA, 601 bp, Human
aaggcttatccctcgtatagattgtacagcctggagttcaacactagagatgataataattcagagtctggttagttggcattaaatctataaaaataatactggttaatggcttttagggaaagaagcctctagatttttaggtatccacttctctcataagtgtaaaagactgcctttttccaattaaatatgacaacttgtatctttcagcaaggaaggatgaagttctttgtctaatcctgatttaaatacattatcatgtgaaaaatctctctcttctatctgccctaaggatagrtttttggggctgtcaagagctgactcttggccaggcgtgtaatctgagcactttgggaggctaaggcgggcagatcacctgaggtcaggagtttgagaccagcctggccgacatggtgaaaccccgtctctactaaaaatacaaaaaattagccgggcatggtggcgggcgcctgtaatcccagctgcttaggaggttgaggcaggagaatcacttgggcctgggaggcagtggttgcagtaagccgagatggcgccactgcactccaggcagggcaacagagcaagattgtgtctcaaa

SEQ ID NO: 52666 - DNA, 601 bp, Human
ttgagtccttctagacttggaggtatcacatgaagctcttaacagccaaacaatgttaggactacatgggcactaacccagtggctgcacgttgtagttctactgagtcatcatctcccattttttgtgaatgattttagacaagagaaatttcacagttcattctgtatatttcctcctacctgccatctgtttcaccagagggaaaagaatctgaagatatttgaaaagagaattaaaacatcttgataagataccaaagaaaaagtgaatgagaagacccttgagatctacctgtcaycttcctaaaaaattctgtaactgctgtctgtgaaagtgtcagtcaaggcttatccctcgtatagattgtacagcctggagttcaacactagagatgataataattcagagtctggttagttggcattaaatctataaaaataatactggttaatggcttttagggaaagaagcctctagatttttaggtatccacttctctcataagtgtaaaagactgcctttttccaattaaatatgacaacttgtatctttcagcaaggaaggatgaagttctttgtctaatcctgatttaaataca

SEQ ID NO: 52667 - DNA, 601 bp, Human
gaggcaggagaatggcgtgaacccaggaggtggagcttgcagtgagctcagatcgtgccactgcattccagcctgggcgacagagcaagactccatctcaaaaaaaaaaaaaattatgaaaaaaatcttactaatgatgtctaggcaacccagcatcccactatgctccaaattcgtggaagccccaagtctcaatctgtcctgatactctggttgagtccttctagacttggaggtatcacatgaagctcttaacagccaaacaatgttaggactacatgggcactaacccagtggctgyacgttgtagttctactgagtcatcatctcccattttttgtgaatgattttagacaagagaaatttcacagttcattctgtatatttcctcctacctgccatctgtttcaccagagggaaaagaatctgaagatatttgaaaagagaattaaaacatcttgataagataccaaagaaaaagtgaatgagaagacccttgagatctacctgtcaccttcctaaaaaattctgtaactgctgtctgtgaaagtgtcagtcaaggcttatccctcgtatagattgtacagcctggagttcaaca

SEQ ID NO: 52668 - DNA, 601 bp, Human
tgagatcatcctggctaacatggtgaaatcccgtctctactaaaaaatacaaaaaattagcaggacgtggtggtgggcacctgtagtcccagctacttgggaggctgaggcaggagaatggcgtgaacccaggaggtggagcttgcagtgagctcagatcgtgccactgcattccagcctgggcgacagagcaagactccatctcaaaaaaaaaaaaaattatgaaaaaaatcttactaatgatgtctaggcaacccagcatcccactatgctccaaattcgtggaagccccaagtctcartctgtcctgatactctggttgagtccttctagacttggaggtatcacatgaagctcttaacagccaaacaatgttaggactacatgggcactaacccagtggctgcacgttgtagttctactgagtcatcatctcccattttttgtgaatgattttagacaagagaaatttcacagttcattctgtatatttcctcctacctgccatctgtttcaccagagggaaaagaatctgaagatatttgaaaagagaattaaaacatcttgataagataccaaagaaaaagtgaatgagaagacc

SEQ ID NO: 52669 - DNA, 601 bp, Human
agttggaacttgatgcattttgttataggaaaaaacaaatcttactaatggggccgggcgcagtggctcacgcctgtaatcccagcactttgggaggctgagggggggtggatcatgaggtcaggagattgagatcatcctggctaacatggtgaaatcccgtctctactaaaaaatacaaaaaattagcaggacgtggtggtgggcacctgtagtcccagctacttgggaggctgaggcaggagaatggcgtgaacccaggaggtggagcttgcagtgagctcagatcgtgccactgcaytccagcctgggcgacagagcaagactccatctcaaaaaaaaaaaaaattatgaaaaaaatcttactaatgatgtctaggcaacccagcatcccactatgctccaaattcgtggaagccccaagtctcaatctgtcctgatactctggttgagtccttctagacttggaggtatcacatgaagctcttaacagccaaacaatgttaggactacatgggcactaacccagtggctgcacgttgtagttctactgagtcatcatctcccattttttgtgaatgattttagacaagagaaattt

SEQ ID NO: 52670 - DNA, 601 bp, Human
gtaaattgtttagttggaacttgatgcattttgttataggaaaaaacaaatcttactaatggggccgggcgcagtggctcacgcctgtaatcccagcactttgggaggctgagggggggtggatcatgaggtcaggagattgagatcatcctggctaacatggtgaaatcccgtctctactaaaaaatacaaaaaattagcaggacgtggtggtgggcacctgtagtcccagctacttgggaggctgaggcaggagaatggcgtgaacccaggaggtggagcttgcagtgagctcagatcrtgccactgcattccagcctgggcgacagagcaagactccatctcaaaaaaaaaaaaaattatgaaaaaaatcttactaatgatgtctaggcaacccagcatcccactatgctccaaattcgtggaagccccaagtctcaatctgtcctgatactctggttgagtccttctagacttggaggtatcacatgaagctcttaacagccaaacaatgttaggactacatgggcactaacccagtggctgcacgttgtagttctactgagtcatcatctcccattttttgtgaatgattttagac

SEQ ID NO: 52671 - DNA, 601 bp, Human
agttgtattcctaaaattattttgtaaattgtttagttggaacttgatgcattttgttataggaaaaaacaaatcttactaatggggccgggcgcagtggctcacgcctgtaatcccagcactttgggaggctgagggggggtggatcatgaggtcaggagattgagatcatcctggctaacatggtgaaatcccgtctctactaaaaaatacaaaaaattagcaggacgtggtggtgggcacctgtagtcccagctacttgggaggctgaggcaggagaatggcgtgaacccaggaggtrgagcttgcagtgagctcagatcgtgccactgcattccagcctgggcgacagagcaagactccatctcaaaaaaaaaaaaaattatgaaaaaaatcttactaatgatgtctaggcaacccagcatcccactatgctccaaattcgtggaagccccaagtctcaatctgtcctgatactctggttgagtccttctagacttggaggtatcacatgaagctcttaacagccaaacaatgttaggactacatgggcactaacccagtggctgcacgttgtagttctactgagtcatcatctccc

SEQ ID NO: 52672 - DNA, 601 bp, Human
actttttaagagttgtattcctaaaattattttgtaaattgtttagttggaacttgatgcattttgttataggaaaaaacaaatcttactaatggggccgggcgcagtggctcacgcctgtaatcccagcactttgggaggctgagggggggtggatcatgaggtcaggagattgagatcatcctggctaacatggtgaaatcccgtctctactaaaaaatacaaaaaattagcaggacgtggtggtgggcacctgtagtcccagctacttgggaggctgaggcaggagaatggcgtgaayccaggaggtggagcttgcagtgagctcagatcgtgccactgcattccagcctgggcgacagagcaagactccatctcaaaaaaaaaaaaaattatgaaaaaaatcttactaatgatgtctaggcaacccagcatcccactatgctccaaattcgtggaagccccaagtctcaatctgtcctgatactctggttgagtccttctagacttggaggtatcacatgaagctcttaacagccaaacaatgttaggactacatgggcactaacccagtggctgcacgttgtagttctactgagtc

SEQ ID NO: 52673 - DNA, 601 bp, Human
aggtttagaaaagtttatgtcttgccaaaggccattgatttataacaagagcaccaggactcaacccctccagtatctctccggctttcaaattatatttcttctgtagtttcctaacagaatcagactcttaattacttcctcctctgtgagcatacactattttgtcttttcctttaaagagagggaaagagaggctgtttttaaaggcatttttcctccactgacttacagtatcatttcacaaatgttttgtcatctaatggccatacgatgtacagaggctcctaaaatgtatatmgaagcttagttgtctcctccctctcattaaataaataaaaacttaaatgtgttggaggtactgaaaattcaatcaaaccctgattattggagcgcttgtgtgtattaaagaatccttctgtgatgtgaatcattatttctaattaatatgaaacattgggtctctactttttaagagttgtattcctaaaattattttgtaaattgtttagttggaacttgatgcattttgttataggaaaaaacaaatcttactaatggggccgggcgcagtggctcacgcctgtaatcccagcacttt

SEQ ID NO: 52674 - DNA, 601 bp, Human
tggagccaaggagaagagagccctccaaaccaaaacaaggtggagagaggacctgagtataagaaagccagtgcctgtgggcaccagttcaattcacacatgcttaaaaatggctaaattttctttaaaaatatatatttctagataatcttagataagagagtagattaattctcatacagcatctgccacacaatacatcctaatttgaccatatgattgaagacatctcaatctagttatgatcattaaaagctgttagtatttcaactatggcaataataataaatcatatttatayaatattttacagactacaaaacaacttcacatgtacagtcacacacgaatctcatagtaaccctgtgagaatgggcagatacaccttactagaactattttacagataagaaaaccaaggtttagaaaagtttatgtcttgccaaaggccattgatttataacaagagcaccaggactcaacccctccagtatctctccggctttcaaattatatttcttctgtagtttcctaacagaatcagactcttaattacttcctcctctgtgagcatacactattttgtcttttcctttaaaga

SEQ ID NO: 52675 - DNA, 601 bp, Human
gtgatgagagaactaattagcagtgtttggggtggggggaatttcaaggtgctcaatattatccatccattcaacaaatacggtacatatttttttaatatccattgtgttcaagggcagaagtgatctttcaagctgagcttggaagagtttgccacctgattaaaacatttattgtttgacaatttcactcaactcctccctttacccaaataagtcacagatctggttacactagctgttcaagccactgctcttccttgtcttatttttcttggtgacaagagtcaagtatatatgrgctctactattatctctctgtctcagcattgtccagacacaagttaggacacttttcatgcctggtcaaaaaagttaatttgtggtttggagccaaggagaagagagccctccaaaccaaaacaaggtggagagaggacctgagtataagaaagccagtgcctgtgggcaccagttcaattcacacatgcttaaaaatggctaaattttctttaaaaatatatatttctagataatcttagataagagagtagattaattctcatacagcatctgccacacaatacatcctaatttgacc

SEQ ID NO: 52676 - DNA, 601 bp, Human
tatattaaaaactatgtagaaataaaaagataaatatttctctttgtgtgcttatatctgtatatatgtgtaacatgataacactgaatcatcactctcagaagtacaaaccatattattagtattattttgggtgtgatgagagaactaattagcagtgtttggggtggggggaatttcaaggtgctcaatattatccatccattcaacaaatacggtacatatttttttaatatccattgtgttcaagggcagaagtgatctttcaagctgagcttggaagagtttgccacctgattaraacatttattgtttgacaatttcactcaactcctccctttacccaaataagtcacagatctggttacactagctgttcaagccactgctcttccttgtcttatttttcttggtgacaagagtcaagtatatatgggctctactattatctctctgtctcagcattgtccagacacaagttaggacacttttcatgcctggtcaaaaaagttaatttgtggtttggagccaaggagaagagagccctccaaaccaaaacaaggtggagagaggacctgagtataagaaagccagtgcctgt

SEQ ID NO: 52677 - DNA, 601 bp, Human
gttgctcattgcaccatgatctataataacgggaaattagaaatttcctttctttctttttttttttttttttgagacagagtcttgctctgtcaccaggctggagtgcagtggcgtcatcttggctcactgcaaactccgcctcccgggttcaagccattctcctgcctcagcctcccaagtagctgggattacaggagcccaccatcatgcccagttaatttttgtatttttggtagagatgggggtttcaccattttggccaggatgttctcgatctcctgacctcatgatctgcccrcctcagcctcccaaagtgctgggattacaggcatgagttactgcgcccggctcagaaatttcctaaatatttaagaagagaatggttaagtatatctaacagcttaacatatgcaatgaagattctgatagttatttgaaagtgtttatgaagacaatgtgacaacctgaaaaatgtttttaagaatttttataattttaatgagaaaaattacgaaacaaagatctgtgaatactatcattataactttgttcaaaaacatggaaaaatgaataaaaagatgctaaaattatattaaaa

SEQ ID NO: 52678 - DNA, 601 bp, Human
agtaatgcatttgggctagagaaaaaaggaatttttgatatttaatcttaacttcagtaccttatgtaagttatttatcctttagtatttttgctatcattttggggcaagggactggaggaaatatttttaaatgggaaatattaagtaatagatattttcctagaaaataaaaatacacttttgaaaaggctcaacaatatacagtatggtttagaagttaatgatcagggcatattgcagagttgctcattgcaccatgatctataataacgggaaattagaaatttcctttctttctttttttttttttttttgagacagagtcttgctctgtcaccaggctggagtgcagtggcgtcatcttggctcactgcaaactccgcctcccgggttcaagccattctcctgcctcagcctcccaagtagctgggattacaggagcccaccatcatgcccagttaatttttgtatttttggtagagatgggggtttcaccattttggccaggatgttctcgatctcctgacctcatgatctgcccgcctcagcctcccaaagtgctgggattacaggcatgagttactgcgcccggctcaga

SEQ ID NO: 52679 - DNA, 601 bp, Human
caggctgtagtgcaatggcgccatctcggctcaccgcaacctccacctcccgggttcaaacgattctcctgcctcagcctcccgagtagctgggattacaggcatgcgccatcatgcctggctgattttgtattttagtagagatggggtttctctatgttggtcaggctggtctcgaactcctgatctcaggtgtgatccacccaccttggcttctcaaagtgctgggattataggagtgaaccaccgcgcccggccagaaggcactatcttttgtctgatgttatctgttgctttagtratgcatttgggctagagaaaaaaggaatttttgatatttaatcttaacttcagtaccttatgtaagttatttatcctttagtatttttgctatcattttggggcaagggactggaggaaatatttttaaatgggaaatattaagtaatagatattttcctagaaaataaaaatacacttttgaaaaggctcaacaatatacagtatggtttagaagttaatgatcagggcatattgcagagttgctcattgcaccatgatctataataacgggaaattagaaatttcctttctttctttt

SEQ ID NO: 52680 - DNA, 601 bp, Human
tgataatgatgatggaaggcactatcttttttttttttttttgagacggagtttcgctcctgttgcccaggctgtagtgcaatggcgccatctcggctcaccgcaacctccacctcccgggttcaaacgattctcctgcctcagcctcccgagtagctgggattacaggcatgcgccatcatgcctggctgattttgtattttagtagagatggggtttctctatgttggtcaggctggtctcgaactcctgatctcaggtgtgatccacccaccttggcttctcaaagtgctgggattayaggagtgaaccaccgcgcccggccagaaggcactatcttttgtctgatgttatctgttgctttagtaatgcatttgggctagagaaaaaaggaatttttgatatttaatcttaacttcagtaccttatgtaagttatttatcctttagtatttttgctatcattttggggcaagggactggaggaaatatttttaaatgggaaatattaagtaatagatattttcctagaaaataaaaatacacttttgaaaaggctcaacaatatacagtatggtttagaagttaatgatcagggcata

SEQ ID NO: 52681 - DNA, 601 bp, Human
tgttcttaataaatgcatcactggcatgatgataaggaagataattttgatgataatgatgatggaaggcactatcttttttttttttttttgagacggagtttcgctcctgttgcccaggctgtagtgcaatggcgccatctcggctcaccgcaacctccacctcccgggttcaaacgattctcctgcctcagcctcccgagtagctgggattacaggcatgcgccatcatgcctggctgattttgtattttagtagagatggggtttctctatgttggtcaggctggtctcgaactccygatctcaggtgtgatccacccaccttggcttctcaaagtgctgggattataggagtgaaccaccgcgcccggccagaaggcactatcttttgtctgatgttatctgttgctttagtaatgcatttgggctagagaaaaaaggaatttttgatatttaatcttaacttcagtaccttatgtaagttatttatcctttagtatttttgctatcattttggggcaagggactggaggaaatatttttaaatgggaaatattaagtaatagatattttcctagaaaataaaaatacacttttga

SEQ ID NO: 52682 - DNA, 601 bp, Human
ggataagagttgaccagttccttgacaaatcaaacgtgatacttgtgttttcagaatttaccatatcccaagtgtttagcacagtgtccagcatatagcaaatatgcaaatacctaaataaaaaataattggtgctgccactcatttttgcatttactcttttgttgccatgtttcactttggtgttcttaataaatgcatcactggcatgatgataaggaagataattttgatgataatgatgatggaaggcactatcttttttttttttttttgagacggagtttcgctcctgttgccsaggctgtagtgcaatggcgccatctcggctcaccgcaacctccacctcccgggttcaaacgattctcctgcctcagcctcccgagtagctgggattacaggcatgcgccatcatgcctggctgattttgtattttagtagagatggggtttctctatgttggtcaggctggtctcgaactcctgatctcaggtgtgatccacccaccttggcttctcaaagtgctgggattataggagtgaaccaccgcgcccggccagaaggcactatcttttgtctgatgttatctgttgctttagta

SEQ ID NO: 52683 - DNA, 601 bp, Human
gagaaaattcccagagccagggttgggtcaccattagcaactgaagaggagcaaaacagacaaggaccttgaatagataaaggtttgaataatgaagagtccagaaaactattgaataaggttcaacatgaggataagagttgaccagttccttgacaaatcaaacgtgatacttgtgttttcagaatttaccatatcccaagtgtttagcacagtgtccagcatatagcaaatatgcaaatacctaaataaaaaataattggtgctgccactcatttttgcatttactcttttgttgccrtgtttcactttggtgttcttaataaatgcatcactggcatgatgataaggaagataattttgatgataatgatgatggaaggcactatcttttttttttttttttgagacggagtttcgctcctgttgcccaggctgtagtgcaatggcgccatctcggctcaccgcaacctccacctcccgggttcaaacgattctcctgcctcagcctcccgagtagctgggattacaggcatgcgccatcatgcctggctgattttgtattttagtagagatggggtttctctatgttggtcaggct

SEQ ID NO: 52684 - DNA, 601 bp, Human
ggttagaaacttggtggggtggctaagttagaggactgtggtcccagaagcccttggggcagaacctgccctgacttgctgaaccagtatggagaaaattcccagagccagggttgggtcaccattagcaactgaagaggagcaaaacagacaaggaccttgaatagataaaggtttgaataatgaagagtccagaaaactattgaataaggttcaacatgaggataagagttgaccagttccttgacaaatcaaacgtgatacttgtgttttcagaatttaccatatcccaagtgtttarcacagtgtccagcatatagcaaatatgcaaatacctaaataaaaaataattggtgctgccactcatttttgcatttactcttttgttgccatgtttcactttggtgttcttaataaatgcatcactggcatgatgataaggaagataattttgatgataatgatgatggaaggcactatcttttttttttttttttgagacggagtttcgctcctgttgcccaggctgtagtgcaatggcgccatctcggctcaccgcaacctccacctcccgggttcaaacgattctcctgcctcagcc

SEQ ID NO: 52685 - DNA, 601 bp, Human
aatttctcaccattcactacgatttcagctacttctggactcaactctttaacaagattgcaagctctctgagaacaagtctaagagaacttcactttctttttgtttctcccatgcctaacaaagtgttctccatgcaggagtgttctgtacatgcctaacccagtggattttgcccctgctattcatctgccatttttgcctcaggaaagcttcagctgcttctcagccctacctccgggttgctgacttggtctgaatgactgatttcagcaaaggtgtatggttagaaacttggtgkggtggctaagttagaggactgtggtcccagaagcccttggggcagaacctgccctgacttgctgaaccagtatggagaaaattcccagagccagggttgggtcaccattagcaactgaagaggagcaaaacagacaaggaccttgaatagataaaggtttgaataatgaagagtccagaaaactattgaataaggttcaacatgaggataagagttgaccagttccttgacaaatcaaacgtgatacttgtgttttcagaatttaccatatcccaagtgtttagcacagtgtccagcata

SEQ ID NO: 52686 - DNA, 601 bp, Human
ttcactttgttgcccaggctagagtgcaatggcttgatctcagctcactgcacccttcacctcccaggttcaagtgattcttgtgcctcagcctcccgagtagttgggactacagacgtgcaccaccacgcctggctaatttttgtatttttttagtagaggcaggatttcatcatgttggccaggctgatcttgaactcctggtctcaagtgatccgcccaccttggcctcccaaagtgctaggattataggcttgagccaccatgcccggccacaaataaagtttttttttttttttttgagacggagtcttactctgtcacctaggctggagtgcagtggcacaatatcagctcaccacaacctccacctcccgggttcaagcgattctcctgcctcagcctcctgagtagctgggattacaggcacccaccaccacacctggctaatttttgtatatttagtagagacggggtttcaccatttgggccaggctggtcttgaactcctgaccttgtgatccacccgcctccacctcccaaagtgctgggattacaggcgtgagccacctcgcccggccaaataaagctcttaacacaa

SEQ ID NO: 52687 - DNA, 601 bp, Human
ctgagtcacttcagacaagacatttaagctctctattcttgggtttcctcctttgtaaattagggacaataacagtacccaccccacaggattctaggtgaaaacacatacacattttatttgttgatatttgatttagaacacaatatttgaagctggctctatctgctacattatgcaagtagcttagcattcctaagtcacagtttactcatttacaaattggaaataatattgtggtagtctctctgctgcgttgctgcctttcaatggcccagcctcatgttatttatacctttaygtagccccttccacttaatctggactgggccagtgatttgccttaaccaggaaaatgtggcagtgaagttgtgccacttccctgcctttcccatcccatcccctaggaaggtatggaagcttccactttgtacttttaggagacctgagccactaagtaagaagtccagttaccctgttggataaaccacatggagaaggaaaggccctgagatacttggagagagggaaaagtccagctgcccagcacctgagctgagcccagcctcagccaaccccaccggctgactgcaaacacatc

SEQ ID NO: 52688 - DNA, 601 bp, Human
ccttttatttaaagtcggaggaagtgggtaagagggttacagggtgagagggcgagatggtgggagaaagaatagagggaaaaggaaacgaggagacagataattgcccgcctggagatcccagacactcagcggtaagaccagcaggatgggggaggggtccctcctgacctcgagaattatgcaactttcttgaagcaaagaagttgcctggaggaggagaagatagggcgaggggtggagggaataactgcactcggggcttgctgaaccgcaggatggcaaaggaaaggtcgcacgwttccaggacaggcagccccccgaaagaagttcagcccgagccaactccaccacgtctcgactccggaagcccgaggagcctggagccctggagtggtgccggatgagcgcgcgagctccagcgggcactacctgggcgggcagcgaagctgagcctgagcgcgcggcggccgccgtcccgcccgaacttgccgtcgggcctgggtcgctcgggtgagtcccgagattgcggagctggagccgaggcttggctgacaaatcccgacccgactctgtgcctggcagtctaagggcttcggct

SEQ ID NO: 52689 - DNA, 601 bp, Human
tcttctttataattccccattttctggtttatgtatagaaagcatgtattctatttataatcagagaccttttaaaaatttaatgtgatcagtattcagtcagtgtgccaggttgcccaacaccccagcctgattcatgagattgagaggacagcaggaataatgaatgaacacagtggttttcagaggctaggtgttttaacattcaatctgcttcactgttactctaatttttaaaaactttttatttagagatggggtgggggtggtagtggctgcaggtgggcaccaccatgccctrgtcattgttactctaaaggaatatctgaataccacaggacacctgaacaccacaggaaagctgtgaatgctcaggaaaggtgccttcaggaggttgcagaaagtgattacatcatatacctaggaataatcttacctgagaaaatgacaaaaggcttttttaaagcttcttagatgtccaggctctgtttcccattaagttcattgtttagctaaggaagtgacatgggggaaaggtgtcggtggggaaaaaggaaaactgttgcctaagtagacagcaacagattagaggtccagtcca

SEQ ID NO: 52690 - DNA, 481 bp, Human
tcaatgcttttttttaattttttttattttttatttttttgaggcagagttttgctcttgttgcccagtctggagtgcaatggcatgatctcggctcactgcaacctctgcctcccggattcaagcgattctcctgcctcggcctcctgagtagctggaattacaggcaagcgccaccatgcccggctaattttgtatttttaatagagacagggtttctccatgttggtcaggctggtttcgaactcctgacctcaggtgatctgcctgcctcagcctcccaaagtgctgggattacagkcgtgagccaccgcgcccagccaagttcaaatgatttctagttgtaaattagctgaactggctaaagatcttttagatggcacaaaggcaaggccctggaagatcatcgcccctttcaccgtctaaatcccgaacaataacaggaatgaacttgcaaaggtggtgtttgtgccaggcactg

SEQ ID NO: 52691 - DNA, 567 bp, Human
agattctgtcagctgcctgcggtgataaagccagccacacatttcttcttttaggacatactcacgatgctaacacaaacaggagttcaatgcttttttttaattttttttattttttatttttttgaggcagagttttgctcttgttgcccagtctggagtgcaatggcatgatctcggctcactgcaacctctgcctcccggattcaagcgattctcctgcctcggcctcctgagtagctggaattacaggcaagcgccaccatgcccggctaattttgtatttttaatagagacaggrtttctccatgttggtcaggctggtttcgaactcctgacctcaggtgatctgcctgcctcagcctcccaaagtgctgggattacaggcgtgagccaccgcgcccagccaagttcaaatgatttctagttgtaaattagctgaactggctaaagatcttttagatggcacaaaggcaaggccctggaagatcatcgcccctttcaccgtctaaatcccgaacaataacaggaatgaacttgcaaaggtggtgtttgtgccaggcactg

SEQ ID NO: 52692 - DNA, 601 bp, Human
aaggtggaaggcagctgatccaggctctaggaccacaggtcgaaaccagctctttggcctggtttgtctgtgttccccttctctctccagattctgtcagctgcctgcggtgataaagccagccacacatttcttcttttaggacatactcacgatgctaacacaaacaggagttcaatgcttttttttaattttttttattttttatttttttgaggcagagttttgctcttgttgcccagtctggagtgcaatggcatgatctcggctcactgcaacctctgcctcccggattcaagcrattctcctgcctcggcctcctgagtagctggaattacaggcaagcgccaccatgcccggctaattttgtatttttaatagagacagggtttctccatgttggtcaggctggtttcgaactcctgacctcaggtgatctgcctgcctcagcctcccaaagtgctgggattacaggcgtgagccaccgcgcccagccaagttcaaatgatttctagttgtaaattagctgaactggctaaagatcttttagatggcacaaaggcaaggccctggaagatcatcgcccctttcaccgtctaaa

SEQ ID NO: 52693 - DNA, 601 bp, Human
ctaggtgggccctggtgggatgactatggttccagaatctcagttttgtctgtgtctagttgatcagcctcagaggaactgagaaagtaccgaaaaccacaagagagtattctgggaacaagcagactcaaaagctattcatttacaagcagaaatgatagatccagcaggggcggtcccaagtcaagggtagcctggtatcccacttacttgggaagtaaagaccacccacaattttggaactgtacttgctaaattgaatataggatggagctatgaatggaaagataaaaagaccatmatttccagactcttttaagtcagcataaaatgcttagttctctaaacaaccaggaagatctcaacataggtgacaatggtggggtcttacgctacagtcacaaaaagctaggactcgtgtatctcaaaactaaggagtgagaaagttgacatttactagcaaaaggtcaatgagcccaccctagctgaggctccagaacctcaatgggatgcataatcatctaccaaccaacacctatcttttaatacaagtcagtacaagctcctcttagtctcaaaaacacaccctcagcatttctgc

SEQ ID NO: 52694 - DNA, 601 bp, Human
ggcctaggtgggccctggtgggatgactatggttccagaatctcagttttgtctgtgtctagttgatcagcctcagaggaactgagaaagtaccgaaaaccacaagagagtattctgggaacaagcagactcaaaagctattcatttacaagcagaaatgatagatccagcaggggcggtcccaagtcaagggtagcctggtatcccacttacttgggaagtaaagaccacccacaattttggaactgtacttgctaaattgaatataggatggagctatgaatggaaagataaaaagacyataatttccagactcttttaagtcagcataaaatgcttagttctctaaacaaccaggaagatctcaacataggtgacaatggtggggtcttacgctacagtcacaaaaagctaggactcgtgtatctcaaaactaaggagtgagaaagttgacatttactagcaaaaggtcaatgagcccaccctagctgaggctccagaacctcaatgggatgcataatcatctaccaaccaacacctatcttttaatacaagtcagtacaagctcctcttagtctcaaaaacacaccctcagcatttc

SEQ ID NO: 52695 - DNA, 601 bp, Human
cttggcctcctaaaatgctgggattacaggtatgagccactgctcagcccctacttttcactttataactttcagttctgtttggactttttggtaagagtatgtattatttttataacaaaagccagctttttaaaaacaaaccccaaaataaatgaagtcagtaaaagttacgtttgttcattatagtcacatttaccatttgcttgggttttctcctttctgatgggttatcacacacagttgcagcctcaactatgataggtgcccaggtgcccctttgaaaacctaggctaagaartgctttgcaagtgcaaactaggagaaagatattcagtattttaatatctgcagaaaagccatcacaaatgaatattttttttttaaataaacaacctagcatgtgtatttttctccagtcaccatgttttgactcctgagtctgtcactggcaatgcttaccagcagactagtcacaaaaaagaacagaaattggatttttgtacagtgttcagaattgagatgtgccacagcaaaattttaaaacaatgagttactgtagaagccacaaagacataaaatatattatgtactagaaaac

SEQ ID NO: 52696 - DNA, 601 bp, Human
ctgcctcccaggttcgcgccattctcctgcctcggcctcccgagtcactgggactacaggtgcccgccaccacgcctggctaattttttgtatttttagtagagatggggtttcaccgtgttagccaggatggtcttgatctcctgacctcgtgatctgcccgcctcggcctcccaaagtgctgggattacaggtgtgagccaccacgcctggccccaggctgctcttaaactcctgacctcaagtgatccacctgccttggcctcctaaaatgctgggattacaggtatgagccactgcycagcccctacttttcactttataactttcagttctgtttggactttttggtaagagtatgtattatttttataacaaaagccagctttttaaaaacaaaccccaaaataaatgaagtcagtaaaagttacgtttgttcattatagtcacatttaccatttgcttgggttttctcctttctgatgggttatcacacacagttgcagcctcaactatgataggtgcccaggtgcccctttgaaaacctaggctaagaaatgctttgcaagtgcaaactaggagaaagatattcagtatttta

SEQ ID NO: 52697 - DNA, 601 bp, Human
taactgggattacaggtacacgccaccatgcccaactaatttttgtatttttagtagatacggggtttcaccatgttggccaggctgctcttttattttatttatttttttttttttgagacggagtctcgatctgtcgcccaggctggagtgcagtggcgcgatctcagctcactacaagctctgcctcccaggttcgcgccattctcctgcctcggcctcccgagtcactgggactacaggtgcccgccaccacgcctggctaattttttgtatttttagtagagatggggtttcaccrtgttagccaggatggtcttgatctcctgacctcgtgatctgcccgcctcggcctcccaaagtgctgggattacaggtgtgagccaccacgcctggccccaggctgctcttaaactcctgacctcaagtgatccacctgccttggcctcctaaaatgctgggattacaggtatgagccactgctcagcccctacttttcactttataactttcagttctgtttggactttttggtaagagtatgtattatttttataacaaaagccagctttttaaaaacaaaccccaaaataaatgaagt

SEQ ID NO: 52698 - DNA, 601 bp, Human
tcaaatcccagtctctagatcatggttaccccgataaggcttttcaccctgagacatcccatcaggcattgcatccagttctccagaatttaatccatgtctgtactctacccggtcctgaggttatgtgaggctcaaccagtaacagagacttcccacaatgcaaaaacaaactaatgctgtttttatcagtcaagtcatatatacatatatgcataataaatccttggaagataacacaagtaactgggaacagtagttacttctgaggagtaaacctagtgtgtgtcttggggttgcrgggtggtggtggcagggaggtgggcagtacttttactgttcacttctttttttacttatttttttgagacagagtcttgctctgtggcccagcctggaatgcagtggcctgatctcagctcactccaacttccacctcccaggttcaagcaattctcgtgtctcagcctcccaggtaactgggattacaggtacacgccaccatgcccaactaatttttgtatttttagtagatacggggtttcaccatgttggccaggctgctcttttattttatttatttttttttttttgagacgga

SEQ ID NO: 52699 - DNA, 601 bp, Human
caattaaatcactcttatgaataccttcattccagagtggcagaatattccagtcactacctgtgcttctggaactgtaatgaaaatttctatccctgtttctccccagtatggctcacatcagacagtcctcgaaaacctgaccagttttgggccagcagagacgtcactttcttgaaccaaaaagtcaaatcccagtctctagatcatggttaccccgataaggcttttcaccctgagacatcccatcaggcattgcatccagttctccagaatttaatccatgtctgtactctacccrgtcctgaggttatgtgaggctcaaccagtaacagagacttcccacaatgcaaaaacaaactaatgctgtttttatcagtcaagtcatatatacatatatgcataataaatccttggaagataacacaagtaactgggaacagtagttacttctgaggagtaaacctagtgtgtgtcttggggttgcagggtggtggtggcagggaggtgggcagtacttttactgttcacttctttttttacttatttttttgagacagagtcttgctctgtggcccagcctggaatgcagtggcctgat

SEQ ID NO: 52700 - DNA, 601 bp, Human
caacttttcagcaattaaatcactcttatgaataccttcattccagagtggcagaatattccagtcactacctgtgcttctggaactgtaatgaaaatttctatccctgtttctccccagtatggctcacatcagacagtcctcgaaaacctgaccagttttgggccagcagagacgtcactttcttgaaccaaaaagtcaaatcccagtctctagatcatggttaccccgataaggcttttcaccctgagacatcccatcaggcattgcatccagttctccagaatttaatccatgtctrtactctacccggtcctgaggttatgtgaggctcaaccagtaacagagacttcccacaatgcaaaaacaaactaatgctgtttttatcagtcaagtcatatatacatatatgcataataaatccttggaagataacacaagtaactgggaacagtagttacttctgaggagtaaacctagtgtgtgtcttggggttgcagggtggtggtggcagggaggtgggcagtacttttactgttcacttctttttttacttatttttttgagacagagtcttgctctgtggcccagcctggaatgc

SEQ ID NO: 52701 - DNA, 601 bp, Human
tctgagaaacacaccacagagctaaccattctttcttcttgaaagactttcttccctggcttccacgcaccactctctggatttcctcctacctctctttctcttctctctccatctctttacagggtccatcagtacttcttgtttcttctcattctatctgtaacctctctaagaaatctcaaccacaccaggatttgaataattatacacattccactacaccccattttcctcccttgggcatcttaaagtcacttcaaactcaatatgttaaataatttctccacttcttccaagsctcccagtacggcttgctacaattagaggcgccaccagccctgacattatacagccagcaatctgcaaatcttcctttcctcctgctttactcgctgcctttatccaatccatcaccaaatcctgtcaaatttacctgctaatatcccttcagtgattaaaatgatctcacttcttctcttttccagcaccactaaagcaacttttcagcaattaaatcactcttatgaataccttcattccagagtggcagaatattccagtcactacctgtgcttctggaactgtaatgaaaatttct

SEQ ID NO: 52702 - DNA, 601 bp, Human
atacaaatgcattgtatttttagtaattggacttgtttgatctcatatcttttgataattactaaaaatctcccttcaaagtgatgaaagattcaaatgaagctagaatttaatttatattaggtctttgagatgaggtttaagtaacattacagtcccattactaggaaaacgggtaaataaactgtgtatagccatgaaatggagtaacgtattaagatctctagctgctgtcatagaacaaaatactttaaagtggtgggtaaaaacgaagttaaggtacaatatatagaaggagaakaagaagaagaaggaggagaaggagaaggagaaggagaaagagaaggagaagaagaagaggaaggaggacgaagaggaagagtaggaggagaagaggaagcggaagagggaggaggaggaaggagaaaggaggaagaaggaagaaggagaagaagaaaaacttgaatcattggtttctacatgcataagtctgaaggacagtccctgaactgagaaatgggctctccttctggggagatgagcaggattggggatagagggtcaagaaagtctattgctttagctgaatttcttaaagcaa

SEQ ID NO: 52703 - DNA, 601 bp, Human
tgacaatgttcctcttctcctggctagctcacaggagtgctggggatacagtgctctgggtctccatatttaaaagaagtttaaattatcatacaaatgcattgtatttttagtaattggacttgtttgatctcatatcttttgataattactaaaaatctcccttcaaagtgatgaaagattcaaatgaagctagaatttaatttatattaggtctttgagatgaggtttaagtaacattacagtcccattactaggaaaacgggtaaataaactgtgtatagccatgaaatggagtaatgtattaagatctctagctgctgtcatagaacaaaatactttaaagtggtgggtaaaaacgaagttaaggtacaatatatagaaggagaataagaagaagaaggaggagaaggagaaggagaaggagaaagagaaggagaagaagaagaggaaggaggacgaagaggaagagtaggaggagaagaggaagcggaagagggaggaggaggaaggagaaaggaggaagaaggaagaaggagaagaagaaaaacttgaatcattggtttctacatgcataagtctgaaggacagtccctgaact

SEQ ID NO: 52704 - DNA, 601 bp, Human
tgtcctttgggacccagctcagtgctaggtataatggtagacccccaaagagtttaaacctaatcaggctttttgaagccaggaacaatgaaatccaacagcctgtagactgggttcaggggtggagcggacactaagagctgtgtagtcaggcaggaggtgagacctagaaggaaatccatggcagaatgaactgatggagggtcagggaagaggtgagtgagggtgctccagggaaggggtacaagcactgccaggagctgtgggtggcagcaaatgggttgcaagggaagtgaggctsgatgagcagggtcacactgtcagattctagaggtttaggaaccaggcaggagatcagccctgacaggacaggacaccaagaagagttctgtagcaggaaaagggtgatgagagccatcatgaaggaagattagcctggctgtggtgtgcaaaggactgaagtcagaggctagtgtgctgcagtctacaaataaatgatcacatcacacagtagggtggaggcaacaggaatggagaaagaggaaggaaagatgagaggtccagaaagggaaaaataatgaagacccaaccatgtcaagac

SEQ ID NO: 52705 - DNA, 601 bp, Human
atgggtctccctatgctgcccaggctagtctcgaactcctgggctcaagcaatcttaccatcgtgtcctcccaaagtgatgggattaccaggcatcagccactgtgcccatctcattcttctggcagtaatctctgccaagtatttgaaggaaaggttcagagaaaaaacatttttctttaattgtgcagcatgagtttaagaggaaaaaaagttatttcccaactcctactggaaagacctcagactccctattaaaataaatactgttgtttatttaaaaagtttcactcctttctcartcaaactaaaatatttgtctttgatcttacagaagagtccctcaggctcacaaaagtacttatattgtattttccacctattcatttaggatacttatatacccttacagagaaactcctcagagattatctaagaactaggtcagtatttcctacgctggggaatctgctaagcgaagctaaccccaaccaggacttgagtgtggcctgtaaaagactttcccgctagaccctgtggtttctccaacctcactcctatgctttgccatttcgaaatctgaggaaaatagtctctcctgt

SEQ ID NO: 52706 - DNA, 601 bp, Human
ccagaactgatgtgatgttcagtatagaaaaataatttttactttactaaagtaattagcattgaaaatcccaaagcaggctgagcgtttttggttagaggtaaaattctactcctttttttccatactccaagggaagataccagaggtatcttcccacgaggactacaaaagagcatcaattggaaaaccacccatattgaatgtgtaggcacatggggtgatgaaatacacacagcataaaggtgcatctaagaatagtatcaaaaacaaggtgttgcccaaccttggcacacagcgmacaggttgttgaacacctactccgtcctgaggccaccaagcagctgcttggccaatactttatttatgccctgccctctcttaattcacacaagtgtaatatcctgcccaccgtgccactccccagcacctctccaaagcaaagaaatcttaggccaggtaagctaacaaaaaacataaaatgagacatgagaagtttcttagggacctagggtcatcagatttagcaaataaaaatgcaagatgcccagctaaatatgaattccagataaataataaataatttgtttagtacaaatac

SEQ ID NO: 52707 - DNA, 601 bp, Human
ggtgcatgcctgtagtcccagctactcgggaggctgagggagaaggatcacttgagcccgagaggcagaggctgcagtaagctcacatcacaccactgcgctccagtctgggtgacagagtgagaccttgtctcaaaataataataataataatgtgctcgattcagtaacccactaaagtgggtctgagtttatcattattctttccttactatccccatcgaaatttatggcaataatagccttggattcagtaattccattgctaagaacaaattctaatgaagcactcaggatgcawcttaaaaatctttgagaatgtttatcagctgggcacggtggcttatgcctgtaatcccagcactttgggaggccgaggtgggtggatcacttgaggtcaagagtttgagaccagcctgaccaacatggtgaaaccctgtctctaccaaaaaaatacaaaattatttgagtgttgtggtgcacgcctgtaatcccagctactcaggaggctgaggcaggagaatcacttgaacctgggaagtggaggttgcagtgagccgagattgtgccactgcactccagcctgggcaacaagagcaaa

SEQ ID NO: 52708 - DNA, 601 bp, Human
aaatacagaaaatcagccaggcacagtggtgcatgcctgtagtcccagctactcgggaggctgagggagaaggatcacttgagcccgagaggcagaggctgcagtaagctcacatcacaccactgcgctccagtctgggtgacagagtgagaccttgtctcaaaataataataataataatgtgctcgattcagtaacccactaaagtgggtctgagtttatcattattctttccttactatccccatcgaaatttatggcaataatagccttggattcagtaattccattgctaagaacraattctaatgaagcactcaggatgcatcttaaaaatctttgagaatgtttatcagctgggcacggtggcttatgcctgtaatcccagcactttgggaggccgaggtgggtggatcacttgaggtcaagagtttgagaccagcctgaccaacatggtgaaaccctgtctctaccaaaaaaatacaaaattatttgagtgttgtggtgcacgcctgtaatcccagctactcaggaggctgaggcaggagaatcacttgaacctgggaagtggaggttgcagtgagccgagattgtgccactg

SEQ ID NO: 52709 - DNA, 601 bp, Human
ggaagcgtggcacacagagcataaacagaggtcatggacaccccaacctccatgatatgagacctgaggatctaactggatctttttggaacctctttggtcagccattaaattgaggcaaccacagaattcatcttctaagatgacagtaggtgtgaccacagagcttagctggattgacaagtcttgatgaaggagagaatttgtgggcagtgccttcaaacttagttccaagtgccttaaggaagatcctctggggagctggatctcatatgttcttctgcacccctcctccaccgcyccccccccacacacacacactcatcttctttgtaaaagacttctttaaaacaacatagagtatcttatctactccacatgacagaggatgtttttatagcagccaacacaaatgcctagatcatttttatctaggtcctatttatctatctaggtcctcaagttccagctcacatcccatctgtctggaaactaacagcatttccattgcaaaaagttacaattgcatctgccccacatgggggaataaaccacacctctaggatgcagagctaggagaccacacacatcagcctttaca

SEQ ID NO: 52710 - DNA, 601 bp, Human
ctgcttgccaaacaaggaaatccaagataaacgtgccattctgtcatgaccttatcctgctgagagacagacagaaacaatggcagagaggaatagccttgcatgttttcatggcacctttcagaaagagatgaaattcaccatcagtcacacctcttggaggttgtaccatttagctgataagaaacagccagagaggcagggagtatggacactcctgaaggcaatcctatgaggagccccctgaaacttcttgaagaagaaaaatagcactgttcccctccccttccaactcttcacrctgacaggagtttctacgaggcagtgtttgtcagtagtattattaaaaaaggaaccaggccagattagtgactcacacctgtaatcacaacactttgagacgccaaggtgagaggattgcttgaggccaggagttcaagaccagcctgggcaacatagtgaaatcctatctctaccaaaagaatttaaaaattagccaggcatagtggcatgctcctgcagtcccagctactcaggaggctgaggcgggagtatcacttgagcctaggagttccaggttacagtaagctatgatcacacc

SEQ ID NO: 52711 - DNA, 601 bp, Human
gatgtataccaaagcaaacagtagatatacaaatgatagactatgggagatttttcccccttaattaacaaagaactataattacttttgaaataacttttaagggttactttttaaaggctactgtcaatttcttagggatggactgaaacaagagattccaaagataaagcctgtgctctttgcaggcatgtcctctcagaagagcgtctgagaataagacattcgaaggactgaagaacagtacgaaggactccttgagccaacaagctgcctgcccaggctggctacaagcctgggkctacaatgtcttgcagccaacagatacatccgggcatgctggtggggtcagcagacactgaggcgctggtaccaagcttgaggtaaggagaacaacatctctcgagcatccatctgtgctggtcttggtgccagcgatacaacatgtatttatctctaatcctgacaacaccacccaaggcaggcaagaggctagagagcttacccaatgtcacacagccagcgtttgaagctcagtaagccaagctccagaaactgtttaacaatctaatagctatgaaaaagatgtggtccccacata

SEQ ID NO: 52712 - DNA, 601 bp, Human
cttttgttacttttttatttttatttttggcagggtctcactctgttgcccagggtggagtgcactggcacaatcttggctcactgcagcctcgaccctccctgagttcaagtgatcctcccacctcagcctcccaaatagttgaaactacaggcacataccaccatacccagctaattttttaattttttgtagaaatgaggtctcactgttgcccaggctggtctcgaaatcttggactcaagcgacctgcctgcctccacctttcaaagtgctggtattagtggtgtgagccactacrcccagctgggcttttgttatttttcaacaatcaaataatccatgttcatggtgaaagaaaatccacactcacggtgaaaaaaaaaattgtaaaatgcagataaacaaaaatgagagagagagaaagatgaatggaaaaaagaaagaagagaaaatacataacttccctatccattactaacacttcagtactggcttccaaatgtgttcttgcttaaatgtcttttgaggggtcttgcttgaactgctttcaaacatcagattttacttatatttcatctgggaaaatcagttcctctga

SEQ ID NO: 52713 - DNA, 601 bp, Human
ctgatattgttgaattctgagtataattattcatatacatttattatttttaataaaaatagtgtaaatgcctaattgcccattatattgtttttataacttcaagaaagactgcacaaaatagaaaaaaaatttatttagaatactaatatgtacatttttgtattgtaactaccctaccatctgtttcacacacatgcacacacacaaatgtgcacacacacacaaccaccatcaccagagcctgcacagttagcacatattagtttctcaacaaatatctaaatttttttttttttttgagatggagtcttgctctgtcacccaggatggagtgcagtggcatgatcttggctcactgcaacctccatctcctgggttcaagccattttcctgcctcagcctcccaagtagctaggactacaggcatgtgccaccacgcctggctaatttttttgtatttttagtagagatgggggtttcaccatactggccaggctggtttcgaactcctgacctcaagtggtccgcctgccttggcctcccaaagtgctaggattacaggtgtgagtcaccacgccaggcctaaataattttttaa

SEQ ID NO: 52714 - DNA, 601 bp, Human
aatcaaggaaccagattctatgaaataataaaaggaaaatggagttcatgactgaaatcaagctgggcagagacataaagggtctttgttaataactgtacaagggaatgcaaatgaagacaggcttcacaaggaattttgacatcttaatgaagatttatgaagaatttgcagcatattaacctcaaatacaaggggaattacatagtcacataaaaacactgctttatgatttctttagcttaaaaacaattcaaaagacagtttcttcatgataatgctaataatttagttacaaagrttccccaccccccccttgtactccactctaattacattctccatcccccattacatttctttctttggttaactctgaagtgatacagctcattggcatgccctaaagctgtgaactgccccactgatgaaatcatgacagtgattaaatttctctattccacacagaaagttttgtgttacacagttttctttgttcatgtccttagtaacgcagaaaatcaactgacattttctcctaataatgaggggaatataagataatgtcaatgaaaaaaaaatcctctactggtgctacata

SEQ ID NO: 52715 - DNA, 601 bp, Human
aactgaaactctagtgttgatcattgccctgacacaactttaaagtggccaccaaacccctcaaatagctattttcatccttgtttacactggccacactgacactcaattggtgagaaaaggcttcccccccaacttttttttgagacggagtctcactctgttgcccagactggagtgcagtggcacgatctcggctcactgcaacctctgctgtccagtttcaagagattctcctgcctcagcctcccgagttgctgggattacagcatcaccacacccagctaatttttgtatttayagtagagacggggtttcaccatgttggccaggctggtctcgaactcctgacctcaagtgatccgcttgcctgggcctcccaaagtgctgagatgataggcatgagccactgtgcccggccagaaaagcctaattttaaagccaaagataaataaataaataaataaataaataaccaggcttctttctactctaggtttcaactgtagaaatctatttgcaaacttcaaaaactattaactttgggcaagaatttttaagatctgataagaggagactctaaagttaataatgtcttgct

SEQ ID NO: 52716 - DNA, 601 bp, Human
ggtcctaaatacttggggacattccgactcagtctcacagactgaaaggtagagagcacagatctcaacaggaactgaaactctagtgttgatcattgccctgacacaactttaaagtggccaccaaacccctcaaatagctattttcatccttgtttacactggccacactgacactcaattggtgagaaaaggcttcccccccaacttttttttgagacggagtctcactctgttgcccagactggagtgcagtggcacgatctcggctcactgcaacctctgctgtccagtttcaagmgattctcctgcctcagcctcccgagttgctgggattacagcatcaccacacccagctaatttttgtatttacagtagagacggggtttcaccatgttggccaggctggtctcgaactcctgacctcaagtgatccgcttgcctgggcctcccaaagtgctgagatgataggcatgagccactgtgcccggccagaaaagcctaattttaaagccaaagataaataaataaataaataaataaataaccaggcttctttctactctaggtttcaactgtagaaatctatttgcaaacttca

SEQ ID NO: 52717 - DNA, 601 bp, Human
tgtacatgccctcgtcttagttttctttctttttttttttttaattgcatgctcattgtaattacttgccccaaagccaggagatttcagaaatatttgactgtttattaccctttgagaattactaattaaaataatttccttcagtgaaaagggttgctcttttcctgattccacttcgacactgctcaccactgaagagaactctaagaatgccttgctaagctcccctgtaattgactgcctcctttgttaacacatgcgtggacttaaaaaacattaaacgacttatacaaatggwaacaaaatgctctttgagttctattgataacttaacctttagtgttttggatgaaatcccaattctagggaagcagggggagccattgaatgaaaccattatgtaaaacattgttgtgggaattattttgtgtgaaaatatatacagtatatcatttaaaatgtctttgaaggtgggctttcaaaatacctaattaaaatatacatattttgtatggcttctctacttcgtgcttcctttttcagggaaagagaagaaatttgcataaggcaaatgaacccatgacgctggatgttagag

SEQ ID NO: 52718 - DNA, 601 bp, Human
ggcacaccgagccaagttacactcatgtaccaatcacagtatcacccagataccgactgcaggatccgcgtgatctgatttaggctgggcataccaatgatttaagaaggcttccctagacaccacaaataggcatgctgccatcactcctgccagttcagtgcattagaaagttaccgactaccagtggcagagccccacaacgtagaatcgagaagaccatgaaaaccaacctcagattcaaaagacttgcacatacaatgtgctgtctggtggcttttgtctccacaatgttaatgcmccgtacactactcatgaagccctcataatgtaattacttctatttaattgattgtacatgccctcgtcttagttttctttctttttttttttttaattgcatgctcattgtaattacttgccccaaagccaggagatttcagaaatatttgactgtttattaccctttgagaattactaattaaaataatttccttcagtgaaaagggttgctcttttcctgattccacttcgacactgctcaccactgaagagaactctaagaatgccttgctaagctcccctgtaattgactgcctcc

SEQ ID NO: 52719 - DNA, 601 bp, Human
aagccctgatgccaaagcatcccaacgacaaagttcattcaaagcagagctaatatagattagagagattaatcggcatatatcagaatatatatatacaggcatatatgtatgtgtataaatatatatacatatgtaaaacacacatgtaaatttccatatagcttgaaattaacttgtgtttttaaaaagtgacctgaactgtttatacccagaaagcttttaatcgtccgctgtattttaaaatcaggagcctgtatctattcttagtgtgctttcgaaataaagcttcccttggttyggggtcacagctgctgcaaagcactctgggtggctcctctccatccctttgaaacagctggtgggaacctagtataaggccttgaacccagctgttcaatcttactttctaactttagcaagtcccttctccactaatgtcactggggcatgccacattgaaaaacacaccagagatggtagattcctatccctgctaaaaaaaactccaggcacaccgagccaagttacactcatgtaccaatcacagtatcacccagataccgactgcaggatccgcgtgatctgatttaggctgggc

SEQ ID NO: 52720 - DNA, 601 bp, Human
tcaaatagggctgttgtataaaatgtgttcagtctataataagctatgtaaccagcctttataattgactatataactgtaattacttaactaaaattcaagatgtacattcacttttcctaaattttctctaaacaaaaaaaagtagtagagataaattccaatttttctaagaaattaccttttcatgataatatcttatgttttaaaacatttacacaaaaaacatttttgcaatgtattctgaaattaaaaatagttatattagaagaaacatttcattctgggttaggaattgtastcattttaaatgacttgagaaaaaagttcatgtttaaatactcagacccgtaataaatatattaatacaaaagtgcgggaaaatgtacaaatgttatcatatgttgccaaatgtgagaaacattgcgggagggggtaggagaaagaattagtgaatacaaagtcattgtgaattcagcaaagggagagacacttctgattctgccaactgcatctggtatttccacctaaaatctacttctccggtaacaaatgctttcaggttcaaccagactgtgaggagacacagctatggggcaag

SEQ ID NO: 52721 - DNA, 601 bp, Human
aaacctgttccttcagaagccagtctctgatagtaactttagcctaacttgccttccatttttattaatgcttttaatatcatattgcctttagtttttattaatgttttcattattttaataactagggaaaatattcaaatagggctgttgtataaaatgtgttcagtctataataagctatgtaaccagcctttataattgactatataactgtaattacttaactaaaattcaagatgtacattcacttttcctaaattttctctaaacaaaaaaaagtagtagagataaattccartttttctaagaaattaccttttcatgataatatcttatgttttaaaacatttacacaaaaaacatttttgcaatgtattctgaaattaaaaatagttatattagaagaaacatttcattctgggttaggaattgtagtcattttaaatgacttgagaaaaaagttcatgtttaaatactcagacccgtaataaatatattaatacaaaagtgcgggaaaatgtacaaatgttatcatatgttgccaaatgtgagaaacattgcgggagggggtaggagaaagaattagtgaatacaaagt

SEQ ID NO: 52722 - DNA, 601 bp, Human
aggcaggcgggtcacctgaggtcaggagtttcagacaagcctggccaacgtggtgaaaccccatctctactaaaaatacaaaaattcaccaggcatggtggcgggtgtaatcccagctactcgagaggctgaggcaggagaatcgcttgaacccgggaggtggaggttgcagcgagccgagatcatgccattgcactccagcctgggtgacaagagggagactccgtctcaaaaaaaagatacagaaacagagttgggtgaagtaaacctacttaataagttcttagtttccatgtggcaragcagagtcaaatcttgttctcataataaggtctagggctttttccatgatacaatactgccttgtgaacccaaagaggctgacgtgcataacttgggccattaggaaggaaggaaaaggggaggtggaccgtcagcactgctgatagcctgactttgtcctggaacaatatctcctgcaggcttggtcctcctcttgcttcaataacacaccaccatccctccttgtccctcctgaaacccttgagtcacacagtatgtcaacttgcctgcaaaacttagctttttttttttttttaac

SEQ ID NO: 52723 - DNA, 601 bp, Human
ggatatagaccatcataattaccagaggaaatggtattttctttacaggatacatttagatttttcctttccatgagttttttttttttttaatggtgttaaaatgaaaggagactttaaagcagctttcaacttctcagtagccccaactatggactaaatgcagaaggccttacacacagcagacattaaaaaactactcatagaataagtgactgaattaaaggaatgaatgaatgaatgaatgaacatatttaatgggtttacttcgacaaatcattttgcttctaggtatcaaatrtaacagttgaatcttattcacatcatatatgtttttatctgtaagtactcataaaactaatctaggaagatttgttccttacttgccccagaaaggaacaaattctagagaatgctgtcacattctattaaacaaattaagtcattctcaattcattcctgttgattctgcaaactgctcggctgagcctctaccaggtactatacaccatgggtcctgaaagtccaccatatctagcatacaatagacactaaataataaatgtatgttgaatgaattgctacttatattcctaataat

SEQ ID NO: 52724 - DNA, 601 bp, Human
ttatcaaaggaagaaacctactcttgcagctgtatttttcatttttaacccccacgttaatcatatattcacaacaaataatggtttaaatttagtctgacgaccagccacaaggctccttctcatcccactatgaggcacatcctgccttcagactctttacgcaatcctcattgacttggagaggaaccccgtgcaatgagttaaacaggatatagaccatcataattaccagaggaaatggtattttctttacaggatacatttagatttttcctttccatgagttttttttttttttaatggtgttaaaatgaaaggagactttaaagcagctttcaacttctcagtagccccaactatggactaaatgcagaaggccttacacacagcagacattaaaaaactactcatagaataagtgactgaattaaaggaatgaatgaatgaatgaatgaacatatttaatgggtttacttcgacaaatcattttgcttctaggtatcaaatataacagttgaatcttattcacatcatatatgtttttatctgtaagtactcataaaactaatctaggaagatttgttccttacttgcccca

SEQ ID NO: 52725 - DNA, 601 bp, Human
gtcagcctgggagactcccagctgcaatactgttattgctgtcatctgcctaatccagaagggagcggcatttattgtatctagaaagaaagattaggctaaaatatatttgactgttcttatgaaagagaatgcatgcctcacgtaactgtgtttgttttcttcttgtccctcctgactttttctgtttttatcaaaggaagaaacctactcttgcagctgtatttttcatttttaacccccacgttaatcatatattcacaacaaataatggtttaaatttagtctgacgaccagccayaaggctccttctcatcccactatgaggcacatcctgccttcagactctttacgcaatcctcattgacttggagaggaaccccgtgcaatgagttaaacaggatatagaccatcataattaccagaggaaatggtattttctttacaggatacatttagatttttcctttccatgagttttttttttttttaatggtgttaaaatgaaaggagactttaaagcagctttcaacttctcagtagccccaactatggactaaatgcagaaggccttacacacagcagacattaaaaaactact

SEQ ID NO: 52726 - DNA, 601 bp, Human
acggaagcaatagacatacgtttctgcttcccacccttccatcttttctccagcctggcatatgaacgtgatggctggagctgcagcagacagctggaattatgaggaatggaagccactcagtaagaacaactaagcagaaaggtgcagcggagccagcaaaccagctcttgagttccttaattcagatttccttaatgttagagaaataaatgatctcatttcgcatccctgtaaatcacaaacatgactccaaaccaatacaagtatgcagaatgtatgcttaaggatgtccacagcrgttttgtttctatctttagtgtatgatgatagaatggttaaacaaattatggtacagtcagacagtggaagactgaacagacatgataaattacatggatctgtatttgctaaaatatattgtgggagtgaacataatcccgttttggtaaatagaacacatatgaacaagggggaagtaggctttattcatatctttacatttctttgttctttttgtacaataagcattatttttctaatcagaaaaaaaatgagaaagctatcctccccccaaaatgaacccatttcctgcttaaaa

SEQ ID NO: 52727 - DNA, 601 bp, Human
gttggccaggctggtcttgaactcctgacctcaggtgatctgcctgcctcggcctcccaaagtgctgggattacaggcatgagccactgcacctggctgatatacttgatttcatatagtcgagtagttaagtaacaattgactcagagacaaaaatattcttaaaacacaggtctagctaaccacaagtctcacatagttcccccaccagcaccccacaatttttttttttttgcattctaataatagcaactctcagattcagtgtgagaggcagccaaagctgcgattcctttactgyccttgttggtaatgagtgccttggtggtaatgagcatctcatgtcagcacaagattttctctcccatttaaagtagaaaggggacttcagcttgcagtaaaaagcacagtaagattgaatgcaagcaaaagaatatgtaatggatttccatttttcctaataaagaaatgctcaagaagttttaatctaatttaatttttctaataatttacaaggagataatagttccaaaatgtgaggggacataccaggtacagaaatgcaggaagccttgaaggttctatgacttcaactaatgga

SEQ ID NO: 52728 - DNA, 601 bp, Human
ctacaggcatgcgccactacgccaggctaatttttttgtatttttagtagagacggggtttcaccatgttggccaggctggtcttgaactcctgacctcaggtgatctgcctgcctcggcctcccaaagtgctgggattacaggcatgagccactgcacctggctgatatacttgatttcatatagtcgagtagttaagtaacaattgactcagagacaaaaatattcttaaaacacaggtctagctaaccacaagtctcacatagttcccccaccagcaccccacaatttttttttttttgcattctaataatagcaactctcagattcagtgtgagaggcagccaaagctgcgattcctttactgcccttgttggtaatgagtgccttggtggtaatgagcatctcatgtcagcacaagattttctctcccatttaaagtagaaaggggacttcagcttgcagtaaaaagcacagtaagattgaatgcaagcaaaagaatatgtaatggatttccatttttcctaataaagaaatgctcaagaagttttaatctaatttaatttttctaataatttacaaggagataatagttccaaaa

SEQ ID NO: 52729 - DNA, 601 bp, Human
cagatatacttgatttctttcgtgtgtgtgtgtgtgtgtgtgtgtgtgtgtgtgtgtgtgtgtgtgtgtttaagatggagtttcactcttgtcacccagactggagaacgatctctgctcactgcaaccttcacttcccaggttcaagtgattcttttgcctcagtctcctgagtagctggcactacaggcatgcgccactacgccaggctaatttttttgtatttttagtagagacggggtttcaccatgttggccaggctggtcttgaactcctgacctcaggtgatctgcctgcctcrgcctcccaaagtgctgggattacaggcatgagccactgcacctggctgatatacttgatttcatatagtcgagtagttaagtaacaattgactcagagacaaaaatattcttaaaacacaggtctagctaaccacaagtctcacatagttcccccaccagcaccccacaatttttttttttttgcattctaataatagcaactctcagattcagtgtgagaggcagccaaagctgcgattcctttactgcccttgttggtaatgagtgccttggtggtaatgagcatctcatgtcagcac

SEQ ID NO: 52730 - DNA, 601 bp, Human
aaatctatccaaactgtttaaagggatctgagtaattcaaatgcaaaaaaagaaaaaaaatcaataaacaccttatagtacaatgaacacaagaaaatggagagaaataatggtagacatcaatttactgcaaaaactacagatatacttgatttctttcgtgtgtgtgtgtgtgtgtgtgtgtgtgtgtgtgtgtgtgtgtgtgtgtttaagatggagtttcactcttgtcacccagactggagaacgatctctgctcactgcaaccttcacttcccaggttcaagtgattcttttgccwcagtctcctgagtagctggcactacaggcatgcgccactacgccaggctaatttttttgtatttttagtagagacggggtttcaccatgttggccaggctggtcttgaactcctgacctcaggtgatctgcctgcctcggcctcccaaagtgctgggattacaggcatgagccactgcacctggctgatatacttgatttcatatagtcgagtagttaagtaacaattgactcagagacaaaaatattcttaaaacacaggtctagctaaccacaagtctcacatagttcccccaccagc

SEQ ID NO: 52731 - DNA, 601 bp, Human
cttgaactggaaaaagggctggcatgaaccccggcatctcaagagagactagaggtgcttttcagagtgaggttcccattttgcaagaaattatttggaggatcaaagacaaaaactgaggcatcgaaagggaccaacttaggcttcagaggaaggggagagtgctactggggaccttgaaaataattatcaggaaacacagcttatggttcacatttcaaacccagcctacaatgtttctttacgtgtatttcttggcatcttcagtcgaaaatatcacccaaatgaggcagagtggtayagtggatttgagatctgtttctgccattaactgactaagagactactgtaagtaacatctccaagccttggtctcctccaatgtaaaatgggcataagaacatccattacatgaggctgttttgagaatttcatcaaataacaaaagtaaagcacctagcacagtgccggatatgcatgacacactataaatattagttcccttcctttcccttgtgaaaatctatccaaactgtttaaagggatctgagtaattcaaatgcaaaaaaagaaaaaaaatcaataaacaccttatagtaca

SEQ ID NO: 52732 - DNA, 601 bp, Human
taatggggccaagtgaattaaatgtcactcatcccaaaaaagaaggcaaatcctctttaaaaccaaaaattcttttgggttaggctagcttctcctctattcatgtgaagagatttaattcctttttgttggttttgtttttttcaattctgggaagaggatgagccaccctggctctggccatcagagccactttctttttgcacatgtttgaaaggcatgacacaacttgaactggaaaaagggctggcatgaaccccggcatctcaagagagactagaggtgcttttcagagtgaggktcccattttgcaagaaattatttggaggatcaaagacaaaaactgaggcatcgaaagggaccaacttaggcttcagaggaaggggagagtgctactggggaccttgaaaataattatcaggaaacacagcttatggttcacatttcaaacccagcctacaatgtttctttacgtgtatttcttggcatcttcagtcgaaaatatcacccaaatgaggcagagtggtacagtggatttgagatctgtttctgccattaactgactaagagactactgtaagtaacatctccaagccttggt

SEQ ID NO: 52733 - DNA, 601 bp, Human
gcctctgcaaactgagcaaaattcttgcttaacctcatttttcctattttgtgaaaacataagaaggaaaaaaaaaaaaggactgggagtttctgttgcttgtttgatttgggccaagagccatattaaagaactttggctgcgttgcaaacaattttattattagtaccagcatttttttttctcctctcatgccaggatcaataatgctattaaaaaatgtatagtccagacacagtggctcacgcctgtaatcctagcactttgggaggctgaggcaggaggattgcttgagcatagragttcaaggccagcctgggcaacatagggagatcttatctctaaaaaaaaaaaaatcaaaatatgagtcgggcgtggtggtatatgcctgtggtcccagcttcttgggaggctgaagcggaagattacttcagcctgggaggtcgaggctgcagtgagccgtgatcataccactgcaccccagtgtgggcggcagagcaaaactctgtctcaaaaataataataaaataaaataaataaaagatgtataaatcaccttaagtttattgtgttggaactccacaacaatgtgagagtctat

SEQ ID NO: 52734 - DNA, 601 bp, Human
tggaagcagcctccaaactgcctcttcttttgccacaacctagctgagcagttaaagagaaccacaccaatgagatgagaatttaaagacagcctggggtcataaaaccaaggcagactggtttaaaactcaatcatactcactgctccctgtcttcatcccctcagtgaaattcctctgtagcctctgtccttactacctccttttttctcttccagtagaatacaagctcttccagaagaaatgttccacagataatgctagccaggtgtggtggctcacacctgtaatcttagcactytgggaggctgaggcgggaggactgcttgagccccagagttggagaccagcttgggcaacataaaaagaccctagctcttaaaaaacaaaaaagaaaaaaagctgccaagcctatgatatttacaatccccatttaagtataagcaaactgtcttatttcagaaaatcagatttttaaaacttttttgatttactaggccaattcaccatcctcttaatgttaaaacaaatgtacatactgaagacaattagcttaaaatttgctaaatgaaacagctttgcaacttgcttcttgtgactc

SEQ ID NO: 52735 - DNA, 601 bp, Human
ttctgaaatagagaatcccatgtaatgtattttgtattgctggaagcatacaaagatataaaaataggaatgattacaagtgcttcattttgaaagaatttaaaactattagcagcatgttgcttatttctatgggcaaagattttgtcttcaaacataagtgttttgtcttttttctgcccaccatttatttaataaatgagagtttcatacagtgtcagacatcagggctcccctccatcagcagagtggttaggacgggacctggaagcagcctccaaactgcctcttcttttgccamaacctagctgagcagttaaagagaaccacaccaatgagatgagaatttaaagacagcctggggtcataaaaccaaggcagactggtttaaaactcaatcatactcactgctccctgtcttcatcccctcagtgaaattcctctgtagcctctgtccttactacctccttttttctcttccagtagaatacaagctcttccagaagaaatgttccacagataatgctagccaggtgtggtggctcacacctgtaatcttagcactctgggaggctgaggcgggaggactgcttgagcccca

SEQ ID NO: 52736 - DNA, 601 bp, Human
agaatcctccagcttcttaccacccaggaaaaggcctggtgtttttggatgaatttacccacactaactttatgatgaaggaagccgtataacaaggactttctgaaatagagaatcccatgtaatgtattttgtattgctggaagcatacaaagatataaaaataggaatgattacaagtgcttcattttgaaagaatttaaaactattagcagcatgttgcttatttctatgggcaaagattttgtcttcaaacataagtgttttgtcttttttctgcccaccatttatttaataaatragagtttcatacagtgtcagacatcagggctcccctccatcagcagagtggttaggacgggacctggaagcagcctccaaactgcctcttcttttgccacaacctagctgagcagttaaagagaaccacaccaatgagatgagaatttaaagacagcctggggtcataaaaccaaggcagactggtttaaaactcaatcatactcactgctccctgtcttcatcccctcagtgaaattcctctgtagcctctgtccttactacctccttttttctcttccagtagaatacaagctcttcc

SEQ ID NO: 52737 - DNA, 601 bp, Human
gttcaagttttttcaacaaccatagatcgtatacctattatgcatgatgggtgatgtactggttaggtgtaaaaatcaaaaacattgtgcaaacatagtaaaggcaaagataaaaatcttatctgtaaaaatagaataatcaggccgggcacagtggcctgtaatcccagcactttgggaggccgaggcgggtggatcacctgaggtcgggagttagagactagcctggcgaacatggagaaaccctgtctctactaaaaatacaaaattagacaggcatggtggtgctactcgggaggcwgaggcaagagaaacacttgaaccggggaggcggaggttgcagtgagctgagagagcgccattattgcactccagcctgggcaacaagagtgaaactccatctcaaaaaaaataaaataaaatagaatcctccagcttcttaccacccaggaaaaggcctggtgtttttggatgaatttacccacactaactttatgatgaaggaagccgtataacaaggactttctgaaatagagaatcccatgtaatgtattttgtattgctggaagcatacaaagatataaaaataggaatgattaca

SEQ ID NO: 52738 - DNA, 601 bp, Human
ggcttcccaaactcactcagcagtgagtgcagagaaggcagctctggccttccaaggttggcaacacttggttcaagttttttcaacaaccatagatcgtatacctattatgcatgatgggtgatgtactggttaggtgtaaaaatcaaaaacattgtgcaaacatagtaaaggcaaagataaaaatcttatctgtaaaaatagaataatcaggccgggcacagtggcctgtaatcccagcactttgggaggccgaggcgggtggatcacctgaggtcgggagttagagactagcctggcsaacatggagaaaccctgtctctactaaaaatacaaaattagacaggcatggtggtgctactcgggaggctgaggcaagagaaacacttgaaccggggaggcggaggttgcagtgagctgagagagcgccattattgcactccagcctgggcaacaagagtgaaactccatctcaaaaaaaataaaataaaatagaatcctccagcttcttaccacccaggaaaaggcctggtgtttttggatgaatttacccacactaactttatgatgaaggaagccgtataacaaggactttctgaaa

SEQ ID NO: 52739 - DNA, 601 bp, Human
ccaccaaagtcacttacagatttcatggccagttctcctggcttcccaaactcactcagcagtgagtgcagagaaggcagctctggccttccaaggttggcaacacttggttcaagttttttcaacaaccatagatcgtatacctattatgcatgatgggtgatgtactggttaggtgtaaaaatcaaaaacattgtgcaaacatagtaaaggcaaagataaaaatcttatctgtaaaaatagaataatcaggccgggcacagtggcctgtaatcccagcactttgggaggccgaggcggrtggatcacctgaggtcgggagttagagactagcctggcgaacatggagaaaccctgtctctactaaaaatacaaaattagacaggcatggtggtgctactcgggaggctgaggcaagagaaacacttgaaccggggaggcggaggttgcagtgagctgagagagcgccattattgcactccagcctgggcaacaagagtgaaactccatctcaaaaaaaataaaataaaatagaatcctccagcttcttaccacccaggaaaaggcctggtgtttttggatgaatttacccacactaact

SEQ ID NO: 52740 - DNA, 601 bp, Human
ccttcagaactcattctattaaagcagcatgttttccaaggcagacatgtgctacataaatagttttcactctggtaccagaaggaaaagaatccttctctctttcataaacctttcttagactctctgacatcatggatattgatgctgtgctagaaccaacatcagcacaggccccggtgagatgtggaaatatacatcatttgctggaagatgttcaaggacacttccgtggtcagaatttcagctaccagctctaggaataatacaggagctggaatgatgcattcctaaatgctcrtcccccactctcccctcccgttctgaacaagtgggctgtggctcctgaatgcggcaagagcaggaacatctagcataggaagcccagcatctgaagtggcagatgagctcatcttgccccaggagtgccagcacagcttgccagcctaaatcccctgggacagagtgtggggccttctgggtggacctcatcctgacagttctgaccgagcttacccatggcttgaagtcccagcactcctgcagtgcagtgggagcctccacggcccacccttcaaactccacacccagccaacacatt

SEQ ID NO: 52741 - DNA, 601 bp, Human
aaaaaaggccgggggcggtggctcacgcctctaatcccagcactttgggaggccgaggcgggtggatcaccacaggtcaagagttcgagaccagcctggccaacatggtgaaaccccagctctattaaaaatataaaaagtagccggcatggtgatgcacgcgtgtaaccccagctactcgggaggctgagacaggagaatcgcttgaacccgggaggtggaggttgcagtgagttgggatcatgccactgcactccagcctaggcagcagagtgagactccatcccccccaaaaaaaaaagatggggaaatactgaagtaaagagatgaaaatcatttccctaagtataaagtaaataataataaaaacaatagttttagtttacactttcagtttcacaattgtagttctgtttaaagctttcataaaatccatcaacttctgggcaggtggaaactcatagccagcctcaggcttgtcacaggccttccaagtgaggaactaattgatgaggatgtcaaaattaagtaactccctttagcaaaataattagacctaagaaatgctttgattattccttcagaactcattctattaaag

SEQ ID NO: 52742 - DNA, 601 bp, Human
cctcacttttgaataacaatggcctcctttgaatctttaaggtaggaaaccacttttactttcgttatgtttaatcagtctagaaacttccttgcattgaagttgtatttgtcttgttttcttttcagtctgtctcctcatttttaaatgcttcctctgctaaaattgttattcagatttcttaatgcaagacttgaaggtattgccaaggggaactcatccattgccttgcgtgaaaacttgggtctaaaggtctaaggttttagaataaatgtgattaaaaaaaaaaaaaaaaaggccrggggcggtggctcacgcctctaatcccagcactttgggaggccgaggcgggtggatcaccacaggtcaagagttcgagaccagcctggccaacatggtgaaaccccagctctattaaaaatataaaaagtagccggcatggtgatgcacgcgtgtaaccccagctactcgggaggctgagacaggagaatcgcttgaacccgggaggtggaggttgcagtgagttgggatcatgccactgcactccagcctaggcagcagagtgagactccatcccccccaaaaaaaaaagatggggaaa

SEQ ID NO: 52743 - DNA, 601 bp, Human
acacacctcacttttgaataacaatggcctcctttgaatctttaaggtaggaaaccacttttactttcgttatgtttaatcagtctagaaacttccttgcattgaagttgtatttgtcttgttttcttttcagtctgtctcctcatttttaaatgcttcctctgctaaaattgttattcagatttcttaatgcaagacttgaaggtattgccaaggggaactcatccattgccttgcgtgaaaacttgggtctaaaggtctaaggttttagaataaatgtgattaaaaaaaaaaaaaaaaaggccgggggcggtggctcacgcctctaatcccagcactttgggaggccgaggcgggtggatcaccacaggtcaagagttcgagaccagcctggccaacatggtgaaaccccagctctattaaaaatataaaaagtagccggcatggtgatgcacgcgtgtaaccccagctactcgggaggctgagacaggagaatcgcttgaacccgggaggtggaggttgcagtgagttgggatcatgccactgcactccagcctaggcagcagagtgagactccatcccccccaaaaaaaaaagatgg

SEQ ID NO: 52744 - DNA, 601 bp, Human
cacaaccaggtgggtctcttccagtcaggcccccaccattgaccttccttagacatacaacaaaaggagcatgattgttgtttctgttaaacacacctcacttttgaataacaatggcctcctttgaatctttaaggtaggaaaccacttttactttcgttatgtttaatcagtctagaaacttccttgcattgaagttgtatttgtcttgttttcttttcagtctgtctcctcatttttaaatgcttcctctgctaaaattgttattcagatttcttaatgcaagacttgaaggtattgycaaggggaactcatccattgccttgcgtgaaaacttgggtctaaaggtctaaggttttagaataaatgtgattaaaaaaaaaaaaaaaaaggccgggggcggtggctcacgcctctaatcccagcactttgggaggccgaggcgggtggatcaccacaggtcaagagttcgagaccagcctggccaacatggtgaaaccccagctctattaaaaatataaaaagtagccggcatggtgatgcacgcgtgtaaccccagctactcgggaggctgagacaggagaatcgcttgaacccggga

SEQ ID NO: 52745 - DNA, 601 bp, Human
atcaaactcttcctttagtgaaagtttgtgatatatatatatatatgatgagtagattcatcccgttcctctactttgttttataaacagtatcagaaatcttccttctcctccttctccttcttttttgttttttcgagacatgatcttgctctgttacccaggctggagtacagtggcataatcatggcccattgcagccccgacatcctgggctgaagcaatcttcccaccttggcctactgagtacctgggaccacaggcacctgcgaccacacctggctcattttttttaaaaaawtttttttgtagaggtgggtgtctccttatgttgcccaggctggtctcgaactcctgagctcaagtgatcctcccacctcagtctcccaaagtgctgggattacaggcacaagccaccgcacccagcccagtatcagagatctttccatatccatcaaagacaacaaacatgatagaagaaactgaatgttagccctttgttttgggcctcacaaccaggtgggtctcttccagtcaggcccccaccattgaccttccttagacatacaacaaaaggagcatgattgttgtttctgttaaa

SEQ ID NO: 52746 - DNA, 601 bp, Human
ggcactatcctcactgaaggtaatgaatacattgttcctaatttaaaacactttgcaatctaaccagcccaaaataaatcatttttattctagaaagcacttataaagaacagttaaattgtcttaaaatataacatgctatagttaaataaaatataaaatattttttgccataaaaataatgataataaacatatattttagcttactatgtggcaatcatagttctaagcactttgcatatataaactcgtaagttcctcatatattaataatccccattgtacatatgatgaaatcraagcacagacaaataacttaagggtcaccaaactagtaactacagagccaggattcaaattctggcagtcagacacccaagtccatgtacctaacctacagaaacatacagggaccaaatacaagatttgtttctgaatgtagttaactatgccactgattatatcacggctctagaaataaataaaattagttataaaaggtactattctatcatctgatagtaatgctattaactgtattttgacatccttttcacatgtatataaatgccttgcattaaagaagacctatcacttta

SEQ ID NO: 52747 - DNA, 601 bp, Human
ttgttgagacggagtctcgctctgtcgcccaggctggagtgcagtggcgcaatctcggctcactgcaagctccgcctcccgggttcacgccattctcctgcctcagcctcccgagcagctgggactacaggcgcccgccaccacacccagctaattttttgcatttttagtagagacggggtttcaccgtgttagccatcatggtctcgatctcctgacctcgtgatcctcccacctcggtctcccaaagtgctgggattacaggtgtgagccaccgcgcccggcatctaaagctcttatraaaaataaggtgtctagtgataagaagtttctcctgggagaggtaacttaaacatttccaccagagggcactatcctcactgaaggtaatgaatacattgttcctaatttaaaacactttgcaatctaaccagcccaaaataaatcatttttattctagaaagcacttataaagaacagttaaattgtcttaaaatataacatgctatagttaaataaaatataaaatattttttgccataaaaataatgataataaacatatattttagcttactatgtggcaatcatagttctaagca

SEQ ID NO: 52748 - DNA, 601 bp, Human
gctgtccgaggttaaatgttattttttggtaccacaccagctagtttcacaatttgtaagcaaaagtgcccaaacaaatataagttgcagtaaccatggttgggtcttcctgaaggaggaatggaatggctttctaacagagcatatcaaaggatcttcctctgattacacaggagccagaaaggggaggaaaaatgaggcaactggctaacaataatagctataacaatacaagtgctggcagcttactatacatcaggtaccaagacatggactacctaaatactcaaaacaacgttaycagataggtactatcattatcaccattttacagataaggaaaatgagactcagaggttaaataacccaatacataaacgtctaaattaagagaaactcagttctgacttcaagttcttccaaaacagtccccaccctccatcccacttccatgcccacttcgccaccactctaaccaaggactaagatctgcagcaggcttcattttctcaagcccattgttttatacattataacagagcctgtgtaggcagtctatttttttccctcttttgtttccctcttattctcttttttaaaa

SEQ ID NO: 52749 - DNA, 601 bp, Human
taaaaacaagctacaaaaaagaatatagaggagtttccaactatttttatgtttgcattgaagaaagtcaagaaaatatatgaaaacacactagtgtcattttgaatggtaccatggctttttattttctcatgttttgccaatcagcattttctacagtgaccaaatagcaattatgtaatatggaaaaaaataacattcttgaatcttgctgcttcaaaaatgtttagaaccttttttttttctgccttaaaatacagacacacacacacacacacacacacacacacacacacacaccaagggggaggggtgatcttctttttagcacttaaggagaaagacaatcaaggcttttgttttcctgaggcttcacttaaatgatattgttttgctgacttcatcctggagaactattcagaataaagcatggaagaacagctgttcttgaccaccagcaactgcaaaacacccagggaataaatttagacttccagaaaggaagaagaaatcaatcagttggtacctgggtgggagaggtgatgatcacacacaggcgggagcaatattaccagggacgccaaagaggagatcaaagaga

SEQ ID NO: 52750 - DNA, 601 bp, Human
ttaaaaacaagctacaaaaaagaatatagaggagtttccaactatttttatgtttgcattgaagaaagtcaagaaaatatatgaaaacacactagtgtcattttgaatggtaccatggctttttattttctcatgttttgccaatcagcattttctacagtgaccaaatagcaattatgtaatatggaaaaaaataacattcttgaatcttgctgcttcaaaaatgtttagaaccttttttttttctgccttaaaatacagacacacacacacacacacacacacacacacacacacacacaaagggggaggggtgatcttctttttagcacttaaggagaaagacaatcaaggcttttgttttcctgaggcttcacttaaatgatattgttttgctgacttcatcctggagaactattcagaataaagcatggaagaacagctgttcttgaccaccagcaactgcaaaacacccagggaataaatttagacttccagaaaggaagaagaaatcaatcagttggtacctgggtgggagaggtgatgatcacacacaggcgggagcaatattaccagggacgccaaagaggagatcaaagag

SEQ ID NO: 52751 - DNA, 601 bp, Human
ttactggccaggcgcagttgcttacacctgtaatcccaacactttgggggccgaggcgggcggatcacctgaggtcaggagttcaagaccggcctcgccaacatggtgaaaccctgtctctactaaaaatacaaaaattagccgggcatggtggcgtgtgcctgtagtcccagctactcaggaggctgaagcaggagaatggcttgaacctgggaggcagaggttgcagtgagccgaggtcttgccactgcactccagcctgggcgacagaacgagattctgtctcaaaaaaaaaaaaaaattactgaaatgggaagatgctcatggtatattaaaaacaagctacaaaaaagaatatagaggagtttccaactatttttatgtttgcattgaagaaagtcaagaaaatatatgaaaacacactagtgtcattttgaatggtaccatggctttttattttctcatgttttgccaatcagcattttctacagtgaccaaatagcaattatgtaatatggaaaaaaataacattcttgaatcttgctgcttcaaaaatgtttagaaccttttttttttctgccttaaaatacagacacacaca

SEQ ID NO: 52752 - DNA, 601 bp, Human
aggctataagtttaatcatagatattattggccagggtacggggaagaaaacacactttattggtaggggtgtcaattggtatacctttttggaaagaaatggaacaacagttttaaaaactttaaatgtacatactctttgatccaggaattccacttctgcaaaattatcctatacataaacagcatatggcacaaggatttatgtccaaggctgcacactgtggcattgtttagtaatagtgaccaaccagaaaataaactaaatatccagcacacaggactggttaaaccaagtacrgtatctcaacggagtggaacattacatattgctgacaaacaatgaacaaatcagtaagtactaatttggaaggctctctaagatatgttaagttttaaaaagacatactgtatatgcccaagcatgcatgtgtatgtagagcatgtctagaataatgctcaggaagctggtagtagtgtttccctggaaaggagaaaagggctgggggtcatggtgggaaggagacctaatttttcataaataccctttggaactatttggattttttgccatatgcgtgtgttacttttctaattaaaa

SEQ ID NO: 52753 - DNA, 601 bp, Human
ctgagattccctcaaattgcaggaaaaatataatgtgtacttaaaactagaggagacacagaggagaggagaaagcacaagcaaagaagacatgctgaggatcccagaagagaagtctcccaaggggcagccctaggctgcagtgacccaggcagaaatgatatagggaaggtgtccagaaacctccagcatggagccgccctgagcatttgttttgttaggatgggatgatccaattccatttggagagaaattatagttccattctaattaattcaggcattacagcagttgatacggsagaaattaagagaatatttttcttgacatttgaagtgtgagctttgaagcagctaaatgaaggccttgtgaaccaagactaaatcagccacattaatttttttttaactttctttctttccagcgctgcaaatatttaagtcttggcaaaattcaaaactcacaactcactcttcactggtatctgagaaatataatactgaaaaggaaaaggacgaaaataatatggaatgaaatgcatgacatgtactgggaagcaaaataacttccaacgaaacttccatttatggcttagtcaaaa

SEQ ID NO: 52754 - DNA, 601 bp, Human
ggaacaaatcgtgtgcctcctgataggattcaatgagaagaacacaacatcacttccatggtattcctgccaaaaatttataacctaaaccaaaatcacgaagaaatgccggacaaatccaaatttaaaaatgattcacaaaataactggcctatatattcctcaaaaatgtcaaggtccagaacacaaggaccgaagacttgttccaaattagaagagattatggaaacaggacaactaaatgcaatgtgagatcctcaatcacatcctgggccagaaacaaaaatagccacaaaggacrtcaccgggacaactgaagacatttcgaatctgggctattagataagagtattgtatcaatgttaaatttcctgattttgatacctacactgtgcttatataagaaaatgtccagctgggcacggtggctcacgcctgtattcccagcactttgggaggccaaggcaggcagatcacctgaggttaggagttccagaccagcctggccaacatggggaaaccccatctctactaaaaatacaaaaatttgccaggcgtagtggcacacacctgtagtcccagctacttgggaggctgcagc

SEQ ID NO: 52755 - DNA, 601 bp, Human
gcctctattccagactgatagaaatctccttccagctgactgcctggactgcatgggaaactgccagattatttcacactctatggtaaaatttaaaattctgaagaaatccagagactctgggggcacacagtgaagtgagtcaaaaagtgtgaagcaggccgggtgcaggggctcatgcctgtaatcccagcactttgggaggccgaggtgggcagatcacaaggtcaggagttccagaccagccttgccaacatagtgaaaccccgtctctactaaaattacaaaaattagctgggtrtggtggcacgcgcctgtagtcccagctacttgggaagctgaggcgggagaattgcttgaacccggaaggtggaggttgcagtgagccgagatcgcgccactgcactccagcctgggagacagagtgagatgccgtctcaaaaacaaacaaacaaacaaaccatgaaggaaagaggccactccttgggatcaatgcctctcggtttgttgtctctcagccctgtaaagtggttcaggatctttgggaaggaaaggaataaggtttggggcaaggatgggggaacagacagaaaccaaagca

SEQ ID NO: 52756 - DNA, 601 bp, Human
tggctcactaattataacaaatgtagcatattaatgtaatacactaacaacaggggaaactgggtgagtgagtgtataggaactctcttctcaattttaatataaaactaaaactggtttgaaaaacagcaaattttaacgtgcccagtgaataccaggaactttgctggctactctctttttaatagtcaatattaatttaatagtcaatggttggggtatgtacaaatggacacaatctttaagagaaaatctggtctataatgtgtcccaggggaataaatagatattaagctaaaaytttttaaattgcttctagaagtgttccctggtctaataagactgggaaatgttgggctaaagaaagttaaaataatttattttattggaagatttgtcagtctttagagtaatagggggtaccaagactttctgaaagagatatatgaattcaacaactcgtttctcaaacttgcaaggctgatattcttctggataggaatactaggaaatgctggtccactgtaactcagtggatgtcttggcagagtactgaattataaattaaatatgaatgaatattatattaagtccctactgt

SEQ ID NO: 52757 - DNA, 601 bp, Human
atgggactctggaacagaaaaagatattagataaaaactaaagaaatctgaataaagtatggatttaataataactggctcactaattataacaaatgtagcatattaatgtaatacactaacaacaggggaaactgggtgagtgagtgtataggaactctcttctcaattttaatataaaactaaaactggtttgaaaaacagcaaattttaacgtgcccagtgaataccaggaactttgctggctactctctttttaatagtcaatattaatttaatagtcaatggttggggtatgtamaaatggacacaatctttaagagaaaatctggtctataatgtgtcccaggggaataaatagatattaagctaaaactttttaaattgcttctagaagtgttccctggtctaataagactgggaaatgttgggctaaagaaagttaaaataatttattttattggaagatttgtcagtctttagagtaatagggggtaccaagactttctgaaagagatatatgaattcaacaactcgtttctcaaacttgcaaggctgatattcttctggataggaatactaggaaatgctggtccactgt

SEQ ID NO: 52758 - DNA, 601 bp, Human
cctcagcagagcatgggaaggcaaaacatctaaatttgtgatgaacaaaatactccttgggataatattccagaacattttagggagagaacaatagttccattaaaaaaaaaaaaaaaaagagctaggcgaggtggcttacgtctgtaatcccagcactttgggaggtcgaggcagatggattgcctgaggtcaggagttcgagaccagcctggccaacacagtaaaaccccgtctctactaaaaatacaaaaaattatctgggcttgttggcaggtgcctataatcccagctactcggraggctgaggagggagaatggcttgaacccgggacgtggaggttgcagtcacccgagatcacgccattgcactccagcctgagcaacaagagcgaaactccagcttaaaaaaaaagaaaagaaaaggcagagtattccaaatgcagtatctgaggccaagccggattaagggcagactgccacaaactgcctcaaaaaggctaaagacctcgtcagctctagaccgttgccagtccccccagaaaggaataacccaaacagaagatttctccatagaagcaggaatgcatcaaagctaaag

SEQ ID NO: 52759 - DNA, 601 bp, Human
atgttgcttgcgttactaagaggaagggctcgaggaaagcctggatagatttacaactctgggcccaataacatgctagtaaaagggaagatatcagtgtatattgcctagacagtttaggtttcccccttagaattaagcctgccaccaaggactctcacctcctggcacaatcccaggtacacagggaaagctcaggaaacgatctgatgaatgaataaaatcagttgggcatttcttacactcttagattaagaacaagagaaaaagcacagtcatgattgatgccaaaaaacctgaratgagtatttcacttctagagcttgttatagtataattacaacttctacttgaaggcctggggtgggaggtaaagggttttgcacagatggtgtcgcaggggaaaagttcccttaagtacagattcaagtaagacaaaatccagacatccagaagggtttaattcatgaaacctatttcaagccagggaagagaggcgcagatggaagaatgataattatttcaaggaacaggcatttctgaaccttctataaaagtatgttcttactagtagttatatttaatatggtagtatctgaca

SEQ ID NO: 52760 - DNA, 601 bp, Human
tggtggcttaagttaaatacttttcatcttcagtttgctatgcatattatgtagaaatatgatttacaagtaaatctccttaaatgaatttaagtagcccaaatctccatatattaaatatatgtattaaatgtataatatatgtgtatatttgaacgacatatatgtacatttgaaagacaataccaacactgaagcttttctagagaagaatagatttctttgaggaagaattcaatggcaaagatttctccaggatggaggtgagggtgggataaaaatgttcttttttgtccatacrctcactgaaattgttattgcaattcctgctgcgtgtcatgcactgggcttaaacttggaaaaatagctcctgccttcatgagaactaacggactggtggaagagaggtgtgaagaaatgagatggatttttatgagtggcttatggaacatgaaactgttaggctacataaggaacctgggagattatctagtccatccccttattttatggaatagggactgtaacccagaaaggttaagggatgtgccctggttagtggcaagtagagccaagaccaaaatcgagatcctcttgtacc

SEQ ID NO: 52761 - DNA, 601 bp, Human
tcgcttgaacccgggaggcggaggttgcagtgagccgagatcgcgccactacactccagcctggtgacaaagaaagactctgtctcaaaaaaaaaaaaaaaaaaaaaaaaaaaagaacttcactttacaaaaataattttaaaatccttaaataaattttataattggtatttctgcaaaaatgcatttataaaagtgctagtttttctcaaaattgtttaccagtcaaatttgcttaacttctgctgggcaatgtcatgtaataaagaaaaccatgcttttcagtctatttcctcctagrtcagggtcaaagaaaacaaggtataattttatatactcacttcatttctgagaaaaaaattctcaatttttgctatatttggtatcattaactttaaaacattttataatatatgtatattttttataatatttcatatatatgtatatattttaaacatagagacgaggtttcactatgttgcctaggctggtcttgaattcctgggctcaagcaatcctcttaccttggcctcccaaagtgctgggattgcaggtggaagccaccacgcctggtggcttaagttaaatacttttcatc

SEQ ID NO: 52762 - DNA, 601 bp, Human
atttattagtaattaggggataaattcatctacttattaaattttgccaacctccctttctactacagaaagagagcatagcctggggccttgctcccagacaggctcagttggtagaagggcaggtaggtctaggcctacctgcagggcctgggccccaagaagacaggctgtacaattaaggccgcctacaagcaagaggagagccagtgtaattacaaactgtccactgagcaagggatattcaggcagttgttgactacccaggacataggggtaggacagagagaacaaacagaaktgtacagataatctttaaatttcaccagaaccaccacttcccccatctctccaaattcctaccagatgctggaaggcaactaaacaagtgagccaaagatcacttttaattccagtccatttccctgctgctgccatggcttaggttcaaaaagtgaagcagaaaatcaccaaaagagttcaaaaaatccaccaagatgaaacacagagcccacacctgaatactgaataatcaggtgtcctggcaaatgccccagaaaactattatagaacactccaatgccatttattatatggtctt

SEQ ID NO: 52763 - DNA, 601 bp, Human
cttttgatcctaattctgtagccagtaacctgaggggtcactggaaagaaaaaggagtatctgatgctcactttcacagaactctgctcaggtgcatctggtctcagttccagtaatgaaagtcaaagatggtagccactgggcccctgtgaagcagggaatggttttaatttactcttctggtctttaacttggattaaagttaattatttttccttttctgcaaaaatacaagttatctgaaggcagtcacatcccatttacctgtctgttattttctactaaataaatattgattgamtgaatgaagagataaaggaatgaaggaaggaaaaaaaatatgagcttccatactgaaataatgaaggctcactttagatttgtaatcaaagtttcctcagatccattttgttaatgttctcgcatgatttcaatgccaatgagttaataggtgaccctttggcattgtggtatacatcaaatcatgcaacaaggaccaaggagttgtttttttcatggcacaacatcatcaaactatatgcctagtggaacaacggcatagcagaaggaacaggaagaaaaatgaaacaatatttatata

SEQ ID NO: 52764 - DNA, 601 bp, Human
cccaggctggagtgcagtggctcgatctcagctcactgcaacctccacctcccaggtccaagagattctcctgcctcagcctcctgagtagctgagactaccggcacccgccattatgtctggctaatttttgtatttttagtagagacagggtttcaccatgtcggccaggctggtctcgaactcctgacctcaagtgatctgcccgccttggcttcccgaagtgctgggattacacgcgtcagccaccacgcttagtcaaaaattaaaatttttttctacttaaaaaaactcaacaaaycaaattttaatttccttaaaaaaatgaagagaaagcaaaacttcaataagaattgctttttttttctagagttgccatttctttggtgaacctgaagtagcctcacagcctttgggaaattcagtaaaaataaaagaaaactctatcacggacaaaagacttcctttcacagaaatgcactctttatgtcttccatgttagattcctggtacccctccacttgaagtgtctgccgcattccaagataattcatcaattatcagatacaagtagctcagctctgttgctacaccagccaat

SEQ ID NO: 52765 - DNA, 601 bp, Human
gtaactcagtaaattatatttttaattttttttttttgagacagagtctcactctgttgcccaggctggagtgcagtggctcgatctcagctcactgcaacctccacctcccaggtccaagagattctcctgcctcagcctcctgagtagctgagactaccggcacccgccattatgtctggctaatttttgtatttttagtagagacagggtttcaccatgtcggccaggctggtctcgaactcctgacctcaagtgatctgcccgccttggcttcccgaagtgctgggattacacgcgycagccaccacgcttagtcaaaaattaaaatttttttctacttaaaaaaactcaacaaaccaaattttaatttccttaaaaaaatgaagagaaagcaaaacttcaataagaattgctttttttttctagagttgccatttctttggtgaacctgaagtagcctcacagcctttgggaaattcagtaaaaataaaagaaaactctatcacggacaaaagacttcctttcacagaaatgcactctttatgtcttccatgttagattcctggtacccctccacttgaagtgtctgccgcattcc

SEQ ID NO: 52766 - DNA, 601 bp, Human
aaagtagacacattgatacacatgatacatacaaaaagactagaaagaaatcatcagcatatttacagccactctttctaggtaagagtataggtgattataatttccttctttgttgtttagtattttatacattccgtaccataaacatacgttttgtctttttgtgtgtagcaattcgttttcttttattattctttttgtttacatacagtaaaattcactctttgtggtatacatgtctgagttttgacaaatgcagagctgtgaaatagccaccacaaccaagacacggaactgwgccatctgccccacaattcctcagtgctgcccctttggagtctactctttctgtactgtcaaccctggcaagtgctcatctcttctctgtccccatagttttgcttttccagaacgtcacataaatggaatcatacaggatgtagttttggggggaagtctggtttcttgcacttagcaaaaacacttttttaaatgctaatcactaaagtaactcagtaaattatatttttaattttttttttttgagacagagtctcactctgttgcccaggctggagtgcagtggctcgatctcagc

SEQ ID NO: 52767 - DNA, 601 bp, Human
cggcctgttgtagaaaggattctaggcgctttggaatgggtacatacaaagtcacagcacaacttcatggctgacacagaataaaaaaatgacttcccaatatattaagaagaggcaacaaagcagtattaaagtatgctaccacttttgtgttttaaaaaacaaagtagacacattgatacacatgatacatacaaaaagactagaaagaaatcatcagcatatttacagccactctttctaggtaagagtataggtgattataatttccttctttgttgtttagtattttatacattcygtaccataaacatacgttttgtctttttgtgtgtagcaattcgttttcttttattattctttttgtttacatacagtaaaattcactctttgtggtatacatgtctgagttttgacaaatgcagagctgtgaaatagccaccacaaccaagacacggaactgtgccatctgccccacaattcctcagtgctgcccctttggagtctactctttctgtactgtcaaccctggcaagtgctcatctcttctctgtccccatagttttgcttttccagaacgtcacataaatggaatcataca

SEQ ID NO: 52768 - DNA, 601 bp, Human
ctggcagaaatcccacagacctgccaaaagaattccgaggcctccctcttttctcgtccctgttgcctcggcgacccgaggccaggcttagtcagcatttttgtttgacaaactgcattctcctgtcccccaacccccaaattaaaaaaaaaaaaagaaagaaagaaaaggttgagggtaaaagcagggctgaatttgctttgggaataatgatttctctacaaggcagcccccgtgaagggacaagggggagccaaggctttgccacttactcgtcttccaggtcctggtcctcgaggtyaaaatcttccagaaagatggccccaaaccgttatatttaaatgaataacacacatgaaaagaaatactctcttcaggtaaagccatatgcctgttttcatgtcaaggaattgttcttttagataaacaggcattgagaagcctgtttctcaatgtctgacctgtgactacgatttcccacttcatttggtaaagttgcaattatgccttttaggatactgagcaaatattgcgttgaatttttcaggtgtaacaacagaatactctgtagtcattgtgggtgtgtgtggctcatgacatt

SEQ ID NO: 52769 - DNA, 601 bp, Human
tcacagctgtacttttaatgcctagagcatttgtaaaacaaatatatgaacgaatgaacttaaatagccaagcttatatggagggatttatagattcacaaaatattagactacgtgacctctgttaacccagtcaactctgaaacctaatgctatgaaatgcttttctaaaagttaaatagtcccctgttctgaagcaaaggctatgaaatagcctacatttatgcttcatgatctgctccaatacgacactctcctagctcgctaaatagctattctttgcatgacaaaaaaaaaaagrggggggcctcagaaccttccccaggccagtgctgctcacagccaggtgtgtccccctccaggagccctctgtcaggatggctgtgcgaggtcagccagctggcccgccgcgcctggtggctgtcaagcctggcagaaatcccacagacctgccaaaagaattccgaggcctccctcttttctcgtccctgttgcctcggcgacccgaggccaggcttagtcagcatttttgtttgacaaactgcattctcctgtcccccaacccccaaattaaaaaaaaaaaaagaaagaaagaaaaggt

SEQ ID NO: 52770 - DNA, 601 bp, Human
agcaataaaatagaaagaccaacccctctacctcagacagttcagaggaaatttaatgaaacagccgatttaactttcctgaacatagttttcctccctgaacagggcaacagaatgaactggatgtattcaatgatagttttcaacgtatatgagtggagctcatgtcctaggaattcacaacccatcaagcaaagttacaagttccaatttcaagggcacttttcagaaggaaagctctccctgctgaccctgacccaaccctcctccaacaaatttatttttgtctatgtccaagctyggggtggaaagacttgcaaaataagggctcaagaatctcttggtgagtttgtggtcaactatctagctctctgaagtgagtaattatttatgggctaaaaaataccctttcctagcagctggaggacgggtgatgtgtaaaatagctggagaagtaaggatgtgaaagacaaatgattatttgtgagctgaaggtgtcccaggaagcaaacctcaaacctcctctccttctaggtccttggcctgcagcttgcctgtggaataaaccaacagaggaggtgagaaagtaaacagcagctga

SEQ ID NO: 52771 - DNA, 601 bp, Human
agaacagtgccaggcactcaagatcacataataaatactgaaggaattattattatttcattttctgaattccaatctcaaaaaaaacaaaataaacaattttaaaagtcacactgtcatgtggaactgatccactttaagtggtgagaggtttcttcctggtcaactttcaccttggagggattaaaccaaagtgtgaaattcatcataatggtcaccaaggctaagaaaacaattttttttaaacaaggagaggtttataaaccatttttatataacataaaatttgttcgaatataamtggaaagtagtgagatgttttacttcacttaaattttataatacgagttctatatttagaactttaaaaattctagcctttttttgaatgaaaatacttccctattccaactcatgaactgaaagagaaaaagaaactgtacaaaacccgaggtctgaaaataaaagggctaacctcaccaacatgttgccatccaaacaggggagggttttgttttaaactaaatttaggtataaaattaaagcccagacccagtaggatttggactgccacatgacatccactacccttgcgtgggta

SEQ ID NO: 52772 - DNA, 601 bp, Human
cctcctacagacgccatctcttcagagatgctcctacctcacccctgtctaaaatggcctcacccctgtcattttctgtctcttaatctgcattaattttcttcagtgcaacttaagttttcattctctgtctttcctactagaatgtaagctccacgagggaaggggccttgtttgtcatgttcactcctgtacccaactaccttaacagtgctaggcatacagtgggtacttggaaatataaactaagaacatgcaatctcacctcagccacaaatatgagagaaataatagcctattktatacaacccaactagccaggtgcaggctccatcctcaagaaatggtcctgctgcactctttcctgctcctcacataggatgaacaggagggccgagtggccaggagctagatgcttgaattggaaacctggtcctgctatctaacagaaagttatttaaccctctgttcttcatttgtaaagtggggataataagagcacccacccaagaaggctgctgtgatgataaaacgggataacactacaaggtgcttagaacagtgccaggcactcaagatcacataataaatactgaaggaa

SEQ ID NO: 52773 - DNA, 601 bp, Human
ctgtagggggctcacagtatcattttctaccttcaactgactaacaaataagagaaaaatcagaaagggtgttgaatgtacccggaatgattgcttttttttttttttgagatggagtctcactctctcagccaggctggagtgcagtggcgtgatctcagctcactgtaaccttcacctaccgggttcaagcaagtcttgtgcctcagcctcccgagtagctgggactacaggcatgtgccaccacgcccagctaatttttgtatttttagtggagatatggttgcgccatgttgcccawgctggtctcgaactcctggcctcaaatgatctgcccaccttggcctcccaaagtgctgggattacaggcgtgagccactgcacccggcctgaataatagctttgaaatataaattaggccagtctgagttagaaagttattatttataataggacactttgtctaagattattccaaaatcattcttaggtcacaagttattccacatagcagccaaagtgaagctcacgtgaccccctgctctaaagcgacctgcttcttgttccacctggatggtaaatagaggcaggtcctcactgc

SEQ ID NO: 52774 - DNA, 601 bp, Human
ctaccctgaagacttaatcaccaagtcatcctaagggcaaatgccgccttctgtctgtagggggctcacagtatcattttctaccttcaactgactaacaaataagagaaaaatcagaaagggtgttgaatgtacccggaatgattgcttttttttttttttgagatggagtctcactctctcagccaggctggagtgcagtggcgtgatctcagctcactgtaaccttcacctaccgggttcaagcaagtcttgtgcctcagcctcccgagtagctgggactacaggcatgtgccaccaygcccagctaatttttgtatttttagtggagatatggttgcgccatgttgcccatgctggtctcgaactcctggcctcaaatgatctgcccaccttggcctcccaaagtgctgggattacaggcgtgagccactgcacccggcctgaataatagctttgaaatataaattaggccagtctgagttagaaagttattatttataataggacactttgtctaagattattccaaaatcattcttaggtcacaagttattccacatagcagccaaagtgaagctcacgtgaccccctgctctaa

SEQ ID NO: 52775 - DNA, 601 bp, Human
gaagctctagtctccagcactgatgtttccctaactaccctgaagacttaatcaccaagtcatcctaagggcaaatgccgccttctgtctgtagggggctcacagtatcattttctaccttcaactgactaacaaataagagaaaaatcagaaagggtgttgaatgtacccggaatgattgcttttttttttttttgagatggagtctcactctctcagccaggctggagtgcagtggcgtgatctcagctcactgtaaccttcacctaccgggttcaagcaagtcttgtgcctcagcctyccgagtagctgggactacaggcatgtgccaccacgcccagctaatttttgtatttttagtggagatatggttgcgccatgttgcccatgctggtctcgaactcctggcctcaaatgatctgcccaccttggcctcccaaagtgctgggattacaggcgtgagccactgcacccggcctgaataatagctttgaaatataaattaggccagtctgagttagaaagttattatttataataggacactttgtctaagattattccaaaatcattcttaggtcacaagttattccacatagca

SEQ ID NO: 52776 - DNA, 601 bp, Human
tgccatttcacatttgttccatctattctaaatcaaagagaacagaagctctagtctccagcactgatgtttccctaactaccctgaagacttaatcaccaagtcatcctaagggcaaatgccgccttctgtctgtagggggctcacagtatcattttctaccttcaactgactaacaaataagagaaaaatcagaaagggtgttgaatgtacccggaatgattgcttttttttttttttgagatggagtctcactctctcagccaggctggagtgcagtggcgtgatctcagctcactgyaaccttcacctaccgggttcaagcaagtcttgtgcctcagcctcccgagtagctgggactacaggcatgtgccaccacgcccagctaatttttgtatttttagtggagatatggttgcgccatgttgcccatgctggtctcgaactcctggcctcaaatgatctgcccaccttggcctcccaaagtgctgggattacaggcgtgagccactgcacccggcctgaataatagctttgaaatataaattaggccagtctgagttagaaagttattatttataataggacactttgtctaaga

SEQ ID NO: 52777 - DNA, 601 bp, Human
ccaaaaactggagatttttttggtaaaaagtgattttcatcatctaaatcttggaagtgccttctgaataaacctagaaaaatcaaattattttctgatagttgtttttaacatggcaggcagggtgcattagaaaccttattatccaaccaaagttttcctgaaagcctcagaaggaacaacagggattgaatctggcataaaaagcctgagtcccaccagtccccatccctcaagcacactcatacaccctgagccacagtttgaaaaaatgtatctcatcaatggtaaatttctaatrctttattaaccataaatgcaagaatcttttgactcataaccctcattatccaaaaacatgaactttactagaatattccatttttcaaccattctgaataaatgtgggagtttacctctaaacaaatacacttttaatttaaaagttgatgagatggctgcattcctttgtattgaaaaaactttatcaacatatgtcttaagaatacaagttgaggccgggcggtggctcacacctgtaatcccagcactttgggaggctgaggcgggtggatcacgaggtcaggagatcaagaccacc

SEQ ID NO: 52778 - DNA, 601 bp, Human
tgcatcccaaaccaaggttaggcctttccccatatttatgcctatcagtttcccactttccatgctgaagtcattggtctcactgtccctcaaaccctaaaaccatggctacaatggcaaacagaacatttaggacttctaaattacagtatcttcgttagatctcttccagccctaacatgatgtgactttagagggtagctgctgtctagacaagtcctagtgaagtcatcggctataaaaattttcagttactagagttggttgcactgttacaaaccatgagagacctgattgattwaaaaaaaaactgtattgttaacttatactgaaataaatctagctggaaagggtctttggctcacttctgttcatctagattgcaaataatcaaatacttaactaacaaattttattcaggaatctacaaaaagcaaaccaaaaactggagatttttttggtaaaaagtgattttcatcatctaaatcttggaagtgccttctgaataaacctagaaaaatcaaattattttctgatagttgtttttaacatggcaggcagggtgcattagaaaccttattatccaaccaaagttttcctg

SEQ ID NO: 52779 - DNA, 601 bp, Human
ttctcagcctcccgagtagctgggattacaggcatgcaccaccatgccctgctaattttgtatttttagaagagacagggtttctccatgttggtcaggctggtctcgaactcccaacctcaggtgatctgcccacctcggcctcccaaagtgctgggattacaggcatgagccaccatgcctggccgaacataatctcttaattgttctgttctcaatttgccatatggcatgcttttatcccctgttggttacataaaaccagaagattcttccaagtataagtactagacgacaccaycatgtttaaaaatataagttcatgcccattttcaaattcttgactaggggtttactctacgtcctatcaccaattttttaatttggaaattttttaacaggcagatgatttcccctgcttttcttttttctgccagctcctcccacttcctccctttattctcaccctcaaccctcaagctccccacctcttcccaatgtaaacaaagatcctattatagtctagatcacataataaagagaataaaaataagtggcccccaaatattaacttacccattgaggaaaggatctgagctat

SEQ ID NO: 52780 - DNA, 601 bp, Human
atttcaccctgaacatcatctcttttcttttctttcttttttttttttttgagatggagtttcactcttgttgccgaggctggagtgcaatggtgcaatctcggctcactgcaacctccgcctcccaggttcaagcaattctcagcctcccgagtagctgggattacaggcatgcaccaccatgccctgctaattttgtatttttagaagagacagggtttctccatgttggtcaggctggtctcgaactcccaacctcaggtgatctgcccacctcggcctcccaaagtgctgggattayaggcatgagccaccatgcctggccgaacataatctcttaattgttctgttctcaatttgccatatggcatgcttttatcccctgttggttacataaaaccagaagattcttccaagtataagtactagacgacaccatcatgtttaaaaatataagttcatgcccattttcaaattcttgactaggggtttactctacgtcctatcaccaattttttaatttggaaattttttaacaggcagatgatttcccctgcttttcttttttctgccagctcctcccacttcctccctttattct

SEQ ID NO: 52781 - DNA, 601 bp, Human
ttttatttgatttaaaaactacttctgctcatgaagatatttctggctaaattctctttcccttttgctcctttgttttaattactttttaaattgtgaaattattttaaactcacatagaagacgcaacaagagtacagagagttcccatgtacccttcaccagcttccccagtgataacatcttacataaccatagtgcaattaccaaaatcagaaatctgacactgtagaatattatttactaaactatagatcttattcacatttcaccctgaacatcatctcttttcttttctttyttttttttttttttgagatggagtttcactcttgttgccgaggctggagtgcaatggtgcaatctcggctcactgcaacctccgcctcccaggttcaagcaattctcagcctcccgagtagctgggattacaggcatgcaccaccatgccctgctaattttgtatttttagaagagacagggtttctccatgttggtcaggctggtctcgaactcccaacctcaggtgatctgcccacctcggcctcccaaagtgctgggattacaggcatgagccaccatgcctggccgaacataatct

SEQ ID NO: 52782 - DNA, 601 bp, Human
agcagagaagaaagagaaaagtattctgcataatcaatcctgcagacacaattctgtataatctgtcacaagaacgcaggcttgcagaaaatgaaaatagaatatttatttatgtttaacttaagttactctcaatcaaaaccaggcaatgattaaactggcaacataaaaaggagggagcacgagtcatggaggcgggaagtggtgcacctgcagacttgctctgctccatcactttttccaagaggcccaggaaatgtaaggtcatggctacatccaagttacaatggtagtgattactgccaggttagaaagggctcacttttgttcagagcagactctacatcattgaagagggggatcaggtcttcagattccaaagttcctaagtcaacgtttgttcctggaagacagtcaaggaaatcagggaaacgggtctgttggggattgatgttcatgggtgtttgtcctgcgttttctcctataacaaaatgaaaagaaaccattttaattccttcttttaggctcttgaaggaggaacagttcaagtatttacataaccctcaccttcatgtcttcaactaccacattattgaccctt

SEQ ID NO: 52783 - DNA, 601 bp, Human
gctgtaggttgtgcggctgcagcggctcttccctgggcggacgatggacagccagggcaggaaggtggtggtgtgcgacaacggcaccggggtaagggccgcgcgaggaggccttggcggccacagacgccggcggggacgagcagctggcgcacgggccctcggcccccagggctgcacctccgggccctcggggcgaaggggcgcggggcggtgcctcccacctccgcgggcgtgggagcgagccggccgttccctggtctcccttgagcctgccacccatttagcctgccaccccctyacccttccgggtgggggcggcgggcgagaccggcactggacatggagcctactgaccgcccggcagggacctgctccgcgctaatgcgggggcaattgggctaaagcggacggaagcgtaaaaggctcggtttgtgtgttccgagaagggctcttttccccagggccaccggtttgtaaaaaggagaaagacctagaggccttcctcttcctgtatagttgaagatacaccaaacgagaagcaggaagcgggtttacttaaaaaaaaaaaaaaaaaaagggaagtgctgtcatggagtgt

SEQ ID NO: 52784 - DNA, 601 bp, Human
aaaaagtattagcctgatttccactatagtttcaaattggcctctaaataaataaaaaactttaaaaattgaatttaaaattttttgttttgtgattgtgtcagatactctttttagaaagtcaagccagttatattttaatgaattcttttaggggttcaaggtaatgagccctgtatttgtagtatatatgagtttttaaatattaaattagaatgggaatgttaaccgaagctgattttttttttttttttttttttttggacacaggatctagctctgttgcccaggctggagagcratggcgtgatctcggctctctgcaacctctgcctcctgggctcaagcggttctcctgcttcagcctcccgagtagctgggactacaggcttgtgccaccacacccagttaatttttttatttttgtagagactgggtctccctatgttacccaggctggtcttgaactcctggggttaaaagatctgcccactgcggcctcctaaagtgctaggattacaggcttgagccactgcaccctgctgtcagaagctaatgttatgttactattccattagttagctaacattagaaggctgat

SEQ ID NO: 52785 - DNA, 601 bp, Human
tatctagtaaaaataaaaataaaattacaggctttttaaaaagttacgattcttttaacctctctggcagacccaaattaaatattctaggacaggagtgtccagtcttttggcttccctgggccacattggaagaggaattgtcttgggccacacatgaaatacactaacaatagctgatgaactaaaaaaatcaccaaaaaaatttcataatgttttaagaaagtttgtgaatttgtgttgggcctcatgcagcccgtgggccatgggttggacaagtttgcctggaaacaagtttgtwcttacgatcacatgaccaatgttggtcccgcttgattttctatctcccagcttgaccagtgtctcagtagggttgcccagaggaggaaaactcatttgatccaataatttatgtggattttaaccattcaaacctccttctgaaatcaagccacttaaagtggcccagataggtgaaaatctggaggtctgtgaaactctaggtttaggtcctcttcacgagctaggcccaggcccctggtgttacgtgtcttgttaccagactagggtgatttcatcagcattgagttagatcaccaac

SEQ ID NO: 52786 - DNA, 601 bp, Human
aaaaataaaattacaggctttttaaaaagttacgattcttttaacctctctggcagacccaaattaaatattctaggacaggagtgtccagtcttttggcttccctgggccacattggaagaggaattgtcttgggccacacatgaaatacactaacaatagctgatgaactaaaaaaatcaccaaaaaaatttcataatgttttaagaaagtttgtgaatttgtgttgggcctcatgcagcccgtgggccatgggttggacaagtttgcctggaaacaagtttgtacttacgatcacatraccaatgttggtcccgcttgattttctatctcccagcttgaccagtgtctcagtagggttgcccagaggaggaaaactcatttgatccaataatttatgtggattttaaccattcaaacctccttctgaaatcaagccacttaaagtggcccagataggtgaaaatctggaggtctgtgaaactctaggtttaggtcctcttcacgagctaggcccaggcccctggtgttacgtgtcttgttaccagactagggtgatttcatcagcattgagttagatcaccaacaaaatgaaggtttc

SEQ ID NO: 52787 - DNA, 601 bp, Human
tggcccagataggtgaaaatctggaggtctgtgaaactctaggtttaggtcctcttcacgagctaggcccaggcccctggtgttacgtgtcttgttaccagactagggtgatttcatcagcattgagttagatcaccaacaaaatgaaggtttctccagtgcgtgctatgttgctggcacagtgcttaataaggtccagtcgtacagagaagcttatagtgctagaataattgcatttgcatttatgtaattgacatttgtagttgattgtggcctgctttatcgggcttatgctactttrtatgttgaatttaggagtgtttgaaacagaaacaaaccaaaaccaaatttggtttcatcttgcaaaatgctttggtataagtagaataaatattttggtggcctaagatcagaacagtcactgtgcagttaacttactaaagaacatcagtaccatgagataaaattagtaaggggaaaataaatattaaataagcccaaatggggctttataaatcccaggttattatttttttgaagagaaaaaaaaaatgtacttttagagcagatgtagatagaatttttcatttttgcttgaaag

SEQ ID NO: 52788 - DNA, 601 bp, Human
atttttgcttgaaagaacattatactgttcatattcttaccatttgatgactcagtgggaagtaagggaactagtttaaaccacactgctgtgaagaggaaactatatatggtaaaatctatttcttaaacacagccttactgcacacaatgaaagaacgaagtcaccaagtcttaaaatgattgacatgggggaggaatttcaaggattaagatgataccaatgataccaaatgatagtttagaaaggaatgttttctttgtattttatcacatcatggtttagttttttttttttttttagacagagtcttgctccgttgcccaggccagagtgcagtggcatgattttggcttactgcagcctccatctcccgggttcaagcaattctcctgcctcagcctccccagtagctgggatcacaggtgtgcaccaccacgccaggctaatttttgtatttttagtagagatgtggtttctccatgttcgtcaggctggtctccaactcctgacgtcaggtgatctgcctgcctcagcctcccaaagtgctgggattataggcgtgagcactgcgcccagtctagattttttttaatactga

SEQ ID NO: 52789 - DNA, 601 bp, Human
tttctccatgttcgtcaggctggtctccaactcctgacgtcaggtgatctgcctgcctcagcctcccaaagtgctgggattataggcgtgagcactgcgcccagtctagattttttttaatactgattattattattatttgcagaagtaatcagattgtcagttttatattattgaaaaattggggccaggcacagtggttgatgcctataatcccagcactttgggaggtaaaggtgggaggattgcttgaggctgggagttcaagaccatcctgagcaacagcgagacccctgtctcyacaaaaaataatataatttaaaaattataatttttattttttctttactgcttcttgcagagcaggactaccccataggcagtgtgcccagagtagccagtataattttttttttaattattttattttattattgtttttgagacagagtctcactctgtctcccaggctggagtgtattcatgttatctcggctcactgcaacctccgcctcccaggttcaagtgattcttctgccccagcctctcaagtagctgggattacaggcatgcaccaccacgcccagccaattttgtactt

SEQ ID NO: 52790 - DNA, 601 bp, Human
tgatcctcccacctcagcctcccgagtttctggggctacaggtgtgtgtcaccacgcctggctaatttttgtattttttgtagaaatggggttttgctctgtagcttcaggctggtctcgaactcctgggcccaagcaatccacccactttggcttcctacagtgccaagattacaggtgtgagccaccattcccagccaattattttagttcttgttattataactgttaatgttttcacttttgaagtaatgtgaaatagtgcaatttttgctatcttgatggatgaatatataccctrtatgaaaactggtgctgagttctatggcaacatctgcttccaataaactactgctcaagcagaatagttttattaataagtgattgataatctttaatttgaatgaaaagtctttttttttgttaggcagtaatagtaggtttacagttgtttttatagtttcagggatttcagtttttgtcttctaacttgggaaatgtttgttgcttaaaatatactcataagaatgttaagatacgaactacccatctgaacgattataattggaagactttgagtgatgtgattatttgccacttt

SEQ ID NO: 52791 - DNA, 601 bp, Human
ttgataatctttaatttgaatgaaaagtctttttttttgttaggcagtaatagtaggtttacagttgtttttatagtttcagggatttcagtttttgtcttctaacttgggaaatgtttgttgcttaaaatatactcataagaatgttaagatacgaactacccatctgaacgattataattggaagactttgagtgatgtgattatttgccactttgccatgttgtatgtccagtgtgtgtagctctgaaggagaggggagacgtgtcaaccttagcagcctcttccctgcactaggatyagacctatgctccatcccaggctcctcctgccacctccagcttctcttacgatttctcacttagtaaacttatttatttgcattcagcatgccaaaaatgaaccttacaaactggtaggttctcttttcattcattcattcattctataatttttttgagataatttatacgcatataagtgagcattttcatcctgataaatggatacttttgactatatctgtttattacttggaggtaggcataataatttaatatcaaaatagtatttaattcccatatttgagatatttgtgtaa

SEQ ID NO: 52792 - DNA, 601 bp, Human
catcctgataaatggatacttttgactatatctgtttattacttggaggtaggcataataatttaatatcaaaatagtatttaattcccatatttgagatatttgtgtaaattatgactgacattaggctggcgatcatgacagatgttatacagaaatgtgggaacaatagggataatgatgagaacagattctcttccatatcatttaagtttgtatcaagtaaactggattttgacttaaaagagagtttgtgatttgggagagaagagtgtgtgagaggtgtgtgtgtgtgtgtgttcacgtggtgtgtgtgttatgttttagtttgaaaatactaaaaaatactagatgttattcttttcctctgaggtagtttttcctccatgtcttaggtcacattatttaagaagacactgagaaaaaatgaactactactcctgaattctgttcattttaagggtgggaagtgtattccagttcatcactatcaaccactgccaaggggaaatagctgtgagcaagtgggttatctattgcatatgctatcatatcatgctaacttctgccttaaaaagtaatccaggctgggtgccgtggc

SEQ ID NO: 52793 - DNA, 601 bp, Human
tgggaggctgaggcagaattgctggaacctaggaggcagaggttgcagtgagctgcgatgacgtcactgcactccagcctgggtgacagagcgagactccatctcaaaaaaaaaaaaaaagacaagtgaaattctggatggcagaatgtcctaggctatttataattaaatgtggttcatcagcgtcatctccaacagggctgctgtagagatctttgaaaataccaaatttttatgttttggagagctacataagatcttgctaagttttaccgcattaaacaaaagagtttcttgtagrtagtagctttcttttgttgttggttttttgtttttttgggttttgttttgttttgttttgttttttttgagacaggtctcattctgttgcccaggctggagtgcagtggcgtgatctcagctcactgcaacctccgcctcccaggttcaagtgattctcatacctcagcctcccaagtaactgggattacaggcatgcaccaccatacctggctaatttttgttggttttagtagagatgggtttccatcatgttggtcaggctgatctcaaacttctggcctcatgtgattcaagtggt

SEQ ID NO: 52794 - DNA, 601 bp, Human
tgtggttcatcagcgtcatctccaacagggctgctgtagagatctttgaaaataccaaatttttatgttttggagagctacataagatcttgctaagttttaccgcattaaacaaaagagtttcttgtagatagtagctttcttttgttgttggttttttgtttttttgggttttgttttgttttgttttgttttttttgagacaggtctcattctgttgcccaggctggagtgcagtggcgtgatctcagctcactgcaacctccgcctcccaggttcaagtgattctcatacctcagcmtcccaagtaactgggattacaggcatgcaccaccatacctggctaatttttgttggttttagtagagatgggtttccatcatgttggtcaggctgatctcaaacttctggcctcatgtgattcaagtggtgtgcatagtagccttctatcaagaggtacattgctcttttctgtctacctttgttttattactgtcatgtatcacattcaggtactatttttcatccttaattctaagaatgtgtggtgcctggagccatagaaaaacagactttttctgaatattaaatatattttaaa

SEQ ID NO: 52795 - DNA, 601 bp, Human
tggtatcatactgttaagtcaacagcaaaacttttaatatttattgatcatttactgtgtacctattatgtgccagacgctgttctaggcagttggaattcatcagtaaacacagtgtagctaacattaaataaatgcttgttaaagagggtgcagactatgattacatttcctttcttatatagcttcctcctcccaccctgaaatttttaattgccctttccttgcaatgtctgctcttactagactatgtattatttattttttgtatgttttttgagacagggtctcacatgatcayggcagccttaacctcccaggctcaagtgatcctcccacctcagtctctggaatagctgggactatagcacatgccacaatgcctggccaatttttaaattttttgtaattttttccgggggggaatcttgccgtgttgcccatactggtctcgagcttctgggctcaagtgatctacctgcctaagcctcccaaagtgctggaattacaggtgtgagccactgggcccagcgtaaacagactatacaagaatttgtaactgccgggcacagtggctcatgtctgtaatcccagcaactca

SEQ ID NO: 52796 - DNA, 601 bp, Human
catttactgtgtacctattatgtgccagacgctgttctaggcagttggaattcatcagtaaacacagtgtagctaacattaaataaatgcttgttaaagagggtgcagactatgattacatttcctttcttatatagcttcctcctcccaccctgaaatttttaattgccctttccttgcaatgtctgctcttactagactatgtattatttattttttgtatgttttttgagacagggtctcacatgatcacggcagccttaacctcccaggctcaagtgatcctcccacctcagtctcyggaatagctgggactatagcacatgccacaatgcctggccaatttttaaattttttgtaattttttccgggggggaatcttgccgtgttgcccatactggtctcgagcttctgggctcaagtgatctacctgcctaagcctcccaaagtgctggaattacaggtgtgagccactgggcccagcgtaaacagactatacaagaatttgtaactgccgggcacagtggctcatgtctgtaatcccagcaactcaggaggctgagacaggaggatcattggaggccaggagttccagaccagc

SEQ ID NO: 52797 - DNA, 601 bp, Human
atagggccaggcgcggtggctcacgcctgtaatcccagcactttgggaggctgaggcgggcagatcacgaggtcaggagatcgagaccatcctggctaacacagtgaaaccccgtctctactaaaaatacaaaaaattagctgggtatggtggtgggcgcctgtagtctcagctactcgggatgctgaggcaggagaatggcgtgaacccgggaggtggagcttgcggtgagccgggatggcgccactgcactccaccctgggcgacagagcgagactgtctaaaaaaaaaaaaaaaaaaagtaaatagctagccaggcgcggtgactcaacgcctgcaatcccagcactttgggaggccgaggtgggcagagcagctgaggtcaggagttcgaaaccagcatggccaacatggtgaaaccctgtctctactaaaaatgcaaaaattagctgggcatggtggtgggtgcctgtaatcccagctacttgggaggctaaggcaggagaattgcttggacctgggaggcagaggttgcagtgagctgagatcacgccactgcactccagcctgggcgacaagagtgaaactccgtctcaaagaa

SEQ ID NO: 52798 - DNA, 601 bp, Human
ctgggcttagtggcgcatgcctgtaatcccagctacttgggaggctgaggcaggagaatcacttgaacccaggaggcggaggttgcagtgagccgagattgtgccattgcacttctgcctgggcaaaaagagtgaaactccgtctcaaaacaaaaacaaaaaaaaccttagcatttgttcagcgaatttgtccatcccacagatacttctggagtgagcactgtgtgccaggagctctgttaggtattggattccagcacgaactgctcagcttagctccctgctcttatgaggcttttgstctagtgagggaacttaggcactaatttagcagtaaataaacatgaaccctggaagtaggcaatgccgtgaaagaagttaaaaggagatgttgcgatagattgagtggctacttcgggtggactgaaagcaccaaaagtttaaaatgttatataaatgcaaagtgatatttttcagatgctgtcttaaaatatagtaaatatcctgatgctaacccacttttattttactgtttcattccagtttgtgaagtgtggatatgcaggctctaactttccagaacacatcttcccagctttgg

SEQ ID NO: 52799 - DNA, 601 bp, Human; identical to SEQ ID NO: 33191

SEQ ID NO: 52800 - DNA, 601 bp, Human; identical to SEQ ID NO: 33190

SEQ ID NO: 52801 - DNA, 601 bp, Human; identical to SEQ ID NO: 33189

SEQ ID NO: 52802 - DNA, 601 bp, Human; identical to SEQ ID NO: 33188

SEQ ID NO: 52803 - DNA, 601 bp, Human; identical to SEQ ID NO: 33187

SEQ ID NO: 52804 - DNA, 601 bp, Human; identical to SEQ ID NO: 33186

SEQ ID NO: 52805 - DNA, 601 bp, Human; identical to SEQ ID NO: 33185

SEQ ID NO: 52806 - DNA, 601 bp, Human; identical to SEQ ID NO: 33184

SEQ ID NO: 52807 - DNA, 601 bp, Human; identical to SEQ ID NO: 33183

SEQ ID NO: 52808 - DNA, 601 bp, Human; identical to SEQ ID NO: 33182

SEQ ID NO: 52809 - DNA, 601 bp, Human; identical to SEQ ID NO: 33181

SEQ ID NO: 52810 - DNA, 601 bp, Human; identical to SEQ ID NO: 33180

SEQ ID NO: 52811 - DNA, 601 bp, Human; identical to SEQ ID NO: 33179

SEQ ID NO: 52812 - DNA, 601 bp, Human; identical to SEQ ID NO: 33178

SEQ ID NO: 52813 - DNA, 601 bp, Human; identical to SEQ ID NO: 33177

SEQ ID NO: 52814 - DNA, 601 bp, Human; identical to SEQ ID NO: 33176

SEQ ID NO: 52815 - DNA, 601 bp, Human; identical to SEQ ID NO: 33175

SEQ ID NO: 52816 - DNA, 601 bp, Human; identical to SEQ ID NO: 33174

SEQ ID NO: 52817 - DNA, 601 bp, Human; identical to SEQ ID NO: 33173

SEQ ID NO: 52818 - DNA, 601 bp, Human; identical to SEQ ID NO: 33172

SEQ ID NO: 52819 - DNA, 601 bp, Human; identical to SEQ ID NO: 33171

SEQ ID NO: 52820 - DNA, 601 bp, Human; identical to SEQ ID NO: 33170

SEQ ID NO: 52821 - DNA, 601 bp, Human; identical to SEQ ID NO: 33169

SEQ ID NO: 52822 - DNA, 601 bp, Human; identical to SEQ ID NO: 33168

SEQ ID NO: 52823 - DNA, 601 bp, Human; identical to SEQ ID NO: 33167

SEQ ID NO: 52824 - DNA, 601 bp, Human; identical to SEQ ID NO: 33166

SEQ ID NO: 52825 - DNA, 601 bp, Human; identical to SEQ ID NO: 33165

SEQ ID NO: 52826 - DNA, 601 bp, Human; identical to SEQ ID NO: 33164

SEQ ID NO: 52827 - DNA, 601 bp, Human; identical to SEQ ID NO: 33163

SEQ ID NO: 52828 - DNA, 601 bp, Human; identical to SEQ ID NO: 33162

SEQ ID NO: 52829 - DNA, 601 bp, Human; identical to SEQ ID NO: 33161

SEQ ID NO: 52830 - DNA, 601 bp, Human; identical to SEQ ID NO: 33160

SEQ ID NO: 52831 - DNA, 601 bp, Human; identical to SEQ ID NO: 33159

SEQ ID NO: 52832 - DNA, 601 bp, Human; identical to SEQ ID NO: 33158

SEQ ID NO: 52833 - DNA, 601 bp, Human; identical to SEQ ID NO: 33157

SEQ ID NO: 52834 - DNA, 601 bp, Human; identical to SEQ ID NO: 33156

SEQ ID NO: 52835 - DNA, 601 bp, Human; identical to SEQ ID NO: 33155

SEQ ID NO: 52836 - DNA, 601 bp, Human; identical to SEQ ID NO: 33154

SEQ ID NO: 52837 - DNA, 601 bp, Human
gcaacaagagcgaaattctgtctcaaaaaaaaaaaaagggagccaaagcagatgagatgaactataggatacactccaatcctgaaattttatacctaattataaaattgttattaaggtcagttatgaatataaaatttgaatcggaaaacaaaacatttaagttcatactgtcattccagagctaaccacagggaggagcgagggatctgaaacaattcccaagggagacagtatttcgctgttacctgaagcccacccggtaggtggagaaaccctcaataccagacagagtatttcyctggcccttttgcctagacttcagaatgctcttcacaaagccacggttaacccgtcttcctccctttcctccctaccgcagttttccctcttctcttttgtagtttcacatcaagttttacctaatactactactttccccccaatatttttcttttccccttttgtccagagtaaaattttctagaaaagccctttgtaggtaggttgtgatgaaaaaaattgatgaaatgacttacaatcaaagaaactataaactacaattacaggcaaatgagaattactgattaagttttagaga

SEQ ID NO: 52838 - DNA, 601 bp, Human
ctcaggaggctgaggccggagaatcacttaaacagaaaggccagtgagccgagatcacaccactgcactctagactgggtgacagagactctgtctaaaaaaaaaaaagagagagagagagaaattctgacctggtttagtaagtaaaaagcgctttaagctattggctattgatatgagatgctaatctgaagataagaaaataaatgtttttcaaccttcaatgccctaaggtagaaccccatagcatacttgtgatatttctttttatattttttccattaatttaatgactgaaacwaatatgcaggtattttaagaattttctgctcaatactatctttatagtcaattctagatgaccccttgaccactaataagccagcttctacacagcaataaatagccagcctcctcaaaattatactatagatattgacactgcctttaataaaaggaaaatatgatttatagcacaaaaaattcctggccgggcacggtagctcacatctgtaatcccagcactttgggaggccgaggcaggtggatcacaacgtcaggagtcttgagaccagcctggccaacatagtgaaatcctgtc

SEQ ID NO: 52839 - DNA, 601 bp, Human
aaataaaataaacataaataaaattcctcagcctgggcaacactgcaaggccctatctctacaaaaaaaaacttaaaaaaaaaaaattagccagtcatggtggcatgtgcctatattaggctgaggctggaagaccccttgagcccagaaggctatgcagtgaactatgatcgagccactgtaaaggcagataagtgtagtgaggatgtgaaggaaccggcacaagaaatcccatactccttaccactcaagcatgggcaagagtgagatcctgtctcaaaataaatacataaataatttwaaaaataaaaaggccgggcacagtggctcatgcctgtaattccagcactttgggaggctgaggcgggcagatcacttgaggccagaagttcaagaccagactcgccagcatgggaaaaccccttctctactaaaaatacaaaaaagttagctgggcatggtggcgagtgcctgtaatcccagctacttgggaggctggggtaggcaaattgctagaacccaggaggcagaagctgcagtgagccgagatggcaccattgcactccagcctgggcaacaagagcaaaactccaacttaaaa

SEQ ID NO: 52840 - DNA, 601 bp, Human
aaaagaagaaaaaaaagaaaatatactaaaagccactgaattatacccttaaaatgaatgaattatacccttaaacccactgaattatactcttaaagtgagttcatatactgtatggtatatgaaccatatgtggtatgaaccatacagtatatgaactctatctcaataaagctgattaaaaaggaacctgtaagaaataaataaaataaaaaggaacctgtatacacattttcaaatactaaatatgattaaaaggtgttgtttttctgctagcattgggtcaaaaaggaaaaaaaakttgatatacttcatctctgaactagatctagaaagaaacaaaaacaactacactgaaatcatactctgtctacaaaatgtcattaaacatcttaagctcagttctaaagatttgtttccagataatacaatgtcaagaactactgatcagacctgtataaatttctatgttcaaattcaagcccttacctctcaaaattcaattctaagactaataacccaatagaagattagaggttagggaaacagtagtaacaactgctaaggaatcagacaatagaactttgtgtaaaatatcctt

SEQ ID NO: 52841 - DNA, 601 bp, Human
tggtaatgccctgtctctactagaaatacaaaaaattagctgggtgtggtggcatgtgcctgtaatcccagctgctagggaggctgaggcaggagaatcgcttgaatctggacagagtgagattctgtctcaaacaaaaagttcaaacatcattagccatttagccatcagagaaatacaaatcaaaactacaatgagataccatctcacacccaccattagttattataaaaaaggtggataagtgtagtgaacatgtgaaggaactggcatcctcatatattgctggcaggaatgtacracggtacagcaactttggaaaacagtttagcagtttctcaaaatgttaaacacgtagttaccatatgacccagcacttccactctttggtatataaccaagagatatgaggacatatttccacacaaaaatttgtacatagtatcactatttataatagcaaaaaaaaaaaaaaaaagtggaaatccaaaatgtctatcaactaatgaatggataaacaaaatgtgacaaatccataccatggaatattattcaaccataaaaaagaacgaaacactgattgattcatgacacaacattg

SEQ ID NO: 52842 - DNA, 601 bp, Human
tcaatgccagtctgggcaacatagtaataagaccctgtctctataaaaaattttaaaaaattagcccagtatggtggtgcatgcatgtaatcccagctactaagaaggctgaggcaggcggatctcttgaacctaggagttcaaggctgcagtgagctatgattgagccactgtgctacagcctgagggacagagcaagactgtctctaaaaaagtaatataaaatagactcaacaacctaggaataaaagggaacttcctaaacctgatagagtacatctatgaaaaactcagtcagccrggcacggtggctcatgcctgtaatactcccccagttgatctacagattctgcataacccctatagaaacccaggtgccttttgtgcagaaattgacaaattaatcctaaaatttagatgaaaaacaaattttaaaaacatttcaaaacgtactaaaaagctacagtaaccaagatagtgtattactggcatagggacatgtagaccaatgaaatggacttgagagttcagaaataaaaccctcacatttacggtcaatttatctctgacaatgatgccaagataattcaatgggggaaaa

SEQ ID NO: 52843 - DNA, 601 bp, Human
aaaaaacagataataacaactgctagcaaggatgtggagaaactgaaattcttgtgtactgttggtggaaatgtaaatgatacaggtgttgtgaaaaacaacatggaggctgggcacagtggctcacgcctgtaatcccagcactttgggaggccaaggcaggtggataatttgaggtcaggagttcgagaccagcctggccaacatggtgaaacccagtctctacctaaaaatacaaaaattagccgggtgttgtggcgagcacctgtaatcccagctacgtgggaggccgaggcaggasaatcacttgaacctgggaggtggaggttgcagtgagcagagatggtgccactgcactccagcctgggcgacagagcaggactccgtctcaaaaaaattttttttaaattaggcagtcactaaaagacaaataccatatgattccacttacagtatgaagtatctaaactaatcaaattcatagagactgaaaatagaatgctgtttgccatgagctgggggaaagagaatggggactcatttaatgggtatggagtttcagttctgtaggatgaagagttctggaaactgggtacacaac

SEQ ID NO: 52844 - DNA, 601 bp, Human
cccacctatgtggaggctgaggtggcaggactgcttgagcccagaggttgaggctgcagtgagctatcacattgcaccactgcactccagcatgagcaagaataagaccgtctcaaaaaaaaaaaaaaagaaaaaggaaaaaagaaaccattaaaaaaaaacagataataacaactgctagcaaggatgtggagaaactgaaattcttgtgtactgttggtggaaatgtaaatgatacaggtgttgtgaaaaacaacatggaggctgggcacagtggctcacgcctgtaatcccagcactktgggaggccaaggcaggtggataatttgaggtcaggagttcgagaccagcctggccaacatggtgaaacccagtctctacctaaaaatacaaaaattagccgggtgttgtggcgagcacctgtaatcccagctacgtgggaggccgaggcaggacaatcacttgaacctgggaggtggaggttgcagtgagcagagatggtgccactgcactccagcctgggcgacagagcaggactccgtctcaaaaaaattttttttaaattaggcagtcactaaaagacaaataccatatgattcca

SEQ ID NO: 52845 - DNA, 601 bp, Human
tggccaacatggtgaaaccccatctctactaaaaatacaaaaaaattagccaggagtggtggcacgcgcctgtagtcccagctacttgggaggctaaggcagaagaatcacttgaacccgggaggcggaccaggaggcggaggttgcagtgagccgagatcgtgccactgcactcccgcctggtgacagagtgagactctgtcttaaaaaaaaaaaaaaaaaaaaaaagatattcttgcaactggaatgatatttcattttccaggagtttgacacaatttaggaggtttttcctgcacamaatggccacccatttccaattaaacattcataaaaacaccacaaccacccacctcactacctcatacccattagaataggaactattaaaaataataataataaaaataaaaccaggcacagtggctcacgcctgtaatcccaacactttgggaggccaaggcgggtggatcacttggggtcaggagtttgagatcagcctgaccaacatggtgaaaccccgtttctactaaaaatacaaaaaattagctgggcgtggtggtgcatgcctgtaatcccagctacttgggaggctgagaca

SEQ ID NO: 52846 - DNA, 601 bp, Human
tcgccaggctggagtgcagtggcgcaatcttggctccccgcaacctccatctcccgggttcaagcaattctcctgcctcagcctcccgagtagctgggagtacaggtgcgtgccaccacacccagctaattttttatttttatttatttatttttttagagacagagtctcactctgtcgtccaggctggactgaagcggcgcaatctcggctcacttcaagctccgccttccgggttcacgccattctcccgtctcaaaactcctgagtacctgggactacaggtgcctgccaagacgcycggctgatttttgtatttttagcagagacggggtttcaccgtgttagccaggatggtctcaatctcctgacctcgtgatccacctgcctcggcctcccaaagtgctgggattacaggcatgagccaccgcgcccggcctaattttttatttttagcagagatggggtttcaccatattggtcaggctggtctcgaactcctgacctcaggtgatccgcctgcctcggcctcccaaagtgctgggattacaggtgtgagccaccgcacccaccaacagtaaactttagtaataaaaattag

SEQ ID NO: 52847 - DNA, 601 bp, Human
ttacgggtgtgagccactgcacccggccaggatgttctttctctctatacctcaaacttaacacatgtaatcaggaaatcagcagtctgcaaaaaaaaaaaaatcaagagcttcccctacaggtcttatttctgtaaatggaatcttaactctcccagacaacacttaataccagagtcatgcttaacttcctggctgtcttccaccatccatcactgagtcctgcatgcagtccttcatcatgttgttgttcctggattactttgttttgttggtttgttttgttttttttttttttttkttttttttgagagagagaatgtctccctgtcacccaggctggagtacagtggcatgatctcagcttactacaacctccgcagcccaggttcaagtgattctcatgcctcagcctcccaagtagccgggattacaggtgtgtgccaccatgactggctagtttttatatttttagtagacacggggtttcaccatgttgcccaggctggtctcaaactcccgacctcaggtgatcctcccgcctcagcctcccaaagtgctgagatttaggcatgagccactacgccagcccacagtacat

SEQ ID NO: 52848 - DNA, 601 bp, Human
gggattacgggtgtgagccactgcacccggccaggatgttctttctctctatacctcaaacttaacacatgtaatcaggaaatcagcagtctgcaaaaaaaaaaaaatcaagagcttcccctacaggtcttatttctgtaaatggaatcttaactctcccagacaacacttaataccagagtcatgcttaacttcctggctgtcttccaccatccatcactgagtcctgcatgcagtccttcatcatgttgttgttcctggattactttgttttgttggtttgttttgttttttttttttkttttttttttttgagagagagaatgtctccctgtcacccaggctggagtacagtggcatgatctcagcttactacaacctccgcagcccaggttcaagtgattctcatgcctcagcctcccaagtagccgggattacaggtgtgtgccaccatgactggctagtttttatatttttagtagacacggggtttcaccatgttgcccaggctggtctcaaactcccgacctcaggtgatcctcccgcctcagcctcccaaagtgctgagatttaggcatgagccactacgccagcccacagt

SEQ ID NO: 52849 - DNA, 601 bp, Human
tgctgggattacgggtgtgagccactgcacccggccaggatgttctttctctctatacctcaaacttaacacatgtaatcaggaaatcagcagtctgcaaaaaaaaaaaaatcaagagcttcccctacaggtcttatttctgtaaatggaatcttaactctcccagacaacacttaataccagagtcatgcttaacttcctggctgtcttccaccatccatcactgagtcctgcatgcagtccttcatcatgttgttgttcctggattactttgttttgttggtttgttttgttttttttkttttttttttttttttgagagagagaatgtctccctgtcacccaggctggagtacagtggcatgatctcagcttactacaacctccgcagcccaggttcaagtgattctcatgcctcagcctcccaagtagccgggattacaggtgtgtgccaccatgactggctagtttttatatttttagtagacacggggtttcaccatgttgcccaggctggtctcaaactcccgacctcaggtgatcctcccgcctcagcctcccaaagtgctgagatttaggcatgagccactacgccagccca

SEQ ID NO: 52850 - DNA, 601 bp, Human
ggcaatggctcatgcatgtaatctcaacattttgggaggtcaaggcaggaggactgcttgaggccaggagttcaagcctgggcaacatagtgagacctcatctcaacaacaacaacaacatccgtaaacagccattctgcagacttcatttcccctagccattatgtcagattaaacagtacaaaccatgtcagttttttttttatttttcaatgtttattttagaatcacagaatacatgtgtaagtttgttagaaaggtatactgtgtgatgctgaggtttggggtatgactgaacccrtttcccaggtgctgggtatagtatcaaataggtagtttttcagctgttcctctgccacacaacccccacccccaccctgccgcaccaccacctctagtagacccatgtctattgttgccatctttacatccatgtgtacttgatgttcagctcccactctcactgcgtgagaacacgcagtatttggttttctgtttctgtgttagtttgcttaggataatgccctccagctacattcatgttgttgcaaagacattatttcattatttttaatgggtgcatagtattccatgatggcta

SEQ ID NO: 52851 - DNA, 601 bp, Human
aacactgaggcaagaggaccacctgagcccaggaggtggaggctgcagaaagctatgatgcaccactgcactccagcctgggtgacagagggagaccccatctctaaaagaaaacaaagttataggatcacattgactgtggtaattacttcatttcagcatcttgttttcttttttttttgagatggagtctcccaggctggagtagagtggcgcgatctaggctcaccatatcctccactttccaggttcaagcaattctcctgcctcagtctcctgagtggctgaaattacagtgggmacctgccaccacgcccagccaatttttgtattttcagtagagacggggcttcaccatgttgcccaggctcttctcaaactcctgagctcaagtgatctgcccagctcggcctcccaaaacgctgggattacaggcgtgagccattgcaactggccaaacacagaaattatcctctcttcctagattaacattttttcttaaactcctgatctcaaatccttctccttcaaggtcttactacacagagaatgtaataaccttaacagcaatccaaatagccgttttggcaatggctcatgc

SEQ ID NO: 52852 - DNA, 601 bp, Human
ctaggcaacatagcaagaccccgcctctacaaaaaaattttaaagttagccaggcatagcagcatgcacctgcagtcagtcctaactactcggaacactgaggcaagaggaccacctgagcccaggaggtggaggctgcagaaagctatgatgcaccactgcactccagcctgggtgacagagggagaccccatctctaaaagaaaacaaagttataggatcacattgactgtggtaattacttcatttcagcatcttgttttcttttttttttgagatggagtctcccaggctggagtasagtggcgcgatctaggctcaccatatcctccactttccaggttcaagcaattctcctgcctcagtctcctgagtggctgaaattacagtgggcacctgccaccacgcccagccaatttttgtattttcagtagagacggggcttcaccatgttgcccaggctcttctcaaactcctgagctcaagtgatctgcccagctcggcctcccaaaacgctgggattacaggcgtgagccattgcaactggccaaacacagaaattatcctctcttcctagattaacattttttcttaaactcct

SEQ ID NO: 52853 - DNA, 601 bp, Human
cctaggcaacatagcaagaccccgcctctacaaaaaaattttaaagttagccaggcatagcagcatgcacctgcagtcagtcctaactactcggaacactgaggcaagaggaccacctgagcccaggaggtggaggctgcagaaagctatgatgcaccactgcactccagcctgggtgacagagggagaccccatctctaaaagaaaacaaagttataggatcacattgactgtggtaattacttcatttcagcatcttgttttcttttttttttgagatggagtctcccaggctggagtrgagtggcgcgatctaggctcaccatatcctccactttccaggttcaagcaattctcctgcctcagtctcctgagtggctgaaattacagtgggcacctgccaccacgcccagccaatttttgtattttcagtagagacggggcttcaccatgttgcccaggctcttctcaaactcctgagctcaagtgatctgcccagctcggcctcccaaaacgctgggattacaggcgtgagccattgcaactggccaaacacagaaattatcctctcttcctagattaacattttttcttaaactcc

SEQ ID NO: 52854 - DNA, 601 bp, Human
gattgagatcaggagttggagaccagcctaggcaacatagcaagaccccgcctctacaaaaaaattttaaagttagccaggcatagcagcatgcacctgcagtcagtcctaactactcggaacactgaggcaagaggaccacctgagcccaggaggtggaggctgcagaaagctatgatgcaccactgcactccagcctgggtgacagagggagaccccatctctaaaagaaaacaaagttataggatcacattgactgtggtaattacttcatttcagcatcttgttttcttttttttttgagatggagtctcccaggctggagtagagtggcgcgatctaggctcaccatatcctccactttccaggttcaagcaattctcctgcctcagtctcctgagtggctgaaattacagtgggcacctgccaccacgcccagccaatttttgtattttcagtagagacggggcttcaccatgttgcccaggctcttctcaaactcctgagctcaagtgatctgcccagctcggcctcccaaaacgctgggattacaggcgtgagccattgcaactggccaaacacagaaattatcctctcttcc

SEQ ID NO: 52855 - DNA, 601 bp, Human; identical to SEQ ID NO: 25762

SEQ ID NO: 52856 - DNA, 601 bp, Human; identical to SEQ ID NO: 25763

SEQ ID NO: 52857 - DNA, 601 bp, Human; identical to SEQ ID NO: 25764

SEQ ID NO: 52858 - DNA, 601 bp, Human
tccatgaatgataattacagtaatattgttcattaattcaaaaaacatttttaaggatccctcactactagggatgcataaaagttgctaaccctcggcctttacccagcgttagaagacaaaacagagggtaaaagtcccagaaacgcgttcgaaccaattcagctaggaattaaattctcagatcctttattacaccaccggagccttaaccttgaggcaagcagcaatttgttcatgcgcagttaacgctccctaaactgccacttgctcagctccgcgcctaaggtgtctattagtrcgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagtgagtgattcggccctgggcgggtgggctggtcttctgccctgcccctgggtacagccctcggtgctctattcccgttccagtctgttgcgagttcaggtc

SEQ ID NO: 52859 - DNA, 601 bp, Human
gttttattaaccgtctggagattacccccaaccccccaattaaaagactaacgctcttcctatagtatctgacagcatcaattatgacgtaagatttgactactccgtgcaaagttagacattcgcttgtactttttccttcagaaagacaattggcatttactgcctctaaagaggctttctgtaactctagcctttgtggagtgttgcccatcttacttcaggacattatccagtcctttcaaaggagtctttaaatgggttacttatgttatcttttattttttgcttgtttgtttgtttatagagagggagtctctgttgccagctggtctggaactcctggcctcaagtgatcctccctcctctgccacccaaagcgttgggatcacaggcgtgagccacctcacctggcccctttattttttaaggaactttttccagttattggattggtgtttaatcttagtgtgctttgcatgttctgaatttgaccaagtttcactttttttaagaatagaaacccagatgtcttacactttttttttttttttttttttgagacagtttcactcttgttgcccaggctgcagtgcagtgg

SEQ ID NO: 52860 - DNA, 601 bp, Human
aaagactaacgctcttcctatagtatctgacagcatcaattatgacgtaagatttgactactccgtgcaaagttagacattcgcttgtactttttccttcagaaagacaattggcatttactgcctctaaagaggctttctgtaactctagcctttgtggagtgttgcccatcttacttcaggacattatccagtcctttcaaaggagtctttaaatgggttacttatgttatcttttattttttgcttgtttgtttgtttatagagagggagtctctgttgccagctggtctggaactcytggcctcaagtgatcctccctcctctgccacccaaagcgttgggatcacaggcgtgagccacctcacctggcccctttattttttaaggaactttttccagttattggattggtgtttaatcttagtgtgctttgcatgttctgaatttgaccaagtttcactttttttaagaatagaaacccagatgtcttacactttttttttttttttttttttgagacagtttcactcttgttgcccaggctgcagtgcagtggtgcgatctcagctcactgcaacctctgccttccggtttcaag

SEQ ID NO: 52861 - DNA, 601 bp, Human
ttcaaaggagtctttaaatgggttacttatgttatcttttattttttgcttgtttgtttgtttatagagagggagtctctgttgccagctggtctggaactcctggcctcaagtgatcctccctcctctgccacccaaagcgttgggatcacaggcgtgagccacctcacctggcccctttattttttaaggaactttttccagttattggattggtgtttaatcttagtgtgctttgcatgttctgaatttgaccaagtttcactttttttaagaatagaaacccagatgtcttacactttttttttttttttttttttgagacagtttcactcttgttgcccaggctgcagtgcagtggtgcgatctcagctcactgcaacctctgccttccggtttcaagcgattaccgtgcctcagcctcccgagtagctgggattacaggcgcccaccaccacacccggctaatttttgtatttttagtagagacggggtttcaccatgttgtccagtctggtcttgaactcctgacctcgtgatgcgcccacctctgcctcccaaactgctgggattacaggtgtgagccaccatacccggcctt

SEQ ID NO: 52862 - DNA, 601 bp, Human
ttgcacactctggacattttcatttatttatttatccagcacatctttaattaagcaactaggttgtgccgggcattgggaattcaacagagggtaagacaaaaaaggttcctacccttgtagagtttacataccctcctgaggaagacagagagtaaacaagcaaacaaataattacatattgtgattattgctatgaagaaaataagcatgtataataatcaataaatgacagaactactgtagaggaatcatagaagggctctctttttcccccttttttttttgcgtctcaattttycgcccaggctggagtgcagtggcacaatctcagctcatcacaacctctgcctctcaggttcaagagcttctcttgcctcagccccctgagtagctaggattacaggcgtgtgccaccacacctgactaatttttgtatttttagtagagacgtggttttaccatgttggccaggctggtctcaaactcctgacctgaagtgatctgcctgcctctgcctcctaaagtgctgggattacagatgtgagccaccacgcctggccagcaaaggtctctctaaggaggtgctatttaacctaag

SEQ ID NO: 52863 - DNA, 601 bp, Human
atctctactaaaaatacaaaattagccgggtgtggtggcacatgcctgtaatcccagctactcgggaggctgaggcaggagaattgcttgaacccgggagacggagattgcagtgagctgagatggccattgcactccagcctgagcaacaggagcgaaactccgtctcaaaaaaaaaaaaaaaagaaaacagaagtagacaatttaaagttaagcgtctttaagtacattttgcccataccaaagttcttatttttaattttattgatacataataatcataatttcatgctttatcackcaggcacaataataattgtacatatttatggagtatatgtgatattttgatacatgcatacaatgtataataatcagtaattaggatagccatcacctcatttatcatttctttcttttgggaacattcaaatcttctagctgttttgaaatatacaataaattattgttaactgtagtcactctactgtgctattgaatgctagaactcattccttctaactgtatttcataccagaattctttatttgtggtatatctctctttttgtttctgttttgctattctagaaaggcaggta

SEQ ID NO: 52864 - DNA, 601 bp, Human
gcctacttttttacatctgcaaaaatattttattttcttgtataatctttattttattatacactttatcttggttttacttttgctttgcagaggcatgagattctagttttgacactaatgttgatcctaatatttgtgaacttgatctctagctttcaggatgccaacccgcccctgaaggttattccccaacacttcaatggcaacagcaacaagtggcacagttttcaactgttcgacaggtaagtgtcatatttaatctaattaagcccctgttggatttatttctgttcttagrctgtagctggaaaaataaaatttatgatcctaaagtatacagaatattcatgaattaattaccaaattatttttataatcattagacataatacagtttgaaatattttctaagttttgtttatttttatttgtttgtttatttatttcaatagttttggggaacaggtggtttttggttacatggataagttctttagtggtgatttctgagattttggtgcacttgtcacccaagtagtgtactctgtacccaatacatggtcttttacatctcaccccctcccacctttcccatttt

SEQ ID NO: 52865 - DNA, 601 bp, Human
agccacttaggcactatgtttgtcagggctgccataacagactaggtggattaaacaacagaaatgtatttattttctcagtcttgaaggctgaaagtcaaagaacaaggtggcagcaaggttggtctctttttgtttgtttgtttgttttttgaggcagagtttcgctcttgttgcccaggctagagtgcaatgacgcaatctctgctcactgcagcctccgcctcccaggctcgagtgattctcctgcctcagcctctgggtagctgggattacaggtgtgcaccaccacatccggctrattttttttttttttgtatttttagtagaggtggggttttgccatgttggccaggctggtcttgaactcctgacttcatgtgatcgcctgcctcggcctcccaaagtgctgggattacaggcgtgaaccaccgcacccggcctaaggttggtctcttctgaggcttttctccttggcttgcatagggccaccttctccctgttttctcacgtggtctttcctctgtgtgtgggagtccctggtgtctctttgtgaatccaaatttcctcttataaggacactagtaagattggattacgg

SEQ ID NO: 52866 - DNA, 601 bp, Human
ccacttaggcactatgtttgtcagggctgccataacagactaggtggattaaacaacagaaatgtatttattttctcagtcttgaaggctgaaagtcaaagaacaaggtggcagcaaggttggtctctttttgtttgtttgtttgttttttgaggcagagtttcgctcttgttgcccaggctagagtgcaatgacgcaatctctgctcactgcagcctccgcctcccaggctcgagtgattctcctgcctcagcctctgggtagctgggattacaggtgtgcaccaccacatccggctaattttttttttttttgtatttttagtagaggtggggttttgccatgttggccaggctggtcttgaactcctgacttcatgtgatcgcctgcctcggcctcccaaagtgctgggattacaggcgtgaaccaccgcacccggcctaaggttggtctcttctgaggcttttctccttggcttgcatagggccaccttctccctgttttctcacgtggtctttcctctgtgtgtgggagtccctggtgtctctttgtgaatccaaatttcctcttataaggacactagtaagattggattacggct

SEQ ID NO: 52867 - DNA, 601 bp, Human
gggctgccataacagactaggtggattaaacaacagaaatgtatttattttctcagtcttgaaggctgaaagtcaaagaacaaggtggcagcaaggttggtctctttttgtttgtttgtttgttttttgaggcagagtttcgctcttgttgcccaggctagagtgcaatgacgcaatctctgctcactgcagcctccgcctcccaggctcgagtgattctcctgcctcagcctctgggtagctgggattacaggtgtgcaccaccacatccggctaattttttttttttttgtatttttaktagaggtggggttttgccatgttggccaggctggtcttgaactcctgacttcatgtgatcgcctgcctcggcctcccaaagtgctgggattacaggcgtgaaccaccgcacccggcctaaggttggtctcttctgaggcttttctccttggcttgcatagggccaccttctccctgttttctcacgtggtctttcctctgtgtgtgggagtccctggtgtctctttgtgaatccaaatttcctcttataaggacactagtaagattggattacggctcaccctaatggcctcaatttaaa

SEQ ID NO: 52868 - DNA, 601 bp, Human
tttataaagaattaaaacttacttatttagcttattttcagagaatacatacaagtaaaatacaccatgttaaaaaaaacccttaaggaagtaagcgtttaatgtatatcctcttaagtttctcacaaatcagtggtattttcataattagcaatcacagcctcagactccaaagtagacttttaaaaattgaatcaaattaggttttaaaaatgtcattctaattcaagtgtccttaattcttgaaaatattagctttagctgaagattttgaaatggtgtatacaacatattaatgtcrtcttatcaatgttacagttttattggatatacttaataagttagttttttcaagtactatcatgtaaaaaatttttagtctttaacattttacttactaaaatcatactttatttaaaaatttacaaattcagaccaggtgaggtggctcatgcctgtaatcacagcactttgggaggctctggcaggtagatcacttgagctcaggagttccagaccaacctgggcaacatggcaaaacctcatctctaccaaaaatacaaaaaaattagctgggcgtgttgacatgcacctgtggtcc

SEQ ID NO: 52869 - DNA, 601 bp, Human
ttcttttatttgttctttgtttctaaacaacagtgtggcaagaaattcaccagtttgaaaaaaaaaaatgaagcttataataccatttagtaaaattcagtctcattttttctttcagattggttttcctcccttgcttagtattgttagcagaatgaatcaggtaaaattaataatagagatatatgcattcttttgtttgcattgtgtgtgaaagtatttgaattgttaatacatatactgaattcttacagtatgcaagactttgtcctaagctctttaatggttcttatttaatccktactacaaccctctatggagagttattattgataactactttttatagatgaggaaacagcatttgaggttaagtaacttgcaggtggtttttcagcaagtaaatggcagtactgagattcagtgccaggtagatctaactccagagctcatgctctgtcttaatcatggtgctagagtattcatttctgtagctttcagttataagtcttagattctggggtttgaattaaatacaaggtccctgacttacaatggttcagtttaggattccttttttcccaccatgcctggctaattt

SEQ ID NO: 52870 - DNA, 601 bp, Human
gaccctatcttaagaaataaatatatggtttttttggatgcacaaatgtttaccattatgttacagttgcctacagtattcagtatagtaatgtgctatataggtttgtagcctaggagcaattggctatgcaatatagtctaggtatagtagactataccatctaggtttgtgtaagtatactctatgatgttcatccagggtcaaaaatcacctaacaatgcatttctcagaatatatctcccttcattaagtgatgcatgactgtacttgatgtgatgctacggtatttatttatttwttatttatttgtttgttttgacatggaatctccctctgttgcccaggctggagtgcagtagcgcgatctcggctcactgcagcctccacctcctggtttcaagtgattctcctgcctcagcctcccaagtagctgggattacaggcacctgccaccacacccagctaatttttgtatttttgtagagacaggctttctccatgttggccagactggtcttgaactcatgacctcaggtgatctgcccgcctccacctctcaaagtgttggaattacaggcgtgagccactgcacccagcc

SEQ ID NO: 52871 - DNA, 601 bp, Human
atgttacagttgcctacagtattcagtatagtaatgtgctatataggtttgtagcctaggagcaattggctatgcaatatagtctaggtatagtagactataccatctaggtttgtgtaagtatactctatgatgttcatccagggtcaaaaatcacctaacaatgcatttctcagaatatatctcccttcattaagtgatgcatgactgtacttgatgtgatgctacggtatttatttattttttatttatttgtttgttttgacatggaatctccctctgttgcccaggctggagtgcrgtagcgcgatctcggctcactgcagcctccacctcctggtttcaagtgattctcctgcctcagcctcccaagtagctgggattacaggcacctgccaccacacccagctaatttttgtatttttgtagagacaggctttctccatgttggccagactggtcttgaactcatgacctcaggtgatctgcccgcctccacctctcaaagtgttggaattacaggcgtgagccactgcacccagccagtatttatatttatatttatatttgtatatgtgtgtgtgtgtatatatatatatgt

SEQ ID NO: 52872 - DNA, 601 bp, Human
caggctggagtgcagtagcgcgatctcggctcactgcagcctccacctcctggtttcaagtgattctcctgcctcagcctcccaagtagctgggattacaggcacctgccaccacacccagctaatttttgtatttttgtagagacaggctttctccatgttggccagactggtcttgaactcatgacctcaggtgatctgcccgcctccacctctcaaagtgttggaattacaggcgtgagccactgcacccagccagtatttatatttatatttatatttgtatatgtgtgtgtgtgtrtatatatatatgtataatctgaactatacttgtttgtagtcaaataagaaacactagaatgtaaatcaacatactacttccttcattgagaaagtcttggagaaaaaaagtcaatgaaagagttgatgtatatcctggtacaaggtacaaactccttatctcattgcagacaagtttgttttttttttttttttttttttttgagatggagtctcactctgtcacccaggctgcagtgcagtggtgccatctcggctcactgcaacctctgcctcccaagttcaagcaatcctcctgcct

SEQ ID NO: 52873 - DNA, 601 bp, Human
acatggtgaaacccccatctctactaaaaatacaaaaattagctgagcatggtggcgggcgcctgttgtcccagctactcaggaggctgaggcaggaggattgcttgaacctgggaggcagaggttgcagtgagccgagatggcaccactgcactccagcctggatgacagaacgagactccatctcgaaaaaaaaaagaaaaaggacaaaaacaacatggtaaacattttattatgtattataaataaaaaagatggctacaagatgatattacaactgatgaaattgtattgaaaaaargttgtacagccgggcatggtggctcacgcctgtaatctcaccactttgggaggctaaggcaggcagatcacttgaggtcaggagttcgagaccagcctgaacaacatggtgaaacccggtctctattaaaaatacaaaattagccgggtgtggtggtacatgcctgtaattccaggtactcaggatgctgagacaggagaattgcttgaacccgggaggcagaggttgcagtgagccgagatcgcgccattgcactccagcctgggcaacaagagtgaaactctgtctcaaaaaaaaaga

SEQ ID NO: 52874 - DNA, 601 bp, Human
atggagtctcgctctgtcaccgaggctggagtgcaatggtgcggtctcggctcactgcaacctccgcttcccaggttcaagcaattctcctgccttagcctccagagtagctgagattacaggtgcccgccaccatgcctggctaatttttgtatttttagtagagacagggtttcaccatgttggccagactggtctcaaactgctgacttcaagtgatccacctgcctcagcctcccaaagtgctgggattacaggcatgagctactgcacctggtgtgtgtgtgtgtgtgtgtgtgtrtatatatatgtgtgtgtgtgtgtgtgtatatatatatatctttatatatatatctttatataattcagtaatgaatatatataagaacagtaagaatcctgtgtcttgactgtacagtgattaatatatattatatatattcatatatattctatatatatcctcacatatattgtatgcattatatagagaggaacaataagaatcctgtgtcttgactacagtgataaatatatttattcatatatgtatattaatatatatttattatatatgaatacatattcactacagttaaga

SEQ ID NO: 52875 - DNA, 601 bp, Human
tcgctctgtcaccgaggctggagtgcaatggtgcggtctcggctcactgcaacctccgcttcccaggttcaagcaattctcctgccttagcctccagagtagctgagattacaggtgcccgccaccatgcctggctaatttttgtatttttagtagagacagggtttcaccatgttggccagactggtctcaaactgctgacttcaagtgatccacctgcctcagcctcccaaagtgctgggattacaggcatgagctactgcacctggtgtgtgtgtgtgtgtgtgtgtgtgtatatatrtgtgtgtgtgtgtgtgtgtatatatatatatctttatatatatatctttatataattcagtaatgaatatatataagaacagtaagaatcctgtgtcttgactgtacagtgattaatatatattatatatattcatatatattctatatatatcctcacatatattgtatgcattatatagagaggaacaataagaatcctgtgtcttgactacagtgataaatatatttattcatatatgtatattaatatatatttattatatatgaatacatattcactacagttaagacacatata

SEQ ID NO: 52876 - DNA, 601 bp, Human
tggagtgcaatggtgcggtctcggctcactgcaacctccgcttcccaggttcaagcaattctcctgccttagcctccagagtagctgagattacaggtgcccgccaccatgcctggctaatttttgtatttttagtagagacagggtttcaccatgttggccagactggtctcaaactgctgacttcaagtgatccacctgcctcagcctcccaaagtgctgggattacaggcatgagctactgcacctggtgtgtgtgtgtgtgtgtgtgtgtgtatatatatgtgtgtgtgtgtgtgtrtatatatatatatctttatatatatatctttatataattcagtaatgaatatatataagaacagtaagaatcctgtgtcttgactgtacagtgattaatatatattatatatattcatatatattctatatatatcctcacatatattgtatgcattatatagagaggaacaataagaatcctgtgtcttgactacagtgataaatatatttattcatatatgtatattaatatatatttattatatatgaatacatattcactacagttaagacacatatataatacatatatgaatat

SEQ ID NO: 52877 - DNA, 601 bp, Human
caaactgctgacttcaagtgatccacctgcctcagcctcccaaagtgctgggattacaggcatgagctactgcacctggtgtgtgtgtgtgtgtgtgtgtgtgtatatatatgtgtgtgtgtgtgtgtgtatatatatatatctttatatatatatctttatataattcagtaatgaatatatataagaacagtaagaatcctgtgtcttgactgtacagtgattaatatatattatatatattcatatatattctatatatatcctcacatatattgtatgcattatatagagaggaacmataagaatcctgtgtcttgactacagtgataaatatatttattcatatatgtatattaatatatatttattatatatgaatacatattcactacagttaagacacatatataatacatatatgaatatatatatatatattcatcactgtacagttaagacacaggattcttattgttcctttagtaggaaccagggaaaaatttcccccaagttatcccccttagatccctctttatttttttttccctattcagaatctttatttaaaagatagtcttagatgtttctcaaggaatca

SEQ ID NO: 52878 - DNA, 601 bp, Human
tttttttaggatagcaaagatgatgagagggttcctgctttgaatttattaatctgcttggttagcaggtatagttaatccttggcttctttattatttatcagtgaggtcagtgaggttagatcgtatttattacatttggtttttgtttggttggtttttttttgagtctcactctgttgctatagttagggtgcagtggcgcaatcacagctcactagagctttaacttcctgggctccagcaatcctcccacctcagcctcctgagtagctaggaccacaaccaagcaccaccacayctggctaattaaaaaaaattgttcgtagagacagggtctcactatgttgcccaggctggtctcaaaactcctgggctcaagcgatcctcccacctaagcctccgaaagtgcagggattacaggtgtaaagccactgcattcagcctgcatttttgtttaattgcctgtgtcctgcgttcattttcagttgtggcatatttttatttagtatctgttttatttcatttcttacatagaaattcttcttggaatttatttgaaaactttttttgttgttttgttttgagacagagtctcgct

SEQ ID NO: 52879 - DNA, 601 bp, Human
tttattaatctgcttggttagcaggtatagttaatccttggcttctttattatttatcagtgaggtcagtgaggttagatcgtatttattacatttggtttttgtttggttggtttttttttgagtctcactctgttgctatagttagggtgcagtggcgcaatcacagctcactagagctttaacttcctgggctccagcaatcctcccacctcagcctcctgagtagctaggaccacaaccaagcaccaccacacctggctaattaaaaaaaattgttcgtagagacagggtctcactrtgttgcccaggctggtctcaaaactcctgggctcaagcgatcctcccacctaagcctccgaaagtgcagggattacaggtgtaaagccactgcattcagcctgcatttttgtttaattgcctgtgtcctgcgttcattttcagttgtggcatatttttatttagtatctgttttatttcatttcttacatagaaattcttcttggaatttatttgaaaactttttttgttgttttgttttgagacagagtctcgctctgttgcccaggctggagtgcaatggcaccatctcggctcacta

SEQ ID NO: 52880 - DNA, 601 bp, Human
agtgaggtcagtgaggttagatcgtatttattacatttggtttttgtttggttggtttttttttgagtctcactctgttgctatagttagggtgcagtggcgcaatcacagctcactagagctttaacttcctgggctccagcaatcctcccacctcagcctcctgagtagctaggaccacaaccaagcaccaccacacctggctaattaaaaaaaattgttcgtagagacagggtctcactatgttgcccaggctggtctcaaaactcctgggctcaagcgatcctcccacctaagcctycgaaagtgcagggattacaggtgtaaagccactgcattcagcctgcatttttgtttaattgcctgtgtcctgcgttcattttcagttgtggcatatttttatttagtatctgttttatttcatttcttacatagaaattcttcttggaatttatttgaaaactttttttgttgttttgttttgagacagagtctcgctctgttgcccaggctggagtgcaatggcaccatctcggctcactacaaccttcacctcctgggttcaagcaattctcccccctcagcctcccaagtagctggg

SEQ ID NO: 52881 - DNA, 601 bp, Human
aaagctttataatatacttaaatattgggaaggcaagtaatcttgtttccatattttcacatattcaatatctagtttcttgatctacaataattatgctgctgatgataattaacatttactgggcaatttgtgccaagcatttttcttagtgaggaacccatttaatccttctaaggtgggtactgttaacagtttacagatgaggaaaccatggcagagagaggttaaataatattactaccatcacaaagctagtaagtgttagagtaatgatccaaacccaggcaactttgactcyggagctaagcttttaactatgctgatcaaaaattaagctaatacctacctcatctgttggtagtagcagttaaatgagatgatatagcattgccctacttactttatgtatagtatctctactctttacaatagatcagagttgtgtttttgtttttgtttttgttttaataaattttttcctttcagctctgttggacttgatttttttccttttacagataatgacacagattcagaaaggttaagtaattggtagctcagcaaaccagtaattaatgaaacctcagacaagtatagt

SEQ ID NO: 52882 - DNA, 601 bp, Human
gcttttaactatgctgatcaaaaattaagctaatacctacctcatctgttggtagtagcagttaaatgagatgatatagcattgccctacttactttatgtatagtatctctactctttacaatagatcagagttgtgtttttgtttttgtttttgttttaataaattttttcctttcagctctgttggacttgatttttttccttttacagataatgacacagattcagaaaggttaagtaattggtagctcagcaaaccagtaattaatgaaacctcagacaagtatagtttctgactrcctcagttgagattttacagtattatgcaattatgaaagcaaaaacattcaagtgtattttttgccctcaaaaagttagataaaaatggaaaaagttctagactacaaaaggttctgaagctaacagctttacaatagaagacacaaagatttgaaagtttaggaaaaaaaggaccgggcatggtggctcatacctgtaatcccaccactttgggaggccaaggcgggtggatcaccttaagtcaggagttcaagactagcctggccaacatggtgaaacctcgcctctactaaaaatag

SEQ ID NO: 52883 - DNA, 601 bp, Human
aatcccaccactttgggaggccaaggcgggtggatcaccttaagtcaggagttcaagactagcctggccaacatggtgaaacctcgcctctactaaaaataggaaaattagccgggcacggtggttcacgcctgtaatcccagctactcgggatggtgaggcaggagaatcacttgaacctgggaggtggaggttgcagtgagctgagatcgtgccattgcactccagcctgggcaacaagaacgaaactccatctcaaaaaaaaaagaaaaaagaaaaaaaaaaggaaagctgggcacartgactcacacctgtaagcccagtgctttgggaggtcaaggtgggaggattgcttgagtccaggggttcaagaatgcagtgagccatgacaaaatttgattagtgattttcctttttatttaatcttataattacataaaatagttaccttgccaaagttaaaattataattcaaggtacatttggagtattttagcatccatctttatcctcattatcctcttttttcctttctcctctagttaaccattgtattactaatttttgtttcatcttttcattcattgtttctttttaaaag

SEQ ID NO: 52884 - DNA, 601 bp, Human; identical to SEQ ID NO: 25656

SEQ ID NO: 52885 - DNA, 601 bp, Human; identical to SEQ ID NO: 25657

SEQ ID NO: 52886 - DNA, 601 bp, Human; identical to SEQ ID NO: 25658

SEQ ID NO: 52887 - DNA, 601 bp, Human; identical to SEQ ID NO: 25659

SEQ ID NO: 52888 - DNA, 601 bp, Human
aaattacttgattagctatctgtatttacattaatatttttcaatctttgttgatccctaattatatttcatataattttattaagctgtaggccacaaattaacatttcaaactcagccaaatttcagggactatccctctttagtttaaggattagatgagatatggacactgtatattgaaataatcatgcactagaatgatagatttaaaataatctttaaaatgtgttagggagattttgcctccctaacacattttattcaaaagttttgcagtatctctcaaaattgtcacaactttccccctttcatgtaaatattatgcttttacacatgaaatatgactctctgggcagtatgtttcctgcttgagttttgccctttgtgtttatattatctcatgttatacaaagtcattttgtgactaatttccagagcactgagtcacagtgtggctgttgcttatcttttcttttttcccacatggtagtactcttggcccttatttttggtaattattttatactaatgagtgctttttcataattaaataattgtttctctcattatatttctgtggttgtttactgctgtatta

SEQ ID NO: 52889 - DNA, 601 bp, Human
aacataatccatttggacaggaaccacatttccaaaggagttttgatttagtcattggtggtaaaacaaaagatatcagactgtaccttaaaaacaaagaaacaaaacaaaacaaaaacttgtccaattcagtatacctaatagagataggaatcaaatagtagtatatgtcattaaacttttccaacaagattctgtggtcacttgaagtagaaaaacttggttttccaatataactactcaaatcagtaaaaataaatattttaaagttttactcttattttaaaattacttgattagytatctgtatttacattaatatttttcaatctttgttgatccctaattatatttcatataattttattaagctgtaggccacaaattaacatttcaaactcagccaaatttcagggactatccctctttagtttaaggattagatgagatatggacactgtatattgaaataatcatgcactagaatgatagatttaaaataatctttaaaatgtgttagggagattttgcctccctaacacattttattcaaaagttttgcagtatctctcaaaattgtcacaactttccccctttcatg

SEQ ID NO: 52890 - DNA, 601 bp, Human
aacacaatagcatatagcatatgcaaactatttatttaaataattttaaagctaaaatggagatgaggtcacacatttatacactgctagagctaaaaacaatcatagaaataagtatctgaaatatccagattttttaaatacaaaaactgaagctcaggaaattgattttttcaccccagagtcttacatttacatattggcaatgtttcaactcagacataggaatgtgaccattcaaggaaagggcaactgcaaagcttcaaaagacacgctattctcacaaatattttcctttttrtcacctaaagtaaatttcagattacttacaatctctagaaattaacatttcattaaaccataactaggaaatgtgtatttaatatttgagcaaaagttaagaaacatatttaaacttaattaaaacaaaaataaattaaagaaaattaattaaaacaaatttttatgtaatgttttgagccaaagttaagaaatttaattaaaacaaaatcatttttggtgtttatgtttttgataggtaaaaataattttctcctaccaaataacaggaaatattaatatttattgccaattaagagag

SEQ ID NO: 52891 - DNA, 601 bp, Human
gagtgaactcccattcacagttgctacaaagagaataaaagacctaggaatacaactcacaagagatgtgaaggacctcttcaaggagatctacaaaccactgctcaaggaaataagagaggacacaaacaaatggaaaaacagttcatgctcatggataagaaaaatcaatatcatgaaaatagccatactgtcctaagtaatttatagattcaatgctatccccatcaagctaccatttactttcttcacatattagaaaaagcaaactactttaaatttcatatggaaccaaaaaacrgtctatatagccaagacaatcctaagcaaaaagaacaaagctggaggcatcacgctacctgacttcaaactatactacaaggctacagtaaccaaaacagcacggtactggtacaaaagcagatataaagaccaatggaacagaacagaggcctcagagataacgccacacatctacatccatctgatctttgacacacctgacaaaaaccagcaatggggaaaggattccctatttaataaatcgtgttgggaaaactggctagccatatgcagaaaacaggaactggaccccttcctt

SEQ ID NO: 52892 - DNA, 601 bp, Human
tcaatagctgaatcaatctagtggaagaaaggatatcagagattgaagatcaacttaaggaaataaagcatgaagacaagattagagaaaaaaaagaatgaaaaggaatgaagaaagcctccaagaaatatgagactgaatgaaaagaccaaacccacatttgattggtgtacttgaaagtgacagggagaatggaaagaagttggagaacactcttcaggatattatccaggagaacttccccaacctagcaagacaggccaacattcaaattcaggaaatacagagaacaccacaaagrtactcctcaagaaaagcaacccaaaaacacataatcatcagattcaacaaggttgaaatgaaggaaaaaatgttaagggcagccagagagaaatgttgggtttcccataaagggaagcccatcagattaacagtggatctctctgcagaaactttacaagccagaagagagtgggggccaatattccacattcttaaagaaaataattttcaagccagaatttcatatcaagcaaaactaagcttcataagtgaagtataaataaaatattttacagacaagcaaatgctgagagatttt

SEQ ID NO: 52893 - DNA, 601 bp, Human
ctggtctgcagcttccagtgagatcaatgcagaaggtgcgtgatttctgcatttccaactgaggtacccagctcatctcattgggactggttagacattgggtgtagcccatggagggcaagccgaagcagggtgctgcgttgcctcacctgggaagcacaaggggtcagggaactccctcccctagccaagggaagccgtgaggggctgtgccatgaagaacagtgcattctggcccagatacaacgctttccccatggtctttgcaacccgcagaccaggagattccatcgcgtgcttrcgccattgaggccctgggtttcaagaaaaaaattggacagcctttgggcagtcacctaccaagctgcgggagttttttttttcataccccagtggcgtctggaatgccagtgagacagaaccatcatcccctggaaagggggcttaagccagggaggcaagtggtctagctgagtggatctcagccccatggagcccagcaagctaagatccactggtttgaaattcttgctcctagcacagcagccttaagtcgacctgggatactccagctttgtcaggggaggggcatccgccatta

SEQ ID NO: 52894 - DNA, 601 bp, Human
agaattccaaattgtgctttcaaggtcttattatataaaatgtttattgtgtctgaatgaattcagtccgacaatgaatcattaaaatgtgatgtattttatcagcaccttattgatgtaataattcgtttctttttacagttattacaagtgtcaataacagaaaaatattcacagaaatttttctgtttttttgcaaccatttgattataaataaattttcatatcaatttttctatttaaaaatatcgatagcatattcctcttttgatatgatttatatgatcatgataatcgtacmagttctatgtcaaccaaaaattttatttttcctcatctctgcaatgggaaaaattaaaaaaggtttaccaatgcagtcacctagaaattgaccattttatttatgtttgatgccatttacaaaaatagtttatttttcatgtaagtgatacattgacatgtctaaagacagcattctatttgatattattaaaattgtattcattatagttaaataaaatttttctatgaccttttataatacacttaaatactttcttccaaaggtagaaaggattgagagaatgaagatttcttacca

SEQ ID NO: 52895 - DNA, 601 bp, Human
gattgaacatttattatctcatttatgttaattaccccctaaaaccttaccttcaaatgcagtcacattgggggttaggtatccaacattttggggaaacacaactcagagcaggaacattcctagtgtttcaagaaagtgtctctaacttggttgcaagtttgtcttggaagtgggggtcactgcctttctatcagtaggctggagctgaagatacatcagccctagagtgcactttctaatgtgcaattcaattctttcctttccacatagctatagactttgattctctgtttcttgyggcattactaacctttaggcaggactggtcatatcaatcacatttctattgaaaatacagcaatcgccaacttcttatgttgtacattttatgataatttgcccaaactatggtgtttgtttattcgtttgtttttggttgttccttaagagtgaagtactggtctgggaaagtgactgttttctgtaagtgttctccaatgagaaagtgtattttttgctcacaataagaaggaaagacttggcagggaaaacagatcctcaccttcgaattccttctctacccttatttctcaactgt

SEQ ID NO: 52896 - DNA, 601 bp, Human
gaaaaaaaaataaattgaagaatctttctaattttctgctcagcagtggctaatgttgttgtcctcttgttgttgattacttccatccactcaatttggctgatctccagggggcctacccttctgtccactaaaacctggcagcctgttttttgttttgttttatctttaactgatgtgctttcattttgttttattttattttgattgtttttcattttgggtgagtttacagcacactaataccaaagaaaatgaataaagaaaacattagaataaaactatgttggaggagaagggraacaacaaactctacaggaattctgatagctttctatttcctttttttgaagtttactttttgcaagtagtattctcaattgtaaatccacaaaatattgagaataactaggatctgcaaatggatttttgttaataaacattctttactagatttccaactgtatttccccaatggagaacttgcataatctcagggagaggtttgagagccagatttttctcaggaaaagagtatttcctgaataaatacattgtgggaatgcaaatgtttgagcagtttcccaggggaggtttaagg

SEQ ID NO: 52897 - DNA, 601 bp, Human
atgagtactttgccatgtctaaaagaaggaaatttcattttagctgctgatttatggtgtaccagtggaagacaggagagacaaaacctgacaaccagaaaagaaaaaaaaataaattgaagaatctttctaattttctgctcagcagtggctaatgttgttgtcctcttgttgttgattacttccatccactcaatttggctgatctccagggggcctacccttctgtccactaaaacctggcagcctgttttttgttttgttttatctttaactgatgtgctttcattttgttttattytattttgattgtttttcattttgggtgagtttacagcacactaataccaaagaaaatgaataaagaaaacattagaataaaactatgttggaggagaaggggaacaacaaactctacaggaattctgatagctttctatttcctttttttgaagtttactttttgcaagtagtattctcaattgtaaatccacaaaatattgagaataactaggatctgcaaatggatttttgttaataaacattctttactagatttccaactgtatttccccaatggagaacttgcataatctcaggg

SEQ ID NO: 52898 - DNA, 601 bp, Human
tatctaaagtttctagttcagatttttctctttattacatattgttgaatttttttcttttttaaagttttactattaatctctaagctcaatgagtactttgccatgtctaaaagaaggaaatttcattttagctgctgatttatggtgtaccagtggaagacaggagagacaaaacctgacaaccagaaaagaaaaaaaaataaattgaagaatctttctaattttctgctcagcagtggctaatgttgttgtcctcttgttgttgattacttccatccactcaatttggctgatctcyagggggcctacccttctgtccactaaaacctggcagcctgttttttgttttgttttatctttaactgatgtgctttcattttgttttattttattttgattgtttttcattttgggtgagtttacagcacactaataccaaagaaaatgaataaagaaaacattagaataaaactatgttggaggagaaggggaacaacaaactctacaggaattctgatagctttctatttcctttttttgaagtttactttttgcaagtagtattctcaattgtaaatccacaaaatattgagaataa

SEQ ID NO: 52899 - DNA, 601 bp, Human
tcaccttgatctcaaacttatagcctccaggaccatgaggaaataacaaactattcatttttagcactttgttatggcagccctagccaactaaaacagactataaagcttcaaatatcagttccgtaacttactaattatatgaatttgatactatatttacttcctatttgtctctatttacttatctataaaatgagtattttactagaacctactacatagtattatgaggattaaatataaaagaattagaatagtgactagcttgataatgttagctattataatttttataagyaatccttgaaaacctcttgggtacactgtagaaacagaagctcagtatttatagatcttattctgcattgagaatgtcatctcagactttttgaaggtctaaaaatataactgaaaaatagcactgatttggaaagagtttaggatcaaaccgagagacatttttgtttgaatttggttaagcatgggagcttagatttgaaagactacaagtggtaaggtgaagcagtacaggtctcaatgtaaaagacatgttctaaagattcagatccattggagctaaaatattttggcaatttgg

SEQ ID NO: 52900 - DNA, 601 bp, Human
ggaaagaaaaaaggaagacctttgagactttcactttttatgaactcttctatgaacttcatatgaactataatccccctaatagccctaacctataagaagtatgatgtgcatcttaagaaaactgaggttcataaagggaatataaccttccaagtagcataaaacagagtaatatttgcactcataactctgtgagtccagaattcatggacacttcaccatacaaagctgacttcccaataattactttgtctccagcatcatctggaaagcattctgcctccagttgtcttcatarttattctggtttgcttggcaagtagctcctttctttctcccttcctcccttcctttttttctccttcctccctctttccctctctctttctcagctcttcctttcttttttaagttcgtttagtggttaagaagagggggtttgtagtaagactgttttaggggctgaattgtgtcccctttcaaatttatatgttaaagttttaactcccagtacttcagaattcaactgtatttgaaaacaaggcctctaaagaggttactaagaataaatgatgtcattgttgttgagtcctaatcc

SEQ ID NO: 52901 - DNA, 601 bp, Human
ttgccttaaacattcatagcagagtgagattttcttgtcacagtctgcattccttccaaattcctgaccttttaatttattttttttaaattgtataaattaaggttcactctttgtgctgtagctgtctatgggtttcaacaattgcatagtgacacatatccacagaatagttgtagtatcatacagaatattttcctctaaaaattctctgtgcttcatccattcatcctcctccttccctcctctattccctttgaagttactgatctttttactgtatctatagtttttaagtaaytcaatcattcacaattttgtacaaatattattacagtcaattttagaatattttcattcccccataaggaaattctccaccctttaggcttcaccctcttcccttaaagttctccatctctacattagtaggaaacaattatttggcttctgtctctatgtattgccaatactgaaagctttagttaaatggaataatataatatctggcctactatgtctggcttctttcacttagcatactgttttcaggctccattcatgctgtagcatatatgattgctttctttttattgctgaa

SEQ ID NO: 52902 - DNA, 601 bp, Human
aactatcactatccaccaactctttaattaattgttcaattaaaatatacatgtatagcaataggaatattgttaacccatatgtccatggaatacagctttattaactagagggcagtgtctgtgtgcagttccttttacctttagacttataggctccacttattttcaatgttatttagttcagccctcctccacccccaaactccttcagtgaggttgccttaaacattcatagcagagtgagattttcttgtcacagtctgcattccttccaaattcctgaccttttaatttattytttttaaattgtataaattaaggttcactctttgtgctgtagctgtctatgggtttcaacaattgcatagtgacacatatccacagaatagttgtagtatcatacagaatattttcctctaaaaattctctgtgcttcatccattcatcctcctccttccctcctctattccctttgaagttactgatctttttactgtatctatagtttttaagtaattcaatcattcacaattttgtacaaatattattacagtcaattttagaatattttcattcccccataaggaaattctccacc

SEQ ID NO: 52903 - DNA, 601 bp, Human
ccatggtagagggcaaaggtgcagtctcggctcactgcaacctccacctcccgggttcaagtgattctcctgcctcagcatcccgagtagctgggattacaggcgcctgccaccatgcctggctaatttttgtatttttagtagagacagggtttcaccatgttggccaggctggtctccaactgcggacctcatgatccacctgcctctgccttccagagtgctgggattacaagcgtgagccactgcaccaggcccagcattccaatttccacacatccttgccaacatgttacatttygagtttttagaaaaatagccattttaacaggcataaactgatatctcattattatttgattttcatttccttggtaaataatgctgctgagcatctttatatatcttatttgtacgtcttcttcggagaaaaatgtgtttaactcctttgcccattttttaaaaatttctgctattgagttgaaggagttccttatgtatcttggaaattatcagatatatgacttgaaaatatgttctctcatttcagtttgtctttttattctgttgattgtttcttttgccacgcagagctttttaa

SEQ ID NO: 52904 - DNA, 601 bp, Human
accccctgtctaaccagtcccgatgagatgagccagatacctcagctggaaatgcagaaatcacccaccttctgcgttgatctctgcgggagctgtagactggagctcttcctattcggccatcttgccagccacccgtactgtactttggaagaaagtcactacatatagccagcactttaaaagaatggagaattatggtccctatccttaaggtgagagtatctatataaattgttcggaatacttttgcaccagatatttgtctctctgtattaaattatttaatcctttatttatrtaagtatggactcatggatatatattctatactttatgttataattcactatgactttacttacattgttgctcaaatggtctcctggctttggcaaatttgagagagcattcagttggctcctgtacttctttgagatagctccatcaatatgagtttttaattttttctgagtgccttactttttgtcactactagatgccccagtctcatattgtatattttatgccccactcttataatcacagacatttctccaagaagccctgattccttctactagagattggtattagaaac

SEQ ID NO: 52905 - DNA, 601 bp, Human
gcttgccctctatgggctgcaccccctgtctaaccagtcccgatgagatgagccagatacctcagctggaaatgcagaaatcacccaccttctgcgttgatctctgcgggagctgtagactggagctcttcctattcggccatcttgccagccacccgtactgtactttggaagaaagtcactacatatagccagcactttaaaagaatggagaattatggtccctatccttaaggtgagagtatctatataaattgttcggaatacttttgcaccagatatttgtctctctgtattaaaktatttaatcctttatttatataagtatggactcatggatatatattctatactttatgttataattcactatgactttacttacattgttgctcaaatggtctcctggctttggcaaatttgagagagcattcagttggctcctgtacttctttgagatagctccatcaatatgagtttttaattttttctgagtgccttactttttgtcactactagatgccccagtctcatattgtatattttatgccccactcttataatcacagacatttctccaagaagccctgattccttctac

SEQ ID NO: 52906 - DNA, 601 bp, Human
ggaggaatctagggaggcagtctgtttacagaggctttgctgagctgttgtgggcttcgcccagttggaacttccctggggctttgtttacactgtgaggggaaaaccagctactcaagcctcagtaatggtggacgcccctccccctaccaagctagtgcgtcccagggcgacttcagactgctatgctagcagcaagaatttcaagccaatgaatgttagcttactgggctctgtaggtggtgggatccgttgagctagaccacttggctccctggcttcagccccctttccaggggartgaacagatctgtccactggcattccaggcaccactggggtatgaaaaaaactcctgcagctaacttggtgtctgcacaaatggcttcctgttttgtgcttgaaacccagggccctggtggggtaggcacctgaggaaatctccgggtctgtgggttgtgaagaccatgggaaaagcatcgtatctaggctagagtgcaccattcctcagggcacagttcctcttggcttcccctggctaggggagggagttccccaatccctggcacttccctggtgaaacaatgccccaccctgcctt

SEQ ID NO: 52907 - DNA, 601 bp, Human
ggacgggagcagcttcaccaacccctgcaaagtgactctgaagaagatgacaagcgctgctccagtcacacccagaagctgactggtccacgcacagccgaagcatgaggaaactcatcatgggactcattttccttaaaatttggacttgtacagtaaggacttcaactgacctttcccagactgaggactgttcccagtatatacgtcaagtcactgcggtaggacaaaaggttgctacagttctattattttatggttattataagtgtaccaggactctaaaaggagcttgtttgtwtaatgctattctatacaaggtatatagccctggaagtgaccagcctgatgtgtgctataacccatcctttttcctagtgcccataaaaacaggcacacttctaggcttcccagtctgtgcttcccgagaaaagagaagcatagctataggcagctggaaagatgatgagtggccccctgaaaaaaatcatgcagtactatgggcctgccacttaggcacaagacggctagtggggataccaaacccccatttatatgctcaaccgaatcatacagttaaaagctgtcttaaaaataataa

SEQ ID NO: 52908 - DNA, 601 bp, Human
gactaactagataccaaagcttgctctgtgaaaatccctgcataaccattgaagtttgcaacaccctaaaccccaccaccttgctccccgtatcagagagcccagttaaacataactgtgtagaggtgttggactcagtttattctagcaggcccaacctctgagaccatccttgaacatcagtagactggtagctgcacgtggacgggagcagcttcaccaacccctgcaaagtgactctgaagaagatgacaagcgctgctccagtcacacccagaagctgactggtccacgcacagcmgaagcatgaggaaactcatcatgggactcattttccttaaaatttggacttgtacagtaaggacttcaactgacctttcccagactgaggactgttcccagtatatacgtcaagtcactgcggtaggacaaaaggttgctacagttctattattttatggttattataagtgtaccaggactctaaaaggagcttgtttgtttaatgctattctatacaaggtatatagccctggaagtgaccagcctgatgtgtgctataacccatcctttttcctagtgcccataaaaacaggcacac

SEQ ID NO: 52909 - DNA, 601 bp, Human
ccacagacataaaggaagtccactttggaaaagaatggttatcatcttcaaaaaaaagggaaaaaaagttggggggggccgcgaaatttatgtaaaaagaatgttatatggtaaattcttatcctgaaataaattaactggttgtttaaagaaagaaatgtttgtaataagtcagaaagttaacgcatgtcaaagaattgtctgtgaaagtcatgaaagagaaaaaaaagttataaaaaagaatttatgcaagaaatgttgtataatttaaaagtaattgggcctcctgaatgtaaaactrttgaagaaacagtttatgtgcaaggtgtataaggaaagtaaaatatacctttggtaaagggattataaggaggcataagaatgtggatttttacctacattaaaaggttaaaaaaaagttttcttttgaaggcttaagcaagttttaaaacattaatcataaagaaaattctgtgtgtaaacatattagctaaagttaaagaggtatcatccagtttttctgtgaactaaacattaaaataaaaacacaacgggttttttcttaaatcactaacctgctctttaacaaaaactataaaag

SEQ ID NO: 52910 - DNA, 601 bp, Human
tcaatcaatcacgaccctctcacacagacctccttagagttgtaggcccttaaaagggacaggaattgctcacttggggagctcggcttttgagatgcaagtctgctgaaatttccagctgaataaagctcctcacttctttaacccggtgtctgaggagttttgtctgtggcttgttctgctacatttcttggtaccctgaccaggaagcgaggtgattaacagaggccaaggcagccccttaggcagcttaggcctgccttgtggagcatccctgtggggactccagccagcttgagcratgcagatcctgagagcgctcctgggtaggcatttgccccagtggaacgcctcctcagagcagtgcacggcaggcccccgcagagggtcaacgcagtggctgaacaccgggaaagaactggcacttgcagtctggacatctgaaacttggtaagactggtctttggaacttgaccactccatttgagtggaagcgtggcctgatcacccacggcgtgtctgtaccagcactttggtttttgtttttgacttgacttggatggcttgatactttggttttggttttgacctggcttggatt

SEQ ID NO: 52911 - DNA, 601 bp, Human
ccattgtgaatagtgccgtgacaaacgtgtgaaagcgtctttatgtagaatgatttatactgggtcaaacggtatttctggttctagatccttgaggaattgccacaccaccttccacaatggttgaactaatttacactcccaacaacagtataaaagagtttttatttctccagcatctgttatttcctgactttttaatgatcaccattctaactgaccagtgatgatgggctttttttcatatgtttgttggctgagtaaatgtcttcttttgagaagtgcctgttaatatccttcrtccactttttgatgggattgtttttttcttgtacatttgtttaagttctttgtagatcctagatattagccttctgtcagatggatatattgcaaaaattttctcccattctgtaggttgcctgttcactctgatgattgtttcttttgctttgcagaaactctttagtttaattagatcccatttgtcaattttggcttttgttgccattgcttttggtgttttagtcatgaagtctttgcccatacctatgtcctgaatggtattgcctgggttttcttctagggtttttatggtttt

SEQ ID NO: 52912 - DNA, 601 bp, Human
agaatgtacagagacttctcatacacctcacacccagtttccctattaacatgttacgttagtatggtgcacttatcgttaatataccaaaattgatacattgttactaactaaagtccatatgttaatcaaatatccttatcttttccccagcacgtttctgttctagcaacccatccagaataccaaattgctctagttgtcatctctccttaagttcccttggctgtgacagtttctcagatttttcttatttttgatgatcttgacagttttgaataatactggtcaggtattttgyagggtatccccttaatagaatttatctgatgtttttactcataattagaccagggttatggggtttgggaaagaagataacagagttaaagtgccatttttgtcacattatgacaaggatacatactaccaacataatttatgactgctgatattgatcttaaacacctgactggggtaatgattgttagatttctccactatgaagttactttctacccctacctttccatactgtttatttatttatttttttatactttaagttctgggatatatgtgcagaacatgcaggtttgtt

SEQ ID NO: 52913 - DNA, 601 bp, Human
aaaaaaatagagaagaatgtacagagacttctcatacacctcacacccagtttccctattaacatgttacgttagtatggtgcacttatcgttaatataccaaaattgatacattgttactaactaaagtccatatgttaatcaaatatccttatcttttccccagcacgtttctgttctagcaacccatccagaataccaaattgctctagttgtcatctctccttaagttcccttggctgtgacagtttctcagatttttcttatttttgatgatcttgacagttttgaataatactgstcaggtattttgcagggtatccccttaatagaatttatctgatgtttttactcataattagaccagggttatggggtttgggaaagaagataacagagttaaagtgccatttttgtcacattatgacaaggatacatactaccaacataatttatgactgctgatattgatcttaaacacctgactggggtaatgattgttagatttctccactatgaagttactttctacccctacctttccatactgtttatttatttatttttttatactttaagttctgggatatatgtgcagaac

SEQ ID NO: 52914 - DNA, 601 bp, Human
gaagggaagggtgttagacagataaatgactatatgactatatgactatataccacagcaagccatagctaaatagtagcgtatgtaatttttttttaaaaaaaaagaaaagcaaaaggcaaataaagtacatgaattgcaggaggaatcaaatatctaaatttttactcaaaaatgctgtctggttctgggtgataacagatttaatgtagggatgaatccatgcaccaacttctatataccatgcaaaatctttttccttttggaaaaatccagctttcttaaaattagaaaacagagrtttataaaacaccatttgcagatctcctccccccatagttcagcagagaatttgctgtaaacatctgcttgataagcccataatcctggctttctaatagaaacatcttcttttaaaaaaattgaccccattatttaaaatagttttagatttaaaaaaaaatagagaagaatgtacagagacttctcatacacctcacacccagtttccctattaacatgttacgttagtatggtgcacttatcgttaatataccaaaattgatacattgttactaactaaagtccatatgttaatcaa

SEQ ID NO: 52915 - DNA, 601 bp, Human
tagcatgaaacaagggacaccttttggaccaatccatttgagttgggaattgtaggagaccatcatagatttggtggacccaaaaccagtctggggtcaggaataagaaaatgtaatagcatggcaaatattaatggaaccatatggtttgggtggtggaaacggacaagtgtaactcccagaaggaggaaattgttgctttcagaagggaagggtgttagacagataaatgactatatgactatatgactatataccacagcaagccatagctaaatagtagcgtatgtaattttttttwaaaaaaaaagaaaagcaaaaggcaaataaagtacatgaattgcaggaggaatcaaatatctaaatttttactcaaaaatgctgtctggttctgggtgataacagatttaatgtagggatgaatccatgcaccaacttctatataccatgcaaaatctttttccttttggaaaaatccagctttcttaaaattagaaaacagagatttataaaacaccatttgcagatctcctccccccatagttcagcagagaatttgctgtaaacatctgcttgataagcccataatcctggctttcta

SEQ ID NO: 52916 - DNA, 601 bp, Human
gagtgtactctgcatcacacagttcaggaagcaggctgaggttgggggcctgctgaagcccttgagagagagggctctaaattcagcaagttcctgtcttaaaaaatggcagcctagggtattgcctaaacttagtactttagactttcgttgggtgctaggattagaaaccagctctgacaaatttggatcatcagtttatttattctagaatatgtggaacaatctgagatgacaagggcaggcttgcattagttctcagaaacagctagagctggtgagctgagcaccaccaggtatytctcattgtggctacactccttagacagctttattttctctcagtgtgacccaatcttctctgcatagcatgatgcatgaacaatgaactgtcctgggttttaaaccttaagagtttttcaatcaaaatagtgtgactacttctctttatggtccaggcttaaatagcttgagactagctctgatagttttagcatgaaacaagggacaccttttggaccaatccatttgagttgggaattgtaggagaccatcatagatttggtggacccaaaaccagtctggggtcaggaataagaaa

SEQ ID NO: 52917 - DNA, 601 bp, Human
atcatctctgaaatacagaacccatacatatctaataaataaagtgttaatatgcactcatttacagactagtaaacatcatatgtgtacctcatatgcaaatttctatgccattttatgtgtatacacatacatttctctgtgcatactcaatgagtcatacttaaaatgtatatgtagtattcagaattatgggcaaacacattcagtgcatatatttattaatattcaagcaaacaggtcatatttcaactttgaaaatataaataaaaaggacagtaattgagagacatgggtaaaygctgatcaatatggcgaagtatgtattaaagtccatttccatgtgcaattttactttccacatctttcgcacagctattctttctcagtcagaaccaataattatttaggcatttttctattatttctttaatgcaacttttaattcctgatttatctttccctctgctctagttcttcttttaaaaaggaaacacattttcagaattttcatctttgtttcctttaaaaaatacattatttacatcaatttcctaaccaggttttctgtgagatagcagacagccaaaacagaggacaa

SEQ ID NO: 52918 - DNA, 601 bp, Human
cactgaacacagtcattttaaaaagctattaaagctatcaaataagaatgcatttatggaaatcttttttacatcttaaaccactatacaaaaataagctatcattttgttaatattctctcattaataccaatgcttgagatttctgtcaacaatttactaatttgccacaaaatgttactttaagaaaggtatatatccacaataaccatcaccatacagtcttctccttgctctattttttattgttaatattctcatttttagacacagagttttatgggattagatctaacttatrttactagatcctttggtgtcctggttgactagatttttatattagtctcaactgggaagttttgattttggaaatatggggaagaaagagagaatagctgaaacctcagatgtctgaagttccctttcctcctcacacttttcctagccaaagggtagcatcaaatgtcatagggagttgtttttacaacattttgctccttgcaatagcccggagctactccagtgtttaatattgtatgctgaaaaaaaagagagaagtgtttcagctaaagttacttggtttcggactgtttaaaac

SEQ ID NO: 52919 - DNA, 601 bp, Human
ttaattttaaacaaaaacaaaataaaactagataaaactgcaactagttggtgaagaggtctttaagtctagcttaaatatcaaaattctttgttaccacctaggtttggaagctaccttatagtaattttaaattctggcttaattactgataacttaattctggattattgattgacagtggcagcagccacaatttcaggaacttcctggttaaccaatattcattttctcagtccagttgaggaaaattggactgggacaaatacagggaacacttggatctatttgcttctcactwcccacaagtgagattgcctgttttttccctgttaagacttattttatcctccaccttccttgtttctgtaacctccagaatgttagaattttaacccaccaccttttgagaaaaaagccgaatgagggattgaaactcataatgttcaaattcttattttcaaaaaggtacattagggtttttactaaataatgcttcatctctaggaaatttttataacatgacttccccttgtggagccctcagagagccaagcttgattgaatctccttcctcttcccatcaacagcagcactctcc

SEQ ID NO: 52920 - DNA, 601 bp, Human
aaatagtttactttgaacaacaacaaaaaaagaatgagactttaatattttcacataaaatatttttaaagcataaaatacaggataagtttttggagtatgattgtctcaaaagaaatcagttttaaatttcctgtaatttcaaaatgtgaattttttgaaacagaaaatatgtgtgtaataaaagttaaattagataattttattaattgcactccacccataatatattattattctaataatcaattttgaattaatagcaagtattagtcttattttagtaatgttaaaacttttkgtaacaaaatgattgaaatgatattgttaattttttatatgagtcataaaattgtaagtagcctttacaatcttggaaggattaaagatacagctttctatacataagttggcattttcatgctgtttgattcatgtgacactaattatttttgaacacgtaaattttatctcaactactaacactgctttcaatttttaaaaatactagttaaatttacataataccatctcattattttgatctatttgataagttaattgattatttttttcaattgaaataaattgagctgacaga

SEQ ID NO: 52921 - DNA, 601 bp, Human
cttgaatattttctgcatattgagtctatgtattttctatgtctttggcaattgatttattaatctcttatggggaatattgaaacctataaatgaccgaaaccaattttgcctctagagggcagcagtattatattgaattaaacagatgagtataaatatcttgaaaaaaagtgttttcatgcattctaaaatagtttactttgaacaacaacaaaaaaagaatgagactttaatattttcacataaaatatttttaaagcataaaatacaggataagtttttggagtatgattgtctyaaaagaaatcagttttaaatttcctgtaatttcaaaatgtgaattttttgaaacagaaaatatgtgtgtaataaaagttaaattagataattttattaattgcactccacccataatatattattattctaataatcaattttgaattaatagcaagtattagtcttattttagtaatgttaaaactttttgtaacaaaatgattgaaatgatattgttaattttttatatgagtcataaaattgtaagtagcctttacaatcttggaaggattaaagatacagctttctatacataagt

SEQ ID NO: 52922 - DNA, 601 bp, Human
ccttctgcactgctctagcagaggttctccatgagagccccacccatgcagcaaacttttatctgcgcatccaggcatttccatacatcttctgaaatctagatgtaggttcccaaacctcaattcttgacttcggtatactctcaggctcaataccatgtggaagttgccaaggctcgaggcttgcaccctctgaagctctggccctagctctacgttgacccctttcaatcatggctggagtggctgggacacagggcacgaagtccctagactgcacacagcatgaggaccctgggcygggtccaggaaaccactttttcctcctaagcctccaggcctgtgatgggaagagctggcacaaatgtctcacatgccctagagatattttccccattttcctggtgattaacattcagatccttgttacttatgcaaatttctgcagctggcttgaatttttcctcagagaatgtaattttcttttcacttgcattgtcaagctgcaaattttccatacttttatgctctgtttctcttttgaaactgaatgcctttaacagcacctaaaccccccttgaatgctttggtgcttagaaat

SEQ ID NO: 52923 - DNA, 601 bp, Human
ttcactctgatacttctttggctgtgcagaacatttttaatttaagttacttgtggatcaacttcaatttaactctcatttggctatttttgtttctcttgcatttgcttttgaggatttagtcataaattctttgcctaggtcaatatgtaggagggtttttcccagattttcctctagaattattatagtttcaggttttacatttaagtcattaatctattttgagttcatttttgtataaggcaagagacattattccagttttattcttctgcatatgattatccaatttctcaamaccatttattgaatagagtgcccattcaccactgtgtgtttttgttgattttgtcaaagaacagttggctgtaaataagtgttacaaccaggagggaggctgtaccctgcaaagtcacaagggcagagctgcccaagaccatgggagcccacctcttgcatcagcgtgacctggatatgagacatggagtcaaaggagatcattttggagctttaggatttgactgccctgctggattttggacttccatggggcctgtagaccctttgttttggccagtttctcccatttggaacagct

SEQ ID NO: 52924 - DNA, 601 bp, Human
ttagatagtttctcattccccagttccctttcatcctcccatcttcctgagtgtccattgtctattattctactatgcccacatgtatgcactatttaccccccacttataaattagaacatgtggtatttgaatttctgtttctgagttatttcacttaagataatagcctccagttccatccatgctgctataaaagacatgattttatttttaatggctgagtagtactccatggagtatatgtgtatatataaatatcacattttatttacccaatcatctgttaatagacacttasgttgattttatatctttgctactgtaaatagtgctgtgctaaacatacaagtacagttatctttctgatataatgatgtatttgcttttgggtagacagccagtagtgggattgctggaacaaatggtagttctattttttaggtctttgggaaatctccatactgttttccatacaggttatactaatttacatttccagcaacaatttataagcattcttttttctcctaatcttcaacatctgttattttttgactttttaatagtagccattctgactggtataatatggtatctc

SEQ ID NO: 52925 - DNA, 601 bp, Human
ttatattgcatagtggtgaagtggattttagtgtaaccataacccaaatagtgtccattgtacccattagatagtttctcattccccagttccctttcatcctcccatcttcctgagtgtccattgtctattattctactatgcccacatgtatgcactatttaccccccacttataaattagaacatgtggtatttgaatttctgtttctgagttatttcacttaagataatagcctccagttccatccatgctgctataaaagacatgattttatttttaatggctgagtagtactccatggagtatatgtgtatatataaatatcacattttatttacccaatcatctgttaatagacacttaggttgattttatatctttgctactgtaaatagtgctgtgctaaacatacaagtacagttatctttctgatataatgatgtatttgcttttgggtagacagccagtagtgggattgctggaacaaatggtagttctattttttaggtctttgggaaatctccatactgttttccatacaggttatactaatttacatttccagcaacaatttataagcattcttttttctcctaat

SEQ ID NO: 52926 - DNA, 601 bp, Human
tgtggaattatttgttttgcagagaaaatctttggtcaaagcaggttagcattcgttatatgaccagagagatagaaagggagcgagagagagaagggaagaaagaatgagagaaataatatgaattgggttataagcctctttcagcaactgcatcatcctttttttcttgaaatagttaattcttctatggagagtaaaatgtctatgaaagtgaaactaacggacccaaacttcttttctaattgtactatgttttattcaatagccttttaaaaaaagaggtgtgtgtgtgtgtgtrtatgtatagctgtatctattgaggtaagttttttggtttactttgttttcactgcaactaaccaacttcatattaatgttttcaactagattgtagactgtcatataacctgacattaaaatatttagatataaaactaatatgatttaattgataagaagaaagaaatgtatacatataatgagtacataagactagaacactaagcaattttcattcctgatttacctattgacaatagtcataagatgggaatatataaatgcttgattaatacaatttttaaaagaacatctattt

SEQ ID NO: 52927 - DNA, 601 bp, Human
agttaactttgtttcttctgtattgcctcttgatctttcaaatgaatgtttttatgatttttagttaattgtaataatatgtgggggaaaggaataaaacaattctttaaaatgttataacattttataaggtaaaaatacattgaattactatcatatgatttgttttagtcttaatgtgtactttttatgaaattttaaatgatctgaacagaggatacaagaactttatgtttgccaaaagtggatggaggaaaaatattgcatataaaaaacataaaggtataaaaaattatgctgrtaagtataattaagaaattatacatgtacataaatatatacacctaatatgtacccacaaaaattaaaaataaacaaacaaaaccacaacaaacaataaactgtacaactgaaagttgttatttttcatatgaaactacattgggaaacatgaacttatgtgaagacaaagttgaaaatggacacatgtaaaataattctttttttggcctgcagtttaaactacagttgcaaatcaaaaaattaatttcccattttcttcaggtaaataaattaaccttcttattgaatttgcatacat

SEQ ID NO: 52928 - DNA, 601 bp, Human
tccttattgaaaagttattttattaagtaaaacttcctactataatatagttttaaaagtctattttctgtaacttttcaatgtattaatttgaaagttaactttgtttcttctgtattgcctcttgatctttcaaatgaatgtttttatgatttttagttaattgtaataatatgtgggggaaaggaataaaacaattctttaaaatgttataacattttataaggtaaaaatacattgaattactatcatatgatttgttttagtcttaatgtgtactttttatgaaattttaaatgawctgaacagaggatacaagaactttatgtttgccaaaagtggatggaggaaaaatattgcatataaaaaacataaaggtataaaaaattatgctgataagtataattaagaaattatacatgtacataaatatatacacctaatatgtacccacaaaaattaaaaataaacaaacaaaaccacaacaaacaataaactgtacaactgaaagttgttatttttcatatgaaactacattgggaaacatgaacttatgtgaagacaaagttgaaaatggacacatgtaaaataattctttttt

SEQ ID NO: 52929 - DNA, 601 bp, Human
acccacaagtattttacaataaaaaagaacatgtatttaataatgttaatgatttctgcaacagttgcagatctgcaaaagaacaaactccttattgaaaagttattttattaagtaaaacttcctactataatatagttttaaaagtctattttctgtaacttttcaatgtattaatttgaaagttaactttgtttcttctgtattgcctcttgatctttcaaatgaatgtttttatgatttttagttaattgtaataatatgtgggggaaaggaataaaacaattctttaaaatgttayaacattttataaggtaaaaatacattgaattactatcatatgatttgttttagtcttaatgtgtactttttatgaaattttaaatgatctgaacagaggatacaagaactttatgtttgccaaaagtggatggaggaaaaatattgcatataaaaaacataaaggtataaaaaattatgctgataagtataattaagaaattatacatgtacataaatatatacacctaatatgtacccacaaaaattaaaaataaacaaacaaaaccacaacaaacaataaactgtacaactgaaagtt

SEQ ID NO: 52930 - DNA, 601 bp, Human
aaattccctccagagtgacataacatttaggcatggttattcaatcaatttctaatctgtcctgtgagtaacaccagagaccttgcctagtgtcatactgactttaaaagcactttagactgcctttgatgcactgctgtgccagtacaatgatttaccatcttacactgaggctgataattcctagcaccattttacaaaataaatttggcatagagttaaatatcatatgaaagtttttcatgtgatacataatcaaaagcttacttcaaagcatactttaaaatagattaggaaaatkgttgcttttatgagattaaatgtcttaaacaatttgaatctcagtatttcaacaaacacattattaagcaacaacgcaggtatatatatatatttaaagacatacttctaatacacaatccacttcattgttagcatgataatagtttcctggaagcaataaaatccacaagattcttaccaaaaaggctgggaaccttggttgattgcggagtcagggagttattcacagcattgagctgggttccataattatccacctggaaaccattcgctggaaaaaaatacagccaattaaaat

SEQ ID NO: 52931 - DNA, 601 bp, Human
atataataactgaataaaacaaaatacgagtgaaaaatacaaagctggaaagacataaagaaataatgcaacgatagtacttaatttttcagataagtcagaatcacaaaagtattaatttttacgaacgaagtagtatttaaaaattagactcaagttcatctggcattcaattcactgctctacctattgaatgtaaggacctgaagtcattttgaatatatcgtattttccaactcccactgaaagtttgcatccccttaatgacctcttaagtgttaattgcacacttattgaatgcctacaatttagggaatttattaatacctgagacagccatcaattttttaagatctcacataagaaagaaacatattatagaaaggcatttatactttagttctcacacattaatcctcatgcttaggctgggttgagggggataagggaggatggggatgggggtctggggagggtgtgaaataggcaggactaaagggtaagtcatgtagagaacttaattctcctttcacataatagtgtttcagttattaaaagcacatattatgctccctcgtagatctcatgtctctttacactt

SEQ ID NO: 52932 - DNA, 601 bp, Human
ttttgccctttctaacttggtagtatgcttaccaaaaattttaaattttatacttcaaaaaaacttaaggcaaaattattccctaacctactctactcactttaatgataaatgactgcagatctccacttgaattggtaaaataattcaaacaaaagtattcaagcatgttgcaaactgatttcatacatttcttgtacttactgatatactgtgtcacatgtatatttaaacctgttaatttagtcattctaaattttcttttacagcagtaagatttaacgtgcttttgaaaatatawtaactgaataaaacaaaatacgagtgaaaaatacaaagctggaaagacataaagaaataatgcaacgatagtacttaatttttcagataagtcagaatcacaaaagtattaatttttacgaacgaagtagtatttaaaaattagactcaagttcatctggcattcaattcactgctctacctattgaatgtaaggacctgaagtcattttgaatatatcgtattttccaactcccactgaaagtttgcatccccttaatgacctcttaagtgttaattgcacacttattgaatgcctaca

SEQ ID NO: 52933 - DNA, 601 bp, Human
caattatacaaataaacatcttttgaccttgaagccccatgatactcctctgtgacaataatctcaacttgtttctaatgaacacattcaaactcttcgagtttccatatatgcattaatttaattctagtatgaattcttcttaaaatattagtcatgattttgagactgtatatttactgatgcatttatctgaataaccagagactttatgagtgtctgaaatataaatttcttctgcaaatgggaacttacaaagaagttgtttaacaaatgagaatctaaggcctggtgagttaartgtattactctgaatcacatggataataataatgagtaaccctacacgaactgactagatatcaggcactgtcctaagaaagttatgtattttgactgatttaacctcacaacacaacctatcaacttagtactataatattaccatcctcattttacattggaaagatgaaactcaggttaagaaatatcttagggtcacacagctattagttgaagagttgggaatttaacgcatgtcttcaggctcaaaggttttttatctgctatatcattatttcaatcatgggggaaatcaaga

SEQ ID NO: 52934 - DNA, 601 bp, Human
aatagttaggtccggtcaaaagactcacaactagcacgaactcctgagaatattcatttttctttgctagttagacatttacaagtgaggtgcagtgagaagactatgtttactatgcatgtaaatattaaaactttattagcagtatgctatcaaaggcatcacgtatacatataaatattaaggaaatgccaaaagcacaaatattaacataggcatgaaatgctatccaatcctagaaagaacatggatgcatgaatgcagaaggcgttcagaaagacttggtaaatatgagccgcaytcttccaaccatcatttgttccttcttttgtaactgtggatcacaaaattgataaataaaaaatgtgagtcatctttatatgtttaacactgtggtcaatgctgagggtgggggaagtctataaactgtatagtacattatgtttttcttcaaaaaaatcttgtaatctagacagtgaggcagagcaaacacaatatctaatagtacaagtattgaaggaatcatagtaagaagccaggggagagagacagaaagaaggcctccttatggtagtgaaaaggcagattggttaagaagatt

SEQ ID NO: 52935 - DNA, 601 bp, Human
gggccaggcagagtagctcatgcctgtaatcccagcactttgggtcaggagttcgagactagcctggccaacatgatgaaaccctgtctctactgaaaatacaaatattagcggggcgtggtggcacatgcctgtaatcccagctactcgggaggctgaggcaggagaatcccttgaacctgggaggcggagattgcagtgagccgagatcgcgccattgcactccagcctgggcaataagagtgaaactccatctcaaaaacagcaacaacaaaaaacaaaacagaacaaaacaaaaacraatagttgatgtatggaagcaaagggatgtataaaaatcaggaaaaaaatgactttttttccatgaatagttaggtccggtcaaaagactcacaactagcacgaactcctgagaatattcatttttctttgctagttagacatttacaagtgaggtgcagtgagaagactatgtttactatgcatgtaaatattaaaactttattagcagtatgctatcaaaggcatcacgtatacatataaatattaaggaaatgccaaaagcacaaatattaacataggcatgaaatgctatccaatc

SEQ ID NO: 52936 - DNA, 601 bp, Human
aaacaaatcttggtgcaacagtgctgattcaaacagtatttagagagcttgaacatttgaaagtaacaagtattgagttggcatggtcaacagggactgattctagaaacaaccacaccaaagttccagtcttgcatccatgtgatcatatctgcactggtcactcagatccatgtaatgcactggtcaatcagatccatgtagtggtattagatataatcaaaactggaaaccccacttttgattagatataatcaaaaactggaaaccccactccactgtgtccctagaagaggcagarttggaattttcctgatcaacagattttatttatttatttatgagagagtcttgctgtcatccaggctggagtgcagtggcacaattacagctcactgcagcctcaacctccctggctcaagcaatcctcccacctcagcctccagaataagtgggtctacgatcacaggccaccatactgagctaattattttatcttttgtagagagagggtctctgcatgtcacccaggctggtcttgaactcctgggctcaagctatcttcccaccccagccttccaaagcgctggtattacaggag

SEQ ID NO: 52937 - DNA, 601 bp, Human
attttcaagtgctatatatgttatttcaaagaaacttagaataaaatttgttaaatgaagatatgtcagatcaaggttacagactttagcttcattaaaaatgatcaataacaaaatgtatacaaatagtactcattttttgactataaacctcggatgaaaataggtcgtcatcatcatcattgaaaacaacctcaaaaattaatactttgtgctttaattgtgtgctcaacaactgggttaagaattttatgtctcattacagttttccaaaagttttgagatacttcttgccacatakaacaaatgaggaacctgaagccaagcgaaattttgtgatctttttttcaaggccacagactgagtcagcaaatagcagaactggaattaaaaaccacatctttctttctataacgtcaatgctctcaaccactaagatatgtcattctgaaaactaactagaaaattaagaaaataatacctgagcaaaactattttaataattttatcagataaaaataaaattgtcacaacttctcctttagaactgatgtccaaattccctcttttctgaagctcaggttcagaacatgctaaatgt

SEQ ID NO: 52938 - DNA, 601 bp, Human
ataattatgtttgaattttcaagtgctatatatgttatttcaaagaaacttagaataaaatttgttaaatgaagatatgtcagatcaaggttacagactttagcttcattaaaaatgatcaataacaaaatgtatacaaatagtactcattttttgactataaacctcggatgaaaataggtcgtcatcatcatcattgaaaacaacctcaaaaattaatactttgtgctttaattgtgtgctcaacaactgggttaagaattttatgtctcattacagttttccaaaagttttgagatayttcttgccacatagaacaaatgaggaacctgaagccaagcgaaattttgtgatctttttttcaaggccacagactgagtcagcaaatagcagaactggaattaaaaaccacatctttctttctataacgtcaatgctctcaaccactaagatatgtcattctgaaaactaactagaaaattaagaaaataatacctgagcaaaactattttaataattttatcagataaaaataaaattgtcacaacttctcctttagaactgatgtccaaattccctcttttctgaagctcaggttcag

SEQ ID NO: 52939 - DNA, 601 bp, Human
ctgcttacgcagatcattcaacacaacagagttttgacccagatcaacagtgaggttcctaacactagaaatggcaatatttcgatagtgcattaaaatgtgaagttaatcactaaggatattgtattatgtgtaattaacttttagaggtttttaaagatgcaataaattattgtcagttaaggaatcattataaggcggttattcttcagaacataaattttacctaatacgtaaactaattcatttatcttaagatcattttaactctgagcagtaagactatcattgggttactatmccataaatgacagtaaaattaaagtaatgaagcaaatggtttcttaagaacattttagttccatttgaatttttttcacttcttgaagagaaaaacttcattgtttccaaatagcaaatttattctacatatagatcagcactcatctattcaaaatccagaatttgctatctacaatgaaagaaaatataaaggttttgcgaaatgtaatttttttagttgagattataattattgacagaaagttaagatagaataaaaagacactaacctgacttttgttgtttttccaaagggaat

SEQ ID NO: 52940 - DNA, 601 bp, Human
tatgtgtgaatgtggttgtaagttgtatccttctttgcaaatgttagttgttacgtctaaatagcaatgccagacatcaagcccccttattccagaacagagaaaattttctgatgacagggagcaaacttcttctcttttcccacatacaacctatagtaaacatggcccaatcataaaatcaaggttatttcaaaatgggaaaaagctaggctagtacatatggggctacagtccctagattggacgtatgagaagaggagcctctgttatcatagaccaagaacagcaggtgaatccyagaaccatttgggcctttccattgaagctgaaaccatggaagatacaccacagatgtggtggagagacatatgctagcttcagtcttcctttgactatccagtcatccaacaaggcctgccatttaccaaatcctttcagaagccagaggagaaagttccccataaaaccacatgagcaggggattggtttgagagcaaacagacagttgaccagcatagatgccagcagagaaaacttcactaaattatccaaggcatcagattgcctctactgacactctttatgacttctgaatcag

SEQ ID NO: 52941 - DNA, 601 bp, Human
gaccttctaggatttgtaaaatgaaaacatcgttttaaatcatatgtagccctttatgttttaccttctcctatgtggggattatagtgcgtgatttttaaaataatttttattgtgtatatttgaggtttacaaaatgatgttatgggatacatatagatagtaaaatagttgctgtagtgaagcagattaacatacccatcttctcacagttacatttttgtgtgtgtgacaagggtagctaaaatctacttatataacagaaatccctaacacaatactgttttactaactgtcatcktcatgttgtacattagatctctaggcttatttatcctacatgcctgtattttgtatcctttgacatgatgatatgccatcataaatcaaagttgaatggtgagaatgtgtgctagacattctagaaaatgttgacatttcctgtcactaagaatcatttatattagaggaattttctagcagtctaggagagttatattgtaattgatttgtactattgtacacacttttccaatgtgtgggatgtgtattatcatcatccttgcacagtgtagaatataaaatgattattaattgccac

SEQ ID NO: 52942 - DNA, 601 bp, Human
acagtaatctgaataaaggggtatttaataaaattcgtgcatttcaattctaggaaaatgcttaacaaaaccatgtgtccagtatattgagatctttctccaatgaattaaaaaatctcatttgctaaagagaagtgttatgattactctttatatgaacaaactatttgtacataataaaaaccactcttcaacaatgtaactgctgaaaatttcttacagacacacacacacacacacacacacacacacacatcacacatatatattaatttacatatcatttgttcacaaatatttrgctttaaaaaattctaatgagcaaagtttttatttgtgatgtaacaaaaacactgaagctgaggaagagttacttctcttgactaagcacatgctgactgatgtaatacaagcacagtttaaagtggaggaattcaggtatggcaagttttaagtttcaaggaatgagtccagatgagttgtttgtcttggtagcattttttttctcatatttgaagcttagttctagatgagttaaatgtttttgcaaaggaagcaaattgatttggatcagacagataagctggtttgtcaatgggat

SEQ ID NO: 52943 - DNA, 601 bp, Human
aattaatttcatatcttaatagattatcatttcaattcaattgctatcttaaacactagtcaattaatgggaagagtatcttctataccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattctaaaaacaatcaggaaaacatggtaagccatrtgtgatagtggatttcaggttttcgtattgtatattgtttatagattaatgttgttgcatgtgtatgtaaaacagtaatctgaataaaggggtatttaataaaattcgtgcatttcaattctaggaaaatgcttaacaaaaccatgtgtccagtatattgagatctttctccaatgaattaaaaaatctcatttgctaaagagaagtgttatgattactctttatatgaacaaactatttgtacataataaaaaccactcttcaacaatgtaactgctgaaaatttcttacagacacaca

SEQ ID NO: 52944 - DNA, 601 bp, Human
acctcacaggtttacatgacttcactcatagacctttaatgataaagtaaaattgaacttgggtttggttgcatataatattttgaaatattcatcagcaactttgttaccgatagactacagagctctaggtataggtaacttaaaaaatggaaaccaaccttgagtttttttcttttttctttttaaacaaaacgtatataaacacaggtttttacttactgagcttttcagatttaacaaaaatttatgtaaaattttgctgaattttctagaagggcactttaaatttaacaagcaytggaatccaaggtacttgggatgccatttccaatattaccagttggatttattgttatttggtattaccataaacttttaaaagaaaaaaagccacataatgaaaaagtatttgtcaattcaagagcgcctttcttctgaggggagaaggatttgtgaggagcagtggttgtgacgtccactcctgttgctttttccagttttggtgtccacataccttggggaagctgtagaattattttatgcctaatttttctctttatagaaaattattattgaattatctgcatagttcatagtt

SEQ ID NO: 52945 - DNA, 601 bp, Human
gagtgcatccaaaggccatcctcctgattggttcctctgagcctcttgtctgtctccctctcactgcctcctctgatacctctccctctgtatcgctctctcttttttctttttctgtctcttgtccttcctctctttttcctttcctctatctcttttcttcctttccatccatctttctgtcctctctcccaaactcaatcctttatattttagcacttcttggcatggatgtaaaccttaattttgaagtcccagagagttatttaatggcagtgtttccagtcattaaaaaaaaaaatgttgaggatggggattctgatgatgttcttggacatactttttggagggaaatggagtctatcaggagagagttgcgggcataggaaattaagtcactcagcttcagatttacactgctaatcagtgaaaactcttgtcaaccttacctcaccctgtgtattctccccacctcgccaccattgataagaaatgtttaagctggcttttctacccttctttctctttttcttcttcatttgagttaatcacttgaccattaatggccctttgaaaacactgaggaaagaaaagccctttt

SEQ ID NO: 52946 - DNA, 601 bp, Human
ccttctcaccttgtacttccatcctcttctctatttttcccagtaatacttacattgttacatgttatttatttgtttttagtgaatgtctctttccctcaattagaatgtaagttccatgaggactgttttttatctttgttcattgctgagactccacggcctaaacattgtctggtgcccagcacaagttagtgctgaataaattgaagagatgaatgtacgataagaggtttttatatagtaaggaaataactaaagtcctttagtggttgtagatgtgtatatatatatatatatatttatatgtataatacatatattcttatgtatatgtataatatattcttatgtatatgtataatacatatattcttatgtatatgtataatacatatattcttatgtatatgtataatacatatattcttatgtatatgtatatcttttgtccctgtttatgatatttctgtaatccttttgtataacttctgagacctccccagtggaaaaacaattaagacttcatttttttacattagtatttttattcaaatggtgtttatttgaatgtaagaggacaacatagatttaaataatc

SEQ ID NO: 52947 - DNA, 601 bp, Human
ctcaccttgtacttccatcctcttctctatttttcccagtaatacttacattgttacatgttatttatttgtttttagtgaatgtctctttccctcaattagaatgtaagttccatgaggactgttttttatctttgttcattgctgagactccacggcctaaacattgtctggtgcccagcacaagttagtgctgaataaattgaagagatgaatgtacgataagaggtttttatatagtaaggaaataactaaagtcctttagtggttgtagatgtgtatatatatatatatatatttatatgtataatacatatattcttatgtatatgtataatatattcttatgtatatgtataatacatatattcttatgtatatgtataatacatatattcttatgtatatgtataatacatatattcttatgtatatgtatatcttttgtccctgtttatgatatttctgtaatccttttgtataacttctgagacctccccagtggaaaaacaattaagacttcatttttttacattagtatttttattcaaatggtgtttatttgaatgtaagaggacaacatagatttaaataatccagt

SEQ ID NO: 52948 - DNA, 601 bp, Human
acagctgtatcttattttatgtaaaagatgtttctggatagttctatataaattaataacacttttgcatgtccatggattatggttgcagaacttatttttgtatatataaatgatttatttttcaaatactttggatttagggaacttggtctcttggccattttaagtcaatacaggtaagtttcaagagacatctgaagacactttggaagtttataaagcaaattgtcctttcgttaatagtactagttctaatatcttaccactacttattatttgtcagagtttcttaaatcarttaacaaactgtatttccttactaagtcaacgaaatcattaaccaccagtttagtcttcaggagtatctagaatttttattttttaattagttattttatgcaatattctactctaatagtttaattctataacatagaatagaggttcctaggaaggtcagtgcttaaaaaaagaaggaagaggttcctaggaacgctaatgcttaaagaaagaagagcttgtgtgattaaaattttttcttgaattttatgaactaaaactcctttacatgtaagagatgaaaatgtaaacaaagtta

SEQ ID NO: 52949 - DNA, 601 bp, Human
tgagtcttttttcatatgcttattagctctttctgggtttttaaattttgttttctattatccgttttcattcttgatctattatattattcatttttattcttggtctattactcttctgacacatctatttttaattaattttgaaaaagtcattttttatatatatatacatttctgttcaatgctacagctactttttctcctgacaaatctgtcctttttaaaaacagttttattgagatataatttaccataacattgacctgttttaagtgtacaattcaatgaatttttactrtatttatagagttttgtaactattactacagtctaattccagagcatctccatttaccctaaaaagaaatgtgtccaacatcagtctctccccatttgtacctccagccctaagcagctattaatttactttctgtgtctacatatttttggttttggatattttatataaacagaattatatgatacatagtcattcctattgtagcatgtatcagtgctacattccatttttattgcctaacagtattcaacggaatgaataaacattttgtttataccagtagatgcacatttgagt

SEQ ID NO: 52950 - DNA, 601 bp, Human
tttatttaaataaattaatggataatctaagatatttcttccactaacctgtccatttttacctaataaataagcatactttattggatattttttttcaagcaaatttgttataggaagtacaactaaacaagtgatgtttgaagtaaaaagctgcttaagaaagtctgtgaattgtctatgaatgcagggtggtattgttttgatagacattttttctttctttttttgttttttttttagcaaaaagtaagttaaggacctgaattatttcattattcataaaagtcatagtgataartaggaaccaagtgactaaaaccacatttagcttcaaaatggaagtttactctcttgcttttctaatgatttagcattcttgttcactttggccatttcacaaaaaggtgacataatcttgttccaagggatattcttttggcatgaaaagaagaaacaaaacattttgcttagggtaagaaggtaattgtatcttaaaaataagcactgcccataattgtccagcaagttgagtgccaaatgtgttgacaatgcctttggaaacaccggggaaaagagttggctgctaataaggagtaga

SEQ ID NO: 52951 - DNA, 601 bp, Human
acattatatatagtatattttatatatatatatatttagtgtgtacatatattcctgtctcctgtctgtgttcaggaatatgtatacacactggaaaaatgtggtgtgtgtacgtgtctgtgttcagccataaaaagaatgaagtcctgtcatttatggcaacacggatggaactggaggatattatgttaagtgaaataagccaggaacagaaaattaaacactgcatgttttcagtcataggtggaagctaagaaaaagttgatgtcatagaagtaaaatgtagaagatactagaggckgggaaaggtagggagaatgggaaaatagagatttgtttaaagacacaaaattacagctagacaggaggagtaagttctagtgttttctaccactgtagggttattatagttaaaaataatgtattgtctaatttcaaataggtagaaggaaggaatcgaatgttcccaacacaaaaaaacgtgctaaatgttcaaggtgatgaacgtgcttattaccctgacctgataagtatacattatatgtattgaaacatccctatgtaccccatgaatatgtaaaattattatatttcaattaag

SEQ ID NO: 52952 - DNA, 601 bp, Human
attctaattcttgcattgttatgtcttaggcacacgtctcagtcttgtcttttatagcattttacacaaaggtgtttcatagcatttaattttcataattatctttatgccccaccgaaagatcttctgggaataggcgatcatacgtatttgtttaatagttaattatctaacagttgagcaactggaaaactttatttacaattgctttttcaatcatgtgtattatgataatggggctaataataacactgagacacttctgggtcatcatgtatcctatgtttctgattacttgaamgtctctaatgtatataaactgtatatgagaaaaataaccagtggaatatttgattaatcaaaggtgtactatttctcaacctagctggggataaaaataaactgttatattaagaatagtatattttgtgtcttaccactcacaatattcttttttaggcaatagagattatgccaaggatgatccattggaatttaagtcccatcagtggtttggagcatctgtgaggtcgaaacaggataaaattttggtgagtcttctggatatttacttacaggtgattttagtcagtttatgtgg

SEQ ID NO: 52953 - DNA, 601 bp, Human; identical to SEQ ID NO: 24453

SEQ ID NO: 52954 - DNA, 601 bp, Human; identical to SEQ ID NO: 24454

SEQ ID NO: 52955 - DNA, 601 bp, Human; identical to SEQ ID NO: 24455

SEQ ID NO: 52956 - DNA, 601 bp, Human; identical to SEQ ID NO: 24456

SEQ ID NO: 52957 - DNA, 601 bp, Human; identical to SEQ ID NO: 24457

SEQ ID NO: 52958 - DNA, 601 bp, Human; identical to SEQ ID NO: 24458

SEQ ID NO: 52959 - DNA, 601 bp, Human; identical to SEQ ID NO: 24459

SEQ ID NO: 52960 - DNA, 601 bp, Human; identical to SEQ ID NO: 24460

SEQ ID NO: 52961 - DNA, 601 bp, Human; identical to SEQ ID NO: 24461

SEQ ID NO: 52962 - DNA, 601 bp, Human; identical to SEQ ID NO: 24462

SEQ ID NO: 52963 - DNA, 601 bp, Human; identical to SEQ ID NO: 24463

SEQ ID NO: 52964 - DNA, 601 bp, Human; identical to SEQ ID NO: 24464

SEQ ID NO: 52965 - DNA, 601 bp, Human; identical to SEQ ID NO: 24465

SEQ ID NO: 52966 - DNA, 601 bp, Human; identical to SEQ ID NO: 24466

SEQ ID NO: 52967 - DNA, 601 bp, Human; identical to SEQ ID NO: 24467

SEQ ID NO: 52968 - DNA, 601 bp, Human; identical to SEQ ID NO: 24468

SEQ ID NO: 52969 - DNA, 601 bp, Human; identical to SEQ ID NO: 24469

SEQ ID NO: 52970 - DNA, 601 bp, Human; identical to SEQ ID NO: 24470

SEQ ID NO: 52971 - DNA, 601 bp, Human; identical to SEQ ID NO: 24471

SEQ ID NO: 52972 - DNA, 601 bp, Human; identical to SEQ ID NO: 24472

SEQ ID NO: 52973 - DNA, 601 bp, Human; identical to SEQ ID NO: 24473

SEQ ID NO: 52974 - DNA, 601 bp, Human; identical to SEQ ID NO: 24474

SEQ ID NO: 52975 - DNA, 601 bp, Human; identical to SEQ ID NO: 24475

SEQ ID NO: 52976 - DNA, 601 bp, Human; identical to SEQ ID NO: 24476

SEQ ID NO: 52977 - DNA, 601 bp, Human; identical to SEQ ID NO: 24477

SEQ ID NO: 52978 - DNA, 601 bp, Human; identical to SEQ ID NO: 24478

SEQ ID NO: 52979 - DNA, 601 bp, Human; identical to SEQ ID NO: 24479

SEQ ID NO: 52980 - DNA, 601 bp, Human; identical to SEQ ID NO: 24480

SEQ ID NO: 52981 - DNA, 601 bp, Human; identical to SEQ ID NO: 24481

SEQ ID NO: 52982 - DNA, 601 bp, Human; identical to SEQ ID NO: 24482

SEQ ID NO: 52983 - DNA, 601 bp, Human; identical to SEQ ID NO: 24483

SEQ ID NO: 52984 - DNA, 601 bp, Human; identical to SEQ ID NO: 24484

SEQ ID NO: 52985 - DNA, 601 bp, Human; identical to SEQ ID NO: 24485

SEQ ID NO: 52986 - DNA, 601 bp, Human; identical to SEQ ID NO: 24486

SEQ ID NO: 52987 - DNA, 601 bp, Human; identical to SEQ ID NO: 24487

SEQ ID NO: 52988 - DNA, 601 bp, Human; identical to SEQ ID NO: 24488

SEQ ID NO: 52989 - DNA, 601 bp, Human; identical to SEQ ID NO: 24489

SEQ ID NO: 52990 - DNA, 601 bp, Human; identical to SEQ ID NO: 24490

SEQ ID NO: 52991 - DNA, 601 bp, Human; identical to SEQ ID NO: 24491

SEQ ID NO: 52992 - DNA, 601 bp, Human; identical to SEQ ID NO: 24492

SEQ ID NO: 52993 - DNA, 601 bp, Human; identical to SEQ ID NO: 24493

SEQ ID NO: 52994 - DNA, 601 bp, Human; identical to SEQ ID NO: 24494

SEQ ID NO: 52995 - DNA, 601 bp, Human
ctttatatttttggccttaactgtgccaatctaattagaattctctgtatttaaaatggttctttttacttattgaaaggcattttagtgtggtttatgtgtaatatcaaagattatttaacacttctcacattttatagatgctctacaaggtcacatgcttttaaaatagtagcaagttaaacttcactctttttttttttttttagaaactgatgtttattttccattaaccatttttccatgttgcttaagagcctatgcaagaacagcttaagaccattcagtggttgctcctacmcattcagtggcctgagcagtgggagctgcagaccagtcttctatggcaggctgagcgctccagtcttcagtagggaactgctgaataggcacagagggcacctgcacaccttcagaccagtctgcaacctcaggctgagtagcagtgaactcaggagctggagcagtccattcaccctgaaattcctcctcggtcactgccttttcagcagcagcctactcttctttttcaatctctccaggatctctgtagaagtagagatcaggcatgacctcccatgggtgttcacgggaaatggtg

SEQ ID NO: 52996 - DNA, 601 bp, Human
gctgagatcataccactgcactccagcctgggtgacagagcgagaccttgtcctccccccaccccccaaaaaagctaaaacctcccactatggtattaaccagttccttggtctttattctttatgcgagatgtgcttgacttttgaacatctttatgctgacatgattacagagtgaataagccatcatcatgccctcaaacagtgaaaggaaaagaaagtgagaatgtgaggcactttgagtggcaccaaagaaaggtgtcacaggaagtcactgaaccagagcattgagtccacatgygtgaaaatcccccatcagtggatgggttggggtggccctgtcccctgaagagtgtggcctgcgggaactgctgccagcaggtcctgatggaggaaaggactcggggaacctgcacagcccagggaaaatgaaacccgcgggaaaacaggaggaggagtcacgcaccctgggctcagttctgccatgcacaagacagtgatgctctgggagtctgcaactctgcccttcgccacgcacaggctttaatccagtaagattgtggccagcaagattgctttaaaaatacaaaagcagccgggt

SEQ ID NO: 52997 - DNA, 601 bp, Human
ttcggaggttgggcttcgctgagctgttggttgatttgcagagatgatgtatatggcctgcactcccgggagagggttcaggggtcccagggagttggggcaaaggaagtggaacagacgagccaggaagctgtgccgggaagctgggaggccaggagatccaggttccagccctggttgtcaaggactggcataggttcaagactgctggaccagggcatggcttcaaattctcactctagcccctactctctgcgtaacttttctatgcctcagtttccccatctgtaaaatgggggggtatgtacgtagttcaaaatggtggtaaggacgatgtatgttaatctatataacgtgcctaaagtgcagtaaacacgaccctgaacctctgcccttggggcctacctgtcttcatgtgtacaccatgaggctgccttagaaaaccgcaaggtctaaaattctttgttactcctcccaaaatccttcccattgccagtggcctgaatatgcttcaaaattcttaatatgaagagagaaaatgctcccctacctgcctgcagccctcagcctgctcagagatagggcttctctcacttctttc

SEQ ID NO: 52998 - DNA, 601 bp, Human
accatggggtggggtgaagggaagttagaaagaactcaggacttatgaatgcataatgctgaactttttggaaatggatgggcctggtgccagtcctcactagggctcctagattgtattctccttacaaaagggccattatgaaagttccgcatctcccgtgtgacaggttcagagccataaatggcatgacgtcagagggaccaggggaggaataggtttcccagccatgtcctcattgtcaagggcactgggaccctggaaagaggtttaggggaaggagggagacactttggagaargccgcagcagttcccagccgttctgcaaaggaggccgctgagcttgcccgaggcatcagctagagctgtctgcaccacgaccacccaaggccccctgccaaaaccgcagagtgcctcgaaagaatcattacaccctcttcctcacctcaagacacgtaagggctgatcacttggcttatccagcccccacgtgacatcctggaagagcagcacctcccacctctatctctgcattttcttttgggatcatttcttttctaccagataggagaggtcatttcctatagttaggagattgta

SEQ ID NO: 52999 - DNA, 601 bp, Human
acagtaatgctaaatctcaattcaaagttagtggggaaaaatatgacgatagatcccttgatttatatccacagaccccagattacgacccttagtataataccatcctttcttttcacagataataaaacttaggccagagaggccaagtggctttctaaatgtcacacagctaataagtagcaaatctgggatcaaaatccagttcttactaatgtctcatctcatccctttaccactacaccatgctacctcaatctaggccttaaaatcatttctttccagtttgtgttttgttttkaaataagtaacacattcttctaacaaattcaaacaatatacaaattgcatgaaaaaaataaaccttctacctttctttaaacacagttctgtcgaaaaatagacagatgaactagggccttgctaattaaagggtgttccctggaccagcagcgtggcatcacctgggggcttataagaaaatgcagacccttggggcccaccccagacctcttgagtcagaactgcattttccccaggtgattcatgggcacagctacttttgggaacagctgtcctggacaacttcctggagtcctgt

SEQ ID NO: 53000 - DNA, 601 bp, Human
aatcccagcactttgggaggcacaggtgggcagatcatgagatcaggagatcgagaccatcctggctaacactgtgaaaccccatctctactaaaaatacaaaaaattagccgggtgcagtggcaggcgcctgtagtcccagctactcgggaggctgaggcaggagaatggcatgaacgtgggaggcagagtttgcagtgagccaagatcgtgccactgtactccagcctgggcgatagagtgagactccatctcaaaaaaaaagaccctgtctcaaaacacacacacacacacacacaccccccacacacacacatgatacagtgatatagatacttgtttatcagtgcattaaaaaaaaattaggcagatctagtatcttctatgattttgaaggtttcaaaacatttcaaaatacttccaagtatttcaaaataactgccacagctgtaatgtgatatgtaaatatctgattctcttgtcaataccatcccaggtactgctaatagtcctgtggcctgttgcctacaatggacagtaatgctaaatctcaattcaaagttagtggggaaaaatatgacgatagatcccttgatttata

SEQ ID NO: 53001 - DNA, 601 bp, Human
catgccactgtaatccatccagcttggataacagagcaagaccctgtctcaggccgggcgcagtggctcacacctgtaatcccagcactttgggaggcacaggtgggcagatcatgagatcaggagatcgagaccatcctggctaacactgtgaaaccccatctctactaaaaatacaaaaaattagccgggtgcagtggcaggcgcctgtagtcccagctactcgggaggctgaggcaggagaatggcatgaacgtgggaggcagagtttgcagtgagccaagatcgtgccactgtactmcagcctgggcgatagagtgagactccatctcaaaaaaaaagaccctgtctcaaaacacacacacacacacacacacaccccacacacacacatgatacagtgatatagatacttgtttatcagtgcattaaaaaaaaattaggcagatctagtatcttctatgattttgaaggtttcaaaacatttcaaaatacttccaagtatttcaaaataactgccacagctgtaatgtgatatgtaaatatctgattctcttgtcaataccatcccaggtactgctaatagtcctgtggcctgttg

SEQ ID NO: 53002 - DNA, 601 bp, Human
gagaagagccacgtcacctaggcaatccaggtgggaaagggctaacgcaaaaaattatgtttcctaaagattgggaagatttagaatagtagaacattcttgagttgcaggaaacctgagaaatcatcagaaccagggaatttaaacttttctgtgtgtgccttgaacctgtttggcagactgctaaagcccatgtactcccttctcagaataatgccctaaattgcataaaataaaactcagaggattacgaaagaaaacaattgtattgaaatgcagctatcaaaatatttaaaaaacraatgtatggctgggcatgacagctcacacctgtaatcccagcactttgggaggccaaggaaggaggatcgcttgagcccaggagttagagactagcctggacaacatagcaagaccctgtctctacaaaagatacaaaagttagctgggcatggtggcatgtactggtagtcccagctactcgggaggctgagatgggagggtcacttatgcctgggaggttgaggatgcagtgagcagagatcatgccactgtaatccatccagcttggataacagagcaagaccctgtctcaggccgg

SEQ ID NO: 53003 - DNA, 601 bp, Human
ctggcattcgaggctatttgcaacctggcaggtaacttcaacctcctgccctccaggcagtgctctctggagacttggtaatgcagccacttttgccagaccagagctgaatggtcctgccattaaaaagtccacacttcatccctcctctgcaacaccactcgcttttcacacacaactggctaattccagagtggagtagaaataaaagtaacatgactagaccaaggaacataagatgagagccaagaaaaacttgtaggtcattgaaaagactgccacgctagacactggggaagtracctactacacaaaggcaccaagggctgggcatggcccaccagtgggaccccacccagaacatgaggccagtcagtgcactgaacctcaccagaccagtgccaataaccaaagccatctaccactgagggtggaagggacttcctcacaagtggagacttggtagggtcccggcaggtgtcagcaggcatgtgtgctgttaaaacacacgcaacagagaagagccacgtcacctaggcaatccaggtgggaaagggctaacgcaaaaaattatgtttcctaaagattgggaagatttaga

SEQ ID NO: 53004 - DNA, 601 bp, Human
tcagatcctttgagaaatgaagatctccatttttccccacaaaagaaatagcttgggcctatgggatgatatttacatgaagctgttgtcgtcaacatcaaacaggattcctcatttattgtttcaatccgttttatcccactcaggcacacactctccataaaatgaatgccttgcattcatatggtatttttacttctttcatttaacatccctgataacataaacatctcccaaatcccccaaatccctctgtttcttgcattacagcagggttgggggtgtgagctgcagatgctakgcagacaccatccacataaacagataagagccgcggagaacatccacagaacatctgcgaatttctgtacagaacctatgtgagtcattctgttctagagtcctccagtggtggattcaacccacttacatcagaaggattttgaaaagaaatctaaaactagccttgacaacaaaagagatggtgtgatcaccttgctccatctcaacacatttagaatgactgcacttctctaaggagtatcatagcatgcacctcctactaacttaaaagacatgtgctaaacagtcagctcagctc

SEQ ID NO: 53005 - DNA, 601 bp, Human
agacagagggggtgaagtgtcaagacatgatcacgaattgaaagaggtccctcttcttctccctccccaactaatgctccttccacatacttccccacttgagataagcagccaacaagcacctgccacgtgtctgaccctatgactggcagggactgctaagatgtaaagcaaacagagttgctgctcctgtgagataaagagcttgcaggtacgtggagtggatcggggggagtggacggggggcagtggacgggtgggagtgacaacgcgattgcttagagggtgaagacctgactawcctgccttcactaagcctcaaaacattcccggaagataagcatcattgtcccatcttgtagctgggacacactcaaaggatttaaaggctttgtaacggtgcagtgataggattcgaacccacgtctgtgtgaatctaagcccatgctcgttccactgcatcacactctctaccactagtgcctggcatcattgaattgctcacttcagatcctttgagaaatgaagatctccatttttccccacaaaagaaatagcttgggcctatgggatgatatttacatgaagctgttgtcgtcaa

SEQ ID NO: 53006 - DNA, 601 bp, Human
ccaggcaccccacccacttccctgaacccccgacagccatgccctccattatgaaagacaagagcctgtgggcacctgcctgccctcggtgcacacacctggggctgctgggaagccctggcctctgtgcctccatgctcaaggcccagggctggctgctggagggaggctgtctggctcatgggtctctctgatgacgggtcagcccagtaccaccagcacttccccagtcccagcctgccaggcctgggcaccgcgtggcctgtgtggtacatgtgtccacagaggatggcagcccaayggataggagaacgaaggtacccaggtagctcttcagcactcccagagtctaagagggccccagagaaaggctcgaaagctgcctctgtggcctgtgtgaggtcagagtggagacagagggggtgaagtgtcaagacatgatcacgaattgaaagaggtccctcttcttctccctccccaactaatgctccttccacatacttccccacttgagataagcagccaacaagcacctgccacgtgtctgaccctatgactggcagggactgctaagatgtaaagcaaacagagttgctgctcc

SEQ ID NO: 53007 - DNA, 601 bp, Human
aaggcgcttaaggaacaaggagactcttggtcaccttagtccctgcttgacacccagtacagtgggaggagtcagcagagggtgtgctggaggtgagtgctgggagactgagtgaggaaggcagtggcgctcccctctggctagcctgggttcatcggtgcccgcactcttccttccgccattcattcattcaaaaatcactccacgagagcctcactctgccagatgctgtggataaacagtggaggctggcactgtgcctttgtctcaggaatccccctgccaggcaccccacccactwccctgaacccccgacagccatgccctccattatgaaagacaagagcctgtgggcacctgcctgccctcggtgcacacacctggggctgctgggaagccctggcctctgtgcctccatgctcaaggcccagggctggctgctggagggaggctgtctggctcatgggtctctctgatgacgggtcagcccagtaccaccagcacttccccagtcccagcctgccaggcctgggcaccgcgtggcctgtgtggtacatgtgtccacagaggatggcagcccaacggataggagaacgaaggt

SEQ ID NO: 53008 - DNA, 601 bp, Human
tccgacaagctggaggggaacaggcggtcagtccttgacatctagtctgttgtctgaggccctctggagggaaggaatcctgtgaatgtcctttccctgccagcccccaaggagatggcccagagacccttccccaagcatgctcctctgtttccaagacaaacaggagcctcgggatggttgctgggctccagggggtgccagtgacatgtaatacaattgagtggtgccctctggagttgtgcaaggagctggcgctggctggtggtgaagccctgggagccagtctcccccatggcargaaaacaaagctgtggcttcaaggtacgaagggcacagcctcccacagcgtttccccttaaggaaggggacagtggacgtgggtttctttgcaagttaatctcactggaaggttcttcacaggcatctttttccattagcccgtcagtgcttctgtacattagattgcatctaacactcactgagctgccgtggtacccagcgtcttgctgggtgcaggacagccacagcgaccatggccccagcccacaaggcgcttaaggaacaaggagactcttggtcaccttagtccctgcttgac

SEQ ID NO: 53009 - DNA, 601 bp, Human
tctgttgggtggagagatgttaaataaataatcacaaatgtgtatttatcacagctatggagtgtgagctggagaataagtacagggtgctgtggtcacccctgagtccactctgagctctcagttgccccaggagtcctgtcccatcatacttcatccctgtccccacggagaaggccacccctcactcagctcagatgcagaaaacagatgacccatctttttccctaatggaatgaagcagagtcagggttttttgtgtctttgcattgtttcatataatctccctcaaattcttaarcccctcctcccatggaaactgttgaagatgccaatttcatactgattccggatgcaaagtctgttctgtctgacctcactgattcctgggggacgtgttaagacctgtgaaatatgtagagctcataaatcaactctggctagatttccacaaatgttttagtttgaaagaaagtcagacagcattgacaagaccccaagtattctgcttccccggccccaacatacccgccggccccagagtctgtggatgctggctgcctgcagcagggcccagcactggctgtccccatctcccctc

SEQ ID NO: 53010 - DNA, 601 bp, Human
taaaattatttgggtttcatatttcctgccaaaccacccgactcccgccaagaggctgtgaactcgccagggggtgatgatatctgataaattatgcctagtgttccattattggaacgctaagcatgtgggagttatttatattctcctgttcaaggtcatcaccaaggtctgattgcaaaaattttaaaaattgcaacatcaggcataaatgggttaatctttacatgcacagctcagacctcaacacataaatggtaaatggataaatgaattccatcagtggtcataagttaacctrtgtagaaactgtacctaatatataatccatttctctttctcatttgaatcccacatatataattcactcatgtagcttttctgcttatttaacaaatatttatcaggcactagaaaaatactatggtgagaccgcgtgtggtggctcacgcctgtaatcccaacactttgggaggcagaggtgggcggattgcctgagctcaggagtttgagaccagcctggccaacgtggtgaaaccccgtctcttctaaaatacaaaaaatagctggtagcacacacctgtagtcccagctactcggg

SEQ ID NO: 53011 - DNA, 601 bp, Human
gggaaaatcaacaaacaaatacataaaaagccaccaatcagtggctctcaaagtgcagcccccgggccagcagcgtcagcatcactcagaagaaaagaccccaccccagacctactgagtcagaaactcggcagcaatctgtgtttgaaggcctccggtggatttaatgcacgctgaagactgtgctggaaaatgataaggctgtgattgggagtaactgcggtgtaatttcagacaaggcagcctgagtaggactctctaaggggtgccatctgaactgagctgaagccagagaggagartgagcccgcaatgtgaagagccaggagagagttccaaatagaaggaagagaaagtgtgaaggccctgaggtccagaagggcctggtatatttggggtagagaaaggagctggcatggtgcctatgaccaaccagggcacgtcgtgggatggcctaaaagggcctaaagctggcgggcccacatgctggtcagtctaaatcacaagcaaactctgggatgtgggacagtcatggagcccttccacatattctctaaaatgaaggggcagacaggcgcggtggcctgtagtcccagcacttt

SEQ ID NO: 53012 - DNA, 601 bp, Human
aagatagataacatttcatggttaaaacccaactccaatctggcaaaatttcaactttgttcttctgaagccaaaggctagtaggcctgagacacagagggttctgaaagtaccacattgggaattctacgaggtgttctatgcaagccagtcacgacattttaattctcttacccagatgtcctgcggcttcgttggaattctgaacccagaaagtaaaatccgtcacctgggattttatgaaaattatccatgtaatctttacccaaaattaataatgacccttagaaaaggctcaagyatgaaaaagttaaagaaaaaggtagtaaagcagagaagagctgagaccaagtagctcccagagtttctgccaatgcttgtccttcttccctctcaggtgcaagacgattgattatgaagcaagaggttccagctgagccttcagccaatagccagctaacaggtacttagcaagcaccaactatgggccaggcagtggggatgcagcaggttacaaggcaacgtttcttcccctcttgaagtttacagctaagggatgggaaaatcaacaaacaaatacataaaaagccaccaatcagtg

SEQ ID NO: 53013 - DNA, 601 bp, Human
agggtctcctgccccatattttctgtctttggaaagagatgatgctagcagtcaaattcattcaatgtacaactatttattgagcttgaatatggaaagaatagggctgtatgatttacaaagaggactggtcacttactatccccagtgtctcgaaatgaatgaattatctaaacgaatcttaaagatcatccttcaaccacggagaagtgacttgctcaaggtcattcagctgctgaatctgatctctttgcacaactcatgatttttggagattaagaaaccagagactttgggcttattcagcgctgccaatggcctgccaggtgatcttggacaaatcctgtcatatcacatacctatcctccagatttctcaaccaaactataaatgtccctccttggtaaagacttcctcaacccccttgggcagaatcagctgttcccacgattctcagtccatagcagccttgtggtggtttatgcaggagttgccaaccctcctcctggcaagcctccaacccacatactccattgcctgtggcccccaatggtagcacgaagtatggaccaggtcagcccaagcctaccctcagcactcc

SEQ ID NO: 53014 - DNA, 601 bp, Human
ggatcacaaggtcaggaattcaagaccagcctgaccaatatagtgaaacatgtctccactaaaaatacacacattagctgggcatggtggcgtgcaactgtagtcccagctactcgggaggctgagacaggagaattgcttaaatgcgggaggtagaggttgcagtgagccaagatcaagccactgcgctccagcctgggtgacagagtgagactccatctcaaaaaaaaaaaaaaaaaaaaaaaagaaagaaagaaaaaacaaaatacgtttaggtagtttattgttgttttgcttaagytacttggagctgggtttctgtcagttgcaatcaaaaagtcctgatgactaatacactgaatttaatcaaatttccctatagctttatggagacacagagtcctaatgttggcatttgcttcatcaaaagccacagcaccaagtgtaacaagtgaatgtatttcactttaaaaggtaaatgagaaatttgctctatgttcctagaaatctctgcagagcacgccagtctaaagttgcccttcttaacctttttcatgttgaggcacacatagaacattacacaagtgtgtaaggtacaatg

SEQ ID NO: 53015 - DNA, 601 bp, Human
aacagcaccctaattttcctttaaggaactgcctttctgcacttttggtccatgcacggcaggtagctttggacccactgctggttccggggtgggcttgtgatgtaggcttgctaaatcaaagcccatgggttgctagtcattgtgacgaactcagggatgggcttgtgacccatgctggctactagagcccaactatgaccttttgccagagctcgagattaaggcaatctctctgggttgttaaactagaaagacataagcctggagctgccagcggcctccacttgagagatcctgycctgagaatgaagaagcctatgttttagagatagtcattggagagagagaaaaaaatgaaggccatatgacactacttaagcccttgccctcaggcatgtctgaagctagttctacttctcagctttcagttatgaaaaaacaaattaggctgggtgtggtggctcacgcctgtaatcccagcactttgggaggccgaggtgggtggatcacaaggtcaggaattcaagaccagcctgaccaatatagtgaaacatgtctccactaaaaatacacacattagctgggcatggtggcgtgc

SEQ ID NO: 53016 - DNA, 601 bp, Human
tcaaaatcaaacaaaaaagaattcaggtgagggactaggcatttcttcagatgttctgtaaagaggattcatggtattatctacctgataactttcaatgaaagggagagttagttttctttgggggcagtatcagtacttgcttacctgaggacaggtgagcagctcagatggcagctctaggcccctacttttgttactagtgaccatcccccaatgtcatggaagggtgtgtgtatgactgagatagtgcatcctttagtgagtgagtgcatcctttgttatctgtcactgtgggctmagaacaaactttgggtccttctgtttcttctctttccatgcaaaagttaggattccaggtacagctcttgccctcccaccatccaaacttccttcatccggtaacagcaccctaattttcctttaaggaactgcctttctgcacttttggtccatgcacggcaggtagctttggacccactgctggttccggggtgggcttgtgatgtaggcttgctaaatcaaagcccatgggttgctagtcattgtgacgaactcagggatgggcttgtgacccatgctggctactagagcccaacta

SEQ ID NO: 53017 - DNA, 601 bp, Human
caaggcgggtggatcacgaggtcaggagatcgagactatcctggctaatatggtgaaaccccgtctctattaaaaatacaaaaaaattagcccaggcgtggtggtgggcacctgtagtcccagctactcaggaggctgaggcaggagaatggcatgaacccgggaggcggaggttgcagtgagccgatatcacgccactgcactccagcctgggcgacagagcaagactccatctcaaaaaaaaaaaaaaaaaaaaaaaagaaatcatatcagtagctaaaaatcttcccactcacacacmcaaaaataccaaatctcaatgatcttataggcaaattcaaataaactttccatgaattgaatttgaataaaatttccatgaatgacctaaggttagaccattctaactttccagagaatagaaaaggaacaatatctcactctatcaagcttatatgtggacaccaaaactagtaagagtaatattaaaaaagaaatgtggcaggtcattctactttatagacattaatgacaaaaatcctaaataaaatgttagccaaacaaatccagcagtatattgtaaacaaatcatactataaca

SEQ ID NO: 53018 - DNA, 601 bp, Human
agctaagcaaccagcttaagaaattagaaaaggggccatgcacagttgctcatatctgtaatcctagcactttgggaggccaaggcaggcagatcacttgagctcaagagttcgagaccagcctgagaaacatggcgaggccctgcctctacataaaatacaaatattagctgggcgcagtagctcatgcctgtaatcccagcactttgggaggccgaggcaggcagatcacgaggtcaggagatcgagaccatcctggctaacacagtgaaaccctgtctctacaaaaatacaaaaaaawttagccgagcgtggtggcaggcgcctgtagtcccagctactcaggaggctgaggcaggagaatggcatgaacccaggaggcggagcttgcagtgagccgagatcatgccactgcactccagcctgggcgacagagtgagactctgtctcaaaaaaaaaaaaaaaaaaaaaacaacaaatattagctgggcagtatagtacatacctgtggtcccagatacttgaggcccaggagatcaaagctgcagtgaaccatgatcatgccactgcatacagcctaggcaacagaatgagactctcg

SEQ ID NO: 53019 - DNA, 601 bp, Human
aaaataaaaaatagaaaaattagctgggcaggacgtggtggcccacacctgtaatcctagcatttatgggagaccgaggtgggcagatcacttgaggtcaggagttcaagaccagcctggccaacgtggtgaaaccctgtatctactaaaaatacaaaaattagccaggcgtggtggcacacacctgtaatctcagctacttgggaggctgaggcaggagaatcaattgaacccaggaggcggaggttgcagtgagtcgagattgtgccactgcactccagcctgggtgacagagctagamgatatctcaaagaaaagaaaaaaattagctgggcatagtggtgtgcacccgtggtcccagctactcgggaggctaaggttggaggatcgcttgagcccgggaaatcgaggctgccatgagccatgtttgtaccattgcactccagcctgggtgacagagtgagactctgactcaaaaaaaaaaaaaaaaagcagttcttaggggctcaggaaaagactgagacacttttcttctttaatatgctaaagaggttgttgatccaaaaagcagaaaatgtactcatcaaaataagagctgttc

SEQ ID NO: 53020 - DNA, 601 bp, Human
ccacctcagcctcccaaagtgctgggattacaggcgtgagccaccacgcctggccagctttgtaattttaaacaagttttttggttggttgtttacttgcccctaaaaaccttcgtttcctcgtttgtgaaaggagttgataatgatggtagttaattcatggggttttgtgagaatcacacataactaaagctctttacacagtaccaggcacagaattggccctcagtcaagactggcaatagcttcatctcaagaagtaggaggaggaagaagaggaagagaagggagtgtgagggcsgggagcccacctcctaaaagaaaaaataaagaaggaactgaaagtcaggttctagtccggaaccttccactagctccgcagtggccttccagcaagtctttctcagctcgtttgagaaaataaggcctctgaggtctcttctatctggaaaggttggtgaatccaaatgctctggggcccagttgagctccctgccctcactactcactgcctaaacctcttacctctgcagggctaaggaggccctctggaggatgcaaaaggaaaagacggaaaaaaaaaaaaaacggctgggagatg

SEQ ID NO: 53021 - DNA, 601 bp, Human
atttttagtagagacgggcttttcaccaggttggccaggctggtcacaaactccagacctccagtgatccgcccacctcagcctcccaaagtgctgggattacaggcgtgagccaccacgcctggccagctttgtaattttaaacaagttttttggttggttgtttacttgcccctaaaaaccttcgtttcctcgtttgtgaaaggagttgataatgatggtagttaattcatggggttttgtgagaatcacacataactaaagctctttacacagtaccaggcacagaattggccctcartcaagactggcaatagcttcatctcaagaagtaggaggaggaagaagaggaagagaagggagtgtgagggcggggagcccacctcctaaaagaaaaaataaagaaggaactgaaagtcaggttctagtccggaaccttccactagctccgcagtggccttccagcaagtctttctcagctcgtttgagaaaataaggcctctgaggtctcttctatctggaaaggttggtgaatccaaatgctctggggcccagttgagctccctgccctcactactcactgcctaaacctcttacctct

SEQ ID NO: 53022 - DNA, 601 bp, Human
acagcccacatctcttctgtaaccccatctccacagaggaattaaaattcaagcatcacggaatcagggtagagtgctggggagacagggatggcggggagaaagatgaaggtagagaaggggaggcagggaaggaaagaagcaggaacaaagaggtctggactatgacgtgggcatcttgagcctctagtaactcgattcaaaggacaacacaggcaagtgggaacaccagctttggggtcggatctggttcaaattctgctgccctcatttttttagctttgtaattttttttttttttaatacagagtctcactctgtcacccaggctggagtgcagcggcacgatctcagctcactgcaacctccacctcctgggttcaagtgattctcccgcctcagcttcccaagtggctgagaatacaggtgcatgccaccatgcccagctaatttttgtatttttagtagagacgggcttttcaccaggttggccaggctggtcacaaactccagacctccagtgatccgcccacctcagcctcccaaagtgctgggattacaggcgtgagccaccacgcctggccagctttgtaattttaaa

SEQ ID NO: 53023 - DNA, 601 bp, Human
aaaacggtcaagataatacatttcttgttacgcatttttactacaataaaaaagtgaatatctgtaaatcaaaacatatttcttcattgattgcattctaagttctataaactgttcccactgaaagaaataatcgatctgtgatcaaaaacaaaaccccataaagaaaagtccagcagccatcctgtgctcctgagaaacttaactccaccccaacagcccacatctcttctgtaaccccatctccacagaggaattaaaattcaagcatcacggaatcagggtagagtgctggggagamagggatggcggggagaaagatgaaggtagagaaggggaggcagggaaggaaagaagcaggaacaaagaggtctggactatgacgtgggcatcttgagcctctagtaactcgattcaaaggacaacacaggcaagtgggaacaccagctttggggtcggatctggttcaaattctgctgccctcatttttttagctttgtaattttttttttttttaatacagagtctcactctgtcacccaggctggagtgcagcggcacgatctcagctcactgcaacctccacctcctgggttcaagt

SEQ ID NO: 53024 - DNA, 601 bp, Human
agcaggatcttgaagtgatacctatacacctatgttcatagcagcattattcacaatagccaggaggtggaagcaacccaaatgtctattagccgttgaatgaatacccaaaatgtggtacattcacatgagggaatattgttcagccttaaaaaggaaggaaactctaacacgtgctacaacatgaatgaagcttggggacagtatgctaagtgaaacacgccactcacaaaaagacaaatactgtatgagtccacttatatgatatatttaaagaggtcaaattcatagaaacagaaartagaatggtggttatcacgggctagagagaaggggaaagagagaaagttgcttaatagatacggagtttttgtttggcaagatgaaaaagttctgcggcacaacaatgtaaatacacttcacactaccgcgctgtgcacttgaaaacggtcaagataatacatttcttgttacgcatttttactacaataaaaaagtgaatatctgtaaatcaaaacatatttcttcattgattgcattctaagttctataaactgttcccactgaaagaaataatcgatctgtgatcaaaaacaaaacc

SEQ ID NO: 53025 - DNA, 601 bp, Human
cctctcagcctccagaaccatgagctaaataggcctctattctttataaattacctggtctgtggtgttcagttatagcaacaccaaagggactaagacagctgatatgatttaaaacaacaattaaaaacaaaaaacaacaacaaaaaatagaaaaaaacgtgttggtgaggacgtggagaaactgaacacttgtgggaatgtaaaattgggtagccactatggaaaactgtatggtggttctccaaaaattaaatacaaaattaccacatgatccagcaatattacttctggatatacrtacaaaataattgtaagcaggatcttgaagtgatacctatacacctatgttcatagcagcattattcacaatagccaggaggtggaagcaacccaaatgtctattagccgttgaatgaatacccaaaatgtggtacattcacatgagggaatattgttcagccttaaaaaggaaggaaactctaacacgtgctacaacatgaatgaagcttggggacagtatgctaagtgaaacacgccactcacaaaaagacaaatactgtatgagtccacttatatgatatatttaaagaggtcaaat

SEQ ID NO: 53026 - DNA, 601 bp, Human
ccaggatggtctcaatctcctgacctcgtgatccgcctgcctcggcctcccaaagtgctgggattacaggtgtgagccaccgcgcccggccaggaatcagtacttttaccaacatcaagctgatgctagcacaagtgttcacacccgcagaaacactagcctagccataagactgtgagtgatgcgagggcaggaaacacactttatctttgtagcccctactccaagcacagtgcctaatacagaatattaatttaaaacccagtcactcacctcataactgttaggatgactactgctrtggtttgaatgtgtccctcaaagttcatgtactgaaattcagttgccactgtgacagtattaaaagtgtgggaaatgcaactaaaattcttaggtcgattacagctggagcttttgggaggtaaataaaattagataaagtcatcaggatggggcccccatgatggaattggtggctttctaagaagacaaagacagacccgagctgatattcacactcttgctttctggccacatgatgccttccaccgtgttatgacacagccagaaggcccaccagatgctggcaccatgcattagg

SEQ ID NO: 53027 - DNA, 601 bp, Human
gaagtggcgcaatctcggctcaccgcaagcttcacctcccgggttcacgccattctcctgcctcagcctcccgagtagctgggactacaggtgcccaccaccacgcccggctaattttttgtatttttagtagagatggggtttcaccgtgttagccaggatggtctcaatctcctgacctcgtgatccgcctgcctcggcctcccaaagtgctgggattacaggtgtgagccaccgcgcccggccaggaatcagtacttttaccaacatcaagctgatgctagcacaagtgttcacaccygcagaaacactagcctagccataagactgtgagtgatgcgagggcaggaaacacactttatctttgtagcccctactccaagcacagtgcctaatacagaatattaatttaaaacccagtcactcacctcataactgttaggatgactactgctatggtttgaatgtgtccctcaaagttcatgtactgaaattcagttgccactgtgacagtattaaaagtgtgggaaatgcaactaaaattcttaggtcgattacagctggagcttttgggaggtaaataaaattagataaagtcatc

SEQ ID NO: 53028 - DNA, 601 bp, Human
gccccccacacactagtcctagccccttgtagttcagcaaaaaaactggcaataagttttatgctttaataatgtctctgagttagcttcaatcagaacaatttgactctcatattaaaaaaaaaccaaaaaacccaaatgccataataaagtaagctccccaaaatatattcactgacactaaagggttgcgtcaagagtctgctcataagtgcctgctcaattgggttcttaataaatgcttttccaatcagtgttagcagtagtggaggaaattctaataaaaaacaactgacgcaakgtacttcacacttctctgcactcctctgccacagacttcccagaagttgctgtctattgtcactgctctgcctgcacacctcccgttcttgactccaatcaggcttccttctcttttattccattaaagcctctctcatcaaagtcaccaatggcctcctcaatgacaaatccaacaatcctttctcattcccagtcttcatccttcaccccttcttagcagcatttggcacagtgaacctctctcatcttctacagagactttcttcattaggcttctatcaccctctcttggtttggg

SEQ ID NO: 53029 - DNA, 601 bp, Human
acgaggggaagaggctaaagcctgctgggaccatagaggtgagggagagggagcaagagagaaagagccctgaaacataccacctcccagttgaggggtggccacatgccctgggagtctagaagtgcgggtcacacccacaaacagtgcagggctgaaacagccacaccctgctccccatcaccctttggacttggtaagagatacaatgacatgaacctaaaataaatatttggattaaacacttttcaggattgcatgtttacctggctgaggaatggggctgccctttcccagccamccctctatgggcaccagcagcttcctggatgtctccagtgaggaaggcagggaggcgagggagctacatgtggggccaaccagctggctgacctgccagaccacccttgccctccctcccaccataaaggcacagtgcccgagtcccactgcccccaatgcctctgctcaggagtcatttatgctataccagtgcggcaacactggtatcggtactagggattcaaagataaatgacacacaggccctgtctgtttacagtctagttgaaaacagacaagggacgaggtaatcccaactc

SEQ ID NO: 53030 - DNA, 601 bp, Human
aacgtgggggctccacccctgtgacctcatccaaacgcagtcacctcccaaaggacccaccttgtaataacgtcacattgtggataatgggcttcaacatatggatttggggggatacaaatgttcagtccatagcaaagtgcttggcctgatggagtaagtgatgtttcctctttcctcccgggacagcttgacatcccagatgggaaagaactttattctcaacaatcataggagggaggagcatcatagaagggaaaagatacaccttcctggcctgaaaattgacatcaacaggacytctcaggggatacccaggaaatctatttttcaagctggccgtgagaatacccaggtgtgcaaattcagcccttggactcaatcagtccatcagcagcagcaaacattcccagctgggtcactctcagagcatgatcatgaaatacgcacgtgcacccttcccatgcctgcagtgagaagaccctgccaccacttccgatcccatcacaactcaccagggtgatctggtacacatcagtgaccttctgcatggcagcctccttatgtctaaaatggaactcctatcacctgcccccctaga

SEQ ID NO: 53031 - DNA, 601 bp, Human
agttctcgaggctggaagtccagggtcaggtaagcagcacagtcaggttctggtgggagccctcacagggcggagagaaagctcagggttcttcatccccttatcagggcaccagtcccaacgtgggggctccacccctgtgacctcatccaaacgcagtcacctcccaaaggacccaccttgtaataacgtcacattgtggataatgggcttcaacatatggatttggggggatacaaatgttcagtccatagcaaagtgcttggcctgatggagtaagtgatgtttcctctttcctccygggacagcttgacatcccagatgggaaagaactttattctcaacaatcataggagggaggagcatcatagaagggaaaagatacaccttcctggcctgaaaattgacatcaacaggacttctcaggggatacccaggaaatctatttttcaagctggccgtgagaatacccaggtgtgcaaattcagcccttggactcaatcagtccatcagcagcagcaaacattcccagctgggtcactctcagagcatgatcatgaaatacgcacgtgcacccttcccatgcctgcagtgagaagac

SEQ ID NO: 53032 - DNA, 601 bp, Human
tctaacatactatgcgtgtcttagtcctgtggggctgctctgacaagaacgctatagactatgtggcttaaacacgaggcttttatttctcccagttctcgaggctggaagtccagggtcaggtaagcagcacagtcaggttctggtgggagccctcacagggcggagagaaagctcagggttcttcatccccttatcagggcaccagtcccaacgtgggggctccacccctgtgacctcatccaaacgcagtcacctcccaaaggacccaccttgtaataacgtcacattgtggataatrggcttcaacatatggatttggggggatacaaatgttcagtccatagcaaagtgcttggcctgatggagtaagtgatgtttcctctttcctcccgggacagcttgacatcccagatgggaaagaactttattctcaacaatcataggagggaggagcatcatagaagggaaaagatacaccttcctggcctgaaaattgacatcaacaggacttctcaggggatacccaggaaatctatttttcaagctggccgtgagaatacccaggtgtgcaaattcagcccttggactcaatcagtcc

SEQ ID NO: 53033 - DNA, 601 bp, Human
ctagagagtattaaagcgaattatactggaaatgaagatacttgactctaagactcttccgaaagcaagagggaaattcagttaagccaccagacacatcggaagagacaagtccaccatctaccttattgtggcccgtctctcattcccagaggatgaagaatatctagtggacattggctgacaattccaaatcccacagagcctcaggctgaggctcacagtgcctggaggcctagtcccaccctagcaatggcccagggctgatttgaaagcagcctcaacttccagaagttctaamatactatgcgtgtcttagtcctgtggggctgctctgacaagaacgctatagactatgtggcttaaacacgaggcttttatttctcccagttctcgaggctggaagtccagggtcaggtaagcagcacagtcaggttctggtgggagccctcacagggcggagagaaagctcagggttcttcatccccttatcagggcaccagtcccaacgtgggggctccacccctgtgacctcatccaaacgcagtcacctcccaaaggacccaccttgtaataacgtcacattgtggataatgggctt

SEQ ID NO: 53034 - DNA, 601 bp, Human
catggccaggcagttcttctgaaaatcttgcaaatttcctactttccttacatcccctaccccaaagactccaggtccccactgtcttttctctaaatgattgtaataacctcatcagttgtctggcagctccaatccctccctggtgaaagtacactaaatattaaacctccagaaccacctcaaaacacaaaaatggcaagtttacatttcctccctagaaccctcaaggcatgcgctttatactttggcaacactgagagttaagcctactttcctactcacatatgggcaaagcacrtctagttttatagcagttcacttcctacaatatacttagccacgtgcatcggaacctccagtttcttgaaagcaggaaaagggccttattcacaatcatagcttaagcaccccacacagtgcctggcatactagagagtattaaagcgaattatactggaaatgaagatacttgactctaagactcttccgaaagcaagagggaaattcagttaagccaccagacacatcggaagagacaagtccaccatctaccttattgtggcccgtctctcattcccagaggatgaagaatatctag

SEQ ID NO: 53035 - DNA, 601 bp, Human
aactttaatatgcgtatgactcagtggggatcttgttaaaatgtagattctaattcattgggttctacaatcctaactagctcccacatgaggccaatgctgctggcttagggaccacactttgagtaacaaggtgctagactgttccaagtgggatttggttctgtatccatgcagcctgctcagagtttcagaaactattaggttggtgcataagtaactgcaatatttaagagagtctaagagggaatttaagttttcaaaaatcaagcagcatgttcacttataagtgggaactgascatgaagatggccacaatagacattggggactactagaggaggaagggagggaggcatgggtcaaaaaactaactactgggaactatgctcagtacctgggtaatgggatccatcatacctcaaacctcagcatcacacaaaatacctaggcaacaaacctgcacatgtacccctgtatctcaaataaaagttgaaactatttttttttaatggggaaaaaaatcaagcagcgattcttaactggattcttctctctctaagataaagcctgctggttataacagagttgttatttttgg

SEQ ID NO: 53036 - DNA, 601 bp, Human
tcaagctatgatcttctacagagacaaactatgcaactaatggagatcacattgtttggttcttgggtaattactttcatccccagagcacttggtaaacatcagctgactttagttgctttcaaactgggcagtgaattggccaagcccattcaacttttgccagtgtatggtccctgccacggggccaggggaaacacatgtcctcttgagcatcatgcatcaagatgtcctgagaggaaggggacaagtcatgtctaatgtcaatctagacatgggtttttttgtttgtttgtttttktttttttttttttttcaaaaagccatgaggctttggccattatcatgaatgtaaagcaaacagacgtggagttcaaactagatttccatttactaaaatttttgccatttgtctatcgacagaaattttggaatctttagaagccagtagtttccaaacctggttacccaagagaattgcctgactaaatcagaatttccagggctgaggcttggaaagctgtgttattttaatgacacattttacctaaatgaatccaatgcaaaactgtatctaaaatccactgtgccaaatcaatac

SEQ ID NO: 53037 - DNA, 601 bp, Human
cacaggtgccagcctgactgcctggcacatagctcccttccccggggaggtgctgtttctgacagctgtggaagatagaagaaggttggtctctgcctcctgcagatgctgttctagaattcactaaagacaccaggatgacagcccaggggtttcatgggctataagcatggttagttctgtgattcaactacagccaaagccagggacttctcccccttgagccccaggcatatggcgggagatctggacaagaggtaaggaaagccagggtacattccttcatggagtctccatctcyacctctgcacccaggcatctctgggcccatctatgattctataattgtaggcatccaaaagcataaaggtacgtgtgcctaatggccatgtatgatcaaccttttcacaatctgattcttgcctcttcccatgccttctttgctccaatactgtgaacaggcaaggtctgactttgtgagcctgtgtacctaacgtcggctgaatatctcagttcttgtgtgagaacggccatcagccaaagggaaacattctcactgggtgacactgggagaagctttccaagagcccttggaagacac

SEQ ID NO: 53038 - DNA, 601 bp, Human
tgttctgcaacagggctgatgtagcctgcctcgtaggtagatgtgagagttcatgaattaacaggagcacaggtgccagcctgactgcctggcacatagctcccttccccggggaggtgctgtttctgacagctgtggaagatagaagaaggttggtctctgcctcctgcagatgctgttctagaattcactaaagacaccaggatgacagcccaggggtttcatgggctataagcatggttagttctgtgattcaactacagccaaagccagggacttctcccccttgagccccaggcayatggcgggagatctggacaagaggtaaggaaagccagggtacattccttcatggagtctccatctccacctctgcacccaggcatctctgggcccatctatgattctataattgtaggcatccaaaagcataaaggtacgtgtgcctaatggccatgtatgatcaaccttttcacaatctgattcttgcctcttcccatgccttctttgctccaatactgtgaacaggcaaggtctgactttgtgagcctgtgtacctaacgtcggctgaatatctcagttcttgtgtgagaacggccat

SEQ ID NO: 53039 - DNA, 601 bp, Human
gtgtgtgtgtgtgtgtgtcctccccagcctccatgacctttggaagagctggcatcaagcatattccctcccgctgtatggtacccagaagcagactttactgggagttctctcatctccctgctccctcctggctgctgtcacaccagtcgggtgcctgggcacttggaggattctgccacagcaaccatagcttggctccccacaggtgaggcagtgactatctgctgcccagatgaccagcaccctggcaactggaggaaagcgctcaccagctctcccagaacctggaaaagcccarcactgcccctgccaggaagaagtcgtcatctgcatcaagcagcacagctctggtgaccttgcagtctcacctgcactggcacctctcccttgagacatccacagagtggccttctcaatctgaaacaactgctcacttaggaaagtcatcaaaacccatcaatatcacctcctcgatgccttccaaggaggccatagacagaaagggctttcaggccccaggacagtggcctacatatttgggaaactcttttaggatttcatacccttagctatgtctcacattccccagccagacagt

SEQ ID NO: 53040 - DNA, 601 bp, Human
ccaccacgccaaccactgtcagcttacacacctgatggagctaaaactggaagtgttcacacggtgggcttcctcggggggaggctgaaagactcatcacacattccagctcacagcggaacttcttacattaaatacatttgacttaaatcacagaaggaaaaatacattgaatcactccaaggacattctttggcagggcctccctttccgcatcagtggaaaagtacaagctatgacaacctgagcaagggtcagtatcctcatgggcaaacagggtctgctttcttttcctgtgcartagtcaggaagagtcccctaagagaaaagaatgctgggtgcattcaatcctttattcattcacttgctcactcattcattcattcattctttttttttttttttttttttttgcgatggaatctcgctctgtcgcccaggctggactgcagtggcgcaatctcagctcactgcaagctctgcctcccgggttcacaccactcttctgcctcagcctcccgagtagctgggactacaggtgcccaccaccacgcccggctaatttttttgtatttttagtagagatggggtttcaccatgt

SEQ ID NO: 53041 - DNA, 601 bp, Human
gagacgtcaataagtccctgaagttttttttggcggggggggcggaatctctcacctttatagcctgaaaacacacctggtgtaatgctgtgtccctggtaatgttcaagaactattgaatgaatgaacacatgaacggcaaacatcaatccctcgcagcccccagaaaggtttttccagccaactagctgacaagcccatttgggtgtgtgtactttaaaaacagccaccaccacgccaaccactgtcagcttacacacctgatggagctaaaactggaagtgttcacacggtgggcttyctcggggggaggctgaaagactcatcacacattccagctcacagcggaacttcttacattaaatacatttgacttaaatcacagaaggaaaaatacattgaatcactccaaggacattctttggcagggcctccctttccgcatcagtggaaaagtacaagctatgacaacctgagcaagggtcagtatcctcatgggcaaacagggtctgctttcttttcctgtgcaatagtcaggaagagtcccctaagagaaaagaatgctgggtgcattcaatcctttattcattcacttgctcac

SEQ ID NO: 53042 - DNA, 601 bp, Human
ccaagatgacggcagcctccactccaccctgatgttaagcatgtgcagcctcagtggcaaagacccagccctgttctcagctgcaaggactccagcctcccctttgcctcccttccatgcagctctgcccaccgagcacagcctcccaggggagctggtgaataatgcttggccagaagctgctcctgctcaaatccacagtgaagtctatgacaataaatagtgccactatcggctggtgcgtatttacattttcccagcagggagtgatggatggcaattgtgtgctgggaacaacacygccttaggaatttctgttctttttcctgccttgaggggaatgaagggtgagggtgaccaacacaggagaagaatcactggagaggcttggtggcagcaagttcccaagcctctgtgcttgcgtaatttgcatcccacacaactgtgcctgccaagtcctacagagagaaaccagacgcatgccagcaggccaggctggactcagaagggcacaaagggccccatcgtgggcatgtgtgcgaagtattcaggccgaagatcaaaatccttgaagttcactcttttaaaaactccagcactt

SEQ ID NO: 53043 - DNA, 601 bp, Human
ctttctcccctgcactgcactttaggggagagcgcccaagatcctgaaatggacctcccgatgccacactctcactttgacctaaaggaagagacttttcattaaatattcacacattaatttactccacaaggatccacggtgcctcctggatctgcctggtccagaggaccccaaaaccttttctccttgtcagccctgccttcacctgcaccttggtgggtcaccttccctcccctcttcattcctgcatcagggtttgctcatctacaccttttctccaccttcaccgaatggtgaggtgcagtcggaagtaatactgaaagctgcaattcactgagcctgtgttatgtgcctgacacctaccttgttacttgtatttactctcacatcaccctgtgaggtgggctcacaatccccattttacagatgggaaaactgagtggaaagagctagtaagcaccaagccaagagctgagtccaggcctccctgcctgcctgactctaagtctactccgtgcaggtctaacagaggtcatgccacccaggaccaagcagattcaggggggagctggcagactgggctgagggagggctgagc

SEQ ID NO: 53044 - DNA, 601 bp, Human
cctttctcccctgcactgcactttaggggagagcgcccaagatcctgaaatggacctcccgatgccacactctcactttgacctaaaggaagagacttttcattaaatattcacacattaatttactccacaaggatccacggtgcctcctggatctgcctggtccagaggaccccaaaaccttttctccttgtcagccctgccttcacctgcaccttggtgggtcaccttccctcccctcttcattcctgcatcagggtttgctcatctacaccttttctccaccttcaccgaatggtgmagtgcagtcggaagtaatactgaaagctgcaattcactgagcctgtgttatgtgcctgacacctaccttgttacttgtatttactctcacatcaccctgtgaggtgggctcacaatccccattttacagatgggaaaactgagtggaaagagctagtaagcaccaagccaagagctgagtccaggcctccctgcctgcctgactctaagtctactccgtgcaggtctaacagaggtcatgccacccaggaccaagcagattcaggggggagctggcagactgggctgagggagggctgag

SEQ ID NO: 53045 - DNA, 601 bp, Human
ccctttctcccctgcactgcactttaggggagagcgcccaagatcctgaaatggacctcccgatgccacactctcactttgacctaaaggaagagacttttcattaaatattcacacattaatttactccacaaggatccacggtgcctcctggatctgcctggtccagaggaccccaaaaccttttctccttgtcagccctgccttcacctgcaccttggtgggtcaccttccctcccctcttcattcctgcatcagggtttgctcatctacaccttttctccaccttcaccgaatggtsaagtgcagtcggaagtaatactgaaagctgcaattcactgagcctgtgttatgtgcctgacacctaccttgttacttgtatttactctcacatcaccctgtgaggtgggctcacaatccccattttacagatgggaaaactgagtggaaagagctagtaagcaccaagccaagagctgagtccaggcctccctgcctgcctgactctaagtctactccgtgcaggtctaacagaggtcatgccacccaggaccaagcagattcaggggggagctggcagactgggctgagggagggctga

SEQ ID NO: 53046 - DNA, 601 bp, Human
cccctttctcccctgcactgcactttaggggagagcgcccaagatcctgaaatggacctcccgatgccacactctcactttgacctaaaggaagagacttttcattaaatattcacacattaatttactccacaaggatccacggtgcctcctggatctgcctggtccagaggaccccaaaaccttttctccttgtcagccctgccttcacctgcaccttggtgggtcaccttccctcccctcttcattcctgcatcagggtttgctcatctacaccttttctccaccttcaccgaatggwgaagtgcagtcggaagtaatactgaaagctgcaattcactgagcctgtgttatgtgcctgacacctaccttgttacttgtatttactctcacatcaccctgtgaggtgggctcacaatccccattttacagatgggaaaactgagtggaaagagctagtaagcaccaagccaagagctgagtccaggcctccctgcctgcctgactctaagtctactccgtgcaggtctaacagaggtcatgccacccaggaccaagcagattcaggggggagctggcagactgggctgagggagggctg

SEQ ID NO: 53047 - DNA, 601 bp, Human
tttctaactaaagcaaaatcatcctcacctctgtcacttcctggcctggatataaacttcgtgaagacaggaagaaagtcaaggtaaaatcaaacttaaaaaatacatccaaaaccatagcccttaaaaaatatatttgaggctgggcatggtggctcacacctgtaatctcagcactttgggaggctgaggcaggcagatcactttagcccaggagttcgagaccagcctggccaacatggcaaaaccccgtttctacaaaaaatacaaatattagctgggcatggtggcacatgactgwaacgccagctactcactcaggaggctgaggcaggagaatcacttgaacccaggaggtagagattgcaatgagtcaagatcgtgccactgcactccagcctgggcaacagagggagacaccatatcaaaaaaaaaaaaaaaaaaaaaaaaaccgaaaaaaaccattcaaggccgtgcgtggtggctcacacctgtaatctcagcacttttgaggcgggcagatgacttgagcccaggagttcaagaccagcctggccaacatggcaaaagccccatttgtacaaaaaatacaaaaattatc

SEQ ID NO: 53048 - DNA, 601 bp, Human
cttgccacatttctgtgactaagcgaaagtgttcccttctcttagcattatttctaactaaagcaaaatcatcctcacctctgtcacttcctggcctggatataaacttcgtgaagacaggaagaaagtcaaggtaaaatcaaacttaaaaaatacatccaaaaccatagcccttaaaaaatatatttgaggctgggcatggtggctcacacctgtaatctcagcactttgggaggctgaggcaggcagatcactttagcccaggagttcgagaccagcctggccaacatggcaaaacccygtttctacaaaaaatacaaatattagctgggcatggtggcacatgactgtaacgccagctactcactcaggaggctgaggcaggagaatcacttgaacccaggaggtagagattgcaatgagtcaagatcgtgccactgcactccagcctgggcaacagagggagacaccatatcaaaaaaaaaaaaaaaaaaaaaaaaaccgaaaaaaaccattcaaggccgtgcgtggtggctcacacctgtaatctcagcacttttgaggcgggcagatgacttgagcccaggagttcaagaccagc

SEQ ID NO: 53049 - DNA, 601 bp, Human
agtctcagtctgcgatgctataaaagttggatgacataatattcaacatcctttccagctctgaaattcgacatattaagttcctgtacaaataactctctgtcactgatctgcttatgttcaaataagtagcatcaaattttccattatagcagaggttggtttgaatgcacagtgactgtcatattcacagacgcccatgtgcaagcctggaaaggagaatcaagccaatctaggcctcaaggatgcttcggacggggcttgagggcagacctactcagcctcaatcaagaaacttggmaagaggtagcttttctttgtttccatgatttcgtttggatctgtttctcaactcctccaggactgactttcaggcaacagaatggtgtcttagagaatttaaactggcagggccttttctagaaaacacagcatagaaatcacaccctagaattagaaattgaagtgacagctagagtttgctgtgaattcactcacttggctaaacccaaaactagaggggaagaaaggaaaataaccttccagtaaaataaacagaaagatcagagagcagatgctaactgcaaaggcagttctcaat

SEQ ID NO: 53050 - DNA, 601 bp, Human
tgagtctcagtctgcgatgctataaaagttggatgacataatattcaacatcctttccagctctgaaattcgacatattaagttcctgtacaaataactctctgtcactgatctgcttatgttcaaataagtagcatcaaattttccattatagcagaggttggtttgaatgcacagtgactgtcatattcacagacgcccatgtgcaagcctggaaaggagaatcaagccaatctaggcctcaaggatgcttcggacggggcttgagggcagacctactcagcctcaatcaagaaacttrgcaagaggtagcttttctttgtttccatgatttcgtttggatctgtttctcaactcctccaggactgactttcaggcaacagaatggtgtcttagagaatttaaactggcagggccttttctagaaaacacagcatagaaatcacaccctagaattagaaattgaagtgacagctagagtttgctgtgaattcactcacttggctaaacccaaaactagaggggaagaaaggaaaataaccttccagtaaaataaacagaaagatcagagagcagatgctaactgcaaaggcagttctca

SEQ ID NO: 53051 - DNA, 601 bp, Human
accactccagcgccccttgtggtgggaaaaaaaaactagactgagacacgggagacttggaagttagacccaactcactttgtctaaaatgttctttctctatgagtctcagtctgcgatgctataaaagttggatgacataatattcaacatcctttccagctctgaaattcgacatattaagttcctgtacaaataactctctgtcactgatctgcttatgttcaaataagtagcatcaaattttccattatagcagaggttggtttgaatgcacagtgactgtcatattcacagacgyccatgtgcaagcctggaaaggagaatcaagccaatctaggcctcaaggatgcttcggacggggcttgagggcagacctactcagcctcaatcaagaaacttggcaagaggtagcttttctttgtttccatgatttcgtttggatctgtttctcaactcctccaggactgactttcaggcaacagaatggtgtcttagagaatttaaactggcagggccttttctagaaaacacagcatagaaatcacaccctagaattagaaattgaagtgacagctagagtttgctgtgaattcactca

SEQ ID NO: 53052 - DNA, 601 bp, Human
tcactacgggtaccttggaaaaaaggcagcccccctgacccctcatttttctgcaaaagcagcatcttcagtggtacacagaacagacagtgtgtggctatggaacttgcattttgaaagggaaaggtgagtttagccaggggagggcaggagttcagccataattaggcgacgtcttcctttcagatgtgaatatgagtggctgggccacatggtaccatgctaggcatccatgagcatcctttccacagctccatgctcccaggaagagaacaaccctcccaggtagaggaatgtccgagttgctggcacccctcacatcagagggtttctgtaacagggctggtatagcccggtctccccctaccactccagcgccccttgtggtgggaaaaaaaaactagactgagacacgggagacttggaagttagacccaactcactttgtctaaaatgttctttctctatgagtctcagtctgcgatgctataaaagttggatgacataatattcaacatcctttccagctctgaaattcgacatattaagttcctgtacaaataactctctgtcactgatctgcttatgttcaaataagtag

SEQ ID NO: 53053 - DNA, 601 bp, Human
cttcactacgggtaccttggaaaaaaggcagcccccctgacccctcatttttctgcaaaagcagcatcttcagtggtacacagaacagacagtgtgtggctatggaacttgcattttgaaagggaaaggtgagtttagccaggggagggcaggagttcagccataattaggcgacgtcttcctttcagatgtgaatatgagtggctgggccacatggtaccatgctaggcatccatgagcatcctttccacagctccatgctcccaggaagagaacaaccctcccaggtagaggaatgtcygagttgctggcacccctcacatcagagggtttctgtaacagggctggtatagcccggtctccccctaccactccagcgccccttgtggtgggaaaaaaaaactagactgagacacgggagacttggaagttagacccaactcactttgtctaaaatgttctttctctatgagtctcagtctgcgatgctataaaagttggatgacataatattcaacatcctttccagctctgaaattcgacatattaagttcctgtacaaataactctctgtcactgatctgcttatgttcaaataagt

SEQ ID NO: 53054 - DNA, 601 bp, Human
gcttcgattgggatgttgggcaaaatgagctctccaattttacccagctctaagattcaacactaaggtttatccaagatggactctccaatttttcccagctctaagatttgagattacccagctcttaagatttatccaatgttaagattcaactcaaagattccatatagaggctccactgcccaggattcttcttaacacgtaagaagaatccatagcatcactccaataggctccttgccagctccatgaacaatgaatatgtccagctgtcaggaacaagagccagttaggctgsgatgagctgggcagcatgaccctggagacccatgaatccagtaacatgagggcactggaattcaccctgaatctcctccttgcaccagagtgaacataaaactctggataaacacatctcttccaagccacagctggccttgccagggaaagcggcggcactgtgggtgaatggatcctttgagcagagctgggcaatgtgacctccctgtaatatgtatccatcaatggggagcctgatgtcattgggaaagcacttctcaacaccccaagctgatgtgataatgggctggagaattca

SEQ ID NO: 53055 - DNA, 601 bp, Human
ggatttgcgctaattccttgggtcttaagtcccccattcacttcctgagcagaagaaaccttcagatggaaaccacaataggcatgcaacttgtttttcttacttatcagtatttcaaatgatcatgtgaaaaccacaaaatgcctttgtttcagtctggttttgtgggggcacgctgagtagcaggggatgttaccaccaccaccagaccctttgctgaggaacaggccatcctggcacaggttggagggaaaagtatagcaagagacctcagaatcgcccacgacacccctgcctagcrtggatgtgtttattttatgattcttggagggccagggaccctgaccaaccctcctcaggcctcaggaactgaacttaggctacaggacatgcaaccaaatttctgattaggcaagaaagccagcaaggctacttctggatagcagacacagaaaagaagcgaatccatgaaactgtacactcccagccagtggaggattggggtcctaccctcagccatattcagagcactttttgagatgcttcgcatagcaaggttcaggtctcacgtttctgtagtaatggggatgggcgggcagtg

SEQ ID NO: 53056 - DNA, 601 bp, Human
gtaacaggtgcctgtaatcacagctacttgggaggctgagacaagggaatcgcttgaaccccagaggcagaggttgcagtgagctgagatcacgccactgcactccagcctggttgacagagctagactctgtctcaaaaaaaaaaaaaaaatacatatatatatatatacacacacacacagacacacacacatatacatataattgtttttgaagattgagaggtgtacccaagtccaccagctaacaaggacacacagtgggaactggaacatgagtcaggggtttttccacaaaaamcaagattcattctgcacagctcatcgtgcggggagggcagggaagagcctctttcccactggcattggttgacccattgtaagcaccatcccacaatgctccatacaccaatggccaaagttccaactgagagattttctatcctcttcccaagtccatgtaaacctcttaggcctctgaaaagagatgtcagtgttttcagagctaaaagccttcacggtgagcagactgagaggcttttcttacaggggaggctaatcccatggccacaaagttcctgcctcctagcatctctggagc

SEQ ID NO: 53057 - DNA, 601 bp, Human
gctgggtgcagtggctcacacctgcaatcccagcactttgggaggccaaggcaggtggattacctgagatcaggcattcgagaccagcctgaccaacatggtgaagtcccgtctctactaaaaaaatacaaaaaaattagccaggcatggtaacaggtgcctgtaatcacagctacttgggaggctgagacaagggaatcgcttgaaccccagaggcagaggttgcagtgagctgagatcacgccactgcactccagcctggttgacagagctagactctgtctcaaaaaaaaaaaaaaaatacatatatatatatatacacacacacacagacacacacacatatacatataattgtttttgaagattgagaggtgtacccaagtccaccagctaacaaggacacacagtgggaactggaacatgagtcaggggtttttccacaaaaaccaagattcattctgcacagctcatcgtgcggggagggcagggaagagcctctttcccactggcattggttgacccattgtaagcaccatcccacaatgctccatacaccaatggccaaagttccaactgagagattttctatcctcttccc

SEQ ID NO: 53058 - DNA, 601 bp, Human
atttttgaaggaccaggcatagtggctcatgcctgtaatcccagcactttgggaggctgaggcaggtggatcgcttgagcccaggagtttgagaccaacctgggcaacatagtgggaccccatctcttcaaaaaatttaaaaattagccaggtgatgtggcacacgcctgaggtcccagctacccgggaggctgaggagggagaatcacttgagcctgggagattgaggctgcagtgagctgagatcatgctactgtactccagcctgggtgacagagtgagaccctgtctcaaaaaaaaataaaataaaattataggctgggtgcagtggctcacacctgcaatcccagcactttgggaggccaaggcaggtggattacctgagatcaggcattcgagaccagcctgaccaacatggtgaagtcccgtctctactaaaaaaatacaaaaaaattagccaggcatggtaacaggtgcctgtaatcacagctacttgggaggctgagacaagggaatcgcttgaaccccagaggcagaggttgcagtgagctgagatcacgccactgcactccagcctggttgacagagctagactctgtct

SEQ ID NO: 53059 - DNA, 601 bp, Human
gaaagccaaggcacattgctgactgtcctcccaacagaacagccacaataactaggcagaaaaagcaccagcaacgaaatctaccaccaccaggagaccagagtcccaggtaccaaggctctccacccaggacctttgggagcatgatcttagatccaaaagtgttcacttaaggaccggggcctccatccacatgtcccttctggggtcaaaagtcaggcaaagtggaaaccatatgtatacacatgatataaacatatacacatatacacctgctggtaagtctatgctccaacgcacscccccaaccaggaatttccaggcaatacctgctccttccatcaccggttgcattccatcagtgaacacccctcaccctcactgacttggaagtttcaggttaacaaataaccatgatgattctaataatatatttattatgcataaataactttgctcattagggaaggatcctgcactcacttgatccttacaacgaggaccattggcccactttagaggttaagtaggttaaggagaagaccaccaagggacacaaggactaatgggaaatccattatcttgagtgtggtggtggtgg

SEQ ID NO: 53060 - DNA, 601 bp, Human
gacatatccaaaaggccaggattttaattatattaaaacttcactgtgtaaaaaaaaaaaaaaaaaaaaaaaaaaacacacacacacaaaaacaaaaacaaacaaaaaaactgcctgaaagagaaaactccggagtggtgagggatgggcagggatataatttttctctttgtggctcgcctacctcggatcctccctgggacaatggaagcagcagcttccagccagcctgacgtggaggggagcccctgtccatgtgatttacaactcatccgcatgggctatggcggttgatgcagaygcagaagcagacgttccagaaaagccaactcttcatcacacacagagtttggcaacagagcccctgtttgagcctcattcgataagcatgccaaagaaaacatgttgttcttgcatttgttgtttcccaaaaacttgctttcactagtttccccatgtgacatgtcctcggattactctctcactcacagaccactggtggctggagtcacccagagagggtgtcaacgcaaaagaagctgcctctccaccatcagataattccgggtgttacacgccttgtgcctctcacatcccagaa

SEQ ID NO: 53061 - DNA, 601 bp, Human
caatgggataaggcaggttcaaggaggctgagaatgggtcagttgcttctgcaatgacccctcagtgggtggagcatggggctggaacccaggctaagcaggcaaacaggagaaggcccaccccttttacagtctggggtcccagcccttgcaggaacagagcagtcaggtgcatgaggtctccctggcaaccatgctctaggagatcacttggagaaaggctaaccaaactgccctccgggccacgtaagaaagcccgggctctggccaggccataaaagtcctgcttagctctggagcrgttctcagaggagcctcagagatctgcctggggaggcagaaagccacgcttagaggctgccgtctgcatctgcagagttcattacagaagtttaagtggccaatatcctggccaaaggacgggttacagggaaggaagacaacaggccaggcatcctgcccagagctgccactatgagagccaccagcacccactcacacccccacccctgccaccttcccaaagctgcacatgattccccaggtgaggatatccagatgagcccctgaagcagctccacctcacacatacaccccagcc

SEQ ID NO: 53062 - DNA, 601 bp, Human
acatctgtagctcacatgatatttctattgcctggcactactacggagaattcttgcttggcaatgggataaggcaggttcaaggaggctgagaatgggtcagttgcttctgcaatgacccctcagtgggtggagcatggggctggaacccaggctaagcaggcaaacaggagaaggcccaccccttttacagtctggggtcccagcccttgcaggaacagagcagtcaggtgcatgaggtctccctggcaaccatgctctaggagatcacttggagaaaggctaaccaaactgccctccrggccacgtaagaaagcccgggctctggccaggccataaaagtcctgcttagctctggagcggttctcagaggagcctcagagatctgcctggggaggcagaaagccacgcttagaggctgccgtctgcatctgcagagttcattacagaagtttaagtggccaatatcctggccaaaggacgggttacagggaaggaagacaacaggccaggcatcctgcccagagctgccactatgagagccaccagcacccactcacacccccacccctgccaccttcccaaagctgcacatgattcc

SEQ ID NO: 53063 - DNA, 601 bp, Human
tttaatgtggctaatagaaaatgtaaaattacatagatggctcacatctgtagctcacatgatatttctattgcctggcactactacggagaattcttgcttggcaatgggataaggcaggttcaaggaggctgagaatgggtcagttgcttctgcaatgacccctcagtgggtggagcatggggctggaacccaggctaagcaggcaaacaggagaaggcccaccccttttacagtctggggtcccagcccttgcaggaacagagcagtcaggtgcatgaggtctccctggcaaccatgytctaggagatcacttggagaaaggctaaccaaactgccctccgggccacgtaagaaagcccgggctctggccaggccataaaagtcctgcttagctctggagcggttctcagaggagcctcagagatctgcctggggaggcagaaagccacgcttagaggctgccgtctgcatctgcagagttcattacagaagtttaagtggccaatatcctggccaaaggacgggttacagggaaggaagacaacaggccaggcatcctgcccagagctgccactatgagagccaccagcacccactc

SEQ ID NO: 53064 - DNA, 601 bp, Human
ggatggggtcgatgcatttgaagcccccttgtaaattgtagcacgtctgctgcaggttgcacgtgtggttcctgtgctcacattcgttgatgtctgaaatgcaggggagacaagaagcggaggcagggcattattggccaggccagacgcgtgggggtggggtaggctggatcttactacagagctgtactatccaatatggcagcaacaggccatatgtggctactgagtacttggaatgtggctgatccaaattgagatgtgctgtaagtagaaaatacacaccagattttgatgactagtaccaagaaataatgtgagccaggcacagtggcttacgtctgtaatcccggtacattgggaggctgaggcaggaggatcacttgaagccaggagttcaagaccggcctgggcaacaaagcaaggtcttatctcttaattttatttatttatatatataattttttttaatttaaaaaaagaatgtaaaacatctcatcaataataatttttatattgaatacatgctgaaataatattttggatatactgcattaaagaaaacatagtagtaaaaacaggagttcaagaccagcctggc

SEQ ID NO: 53065 - DNA, 601 bp, Human; identical to SEQ ID NO: 29512

SEQ ID NO: 53066 - DNA, 601 bp, Human; identical to SEQ ID NO: 29513

SEQ ID NO: 53067 - DNA, 601 bp, Human; identical to SEQ ID NO: 29514

SEQ ID NO: 53068 - DNA, 601 bp, Human; identical to SEQ ID NO: 29515

SEQ ID NO: 53069 - DNA, 601 bp, Human; identical to SEQ ID NO: 29516

SEQ ID NO: 53070 - DNA, 601 bp, Human; identical to SEQ ID NO: 29517

SEQ ID NO: 53071 - DNA, 601 bp, Human; identical to SEQ ID NO: 29518

SEQ ID NO: 53072 - DNA, 601 bp, Human; identical to SEQ ID NO: 29519

SEQ ID NO: 53073 - DNA, 601 bp, Human; identical to SEQ ID NO: 29520

SEQ ID NO: 53074 - DNA, 601 bp, Human; identical to SEQ ID NO: 29521

SEQ ID NO: 53075 - DNA, 601 bp, Human; identical to SEQ ID NO: 29522

SEQ ID NO: 53076 - DNA, 601 bp, Human; identical to SEQ ID NO: 29523

SEQ ID NO: 53077 - DNA, 601 bp, Human; identical to SEQ ID NO: 29524

SEQ ID NO: 53078 - DNA, 601 bp, Human; identical to SEQ ID NO: 29525

SEQ ID NO: 53079 - DNA, 601 bp, Human; identical to SEQ ID NO: 29526

SEQ ID NO: 53080 - DNA, 601 bp, Human; identical to SEQ ID NO: 29527

SEQ ID NO: 53081 - DNA, 601 bp, Human; identical to SEQ ID NO: 29528

SEQ ID NO: 53082 - DNA, 601 bp, Human; identical to SEQ ID NO: 29529

SEQ ID NO: 53083 - DNA, 601 bp, Human; identical to SEQ ID NO: 29530

SEQ ID NO: 53084 - DNA, 601 bp, Human; identical to SEQ ID NO: 29531

SEQ ID NO: 53085 - DNA, 601 bp, Human; identical to SEQ ID NO: 29532

SEQ ID NO: 53086 - DNA, 601 bp, Human; identical to SEQ ID NO: 29533

SEQ ID NO: 53087 - DNA, 601 bp, Human; identical to SEQ ID NO: 29534

SEQ ID NO: 53088 - DNA, 601 bp, Human; identical to SEQ ID NO: 29535

SEQ ID NO: 53089 - DNA, 601 bp, Human; identical to SEQ ID NO: 29536

SEQ ID NO: 53090 - DNA, 601 bp, Human; identical to SEQ ID NO: 29537

SEQ ID NO: 53091 - DNA, 601 bp, Human; identical to SEQ ID NO: 29538

SEQ ID NO: 53092 - DNA, 601 bp, Human
acgtgaactgataagggagaaatcatatccataaaaagtcaaatcagtccaatcaacccctctgatggtcaacagggtgacagccaatgcaatggcattgcctcaacatccaggaaaactaactggacagccagggccaacttaatgactctggtttcactaggaccatacttaaattgaagcaagtcagtcagggaagatacaaatggaagtcacacatcaatgaagttggtctcactcaactatgccaatttatgacagaagactacatttgatttaatatcagtattgtagtgggggraaaatgaaaagaaaaaaacctactttgtcttttaagttcttcaatttgttcttcttttacatctaactgttctgtaagtcttgatgctgaatccaatgcagcatttgcttcatccaaacattcctgagaaagaaaactttattaaaaaaaagtatgcaaaaattatttcacaaactataaggctgagagacatcttagagtcaacctctacatttcagctggtgaagctgcacctctatgaccttgggcaaatgtatccaaccaataagtatcaaaggcagaacccacattcttttcaat

SEQ ID NO: 53093 - DNA, 601 bp, Human
tccattagtctagcccaacccgaagattatcaattcccagtgtgtctcctctcagttgcccatatgtcttccagataatgttgtagttgcactggccttcgatctaactagactgttttctaaataaatactgctcttggtaaaggcaaccatttcaacgttagggcacaatacagaagatgctaccatattttcaggggaaactggagatatacagaacaaaatacaagtcagactataaataaccattttcctgatagggctacaataacatgaaaagaccacgaattatggtaatagktaaaaagatcggagttcaaatcttgcctctttaatctataaaatggataataccacttattttagagatgcttataaaaagtaaatgatgagaagactaaatacataaatgttatgtcaaatgtccataatagacactcaatacataattgtttccttgctgcccattttcaggccctctactagatttagagatcctagcctggtcaagacttacaaggtagaagacttttggtttggcagtaacttgcctcagaatcaagtcattttgaggacaattacttcacatctatcttttttt

SEQ ID NO: 53094 - DNA, 601 bp, Human
acactgctgtttcacctccattagtctagcccaacccgaagattatcaattcccagtgtgtctcctctcagttgcccatatgtcttccagataatgttgtagttgcactggccttcgatctaactagactgttttctaaataaatactgctcttggtaaaggcaaccatttcaacgttagggcacaatacagaagatgctaccatattttcaggggaaactggagatatacagaacaaaatacaagtcagactataaataaccattttcctgatagggctacaataacatgaaaagaccaygaattatggtaatagttaaaaagatcggagttcaaatcttgcctctttaatctataaaatggataataccacttattttagagatgcttataaaaagtaaatgatgagaagactaaatacataaatgttatgtcaaatgtccataatagacactcaatacataattgtttccttgctgcccattttcaggccctctactagatttagagatcctagcctggtcaagacttacaaggtagaagacttttggtttggcagtaacttgcctcagaatcaagtcattttgaggacaattacttc

SEQ ID NO: 53095 - DNA, 601 bp, Human
caggcaattcttgtggctcagcctcccaagaagctgggactacaggcatgagccaccatgcctggctaatttttatatttttagtagagatggggtatcaccatgttggctaggctggtctcaaactcctgacctcaggtgatccacccaccttggcctctcaaagtgctgggattacaggtgtgagccaccacgtccggccaaatcattttcaattagcaggaatttatgtcaaggatgatggcagagaacaagaaggaaaggaaaatgtcaaatttgaccataaatatagcaagataaygcattttaatggttcagtcacaggtgtataatttctcatcaatagcaattccatggaattctgaactctgatcagctcagagtagttaatgaaaaccactgtcatatgtgcttcataggccactctactgagtttggatatgggatggcatgtgaagtctttggaactgtattgaagaacactttcaggtaaaatgctgaaagaataattttttaaaaggaaggatagcagtaattcttttaacagccaacactgtctattaaactatagtacttaggatcgtaggatttattttcttcg

SEQ ID NO: 53096 - DNA, 601 bp, Human
aatggtccaaggaaattttccattctcaactcttaggagacttttaaaagtagtcattcaaccttcttaaaaaaaaaatcagttatgctgccctttcagatacaggtataaactagcagacagaccaaaagatcttcctgatgttagaactaaatttgtattgcttatgaaaactcacttttctttgcacaccataaaattcaccacctttctgaatcatagttatcaaaataacaatatcttgtgctttttatttcaatttatccaatcattttttttcttttcttttttttttttttttgggaccaagtttcactctgttgcccaggctggagtgcagtggcgtgatctcaactcaccgcaacctccacctcccaggttcaggcaattcttgtggctcagcctcccaagaagctgggactacaggcatgagccaccatgcctggctaatttttatatttttagtagagatggggtatcaccatgttggctaggctggtctcaaactcctgacctcaggtgatccacccaccttggcctctcaaagtgctgggattacaggtgtgagccaccacgtccggccaaatcattttcaattagc

SEQ ID NO: 53097 - DNA, 601 bp, Human
caggctgtagtgcagtggcacaccctctgctcactgcaacctctgcctcccaaggttcaagcgtttcttgcacctcagcctgctgagtagctgggatcacaggcatgtgccaccacacctggccaatttttttgtatttttagtagagacaggctttcaccatgttggccaagctggtctccaactcctgacctcaagtgatccatctgcctcagcctcccaaagtgctgggattacaggcatgggccaccgtgcccagccctgctttgtcttttaactcaattattttcaactgtatccmacacagaatttgaaggtctagagtatatggtaaatgttttgttgtcccataatcataattgttcactgctgagtgaaaagtatcttttaaaattctaggccaggcccagttgctcatgcctcttgtaatcctagcactttgggaagccaaggcagaaggatcatttgatgccaggagttcaagaccagcctgagcaacatagacaaaccgtctccacaaaaaaaaaaaaataagatcctgcctcttaaaaataaaaataaacttctacttcttagcaatgaactcacaggaaaagaatta

SEQ ID NO: 53098 - DNA, 601 bp, Human
tagtagagacggggtttctccatgttggccaggctggtcttgaactcctgacctcaagtgatccacccacctcagcctcccaaagtgctgggattacgagtgtgaaccaccgcacccggcccaaataatatatttttaaaagatattatactatttgcaatttgaggttaagctttacaagcatctgttttgtcttttttgttgttgtttttttagacagagtctcgctctgtcacccaggctgtagtgcagtggcacaccctctgctcactgcaacctctgcctcccaaggttcaagcgwttcttgcacctcagcctgctgagtagctgggatcacaggcatgtgccaccacacctggccaatttttttgtatttttagtagagacaggctttcaccatgttggccaagctggtctccaactcctgacctcaagtgatccatctgcctcagcctcccaaagtgctgggattacaggcatgggccaccgtgcccagccctgctttgtcttttaactcaattattttcaactgtatccaacacagaatttgaaggtctagagtatatggtaaatgttttgttgtcccataatcataattgtt

SEQ ID NO: 53099 - DNA, 601 bp, Human
attctcctgcctcggtctcgcgagtagctgggataacaagcgcctgccaccacgcctggctaatttttgtatttttagtagagacggggtttctccatgttggccaggctggtcttgaactcctgacctcaagtgatccacccacctcagcctcccaaagtgctgggattacgagtgtgaaccaccgcacccggcccaaataatatatttttaaaagatattatactatttgcaatttgaggttaagctttacaagcatctgttttgtcttttttgttgttgtttttttagacagagtctygctctgtcacccaggctgtagtgcagtggcacaccctctgctcactgcaacctctgcctcccaaggttcaagcgtttcttgcacctcagcctgctgagtagctgggatcacaggcatgtgccaccacacctggccaatttttttgtatttttagtagagacaggctttcaccatgttggccaagctggtctccaactcctgacctcaagtgatccatctgcctcagcctcccaaagtgctgggattacaggcatgggccaccgtgcccagccctgctttgtcttttaactcaattatttt

SEQ ID NO: 53100 - DNA, 601 bp, Human
tgagacttcccttctcctacctactttcctctaaaattagtaatttgtatattgattacatgtctatataataatttggttatactgggttatatataaaatatatatgtgtgtatatatatttgagacagggtcttgctctgttgcccaggctgtggcatgatcacagctcactgcagcctcaaactcctggggtcaagccatcctcctgcctcagcctcaggaaatagttgagattaccagtgtgcaccaccacaaccagctaatttctaattttttgtagagatggggtctcacgatrttgcctgggctgatctcaaactcctgcgttcaagtaattctcctgccatagccttccaaaatgttgggattacaagtgtgagccactgtgcctgtccctatataaaacatattatcaaacaatttcacctatagctttttactgttttaacatggccactaaaaaatttaaaattgcacgtggctcacagtatattcctactggacagtactgcttttagaacataaccaggatataacactactctatactatctcttattttaaaaagagaggctgggcgcagtggctcacgcttgta

SEQ ID NO: 53101 - DNA, 601 bp, Human; identical to SEQ ID NO: 29539

SEQ ID NO: 53102 - DNA, 601 bp, Human; identical to SEQ ID NO: 29540

SEQ ID NO: 53103 - DNA, 601 bp, Human; identical to SEQ ID NO: 29541

SEQ ID NO: 53104 - DNA, 601 bp, Human; identical to SEQ ID NO: 29542

SEQ ID NO: 53105 - DNA, 601 bp, Human; identical to SEQ ID NO: 29543

SEQ ID NO: 53106 - DNA, 601 bp, Human; identical to SEQ ID NO: 29544

SEQ ID NO: 53107 - DNA, 601 bp, Human; identical to SEQ ID NO: 29545

SEQ ID NO: 53108 - DNA, 601 bp, Human
tgacttaagtagtctttggtgctttaagagacctctattctacctgctttatggctgtgaaaaaaattagcaccttttccatgtcaaatgctggaaatgcatgcctctctccccacaggttccctcttagctctgaattcacaggtagccctgattagcctgtcacttttatcctttttgagaagagaattaggaaccagatatctttgaacaccaagagacactggtcacatctcctggatttgccaaatatcctccagggggtgaacagcctctttgagggtcacagcactaagctggyaaccctcttcaaataagtccccctttcctaatctccttacaactgctaattatgaggctaggtttggatgatcaaaaacacacatttgggatgccccttagcaatccctgcatagagggcctgttagacacatctcatgagaatgtgtgggcatataacacccattttcctaaagggactctgacatttgagataatagggaaaatccttacatcagtgaaaaccagtataagcctacacgtaactctgacatttaaaagtctgagcccaaggagactgaggatgggggaagaggagatt

SEQ ID NO: 53109 - DNA, 601 bp, Human
attaaacaatgtgtgtgtgtgtgtgtgtgtgtgtgtgtgtgtgtgtatctgcgtgcctgtgaagtccagtacacataggtaaataaaaaccaatgttatttagttgcccatccagtttaacattgctcatcttccccaagcttaggcctgggacaggcatggactcctgctgagtggaaggggcctagtgggtgtcctcacctccatattcccactcactgctgcttctggttgtttagcaatgcggtgcgagaggcaggaaattataggaccaaagggtctggctagactggtggttttkctgtcatctatgtgacaaatgcccaaatgctgcctattttttttctcctggggaccatttgtgggtccttcagagacaacttgctaacaccaagagagtactttgaatatatatattttctactattttagctgaatttttataattcctaccctggctcttataccatcacttactctatgcagcctctttttcactatttgacttaagtagtctttggtgctttaagagacctctattctacctgctttatggctgtgaaaaaaattagcaccttttccatgtcaaatgctggaaatg

SEQ ID NO: 53110 - DNA, 601 bp, Human
gtttctatttcataggacttttatgatgtttaaataaaatggtatatataaaatgcttagaagattttttagcatatagtgggcccttaatacgtgttagctacaggatttacaattccagctatcaaaatgttttatatgttgtcatctaaatctttcagaggtcactaaaaaccattctgttttataggaatactctgagaagagtcaggtatagaggaaggagtactaaataagaagtcatgggttaggttttagtcccagttttgccaacacttccatccatgacctgtgtcaaacygtttcccttctaagagctttaattatctcattagtaaaatgcagaaagtaataatcatcctgccaatcacataggattgtggtgacactaatgtgagataatgaaactaagagccctttgaagatgatacaaatgtggggtattattattaatccaatttaaaactcatgatgccatggaagcattataataaaataataaaaatttggagtaaatattaggaataatgtggtgttaaaagatggaatgttttgttatgtgaaggaaaaaaataaatgaatttctaccacgaagcagggc

SEQ ID NO: 53111 - DNA, 601 bp, Human
aaaaaatccagcagtcatattcattagggtattgtgctattatctccactaagagtcagaattcagaaactttttatttttctcaccaaaatcatctttaaagggagatttttgttttgattgctttcttaactgaaattctgcaatcattaaggctctgtatgtgtgtgtgttttaaaccaattaataatttgtgttttacattgctttattttgtgctgacttttttctttcagtccagctcaacattcaaacaatacctctctggaatactcacggcatcgaattttctatcaaaaarcatttcagaagtcaaaaggtttttaaagtttaaaagcaactaaatgcttcttggacctgactccttttacataatctctgttttactgatagttttaagggaaatggtactttaataattgtatggacatctcaacagaaacatcctcagtttactgctgtgtatcttactaagtatatagaaaatcaaccacataaattattattgttctaaaaaatcttaagctgatattttgatcatgaaatcgcagctcttaggagatttgtaagaggtaatcttaggtctgacctgtggtatgat

SEQ ID NO: 53112 - DNA, 601 bp, Human
ttgtgcctaggtttgtcttcacaattctagacccagttctagccaccagctgcctgcacaattttgctcctgattctgattaccagtgtgtctggtattcatttcaggtactcaacaggtatttgttaaatgagtgaagattccttggaaagtccctctactcagtaatttcaaggatcttagcctctaatgtaccctaaatgacgctcaatttctttctaccagactaacttctcaaagtactgattgacatcaatgcagtatctaaccccaaattaaggatccctagatttagcaagaygcaaaagtcaactgatgtttttacagagataatgtgactctgtattaagggaaaggcactcttttccataattttatgctttcattccttggtgaccagtacccgttttcattttctcaggattaaaaactgctctcagggaagcatttgttacctttattagaatatgtaaatcatatagcttcatgtgttatgtatcccagagttatttgcattttactcatacgtaataaataagaattttatttaaaatagaaatatcttgttattatttaaattttactcttaggcattgttaca

SEQ ID NO: 53113 - DNA, 601 bp, Human
aagttttccttaactacctgcctgtctttaactaccctcctgttccacacctccaattttatcccctcccttgatttaaattagtgggataacatggtagcccattttgatatggaattccaagcgttttttaaaccttaatagttgaaagtgaaaaaactttgacatttgaaaagtcaaaaaattggtttagtctacatagataggctttattttaccttcagtgcagactaattcttttgttttataaaaaatactttgaataggtcttttagttacactaaaaaaagtaagggctctcctttggcatttagaagactgagacaatgggattccaagaggctaaacatctccagaaagtaatgctcaagcttgtcttcaccatgagcacagctgcatcactctcaggttctgtgtcctttagaaaactgtcatgttttttctaaatgtgaatttagactgcacagtcttttaacataggggttgatccttagagatgaatgacattaattttgattggcccctatctttattttagtcacagaacttgaggtcctgaactcaggacagcaagacatgtcaaaaggacttctgtagtgga

SEQ ID NO: 53114 - DNA, 601 bp, Human
gaatctcccaactcatccagtggttcaccctgtggcatttgatttacccttttcagtaaccctgctttctgttaattgggcaattcatatttgtcatatatgcctgttgctttggtgtctattctttctagtctcctctttggtagctccatgccttgccttaaatactcaagttttccttaactacctgcctgtctttaactaccctcctgttccacacctccaattttatcccctcccttgatttaaattagtgggataacatggtagcccattttgatatggaattccaagcgttttytaaaccttaatagttgaaagtgaaaaaactttgacatttgaaaagtcaaaaaattggtttagtctacatagataggctttattttaccttcagtgcagactaattcttttgttttataaaaaatactttgaataggtcttttagttacactaaaaaaagtaagggctctcctttggcatttagaagactgagacaatgggattccaagaggctaaacatctccagaaagtaatgctcaagcttgtcttcaccatgagcacagctgcatcactctcaggttctgtgtcctttagaaaactg

SEQ ID NO: 53115 - DNA, 601 bp, Human
agccattccacattaattcctcatagtatcatcttctggctggtagctttttctctttgctgaaactctacttcagggcattaggaatctcccaactcatccagtggttcaccctgtggcatttgatttacccttttcagtaaccctgctttctgttaattgggcaattcatatttgtcatatatgcctgttgctttggtgtctattctttctagtctcctctttggtagctccatgccttgccttaaatactcaagttttccttaactacctgcctgtctttaactaccctcctgttccwcacctccaattttatcccctcccttgatttaaattagtgggataacatggtagcccattttgatatggaattccaagcgttttttaaaccttaatagttgaaagtgaaaaaactttgacatttgaaaagtcaaaaaattggtttagtctacatagataggctttattttaccttcagtgcagactaattcttttgttttataaaaaatactttgaataggtcttttagttacactaaaaaaagtaagggctctcctttggcatttagaagactgagacaatgggattccaagaggctaaa

SEQ ID NO: 53116 - DNA, 601 bp, Human
tgagaactaaaaaagtcaattttcaacagaccatgggtggagaatgtgtccttagtagagcaggggtatatttggaagacaagagtgtaaggggagataaggaatatatttctttctacacccatgaggccaaaatagtagggatgatgacaactgggaggtaacggtagccaaacagaatagcaaaataagtatcagtgtatatagtgtgtccttcacaaatatttgttgaataaatgaataaaagtatagaaaacataggcatagggtctctggttttagggatttttaaaatattcargtatttgcactagttaggtattagcccagatgaagaataaagtcatttttatttgcttattttgatgcatatgttgtatatgtcaatgtttttagtcacatcctgtttaatgtagaaaaagatatttttcatgtgtaaaaatgtttaaaaaaacaatttaaaaagtattttctgtgatcctgtaactctttgtatatatggtcagccatgaattcactcactgactcaagttgtaaatgacacacaataacctacctgaaggagggaaaaatccatgtcccatggaaggaagagagaccc

SEQ ID NO: 53117 - DNA, 601 bp, Human
atcttttataatgatgttacaaatgggaattatctgtatgttacttgactgagaactaaaaaagtcaattttcaacagaccatgggtggagaatgtgtccttagtagagcaggggtatatttggaagacaagagtgtaaggggagataaggaatatatttctttctacacccatgaggccaaaatagtagggatgatgacaactgggaggtaacggtagccaaacagaatagcaaaataagtatcagtgtatatagtgtgtccttcacaaatatttgttgaataaatgaataaaagtataraaaacataggcatagggtctctggttttagggatttttaaaatattcaagtatttgcactagttaggtattagcccagatgaagaataaagtcatttttatttgcttattttgatgcatatgttgtatatgtcaatgtttttagtcacatcctgtttaatgtagaaaaagatatttttcatgtgtaaaaatgtttaaaaaaacaatttaaaaagtattttctgtgatcctgtaactctttgtatatatggtcagccatgaattcactcactgactcaagttgtaaatgacacacaataac

SEQ ID NO: 53118 - DNA, 601 bp, Human
catttgaattatttctttcaggccaccactgaagcatgtttatttattccctgttttgttccaaaaagtatttaaaatggcaagcttaccaatttatctcaatagcttttttttaaaaaaaagtttcctgatagatttgttcaatgttcctctggtattgttagcctctcctcgacccaacttttttttttaactgtgagaagatgaccattgtacatgagtgactatgaagactgaacttttgggtggagaagtcagttatgccgaccttagctcaattcccaaaaggcaaatcttggcrtaaatgaggtcaagtaaggataatgttgaagttagatgtggctttctccaaggtaagacctacggagtgcttggtgcctcctccatatccaatctaggaagcaaaggtggaggcagtggaggtcctgtcctccaggagaggcagaaaggacccaaagaatgttgaggggaagggcctgagaaagagtcaaattgcttggagagctgggatcaagattgtatttttggagtcatttggggatggaattgggattaatgggtgaggcagaaaactgcccaaagccttgctgatgactcttgg

SEQ ID NO: 53119 - DNA, 601 bp, Human
ggaggaagcttgaatttaatttccagtgctagtatgttgaattgttttctcatagagaaatatatctggatgacaaaatttcaggacactttgaagtacaataaattaaatgtcaggatggaaataggtaatacatttgaaatgccatatctacttgtcagtaacctacttactaagtgctaaatacatttgaattatttctttcaggccaccactgaagcatgtttatttattccctgttttgttccaaaaagtatttaaaatggcaagcttaccaatttatctcaatagcttttttttwaaaaaaagtttcctgatagatttgttcaatgttcctctggtattgttagcctctcctcgacccaacttttttttttaactgtgagaagatgaccattgtacatgagtgactatgaagactgaacttttgggtggagaagtcagttatgccgaccttagctcaattcccaaaaggcaaatcttggcgtaaatgaggtcaagtaaggataatgttgaagttagatgtggctttctccaaggtaagacctacggagtgcttggtgcctcctccatatccaatctaggaagcaaaggtggaggc

SEQ ID NO: 53120 - DNA, 601 bp, Human
gttaaaaagaattgatcttaaaaagtcttaaaggagtttgatctgtcttgatctgtcaggaaatctttagttggaggaagcttgaatttaatttccagtgctagtatgttgaattgttttctcatagagaaatatatctggatgacaaaatttcaggacactttgaagtacaataaattaaatgtcaggatggaaataggtaatacatttgaaatgccatatctacttgtcagtaacctacttactaagtgctaaatacatttgaattatttctttcaggccaccactgaagcatgtttatttattccctgttttgttccaaaaagtatttaaaatggcaagcttaccaatttatctcaatagcttttttttaaaaaaaagtttcctgatagatttgttcaatgttcctctggtattgttagcctctcctcgacccaacttttttttttaactgtgagaagatgaccattgtacatgagtgactatgaagactgaacttttgggtggagaagtcagttatgccgaccttagctcaattcccaaaaggcaaatcttggcgtaaatgaggtcaagtaaggataatgttgaagttagatgtggc

SEQ ID NO: 53121 - DNA, 601 bp, Human
tatagatgataatgccagctgctttattgctttcttactaagaaccaggcaagaaaccaagctttagcttatttaatcctcataataccaccatgagaaagatctaattattattgctacttctattttactgataaatagactgaggcacagatgtcttgagtgatttgtgcaaagtcattcaaccaggagtgtccatgtcacattttttggtcatgtatgtctggtttcagggtctgagttactgattgataagttatcctccactttaaacgcatttttttcatactgagtacccagrctgccttcacattcggtcaatgctaatgccagtaatcattttctctatctcctctctgccttgaaacttatggttaaaaagaattgatcttaaaaagtcttaaaggagtttgatctgtcttgatctgtcaggaaatctttagttggaggaagcttgaatttaatttccagtgctagtatgttgaattgttttctcatagagaaatatatctggatgacaaaatttcaggacactttgaagtacaataaattaaatgtcaggatggaaataggtaatacatttgaaatgccatatctactt

SEQ ID NO: 53122 - DNA, 601 bp, Human
gaaatttgtgcaaggaggatgataaaataggatctcaactatcatagttaattttgttttacaaacatctaatagcttcattgctctttattctaatgttaaagggcagagtgtgcataatcatttacattgtaaatgctttttaaaaatgaagactttgtttttaagaaacatacaacgtgaaaaaatgatgactggtacattttccttaggaattcttaaaatgtgtcaagaccagcctggccaacatggtgaaaccttttctctactacagatacaaaaatttagctgggtgtggtgktgcatgcttgcaatctcagctactggggaggctgagacaggagaatcacttgaacccagaaccagaggttacagtgagccaagatcacaccactgcactccagcctgggccacaagagcaagactgtcaaaaaaaaaaaaaaaggaaaaaagcaattcttaaaacgtgctatacagaaaaagaaacgataaggaatatatgtgtaaaatgttaccactgtttacctctgaaaaatgctcccactggtgtttgatacgactttagtttttgtcccagtggagtcaataaagcataaagtca

SEQ ID NO: 53123 - DNA, 601 bp, Human
ttatctaagacatgaaaatatctgaatacttgtataagattatgccacatgtaaaacatatattttgtcctcatttcatttttgaaagaaatttgtgcaaggaggatgataaaataggatctcaactatcatagttaattttgttttacaaacatctaatagcttcattgctctttattctaatgttaaagggcagagtgtgcataatcatttacattgtaaatgctttttaaaaatgaagactttgtttttaagaaacatacaacgtgaaaaaatgatgactggtacattttccttaggwattcttaaaatgtgtcaagaccagcctggccaacatggtgaaaccttttctctactacagatacaaaaatttagctgggtgtggtggtgcatgcttgcaatctcagctactggggaggctgagacaggagaatcacttgaacccagaaccagaggttacagtgagccaagatcacaccactgcactccagcctgggccacaagagcaagactgtcaaaaaaaaaaaaaaaggaaaaaagcaattcttaaaacgtgctatacagaaaaagaaacgataaggaatatatgtgtaaaatgtta

SEQ ID NO: 53124 - DNA, 601 bp, Human
tgttgtacattctatgggttttgataaatgtgtaatgacatatgtctaccattacagtatcatacagggtagttccactgccctaaaaaaaatccctatacttcatctattcaaccttccttccttccctcacctctggtccctgacaaccactatctttttgctgtctccttagtttggccttttccagaccatcagatacttagtatcatatagtaaaaggctagactttttaatattggcttattccacttggtaatatgcatttttctccatgtcttttcatggcttgatagctaawttctttatattgctaaataatattctattgtgtgcatagatagtctatgcattctactattgaaggacatcttgattgctccaaggtttgacaattatgaataaagctcctataaacaggtacagcttttttcaactcatttgagtaaatgccaaggaacacaatggctggatggtatcataagtgtttagttttgcaaaaactgctaaactttcttgctataccattttgtattcccacctgtaacgaatgagccagaggccaagctgccatcatctcttgcctggcctcctgtgcagc

SEQ ID NO: 53125 - DNA, 601 bp, Human
agattaccctctaaattatgggtaagcctcatctaatcagttgaaaaccttaagaaaaaagattaaggtcccccaaagagaaaggaattcagcttccagaacgcctttgaaatcaagactgcaacaatggctcctgccagggtttccagcctgccagtttgctttgcaaatttcagacttgccagcaccaataatcacatgagcccattccttaaaatacatatctcgctctctctctcctctctcctctcctccctctctctctccctctctctctctctctctctctctctctctctcgtgtgtgtgtgtgtgtgtgtgtgtgtgtgtgtgtgtgtttgtgtgttgtgtagctgttggtttggataagaaatcatctttccatcatttatgaatgctgcgtgataactaccagtgtaggttataaataaaatagaatataaagactcagttctctattaatattcatttaatagaacataccagtcctatttctcatgtaaaaatcctatttgcaatgaaataaaatgcctttttagcaattataaatctaaacaccatactgtttaaacattacagaattattgtcaaactaaatgaa

SEQ ID NO: 53126 - DNA, 601 bp, Human
agcagattaccctctaaattatgggtaagcctcatctaatcagttgaaaaccttaagaaaaaagattaaggtcccccaaagagaaaggaattcagcttccagaacgcctttgaaatcaagactgcaacaatggctcctgccagggtttccagcctgccagtttgctttgcaaatttcagacttgccagcaccaataatcacatgagcccattccttaaaatacatatctcgctctctctctcctctctcctctcctccctctctctctccctctctctctctctctctctctctctctctstcgtgtgtgtgtgtgtgtgtgtgtgtgtgtgtgtgtgtgtttgtgtgttgtgtagctgttggtttggataagaaatcatctttccatcatttatgaatgctgcgtgataactaccagtgtaggttataaataaaatagaatataaagactcagttctctattaatattcatttaatagaacataccagtcctatttctcatgtaaaaatcctatttgcaatgaaataaaatgcctttttagcaattataaatctaaacaccatactgtttaaacattacagaattattgtcaaactaaat

SEQ ID NO: 53127 - DNA, 601 bp, Human
taaagcagattaccctctaaattatgggtaagcctcatctaatcagttgaaaaccttaagaaaaaagattaaggtcccccaaagagaaaggaattcagcttccagaacgcctttgaaatcaagactgcaacaatggctcctgccagggtttccagcctgccagtttgctttgcaaatttcagacttgccagcaccaataatcacatgagcccattccttaaaatacatatctcgctctctctctcctctctcctctcctccctctctctctccctctctctctctctctctctctctctckctctcgtgtgtgtgtgtgtgtgtgtgtgtgtgtgtgtgtgtgtttgtgtgttgtgtagctgttggtttggataagaaatcatctttccatcatttatgaatgctgcgtgataactaccagtgtaggttataaataaaatagaatataaagactcagttctctattaatattcatttaatagaacataccagtcctatttctcatgtaaaaatcctatttgcaatgaaataaaatgcctttttagcaattataaatctaaacaccatactgtttaaacattacagaattattgtcaaacta

SEQ ID NO: 53128 - DNA, 601 bp, Human
ccaatttaaatgtcgctgtgaaagtattttttagatgtgattaacatttaaatcagtagactttgaataaagcagattaccctctaaattatgggtaagcctcatctaatcagttgaaaaccttaagaaaaaagattaaggtcccccaaagagaaaggaattcagcttccagaacgcctttgaaatcaagactgcaacaatggctcctgccagggtttccagcctgccagtttgctttgcaaatttcagacttgccagcaccaataatcacatgagcccattccttaaaatacatatctcrctctctctctcctctctcctctcctccctctctctctccctctctctctctctctctctctctctctctctcgtgtgtgtgtgtgtgtgtgtgtgtgtgtgtgtgtgtgtttgtgtgttgtgtagctgttggtttggataagaaatcatctttccatcatttatgaatgctgcgtgataactaccagtgtaggttataaataaaatagaatataaagactcagttctctattaatattcatttaatagaacataccagtcctatttctcatgtaaaaatcctatttgcaatgaaataaaa

SEQ ID NO: 53129 - DNA, 601 bp, Human
aaacatgacaaaaccagcatatggaagtgatattccacatagtagagtggtacttaggaggctggaaatccttagtcgtgatgcatgaggtcatctactgagaagaaagtgcatataattttagggagaaataatgatacggattaattagggacacacaaataaaggacaacagtgtgttaagggaagagcatggaatatgctattgtgtaacttgaaaagggaatcttgaaaaggcaacaactacctccgtgaggtttaattttatgtgtcaccataggtaggttatggtggccagtcrtttggtcaaacaccaatttaaatgtcgctgtgaaagtattttttagatgtgattaacatttaaatcagtagactttgaataaagcagattaccctctaaattatgggtaagcctcatctaatcagttgaaaaccttaagaaaaaagattaaggtcccccaaagagaaaggaattcagcttccagaacgcctttgaaatcaagactgcaacaatggctcctgccagggtttccagcctgccagtttgctttgcaaatttcagacttgccagcaccaataatcacatgagcccattccttaa

SEQ ID NO: 53130 - DNA, 601 bp, Human
ctcataaatgatccaagagagctcaccaaacatgacaaaaccagcatatggaagtgatattccacatagtagagtggtacttaggaggctggaaatccttagtcgtgatgcatgaggtcatctactgagaagaaagtgcatataattttagggagaaataatgatacggattaattagggacacacaaataaaggacaacagtgtgttaagggaagagcatggaatatgctattgtgtaacttgaaaagggaatcttgaaaaggcaacaactacctccgtgaggtttaattttatgtgtcrccataggtaggttatggtggccagtcgtttggtcaaacaccaatttaaatgtcgctgtgaaagtattttttagatgtgattaacatttaaatcagtagactttgaataaagcagattaccctctaaattatgggtaagcctcatctaatcagttgaaaaccttaagaaaaaagattaaggtcccccaaagagaaaggaattcagcttccagaacgcctttgaaatcaagactgcaacaatggctcctgccagggtttccagcctgccagtttgctttgcaaatttcagacttgccagcac

SEQ ID NO: 53131 - DNA, 601 bp, Human
gcttcccaaacatttcagcacaatgatacaccagtctagaggtaccgactgttaatatctttagtgtgctattctaataatgaataaaactaaggaaagatagggaagtgaattcataaacagatgtctgctattaaaggaagtaactggagtgggaagaaaaaagggggattgaatccataatagttgtcatatacttaataatcttgtgtgtatcttaagtatagtacatgctatttgaattaggctttgcaatttataaaagtcattcacagatgctacttcattggataagtacctstaaattttaggaaaataaccacttaagtgctcccaacgatatccattctatcaatgtcacagattttaaaagtgaaaaaaaaaatgaaaacacatgatatcaaatagattatgtttaaagcgcatttcaggtgaccacggggtggagctctcatgggtttagagctgctggctgaggaaatcaacccagtgagtgaggtagtgaataggaactgaaacaatgaccacgctctgtataagctccaggtagataaaattgactggactgctgagtaataacagctgccattaaagaggaaac

SEQ ID NO: 53132 - DNA, 601 bp, Human
tttctgataactacttttcaattctgtcaaacataaaatgtctattttggcgagtcttttgtagttttagttctaggaaatatcttgtttcctagatggaaaaaataagctgtattcttaagggctgaaagaatgtaaaattgggtcatattagcatgtgtttcacattgaaaactctgatgatataactaggcgtttctaggggccatcaaatatcccttgcttcagtgacagaaatgttgaaaaaaaaaataacctatcaaaagtgagcatgagagagatttcctccattatggaaagragggaagcaaatggtcttctgtctttagggcagaggaagcctaagtgatcttgacatgtagattgctacccagtgtagaatgtatttcatgaaatgttacattttattcaggtaaaattagttgtgtaacatatacatgtgtcagaattgtttttaaacagttgttcacaaaggttcatttgaggagaaaggtcattcaaaaatctttgctttcagtcttcatgtcaacttaaaataaataaaaagaatgcatccgggaccaggtgtttttgttataggtaagttcatcataaagtccca

SEQ ID NO: 53133 - DNA, 601 bp, Human
gctcctaaaggtggtgaaagtctaactggaaatgtagtggattatttgtggaagtttccataatagttacaagatataattcaaaaactctttaaaaatactattttaaggacgggcgcagtgactcacgcctgtaatcccagaactttgggaggccgaggcgggtgaatcacctgagatcaggagttcgagactagcctggccaacatgggaaaccctgtctctactaaaaatacaaaaaacaattagccgtgcgtggtggcatgcgcctgtaatcccagcaggagaatctcttgaactygggaggtggaggttgcagtaaacggagatcaagccactgcactccagcctgggtgacagagccagactccgtctcaaagaaaaacaaaacaaacacacaaacaaaaaacaacactatttataccaggcactctgcaaggcaacagacttatttagtggaaggcaagggaaatattgttgctatttcacagggcttattccagtggtgaggagaaatgaaaaataagatacaatatatgattacaaacagggataagtgctaggaggtaaaccactggctgggggcagcaatagtgaggaa

SEQ ID NO: 53134 - DNA, 601 bp, Human
ttgtctcacactttagtaaacaggtgatatattacaagtttctgaaaaatgatagtgaatttcctgggctcctaaaggtggtgaaagtctaactggaaatgtagtggattatttgtggaagtttccataatagttacaagatataattcaaaaactctttaaaaatactattttaaggacgggcgcagtgactcacgcctgtaatcccagaactttgggaggccgaggcgggtgaatcacctgagatcaggagttcgagactagcctggccaacatgggaaaccctgtctctactaaaaawacaaaaaacaattagccgtgcgtggtggcatgcgcctgtaatcccagcaggagaatctcttgaactcgggaggtggaggttgcagtaaacggagatcaagccactgcactccagcctgggtgacagagccagactccgtctcaaagaaaaacaaaacaaacacacaaacaaaaaacaacactatttataccaggcactctgcaaggcaacagacttatttagtggaaggcaagggaaatattgttgctatttcacagggcttattccagtggtgaggagaaatgaaaaataagatacaat

SEQ ID NO: 53135 - DNA, 601 bp, Human
cagttgtctcacactttagtaaacaggtgatatattacaagtttctgaaaaatgatagtgaatttcctgggctcctaaaggtggtgaaagtctaactggaaatgtagtggattatttgtggaagtttccataatagttacaagatataattcaaaaactctttaaaaatactattttaaggacgggcgcagtgactcacgcctgtaatcccagaactttgggaggccgaggcgggtgaatcacctgagatcaggagttcgagactagcctggccaacatgggaaaccctgtctctactaamaatacaaaaaacaattagccgtgcgtggtggcatgcgcctgtaatcccagcaggagaatctcttgaactcgggaggtggaggttgcagtaaacggagatcaagccactgcactccagcctgggtgacagagccagactccgtctcaaagaaaaacaaaacaaacacacaaacaaaaaacaacactatttataccaggcactctgcaaggcaacagacttatttagtggaaggcaagggaaatattgttgctatttcacagggcttattccagtggtgaggagaaatgaaaaataagatac

SEQ ID NO: 53136 - DNA, 601 bp, Human
ggaagacaaagaggattacccttccaaagagatagcaaaactttcccattatcatacttttctaattctataatcaggaatagaattctaggatggaaaattagaaatagaacactaagatggaaaattaaggtgactcatccttgaattagaatgagcatcggagatatcttaacccagttgtctcacactttagtaaacaggtgatatattacaagtttctgaaaaatgatagtgaatttcctgggctcctaaaggtggtgaaagtctaactggaaatgtagtggattatttgtggaartttccataatagttacaagatataattcaaaaactctttaaaaatactattttaaggacgggcgcagtgactcacgcctgtaatcccagaactttgggaggccgaggcgggtgaatcacctgagatcaggagttcgagactagcctggccaacatgggaaaccctgtctctactaaaaatacaaaaaacaattagccgtgcgtggtggcatgcgcctgtaatcccagcaggagaatctcttgaactcgggaggtggaggttgcagtaaacggagatcaagccactgcactccagcctggg

SEQ ID NO: 53137 - DNA, 601 bp, Human
aagttattataagttctgttagaaggcattttacatcagtaaatctcaaaggaggtcaataaatcttttatcaaactccaaagctaacaaacaagagttagttcagactcttagaaggttgctatttatatttacagttccaacttgggggttcccactgagtaaaaggttaattctttatttcttgagaattttttataaaccctgatgatttacatttctaaactactgcagatgcttggcttttatgtcatcagattgagaacaaacaggacaaggaggcttctcagaaaataagaaytatttaactaaaacattctttacttggtgatattccctctctcaacctgttagtttatatcttttttactatacaacactttagaaaaaatactacattctctcatactaaaatattttgttagttggtttttaagcaaagattcttaaaataaataaaataaaaatgagtaattttcttgctcattgttaaggaaataatagagaaggcaaaatctctcaagaaccgaggaatgattaatatcctttaatgcaatggtcctcaatattttggcaccagggactagttgtgtggaagaaa

SEQ ID NO: 53138 - DNA, 601 bp, Human
gcctgaccaacatggtgaaaccccatctctacaaaaaaatacaaaaattagccaggtgtggtggtgcacgcctgtaatcccagctaatcaggaggctgaggcaggagaatcgcttgaacccaggaggcagaggttgcagtgagccaagatcgcactactgcactccagcctgggtgacagagtgagactccatctccaaaaagaaagaaagaaagatagaaaaatatgtaaatatcatagcgagatagagtatacactatctttaattattaaaaggtattttttacactacttttcaacyattattatttgctctatctttggctgacttactaatactttgcttgagggacaagtggtgaggaaaaggaagtgggccttttgattgaggaggaggatagtaatactcgcatttcatgcagttccctagggaagcaagcaggccagtagggaaactggaaagtaccccctaacagagagagaggagagtgagcagggatataaaccactccagccacctcatgattttgctttgaaaatctatagaagcactgtagtccattctaatggttatcagaaactgctagcaggaaggcctact

SEQ ID NO: 53139 - DNA, 601 bp, Human
cactgaatcgtttagtcacccattcactgattcatcaaatgcaaagaagaggaaggaaattttgcaaaaattgacattaataatttccccaaatccctattagaatttgactgtgattagtaatatgagtaagagagcaaaagcgactaaggtcaggttaggagcacataaggaatgagaaaaagagtgctataactttctttctaaagactttttctctaggtcactttttttggttgactcctgcagaataaaggaatttacaaacaaaaatgtttggtagtccaaattttgggaaacttttttttttttgcctctggttatcttttttgcactgacttaaagtattttttgaaaaatgtgtattataacacattaagcttcaaaaatccaaacaattattctttataatacttattacttagaatacctctatgggcattaaagagacaatagaaacttataggaatggaagtttggaatgcttccaaactaacaaacctcagttacaaagactgtcttaccatgatacctgtatgaagcattatgtaatgcacagtttgagtgacatcagctgcatgaatcaaattgtgatatggat

SEQ ID NO: 53140 - DNA, 601 bp, Human
tttaatagtcacctatcactactttttaatgtagagaaaacttgttaaaataactttccaaaaattgtcaagctgacagtgtaacctagtttagacaaaatagtcaatacattcataaactcatgttgtcttccctttctccatctatggtaaaagttctcattattctctttagttcaaaggtattttcttggttctggaaaacactaaaggtctaccaccagactatttttgtaatggttaaattaatggatgagtaaagaggccagtgacacatttttgctaaaggatgaataaaatyagaaagttacatttatatttggtaagtcatagctgtctcagaaagtgactatgtgatctttgctaacaactttaactttctaggagtcatgcgaggctgggccaaattccctagtcttacagagaagttggaacggcttatttggtcccataacagtcttccttataattctgagggtaaaaccacattgtggatttgattttctctatttaccaattaatatgacacccacatctcttcaatgtcaccttcacaccaggtgaagctgatatagtagacttttatttggctccctttaca

SEQ ID NO: 53141 - DNA, 601 bp, Human
gaatgccctccccaacacttcactgtttgaattgcaactcttcctctgtctccatcaaggggctacaatgtgtaagcccaccccatttcaggctttaacagcttggaattatcatgtgtccatctctggccgtgggagcagacttatataagaactggattgacagtgagtgtcccttttctcactcctcaattctgccactgccatcacctgaccaagtgcatatagacaggtcactctacctctcgaggtcttcattttctatttttagatgacggatatcagaccagatgatctatastgtggatctcactcatcttagggtcctttaagttctaaagtgtctaatattttaataaactgtttctatattccccacatcaaacaataactcccacatctggaaaatcagttgttaaaaatatatatatattaaaaaaccaaatgaactgaccacacaagagcctgcacatgtatgcttatatcagtattattcataagtgcccaaatttggaaacaaccaagatttgctttaataggtgaatagataaacaaactatggtatgtccatgtaatggaatagtattcagtgataagaaat

SEQ ID NO: 53142 - DNA, 601 bp, Human
ttttcctttgacattaaatacaaataaaagcaaaaatctccctatactctgcaaatatgggtagaaaaacaacattcctgctacataaccagactctgacgttttccttttccctccaaactgtatcaatctctgggaccctggggtttcctccattccagggacagacagaatgccctccccaacacttcactgtttgaattgcaactcttcctctgtctccatcaaggggctacaatgtgtaagcccaccccatttcaggctttaacagcttggaattatcatgtgtccatctctggcygtgggagcagacttatataagaactggattgacagtgagtgtcccttttctcactcctcaattctgccactgccatcacctgaccaagtgcatatagacaggtcactctacctctcgaggtcttcattttctatttttagatgacggatatcagaccagatgatctatagtgtggatctcactcatcttagggtcctttaagttctaaagtgtctaatattttaataaactgtttctatattccccacatcaaacaataactcccacatctggaaaatcagttgttaaaaatatatatat

SEQ ID NO: 53143 - DNA, 601 bp, Human
agctcagtgatgagcgatctttaattaaaatcctccacatcgtggatccagtggatgtagagagcctttgttaagcaaaatgatctgcatagtcttgttttcctttgacattaaatacaaataaaagcaaaaatctccctatactctgcaaatatgggtagaaaaacaacattcctgctacataaccagactctgacgttttccttttccctccaaactgtatcaatctctgggaccctggggtttcctccattccagggacagacagaatgccctccccaacacttcactgtttgaattkcaactcttcctctgtctccatcaaggggctacaatgtgtaagcccaccccatttcaggctttaacagcttggaattatcatgtgtccatctctggccgtgggagcagacttatataagaactggattgacagtgagtgtcccttttctcactcctcaattctgccactgccatcacctgaccaagtgcatatagacaggtcactctacctctcgaggtcttcattttctatttttagatgacggatatcagaccagatgatctatagtgtggatctcactcatcttagggtcctttaagt

SEQ ID NO: 53144 - DNA, 601 bp, Human
tcctagttataacctagcactggccctgccactgaatatttatgatagagtagacaaggacaaaataaaaaatgaaaagttcccactaaaacaacaccaccaccaccacacatggatagctatgtgagatgatggatatattaatttgcttctgtataataatcattttactatctgtatcttatcatgttatataccataaatgtacacaataaaaactatttaataacaacagagaaaacaaaaactaaagaaatctggcattttatacaagcagcctgtttaagatctgtgtctgatmgtctgccagataaaccaagctttattattcatccaacatatgataaatgacctaccaggcactattactttctttttttttctagcactatcataaagatgaaataatatatgtctttaatagcacatatttctaaaatagatttccatttaataatcttagttaaggcctaaaaaggatttaatgaataatcatacctcaatatacagaaatatgaactagcaaagcacatgtataattctcattgaagagataattgaagagatgtttcccaagcaaaacactgtgtgcatttctaga

SEQ ID NO: 53145 - DNA, 601 bp, Human
tttatcaaaaaaaaaaaagaaatttatttatcacagttcttaactggaaagtcaaagatcaacataccatcatctcaggagggccttcttgctgtatcatcaaatggtggaaagcatcacatagtagaaaggcagagagtgcaagagagcaaaccctctctggcaagccccattttataatggcattaatttatttatcaggatagaacactcctgacctcaataccttccaaccctgtcacattgggagttatgtttgcaacacatgaattctgggaaacacattcaaaccatagcagtytgtgtctagattcttctttgctttttgcttttgcatgtggatgttcagtcgtgttagcaccatttattgaaaagattatttttgcttcactgtattgcttttactcctttgtcaaagatcagttgactatattttttgtaggttcattactgggctctctactctttttcattgatctatttgtctgtccttttatcaatactacactgtcttgattactgtggttttgtagcaagtcttaaagttaggtagtgtcagtcctccaactttgtgcttctcctttaaaactgtgttagctat

SEQ ID NO: 53146 - DNA, 601 bp, Human
tctttgtatattttggataacagtgctttatcagatgttctttgcaaatattttcttccagtctgtggcttgtctttttagtctcttgatagtgtctttggtagagcataaatttttaattttaatgaaatccaacttatcaatttattatttcatatattgtgcctttgatattatatttaaaaagtcatcaccaaatctaaggtcatctagatttttcttctatgtaatcttctaggaattttatagatttttgttttaaatttaggtctgtgatccattttgagttaattttgtaaakggtataaggcctgtgtcttagtgtgttttatgctgatgtgacagaatacctgaggctgggtaatttatcaaaaaaaaaaaagaaatttatttatcacagttcttaactggaaagtcaaagatcaacataccatcatctcaggagggccttcttgctgtatcatcaaatggtggaaagcatcacatagtagaaaggcagagagtgcaagagagcaaaccctctctggcaagccccattttataatggcattaatttatttatcaggatagaacactcctgacctcaataccttccaaccct

SEQ ID NO: 53147 - DNA, 601 bp, Human
agtgttatggattttggccattttaatagatgtgtattgcctattgatctatttggtatctcattgtttcaatttggatttctctgatgacatgatatggaatatcttttcatatgcctatttgccatttgtatatcttcctagctggagtgactggtaaagtttttggttcatttttaaattaggttgttagttttcttattgttgagttttaagcattctttgtatattttggataacagtgctttatcagatgttctttgcaaatattttcttccagtctgtggcttgtctttttagyctcttgatagtgtctttggtagagcataaatttttaattttaatgaaatccaacttatcaatttattatttcatatattgtgcctttgatattatatttaaaaagtcatcaccaaatctaaggtcatctagatttttcttctatgtaatcttctaggaattttatagatttttgttttaaatttaggtctgtgatccattttgagttaattttgtaaagggtataaggcctgtgtcttagtgtgttttatgctgatgtgacagaatacctgaggctgggtaatttatcaaaaaaaaaaaa

SEQ ID NO: 53148 - DNA, 601 bp, Human
tacctcccaacaggtccctccctcaaaacatggggattacaatctgagatgagatttggtggggacacggagccaaaccatatcagccactgtctttcagactccagaatggtaaatctaccgacagcttgcactgtgcacatggaaaagccacaggcactggacgccagccagtgaaagcagccatgggggctgtaccctgcagagcaacagaggtggagtgcccaaggccgtaggagcacaccccctgcatcagcataccctgaatatgagacatggagtcaaaaagattatttggggkctttaagattaaataactgccctgctggggttcagacttgcatggggcctacagtccctttgtttgggccaatttctccctttcggaataggagcatttacccaatgcctgtaaccccattatatctcggaagtaactaacttgtttttcattttacaagctcataggtggaagggacttgccttgtctcacatgaggctttggagttggacttttgagttaatgctggagtgagttaagacttttggggactgttgggaaggcatgattggttttttgaaatatgagaaggacatgtga

SEQ ID NO: 53149 - DNA, 601 bp, Human
tggaattttgaacttgagagagatgatttagggtatccggtgaaagcaatgtctaagcagcaaagtgttcaagatgtggtttggctgtttgtaaaagcctatgctcatttgcataaagaaagaaattacctgaaactggaacttatatttaaaagagaagcagagcataaaagtttaaaatagttgcagcctgaccatgaggtagaaaagaaaaacccattttctggggaggaattcaaggctgcaaaaatttgcatacgtaaagagaaacctaatgttaatagcccagacaatggggaaratgtctccagggcatttcagagaccttcatggcagcccctcctatcacaagcctgaaggcctagcagggaaaaatggattcatgggccaggcctatggcctccactgctctgtgcacgcatcctggacattgtgccctgcatcccagctgctctagctccagtcgtggctgaaagaggacaaggtacagctcaggccattgcttcagagggtgaaagccccaagccttggtggcttctacatggtattaggcctgtaggtatgcagacagtagtaattgaggcttgggagcctttgccta

SEQ ID NO: 53150 - DNA, 601 bp, Human
cagacagtgaagactaggttgaggacgtcttaggtagagataaggaggtcttaggtagagacgaggaacttatttgggactctgagtatttgagtacttatttgagtaaaagtcactctggctatgctttagcaaaaagactgatggcattgtgcccctgctctagaaatctgtggaattttgaacttgagagagatgatttagggtatccggtgaaagcaatgtctaagcagcaaagtgttcaagatgtggtttggctgtttgtaaaagcctatgctcatttgcataaagaaagaaattrcctgaaactggaacttatatttaaaagagaagcagagcataaaagtttaaaatagttgcagcctgaccatgaggtagaaaagaaaaacccattttctggggaggaattcaaggctgcaaaaatttgcatacgtaaagagaaacctaatgttaatagcccagacaatggggaagatgtctccagggcatttcagagaccttcatggcagcccctcctatcacaagcctgaaggcctagcagggaaaaatggattcatgggccaggcctatggcctccactgctctgtgcacgcatcctgga

SEQ ID NO: 53151 - DNA, 601 bp, Human
acagacagtgaagactaggttgaggacgtcttaggtagagataaggaggtcttaggtagagacgaggaacttatttgggactctgagtatttgagtacttatttgagtaaaagtcactctggctatgctttagcaaaaagactgatggcattgtgcccctgctctagaaatctgtggaattttgaacttgagagagatgatttagggtatccggtgaaagcaatgtctaagcagcaaagtgttcaagatgtggtttggctgtttgtaaaagcctatgctcatttgcataaagaaagaaatkacctgaaactggaacttatatttaaaagagaagcagagcataaaagtttaaaatagttgcagcctgaccatgaggtagaaaagaaaaacccattttctggggaggaattcaaggctgcaaaaatttgcatacgtaaagagaaacctaatgttaatagcccagacaatggggaagatgtctccagggcatttcagagaccttcatggcagcccctcctatcacaagcctgaaggcctagcagggaaaaatggattcatgggccaggcctatggcctccactgctctgtgcacgcatcctgg

SEQ ID NO: 53152 - DNA, 601 bp, Human
ttgttgaatggctgtgaccaaaatactgatagtgatacagacagtgaagactaggttgaggacgtcttaggtagagataaggaggtcttaggtagagacgaggaacttatttgggactctgagtatttgagtacttatttgagtaaaagtcactctggctatgctttagcaaaaagactgatggcattgtgcccctgctctagaaatctgtggaattttgaacttgagagagatgatttagggtatccggtgaaagcaatgtctaagcagcaaagtgttcaagatgtggtttggctgtttstaaaagcctatgctcatttgcataaagaaagaaattacctgaaactggaacttatatttaaaagagaagcagagcataaaagtttaaaatagttgcagcctgaccatgaggtagaaaagaaaaacccattttctggggaggaattcaaggctgcaaaaatttgcatacgtaaagagaaacctaatgttaatagcccagacaatggggaagatgtctccagggcatttcagagaccttcatggcagcccctcctatcacaagcctgaaggcctagcagggaaaaatggattcatgggccag

SEQ ID NO: 53153 - DNA, 601 bp, Human
ccactcgtacacatattttttcccctctgtcacacctgagaagcaaaaccaatccctcctcttccattctcctcctcagcccactccacataaagacagaggatgaaggcctttttgatgacccacttccacttaataaacagtaaatatattttctattctttatgattttcttaataacattttcttctctctagttactttattgtagtaatattgtatgtaatacaaataacatacaaattatgtatttatcaacttttatattattggtaaggcttcctatccagagtgggctatyagtagttaagtttttgaagtgtcaaaaggtatacatgggttttcagttgaatgggggtgccccaacccctgtattgttcaagggtcaactgtaaaatgaaaggcctgaactgtgtctccaaaagaaagttccaccttccctctacctgacagcattttctagagttgcaaaaatgagcccatatctctagatatggccttgaagaaccaggaaactttgaaaatttgaaaaagtgttcacaggagatttaggcttattttaaactctgatttttatcttttacgttttttaatgttttta

SEQ ID NO: 53154 - DNA, 601 bp, Human
taaaatgttatcaaacgtatagcatcaaataggtattttatagatttttggaaagtgttgaatctattaaattctaaaatgtatataatatgtacactatttgttaaaacaattctttaaaaacattcaattaaaatgactctgaagttaccaaacagaaacttagacaattacagcaataaactattagaataaaatatttaaaatggtaaataacaaaatataataggaaataaaatcacactgaaatagcaacaaagtgaactttgaggaaaaaatgtttatttctttgaataacaagaaattaatattataaaaattatctatgggaatggtaatcactgattaagaaaataaactaataccctagatgtaaataatctctcttaggctttaggaaatatctcagaacttgtctgcttgttcctacctttgcccatctaatcgctacatagcccaacagtggtctctttaaaattatttcacagttagatcctggcatttctagactgtaaatcctcttgggctactatttcctgcagaatacagttaacccttgaacaacataagtttgaactgtgtgggaccactcgtacacata

SEQ ID NO: 53155 - DNA, 601 bp, Human
gctagtgctttcccttctcactcccacaactcttctgcagtcataattcctaaatattattatttttaatctgaaaggaactttagccattttaaagaaaaactattccaaatacagtattatatagtatttcaatgctttgaggaaaaaaagtagtccagtggggcctgagactattctaaatccacatgtcaaccaaactaaaaggtttgatgtctcagagaagagacagagataagaagagcatgagatttcaagaccctatctgattcttcttcattttgcatttttaatcaaaackactactattaataaaaccagtgctattcattcagtatttattcagcaaggcactgaactgtaaggattaaatgtcttcatataataccgataataaaatactttagcaactagttgctttgtatgtatacaaagacatttaatcctcctaacaatcctgagggagcattaatatttccccccaaaggagactgagtcacccagtcacacagctggtacatggctcagataagattcaacgcaagaggtcccacttccaaagcagacacatggaccactcctctgtgccaagcttccatca

SEQ ID NO: 53156 - DNA, 601 bp, Human
gagaaatgaaataatctgaaaatacagaaataaaagaacttctctaagtgggactgtgatataataaaacaaaattatctgatattcattcccagttcctagcagagcttcaaaaacctgtggaatttcatgagtgataggagactctaggctaatgaggcaactctgggcctatcccctagatagtttcagcatagggcctggtcaccagaaaccaaccacatgattagaaagttggaactttaagccagccaggggatatctgggaaggaagtgaggctggagactgagttcaatcgcrtgtccaatggtttaatcaaccatgcctatgtaatgaaaccttgataaatactctggacaggaaagctcagtagagcttcctggatggtgaaaacattgacaaggcaggatggtggtactcgctaactccactggaaatagcaaggaagctctgcatccaagaccctcccagacctttccttatgggccttttcatttggctctgcctggattgtattctttataataaaattgtaattgtaaggatagcacttttgaagttttgtgagtcattctagcaagttatcaaacctagagaggg

SEQ ID NO: 53157 - DNA, 601 bp, Human
atgaacaaactttcaaaataccacacattatgtccatcaacaatgggagacagaaacgtgagtcatccaaacatagtaatatatttggtgtttatatcttcagaacaggtataaaattaatgaacaaactttcaaaataaagaacaatactgagaaatgaaataatctgaaaatacagaaataaaagaacttctctaagtgggactgtgatataataaaacaaaattatctgatattcattcccagttcctagcagagcttcaaaaacctgtggaatttcatgagtgataggagactctakgctaatgaggcaactctgggcctatcccctagatagtttcagcatagggcctggtcaccagaaaccaaccacatgattagaaagttggaactttaagccagccaggggatatctgggaaggaagtgaggctggagactgagttcaatcgcatgtccaatggtttaatcaaccatgcctatgtaatgaaaccttgataaatactctggacaggaaagctcagtagagcttcctggatggtgaaaacattgacaaggcaggatggtggtactcgctaactccactggaaatagcaaggaagc

SEQ ID NO: 53158 - DNA, 601 bp, Human
gtaagtatgtgaagctataaaatttcccctaagcactgcttcagttgcatccaacaattttcaaatattatgttttcaaaatcattcaacttaagatatttaaaaatttcttcttaacctgaaaaatctttgtatctctttatttttctgtttttgcatctctaatgtcacagggctatacagaaagatctctggttgattgattgagtatatcattataatttttaattgaccataataagcagttgacctttagaatttggtaggtttttacatttagtgtatttttttagcacaaagyaaattattaaaatatttttcaatactatttttaggaccaaaatatttgaatttagtaagatgctactcagtaactttctctaggaatataaattgcaatataaaaatgaaaccacacattatgtccatcaacaatgggagacagaaacgtgagtcatccaaacatagtaatatatttggtgtttatatcttcagaacaggtataaaattaatgaacaaactttcaaaataccacacattatgtccatcaacaatgggagacagaaacgtgagtcatccaaacatagtaatatatttggtg

SEQ ID NO: 53159 - DNA, 601 bp, Human
tcttaaggtgaaacagatataacttactttattacacattttttttctaatgtaagtatgtgaagctataaaatttcccctaagcactgcttcagttgcatccaacaattttcaaatattatgttttcaaaatcattcaacttaagatatttaaaaatttcttcttaacctgaaaaatctttgtatctctttatttttctgtttttgcatctctaatgtcacagggctatacagaaagatctctggttgattgattgagtatatcattataatttttaattgaccataataagcagttgayctttagaatttggtaggtttttacatttagtgtatttttttagcacaaagcaaattattaaaatatttttcaatactatttttaggaccaaaatatttgaatttagtaagatgctactcagtaactttctctaggaatataaattgcaatataaaaatgaaaccacacattatgtccatcaacaatgggagacagaaacgtgagtcatccaaacatagtaatatatttggtgtttatatcttcagaacaggtataaaattaatgaacaaactttcaaaataccacacattatgtccatca

SEQ ID NO: 53160 - DNA, 601 bp, Human
tgggaagtaggcaggatgggaaaaggtaagaaggtgtatagagacaggaaggggaagactcatgtctcccactcctggaagaatgagaagctagggcctacccttgagttttctgaagtcaagtccaattatctctctaatttgcattattaggcttcttatgtttgaccaatgtacataaaatacagtctttaacaagaaacacaagatgtttacatttaaactgtagctgagcaccatgatgagctctggacagacctcttttgatttacctcaaaatctctagcacagccagtggaawttaagacacagtatttagcttcttagtaccttccaaaggaatgaagacatatatttgcaaattgctttgtaaaagtgctgttttcactgtccgagatgaaaaacccagtcaccttggctaaatgcagagcagaatggtatcagtactgtgggtctgacaaagtgacagttttacagatggctatgtgaggatgaacaaaaataaaacatacaagaaccactgcagtcctgctaatttctaggacatatgcatagatacatagacacagttcaatatcttatgtcaaatcagagaaatgca

SEQ ID NO: 53161 - DNA, 601 bp, Human
ggcgcctgccaccatgctgagctaattttttatatttttagtagagatggggtttcaccatgttggccaaggtggtctcgaactcctgacctcaggtagtccctctgcctcagcctcccagagtgctaggattactggcgtgagccactgtgcccagccactttcttgagctaaattttatagaatgttgaatggcaacatatttcctatagggcttaggcatttgacagatatatgcagggatgaccttcctacagatggagcaagagattttatattctatttgcttcctgtacctcamaattaatttagaatattaaattttcactgtcaaagcacattgaatgctaaagtacattaattatttaatttatttataaatatttcaaagtattatttactctttagggtgaataaaggccatgagtgcaagattagtagggggccctgtaggtaaactatgaaggaactagaactttgtataaagagaatgttagaatctctgagtatagatttggccacctttataatttcctcattctgtcccaggataaggaatatttattttccatcaaggtaaaagcagaggtcatcgcaataa

SEQ ID NO: 53162 - DNA, 601 bp, Human
tgttaattgaccacctagggtactattttaagttctatgttctttttttgttctttttttttttttttttttttttttgagatggagtctcactctgttgcccaggctggagtgcagtggtgcaatctcggctcactgcaacctctgcctcctgggttcaagtgattctcatgcctcggcctcccgagtagctgggattacaggtgcatgccaccacgcccggctaattttttgtattttttagtagagacgggtttcaccgtgttagccaagatggtcttgatctcctgacccgagatcyacctgcctcggcctcccaaagtgctgggattacaggcataagccactgcacccagccagttctatgttcttaaatgcctgagatgtgtagactgtcaactggggcatcacctctactaacatggcagcaatttgcattacagcaacaagcctcagaaacttccattcttagcttgccacatcaggtccttagcctgccacgtttacacttactaagcaaggataggcacctgtgttatggtctctagaaaaacagctgttgaaacttggatgggaaggggaaaaggtcagagcaggcagc

SEQ ID NO: 53163 - DNA, 601 bp, Human
atctctgggagacagcattaatcccaccactttgagatgtcagtactgaatgaagacttttacatttaaagtactcatcaagatagaaaatgacacacagagaaaagggcattgtcctctgggagcattttccatcccatgtttaggcagaggaggagacaacaacctattctaaggtctgtgtacatggcaatatcccagatcccaggactgctgtgggtgcctcaagtcaagaattgttgttggaaacacttctgagagcaatggactaccacctgaatataggagaatagctggaggkaggctttttaagtgataatgtcctgtaaatatgcacatttaaagattgtccatcagatgcttggataaaagtaattcacatttcaagtaactggattacttatagtatataataaggcacatttttaatttaataaaacttcagtagttttaatggatgccttcaagttaaatcagtgttaattgaccacctagggtactattttaagttctatgttctttttttgttctttttttttttttttttttttttttgagatggagtctcactctgttgcccaggctggagtgcagtggtgca

SEQ ID NO: 53164 - DNA, 601 bp, Human
aaacaccacaaagatgaaaaataatgcaaaaaagaaaatatcatacctgcttgccacataggaagaagtttcggcttttgaggcttcctctataagaggaataacaattttctctgttgagtctgtcagaagagaaaatgttggctctactatgaaatcgatgaaacctacaaaagccaaaatgagaagagagagagataaattcaagtgttacaatttcctgaattctgaaatcagaaataatgaagagcttctgacaatcctgggatagcaagaatcaactaaaatattggttctgctyaccctttgtattgttttaatctaataacagtctttagagatggtttaactgctctataaaataatacttgaagccatggaagtgacacaatttaagcttgctaactcaagtatattggcttttctatttactattcagccttatataatatacgattgctaacaatacatttagatccaatgagagtgactatagtttcctctctcaacaccagggatcattatcttttttgaaagcacatcatgtgcattttggattttattctttactaacaagaaatcatatctaagctccaaagaa

SEQ ID NO: 53165 - DNA, 601 bp, Human
aaatataatcattaaggaaagtgttactaaacaccacaaagatgaaaaataatgcaaaaaagaaaatatcatacctgcttgccacataggaagaagtttcggcttttgaggcttcctctataagaggaataacaattttctctgttgagtctgtcagaagagaaaatgttggctctactatgaaatcgatgaaacctacaaaagccaaaatgagaagagagagagataaattcaagtgttacaatttcctgaattctgaaatcagaaataatgaagagcttctgacaatcctgggatagcragaatcaactaaaatattggttctgcttaccctttgtattgttttaatctaataacagtctttagagatggtttaactgctctataaaataatacttgaagccatggaagtgacacaatttaagcttgctaactcaagtatattggcttttctatttactattcagccttatataatatacgattgctaacaatacatttagatccaatgagagtgactatagtttcctctctcaacaccagggatcattatcttttttgaaagcacatcatgtgcattttggattttattctttactaa

SEQ ID NO: 53166 - DNA, 601 bp, Human
atgtccaccaggttgttcttgaaactcttcaggtccactgctgcaagggagtagtctggggaataggacccatcactcatggagccttttgtatttgatcgtcttagtgcatcagcaatgtgtaaccccacaatggtggttgagctaacagtaacaaccaaagaaaccaaaaaacaccatcaggatatggggtgaacaaggaaaacctgaaaaactttacaaaaccgactagaaaagcaggatagtagatgctcagtcccagttctgagcacgtggcagctgctcatctcctttctctccstccccacactggattctccttagtacacaccttacttagtatttcatattttgtgtattaaacttcagttgtcaaaggcagatgcaatataatataaagccactaggtggcaatactccctaataattcttgtgagaattctctgcctagatgtgagaaatataatcattaaggaaagtgttactaaacaccacaaagatgaaaaataatgcaaaaaagaaaatatcatacctgcttgccacataggaagaagtttcggcttttgaggcttcctctataagaggaataacaattttctct

SEQ ID NO: 53167 - DNA, 601 bp, Human
actgtgttataagaaaatacttgagaaagtactccagtgtgaagagaaatgataccaaatagtagctctgacacacaagaagaaatgaagaatatcataagggtaaatatgtgagaacatacaaaagattgcatatacgaatgtgtgtgtctgccatctgtcaagttctgcaggaattaatgtgctatttttggctctctggtctattcccaaggcccatcttattatctctatatcacagccacactaaatttattacttcagtataagagtaaattttgatatatggcaagtgctcccrctttattatccttcaggagtgtcttgagtattcttaggtatttgcaataccatatagattttaggatcaatttcttaaattccatgaaaaatgtattggaattttcactggaaacatgttatatttatggttgacatttgggataattgaaaacgtttcaatattgtgtctttctgactataaatatgatttaacactctattttgatcttatattatccattttaagaaaagtaagtttattcctgagtatattaaagctgcaaaaaacacaaggaaaaaatttctggctgaaaaaata

SEQ ID NO: 53168 - DNA, 601 bp, Human
ttgtttctatttttactacccaaacaaaagcacattttccattctgtagcagagtaatccttttgaaacctcagttcagatcaatcaacattttttctcaaaactctacatttggtttcctgtctttctcgggccaaaaccaaaggtcaggcaccacattccccactcatcacattgcctacattattcccacttgtccaatttcttcctgcttcactgcccttcttgttgtttctggcatgtcaggcaagcttggcctcctagataatgtggtagccaatccgttttaaaaatttgttamcacccaccctcccagacctctccatcattctctttctaacctccattgtgtatttatttaaattatttcttcctcagtgaaggctttccttaccagtttactatatagaaattatccccaatttccatagtaattagattttcttaatctggtaatgtctttatttttctttatttctgaatagttttgctggatttagaattcagcattagggacacccctagtttctatatagtagccctataacccttatttctagaacacatggcagaaacataaataatatagtaataacagcta

SEQ ID NO: 53169 - DNA, 601 bp, Human
aactggtgcactctgctgggagagtcccccttgttagggtcagctgctctcttcagagccagcagacaggaaagattaaatccgctgaacctgcgactgcagctgcctctcccttcaggtgctctgtcccagggagttgagagtcctgtctgtaagcccctgactggagctgctggatttcctgcagagatgccctgcccagtgaggaggaatctagagaagcagtctggacacagccgctttgctgtgttgtggtgaattttgcttagtccaaacctctcagtctccttcacactgtcargggaaaaccgcctactaaagcccagcagtttgcttattttgtgcaacactgtgtccttcattcctgtggtgattagttaaattttaacagttttatactgttccataatatgtacatactacagtatataaatcaattttactgttttttacactttattttgcagtcatgaacaatgctgctgtgaatattttagacatgtctttgatgcatatgcacaaaagtctctctggggtaaaaatacagaagcaaaattgtcgagaagtatggcacatgcatctttaaatttcctacagaatg

SEQ ID NO: 53170 - DNA, 601 bp, Human
ttctctaatcttgtctgcatgccttatttcagcaagatggtcttcaaattctgatatcctttcttctgcttgatttattcagctattgatacttgtgtatgcttcatgaagttcttgtgctgtgtttttcatctccatcaggtcatttatgttcctctctaaactggttattctagttagcagctcctgtaaccttttatcaatgttcttagcttctttgcattgggttagaacatgctcctttagctcagcagagtttgttattacccaccttctgaagcctacttctgtcaattaatcyatctcattctctgtccagtcctgtgtccttgctggagaagtgttacaatcatttggaggagaagaggcattctggcttttggaattttcagcgtttttgcactgtttcttcctcatcttcatggatttatctacctttgatctttgaagctgatgacctttggatgaggttttgtaggaggtcttttttgttgatgcttttgttgttgttgctttctgtttgttactttttcttctaacagttagacccatcttctgcaggtctgctgcagtttgatgggggtccactccagaccctgtc

SEQ ID NO: 53171 - DNA, 601 bp, Human
aaagaatgattatcacaaaattcaaaacaataattagctcatgggtgggagagaaggaaataaatgattagagaaggcatagagagaattccaagggcatggcaagatcatatatttcatattttggggcctagatggtaggttttctacctctctccttccttcttcccttctcctcctttctctaccccctcctctctcgtcctccctcttgcgctctgtctctctctttcttccctgcctactgcagataatcatttgaatttctactttgtgccagtctctgttcaaagagcttggratacatcagcaatggaaacaaacatctttattttaatgaaccttatttttaagagggtgaagtagataataaaaatgaagcataataggtcaacagtctctccctgctctaggactagggagatgtttttgcgatatctgtgaaatagagcttaagggttaatatgatgatgagcaaacatctggaattctcttcaaagccctgatgcttaattaatattccaaagctctaaacatcatatgacctgcttattttaatctcaatgcaattgtaataaagaaactttcatcttcagcgtat

SEQ ID NO: 53172 - DNA, 601 bp, Human
tatttccgagggaaaaacaagaaagaattctgagaaaaagtcagggatccaggggttagagaagatctttgtcatgttcccttatccagcattctgaacaaggtgggtgttctcagcatgcaaggaatagaggaggggtggctgtgtagaatgtcaggacaggagagcctgagagagcgcctgcagtattcagtcaaccccagtgactctgatgtgaagaccagcctgtccttcagccctgagaagtacaatgagaaggagaagaaaagagagcaagcaagctgtggcaagcaaagatgtrggggcctgccgtgggaaagcaaggggtcagagtcagaaggtgataccagccaaaaaccaatgggggctgtctgtctggaaagatgagagagaggccagaggtcaagcaagaacctgatgctcatctgaaatccattaataccacaacattagtccccagggactgcaatgccatctaaagaaggaggaaagagaggtcagaaaccctggattgaccaggcttactctgattcagtcaaaacacttaaatgataagcttatattttcttcaaacaggtagcatgaggacatagctagaaac

SEQ ID NO: 53173 - DNA, 601 bp, Human
atttggccatccctgtgcattttgagttatttccgagggaaaaacaagaaagaattctgagaaaaagtcagggatccaggggttagagaagatctttgtcatgttcccttatccagcattctgaacaaggtgggtgttctcagcatgcaaggaatagaggaggggtggctgtgtagaatgtcaggacaggagagcctgagagagcgcctgcagtattcagtcaaccccagtgactctgatgtgaagaccagcctgtccttcagccctgagaagtacaatgagaaggagaagaaaagagagmaagcaagctgtggcaagcaaagatgtgggggcctgccgtgggaaagcaaggggtcagagtcagaaggtgataccagccaaaaaccaatgggggctgtctgtctggaaagatgagagagaggccagaggtcaagcaagaacctgatgctcatctgaaatccattaataccacaacattagtccccagggactgcaatgccatctaaagaaggaggaaagagaggtcagaaaccctggattgaccaggcttactctgattcagtcaaaacacttaaatgataagcttatattttcttcaaac

SEQ ID NO: 53174 - DNA, 601 bp, Human
cattcaaattggaggagggaaaagcttaactccttacccttccagtgacatatttttcaccccctatgaaaccaaaagtaaggtgtaagggagaaaagagttggaagattcaagagacttagacagttatagtctgagacgggacctgctctctgaatttggccatccctgtgcattttgagttatttccgagggaaaaacaagaaagaattctgagaaaaagtcagggatccaggggttagagaagatctttgtcatgttcccttatccagcattctgaacaaggtgggtgttctcagcrtgcaaggaatagaggaggggtggctgtgtagaatgtcaggacaggagagcctgagagagcgcctgcagtattcagtcaaccccagtgactctgatgtgaagaccagcctgtccttcagccctgagaagtacaatgagaaggagaagaaaagagagcaagcaagctgtggcaagcaaagatgtgggggcctgccgtgggaaagcaaggggtcagagtcagaaggtgataccagccaaaaaccaatgggggctgtctgtctggaaagatgagagagaggccagaggtcaagcaagaacctga

SEQ ID NO: 53175 - DNA, 601 bp, Human
aattcaaaagccacatccatgcatggctaaaaggtttttggaaaatacttaatcaagttctaccttcccacccatacttccagaggagatccaggtttctcactccctggacatggatctaggttttccctaagagaagcaaaaaggggtatgaaggtgccattcaaattggaggagggaaaagcttaactccttacccttccagtgacatatttttcaccccctatgaaaccaaaagtaaggtgtaagggagaaaagagttggaagattcaagagacttagacagttatagtctgagacrggacctgctctctgaatttggccatccctgtgcattttgagttatttccgagggaaaaacaagaaagaattctgagaaaaagtcagggatccaggggttagagaagatctttgtcatgttcccttatccagcattctgaacaaggtgggtgttctcagcatgcaaggaatagaggaggggtggctgtgtagaatgtcaggacaggagagcctgagagagcgcctgcagtattcagtcaaccccagtgactctgatgtgaagaccagcctgtccttcagccctgagaagtacaatgagaag

SEQ ID NO: 53176 - DNA, 601 bp, Human
gatctggttttgtttctacttgtttgttataacaggctcatgcctatttagacaaggagacacaggggttgttactaagctaccccaaaaacaaaggcatctatcctttgtcttcaaattcaaaagccacatccatgcatggctaaaaggtttttggaaaatacttaatcaagttctaccttcccacccatacttccagaggagatccaggtttctcactccctggacatggatctaggttttccctaagagaagcaaaaaggggtatgaaggtgccattcaaattggaggagggaaaagyttaactccttacccttccagtgacatatttttcaccccctatgaaaccaaaagtaaggtgtaagggagaaaagagttggaagattcaagagacttagacagttatagtctgagacgggacctgctctctgaatttggccatccctgtgcattttgagttatttccgagggaaaaacaagaaagaattctgagaaaaagtcagggatccaggggttagagaagatctttgtcatgttcccttatccagcattctgaacaaggtgggtgttctcagcatgcaaggaatagaggaggggtggc

SEQ ID NO: 53177 - DNA, 601 bp, Human
tattggtctaaaattctctttttttgttgtgtctctgcctggctttggtatcagaatgatgctggcctcataaaatgagttatggaggattccctctttttctattgattggaatagtttcggaaggaatggcaccagtttctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcraggaatttatccatttcttctagattttctagcttatttgcatagaggtgtttgtagtattctccaacaccatttattaaatagggaatcctttccctattgcttgttttggtgagggttgtcaaagatcagatggttgtagatgtgtggcattatttctggggcctctgttctgttccattggtctatatatctgttttggtaccggtaccatgctattttggttactgtagccttgtagtatagtttgaagtcatgtagcatgatgcctccagctttgttctttcatttggatttccc

SEQ ID NO: 53178 - DNA, 601 bp, Human
tacacgttgcataaaacagaacaggttatctcatttgttttttatttattttattttattttatttttattatactttaagttctgggatacatgtgcagaatgtgtaggtttgttacagaggtacacacgtgtcgtgggggtttgctgcacccatcaacccgtcatctacattagatatttctcctaatgctattcctcccctagctccccaccctctgacaggccctggtgtatgatgttcccttccctgtgtccatgtgttctcattattcaagtcccacttataagtaagaacatgytgtatttggttttctgttcctgtgttagtttgctgagaatgatggtttccagcttcatccatgtccctgccaaggacatgaactcatcctttttaatggctgcatagtattccatggtgtatacatgccacattttctttatccagtctatcattgatgagcatttgggttggttccaagtctttgctattgtgaacagtgctgcaataaacatacgtgtgtatgtatctttatagtagaatgatttataatcctttgggtacataccactgtcttccacaatggttgaactaatttacc

SEQ ID NO: 53179 - DNA, 601 bp, Human
attcaatacaaagtaacattgacatgttttcgttactttcaaaaaatcaatttttactttctctaagcaacagatatggaagagtgaggcccactggtgagtactaataggcattgctggcaaataaaaacatgtgctcagaaagcttacagagacccgtgagataaaactacagataaataccacaggggaatgtaggtctttgagagtcactgctctgtaactagttggggtggggtgccaaggctaacactgctattcattctccctgagcagcttgttatctagcagtcctaaaggygatttgaaaatattcactgaaaaagcctctctaagtgtccacagaatcagagcttgggaatggagcctgaagccattcagccttatttcctgatgacgtccatggacgcagacctaggtttttcacagagaagcaaaggaggaatataaaggtggtactcagatagattacttatttattgttccaataacaactttttcacatgctctgaaaccgaaaggaagacttggcttgattcaaactgtgatacttttcagaaggagcaagagaaactctgagagtcaatcaggggagggtaaa

SEQ ID NO: 53180 - DNA, 601 bp, Human
tttgttttcctctgattatttgtcccttttgaaatctaaaatgtacatgtatattctctcagaattgcttaggattcagtcctgggaacttagaagttataatgtaaagtgaactgtgctttacatgaagggttttgattgaattaaaaagatagtggaaaggaatagcaaatattttaagaacacataccttataaatacaactttttaaagtaattcaatacaaagtaacattgacatgttttcgttactttcaaaaaatcaatttttactttctctaagcaacagatatggaagagtgaggcccactggtgagtactaataggcattgctggcaaataaaaacatgtgctcagaaagcttacagagacccgtgagataaaactacagataaataccacaggggaatgtaggtctttgagagtcactgctctgtaactagttggggtggggtgccaaggctaacactgctattcattctccctgagcagcttgttatctagcagtcctaaaggcgatttgaaaatattcactgaaaaagcctctctaagtgtccacagaatcagagcttgggaatggagcctgaagccattcagcctta

SEQ ID NO: 53181 - DNA, 601 bp, Human
ttacattttgaaccataattagagagagaatgatagcaagctctagtttttatttctgaaagactttgttttcctctgattatttgtcccttttgaaatctaaaatgtacatgtatattctctcagaattgcttaggattcagtcctgggaacttagaagttataatgtaaagtgaactgtgctttacatgaagggttttgattgaattaaaaagatagtggaaaggaatagcaaatattttaagaacacataccttataaatacaactttttaaagtaattcaatacaaagtaacattgrcatgttttcgttactttcaaaaaatcaatttttactttctctaagcaacagatatggaagagtgaggcccactggtgagtactaataggcattgctggcaaataaaaacatgtgctcagaaagcttacagagacccgtgagataaaactacagataaataccacaggggaatgtaggtctttgagagtcactgctctgtaactagttggggtggggtgccaaggctaacactgctattcattctccctgagcagcttgttatctagcagtcctaaaggcgatttgaaaatattcactgaa

SEQ ID NO: 53182 - DNA, 601 bp, Human
tcttagaacttcatgattcttaccttctgaaagttccactctatcaaatgcatactcctgctctattgtactgctaacatgatatagaacatgatctgaagacaaagctgaagaggttaaattggaaataggaacaataaaggaaatatataatataataatttaatttactaataatttaaaatatataaaattactaacatgatctcatttaaacttctaattacattttgaaccataattagagagagaatgatagcaagctctagtttttatttctgaaagactttgttttcctctgattatttgtcccttttgaaatctaaaatgtacatgtatattctctcagaattgcttaggattcagtcctgggaacttagaagttataatgtaaagtgaactgtgctttacatgaagggttttgattgaattaaaaagatagtggaaaggaatagcaaatattttaagaacacataccttataaatacaactttttaaagtaattcaatacaaagtaacattgacatgttttcgttactttcaaaaaatcaatttttactttctctaagcaacagatatggaagagtgaggcccactggtg

SEQ ID NO: 53183 - DNA, 601 bp, Human
caacactgacagagctcttacctagccctgagtaggagacaccagaaatctgatgctgaacagcccatgagttctgctctcaagaaaaaaagatgataggcatttgtttgcactggtacacagggggtctctgtaaatatttttgtaatgacttaattagtggttctcaaccttttatcaaaatccatagtttttacatttgtaacatactccaatcatatctcataatacacagtggttctcattgcatagagaaatgatgcacacacccaaagcagaatgccagaacctcgataaggcwtgtgtagttaaatgtcctctccacctccactcttactagaactctaatttgggtaggcctcctgcaaatgcatttctcacttcttattttgagaacgcaaggtagaatatgataagcagtctaactacactacagtatgaaagagacagctatgtttataaaactaaatgataggcttcttggagaagatggcattttaattgaatcttggaagacaggattttaataagcagaatggaggagaaggcccaggaagagcattctatgaggagggaagaacaaaaccaaaggtagagagat

SEQ ID NO: 53184 - DNA, 601 bp, Human
aatactatgttaatcataaggcaaatttgatcttttaataatgttaatactttcccaccaattttaaatgtttctcttacttctagtgaaaaacacttctagttttgtttttaaattttttaaccagtgatataaaacctattcccatttttttgtttcctactgagaaaatgtatgagcttttctagcaaaaacataatttaaataaaccgtaaaatgttaaaaatataagcaaccatctaactcagtaactcgtgatattttctaattacaaatgtaggtcataggtacagtgattaasattttgaaaaatgtcctgagggtaatgaggaaattaagtttttataggaattctaatgaaattgaaaataacagacaaaccatgatcaacccagacaatatgcagtattgcatattatgtatggtacgtgatttttgtttgaagaactatagacgtcattttagggaaaccatcaggcttttgctttgttgaattgattaatcttttgatcagaactaaattgttctgaaaaattgggagtattttagaagcagaatgagaagagagatagatagagacctggaatcaagaggaacggaa

SEQ ID NO: 53185 - DNA, 601 bp, Human
cccctactttcaaatttagtaaagagtacatcatctgataactcatcttcctaccaacccagatcctttcttgtcctagtcctgcccctcttgggaaaacattttatcatcaccaagccagctaataatctctatgggaatgcaggcatgctccctctaccttccttcttacttttgttgtccatgcaaatacagtggacaggagacacacacacacacacacacacacacacacgcacacacacacacacactctccctctctctctttctctttcatacacacacacacacacacacactcacacacacaatattacttaaaatatccttaagttatgctgctgtcagaatccttccatcagtagattttgagcacactttttgctctggagggaagtttagagaatttaactaaaccaacccatcataattaacttctagaacatgatacaggttactggttttgaatttgggcaaaatagatgaaaagccccgccttttcaaaaattagttttgtgacgttagacaaataatttagtttctctgagtgagcttcacttttgtcagactaaaattctttccttgtagagttagctgta

SEQ ID NO: 53186 - DNA, 601 bp, Human
gctctaaggcaccactacaaaacaaaatggaatcagctgcagttctgtgtctctctacttactaaccagtcatgaccccgtttgtaaataacaaatctttttttcctaccccactgactcaaatttataatttgctggtctgtttcagcttaagcatttgaaagtaaactttaaaatgcgtaagtacaatctttaggatttagtttatataatatctagcacagtggtactagataaaacagatttattaaaattgttaactgaacaagtcttcgtttattgcccagctggctctttactyaccaaacctcttagatacttgcagcaaatgggttatttgtttccatggttatgctgtccatgtttctggctatgcaatagtcaatggttttggttttgtattgtgtgaagggtttttttttttcttaattgtaaagttatttataggctaaggtttccttgacaagagtatttccttggttaaaaaatttcctcctaaaaatgtttttattcttttaaatggagattcattgacgggacttacatagaatagattgttattttatagttatgatggagtttttctattaaccaggttatt

SEQ ID NO: 53187 - DNA, 601 bp, Human
cctgaccctgcagtgtggcctccgcctgggacccacaagacacttgggcctgactcccaaccccccggggcaactcccccttgtgcccaccccttgtctgggcttggcgcctcggttgcatcagggccagtgccggttgcgcggtggccggccaaggtcactgcggggaggtgggagcatggctgctcgcaaccctccacccctcttcccctttcatctcacgctccccgcctttctgcccttgacttctacttctcccatatcatccctcacaatccccttcctccatctcttcccccgmcccccccacctctggggtctctctccccttcgtctgtctcccacccgtcccactgtgcagctcttggccttgtttgatggcgctccccgctccaaagcacacccgctccagagcaagagtttccaaagggggagggggaggacctctcagtgcagcctctggggaccaccccactgtgggcagcaaccagggaagggaaacaaaatcagccctagcctctctttttggtgggggcagttttgaggggtggcattgggtgaacgggccccagtgagcccggtcagaaaggactggcctcca

SEQ ID NO: 53188 - DNA, 601 bp, Human
agcagaggagtgaccccagcactctcttcttcttcccagtcactgcgctccctgtgaacagccctatgaataaaggggataccgaggtaagaaggggtgctggggatgaggggtaggaggctccagtggacacttcacagccagttcttgggcagctgcaggagtaagttcggcataaagccaagagccagcactgcggctgctgagcctggggacagcttgcaaaagaagatatcaaagattgcttgctttccctgctgtcctgctgtggggacttccccagcttcctctgagctgcacrtgcagcggaagaggcctgcatcttacctgctgggccgaggtgcctggcttcaggctgtcttgaacactctgaatccagtaggctccccaggggctggtgggggtggcttctctgtagttgtagttgtccacagacctgtaaaaatggcctttgcctgcctggctctggcctccccgctttgctctttctccctgaaaggctctgccagtaacaacccacacccagcaggctctccagccctggctgtcccaaaggaacacaagcaaaacatcttgatcatggctcctgcacccacggtcc

SEQ ID NO: 53189 - DNA, 601 bp, Human
gacacctcctgctctctactcagctctaggctgtggaagcagggctggagttgtgaacccctccctgggcgtgctgacactccatgcttgaaagagtgtttttccatctgtacctcattaccctgggagagcagttgggaaggtattctcactcccgttttacaaatgaggacactgaggctcagagaggttaagtcacttctccaagatcacacagctaggataccacattacggtgggcaccatcatcaaagatcactcatttatcagatgcctaattatccacagcacctttgcaggyacaggataagactttcagaggcgtggctgtggttgacctgggatatgctcccaggtgtagtcaatgtgtgctcacatgccgcccagggattcacccatcccatgatgaacatggagtgagaatatgaagctgtgactccttgcatgcgacaacaccatgggtgtttggagacagtaacctacatcctatttccaaacagggtagagccagggaaggtctttgtctcctctgggcagtccagaaggacttcctggaggacctgacctttgggcatcttcacgatcagagcacttttgtaag

SEQ ID NO: 53190 - DNA, 601 bp, Human
tctcactcccgttttacaaatgaggacactgaggctcagagaggttaagtcacttctccaagatcacacagctaggataccacattacggtgggcaccatcatcaaagatcactcatttatcagatgcctaattatccacagcacctttgcaggcacaggataagactttcagaggcgtggctgtggttgacctgggatatgctcccaggtgtagtcaatgtgtgctcacatgccgcccagggattcacccatcccatgatgaacatggagtgagaatatgaagctgtgactccttgcatrcgacaacaccatgggtgtttggagacagtaacctacatcctatttccaaacagggtagagccagggaaggtctttgtctcctctgggcagtccagaaggacttcctggaggacctgacctttgggcatcttcacgatcagagcacttttgtaagacatcattttagtgccctgaggcagttttctcatgtttagagaaatagcacttggggatgagaaggtaccaggtaccattccctacaccccattctcactatgatccaccttggaggggaacctgctggccatgtggttggagtgg

SEQ ID NO: 53191 - DNA, 601 bp, Human
gcacttgactctgggtaaattccagtaactgagagtcagaaaatctggtggaagattcagcaagttcctctctgggactgtcatttccttttaattataaagcggaaaagcaggatccgccgtgccacctggctcaatctgttattgatattgttaaagaaatcaaggcccagagaggttgagtgacttgtccaaggtcacacagtgaatagagacatgccaggtgcagcttccctaaaacccacggcctctgcagttcagtcattttaggaaatacctttatgaagtagtgagccactcrtcactgatgatattcaagccaagcctggacaggatactggagtggagggttaagctgccatcttcccacagttagcctctatgcccagccccccagctccttccaggcttgatgcaaagcacggccctagccttgcaagtcaggaaacctgagtttggccctgcacctgccccggctgacttcctgtgggaagcggccgtttccaccagggcaggaccactggtggtggtgtgtctctccatgagaacagggcattacagcatgaatccagcatctgcttcccaacgaagcgagagtgtt

SEQ ID NO: 53192 - DNA, 601 bp, Human
agtaactgagagtcagaaaatctggtggaagattcagcaagttcctctctgggactgtcatttccttttaattataaagcggaaaagcaggatccgccgtgccacctggctcaatctgttattgatattgttaaagaaatcaaggcccagagaggttgagtgacttgtccaaggtcacacagtgaatagagacatgccaggtgcagcttccctaaaacccacggcctctgcagttcagtcattttaggaaatacctttatgaagtagtgagccactcatcactgatgatattcaagccaarcctggacaggatactggagtggagggttaagctgccatcttcccacagttagcctctatgcccagccccccagctccttccaggcttgatgcaaagcacggccctagccttgcaagtcaggaaacctgagtttggccctgcacctgccccggctgacttcctgtgggaagcggccgtttccaccagggcaggaccactggtggtggtgtgtctctccatgagaacagggcattacagcatgaatccagcatctgcttcccaacgaagcgagagtgtttttcagggctgggcttgtgtctg

SEQ ID NO: 53193 - DNA, 601 bp, Human
ttccaggcttgatgcaaagcacggccctagccttgcaagtcaggaaacctgagtttggccctgcacctgccccggctgacttcctgtgggaagcggccgtttccaccagggcaggaccactggtggtggtgtgtctctccatgagaacagggcattacagcatgaatccagcatctgcttcccaacgaagcgagagtgtttttcagggctgggcttgtgtctggggtggggtgggggtacgaaggctgctctggcttcaggatgggccccactctgaggcctttgggacagaccaggccaygtgtgagaacagagagggctttggggaggaggcacgtaaacacagccacgtcagtaggattcctgtggccctttccaagctaacacactgttcttcctcccactcatgagccagcctgggcagcaagcacccacctcctactgttgttggagggggcagggagtgctgggcacagctgggactattattacctggatagttatgtcatcatcagtgaccttggactagtgttttgttttgtttttaactaagcattaaatattttattacaattgataactttaaaattaaatattgaat

SEQ ID NO: 53194 - DNA, 601 bp, Human
gcaagtcaggaaacctgagtttggccctgcacctgccccggctgacttcctgtgggaagcggccgtttccaccagggcaggaccactggtggtggtgtgtctctccatgagaacagggcattacagcatgaatccagcatctgcttcccaacgaagcgagagtgtttttcagggctgggcttgtgtctggggtggggtgggggtacgaaggctgctctggcttcaggatgggccccactctgaggcctttgggacagaccaggccatgtgtgagaacagagagggctttggggaggaggcrcgtaaacacagccacgtcagtaggattcctgtggccctttccaagctaacacactgttcttcctcccactcatgagccagcctgggcagcaagcacccacctcctactgttgttggagggggcagggagtgctgggcacagctgggactattattacctggatagttatgtcatcatcagtgaccttggactagtgttttgttttgtttttaactaagcattaaatattttattacaattgataactttaaaattaaatattgaatgactaactgattacatttaaataattaaatagac

SEQ ID NO: 53195 - DNA, 601 bp, Human
tatatatgactattttccattaacagattcctggatgtatttctgtccatccgtctatccgtccactccctcttgggctcccataacatcttctgtgtgcctctgtcttagcatttaccacacagcaaccctattttctagacaagcacccaactcttggagagcccaagttgcccatggagctaggaaatagccagaaggggactggaacccacgttgcctgagaccagggctgggcatgctccctggcccacagctgcccaggaaagcccattgttggggaagaaatgagctgggctarctgaggggccaacatcaggaataaggcacaggtgtggggacagtcagaggaggcagcggcggcggggggagaggggtctctgggtcatggctgcaggcgccaaccctgggctcagatgtaggcacagggcttggccttctccccgggcctggactcagcgtccaaggttagcagagcttgcctgaatcaagagctgtcaccattactgcctgctgcagggttcctggagctaccagccaggtcctgaggggttccccacccccaactcctgcccagccaggtcctgaggggttccccacc

SEQ ID NO: 53196 - DNA, 601 bp, Human
cctctgtcttagcatttaccacacagcaaccctattttctagacaagcacccaactcttggagagcccaagttgcccatggagctaggaaatagccagaaggggactggaacccacgttgcctgagaccagggctgggcatgctccctggcccacagctgcccaggaaagcccattgttggggaagaaatgagctgggctagctgaggggccaacatcaggaataaggcacaggtgtggggacagtcagaggaggcagcggcggcggggggagaggggtctctgggtcatggctgcaggcrccaaccctgggctcagatgtaggcacagggcttggccttctccccgggcctggactcagcgtccaaggttagcagagcttgcctgaatcaagagctgtcaccattactgcctgctgcagggttcctggagctaccagccaggtcctgaggggttccccacccccaactcctgcccagccaggtcctgaggggttccccacccccaactcctgcccagccaggtcctgaggggttccccacccccaactcctgcccctgggatccttgctccatttgagcctttcttgctgtgtggccaca

SEQ ID NO: 53197 - DNA, 601 bp, Human
gctgaggctggagaggaggctgtccccgaggaagaaggccccactgtagtgctgaacccccacccgagccttggctacaaggagatccggaaaggcgagagtacgtatgatggcgaagacctcaacgaacgtgtctgggagagggggatgggtgggaggagagccttctccataacctcattccaccttcataacaaccctgaaaggtaggtattagctccatttcccaggtggacaaatgaggctcagagaggttaagtaatttgcccaaggtcacacagctaatttgtagcaaaagctraggttctaccccagatttatctgactccaaaaccatgcatttcccactattccacatagcctccccccaccaaccccagaagctaggggtgggtgatgggtgggctggctttgggaacagagaccatggcaggagcgcacaggctgatctgggaacagtgtcagcttcaactacggtttaggagaggccctggctcccgctgcgggcctgtcagggtctttcctcactctccagctgccgggcttctggggtgaggatgaggggaagaggcaggctccagctaacccacccctctgagcc

SEQ ID NO: 53198 - DNA, 601 bp, Human
gaggctggagaggaggctgtccccgaggaagaaggccccactgtagtgctgaacccccacccgagccttggctacaaggagatccggaaaggcgagagtacgtatgatggcgaagacctcaacgaacgtgtctgggagagggggatgggtgggaggagagccttctccataacctcattccaccttcataacaaccctgaaaggtaggtattagctccatttcccaggtggacaaatgaggctcagagaggttaagtaatttgcccaaggtcacacagctaatttgtagcaaaagctgaggttctaccccagatttatctgactccaaaaccatgcatttcccactattccacatagcctccccccaccaaccccagaagctaggggtgggtgatgggtgggctggctttgggaacagagaccatggcaggagcgcacaggctgatctgggaacagtgtcagcttcaactacggtttaggagaggccctggctcccgctgcgggcctgtcagggtctttcctcactctccagctgccgggcttctggggtgaggatgaggggaagaggcaggctccagctaacccacccctctgagccgag

SEQ ID NO: 53199 - DNA, 601 bp, Human
tgcccaaggtcacacagctaatttgtagcaaaagctgaggttctaccccagatttatctgactccaaaaccatgcatttcccactattccacatagcctccccccaccaaccccagaagctaggggtgggtgatgggtgggctggctttgggaacagagaccatggcaggagcgcacaggctgatctgggaacagtgtcagcttcaactacggtttaggagaggccctggctcccgctgcgggcctgtcagggtctttcctcactctccagctgccgggcttctggggtgaggatgaggggaagaggcaggctccagctaacccacccctctgagccgagagggtcttgcaaagcctggcatcaagaaggtttttcccgctaagcgtcatcactgtggagaggctgggctgtggccgcagcagaggcccccagggagtggcagagactgggaaaatggtggtcccccacccattctcctgctcttgcccaccacctgctccaggtcggtcggaggctctggctgtggatggagctgggaagcctggggctgaggaggctcaggaccccgaagggaagggagaacaggagcactcccagcag

SEQ ID NO: 53200 - DNA, 601 bp, Human
gaggatggggtgggggcctcctcaacacagcccaagggtcttcttagaaacccgagcctcgcagagcacctgccccagggcctcctccaagactaaggggctgtagagtctatttccacggcctgcaatgtcggggtccctgggccaggatgccctcggcagcctcaaatctggcagtgaccccgggaaaatgacccctcccaggtcaaaggaggcagccttccctgcgctcctgctctaagtcttgaggttgtgctcttgtgggtgtccaagttctgaggcctgaaagcttctgcagacrggcatagaacagggctcagaggaggggtccctgcttccctaaacttgggtagccagagttcaggatcctctcacaatcaggaccagggatcaaagcccagccctaggcaggctgatgtggggcagctcccccagcatgtagccctgtctcaggccccacattcccctcaggtgggaaggctgcagaagacagacccggaagtcccaggctggcctcaccctgggtcctggcaaccatgggctaggccgagggaagggggctcttcagggcactgtaagctttgttttccatgtgccctaa

SEQ ID NO: 53201 - DNA, 601 bp, Human
agagcacctgccccagggcctcctccaagactaaggggctgtagagtctatttccacggcctgcaatgtcggggtccctgggccaggatgccctcggcagcctcaaatctggcagtgaccccgggaaaatgacccctcccaggtcaaaggaggcagccttccctgcgctcctgctctaagtcttgaggttgtgctcttgtgggtgtccaagttctgaggcctgaaagcttctgcagacaggcatagaacagggctcagaggaggggtccctgcttccctaaacttgggtagccagagttcrggatcctctcacaatcaggaccagggatcaaagcccagccctaggcaggctgatgtggggcagctcccccagcatgtagccctgtctcaggccccacattcccctcaggtgggaaggctgcagaagacagacccggaagtcccaggctggcctcaccctgggtcctggcaaccatgggctaggccgagggaagggggctcttcagggcactgtaagctttgttttccatgtgccctaaaagaacggactcccacctgtgcgggaccatttgagaggaagtggggcctggataagaggcca

SEQ ID NO: 53202 - DNA, 601 bp, Human
gggtccctgcttccctaaacttgggtagccagagttcaggatcctctcacaatcaggaccagggatcaaagcccagccctaggcaggctgatgtggggcagctcccccagcatgtagccctgtctcaggccccacattcccctcaggtgggaaggctgcagaagacagacccggaagtcccaggctggcctcaccctgggtcctggcaaccatgggctaggccgagggaagggggctcttcagggcactgtaagctttgttttccatgtgccctaaaagaacggactcccacctgtgcggraccatttgagaggaagtggggcctggataagaggccaccaagagcagtgtggggacagggcccccggcatcagccaccttcttgtgcataatgatcccgagagcagtacagtaagctcattatcactgtctccatgatggatgagggtacagagagacaaagccacctgtccgaggccacacagctaacccagcgcctttctggcttactgtgccttccatgccactggccaggctggcccgagtgaaccccaatgtctctcctaggaccaggagctggagagcctgtcggccattgagg

SEQ ID NO: 53203 - DNA, 601 bp, Human
ggaccatttgagaggaagtggggcctggataagaggccaccaagagcagtgtggggacagggcccccggcatcagccaccttcttgtgcataatgatcccgagagcagtacagtaagctcattatcactgtctccatgatggatgagggtacagagagacaaagccacctgtccgaggccacacagctaacccagcgcctttctggcttactgtgccttccatgccactggccaggctggcccgagtgaaccccaatgtctctcctaggaccaggagctggagagcctgtcggccattgargcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacaca

SEQ ID NO: 53204 - DNA, 601 bp, Human
taaaattcttttcccttttatttttcccctcttacatgtagccctggacaggatatgggtgtggggtcagcaggcacgaaggacccaaaggaagaagaggaatgtgacggggagggcctgggggtgttgttagagtgaggatagggacaggccttggaaagcttggaggaaatagataccctgagcctgacaaaggggttccctaattacctgaaaggcttcctgctccagccagcactctggcagtgctgcctggtggcccttgagccccttaccctgactctgctctgtgatctccccsacttccaacaaagacagcccacttctggttagttgcagtgcctatgcacatgccaccttctcaaagggacagaaaaaaagaacttcccaaaacaagctctttgttggggtaaatgatgagaaaacaaaccacagaaatcccctctaccctaaattttacaataataatagcatttctgcaatggccctatggtagcatttcaaggtacactcagttatctcatttatcccacaatgtatcccaggactgaaaatgactcctagtattaacaaaacaaaacaaatccaagcaaaaacccta

SEQ ID NO: 53205 - DNA, 601 bp, Human
ctcctgcctacctttgctcatccaggattgtctggggttctaggctttgtcactcaaagacctcttaagacattttcttaaatcagctgcctagggatgccactcctctctaagaagtatcagtttgatttcatttttccaaataaagaagaagcctacttcccaattaagcccaaaggccttttccgttgcatctgaagggaagtaactcattccgacggactccaagagcacaggtactaagaagtacacctttatatgcatccctatttgtttgtctctccatctttccaacatgcaygcatctttctccttagcacaacgtccagctctgggactaaaagtcatagataatatgttttcatttattagctaaggagggaagagaatgttctcattagagaagtccaagcccacaaaaatatggaattctcacagccctggcgactgtgagaattttcttctggagggtggtgttgtgttctttttccataccttcttatttttaattctccacactgcaagccatttagttagatcaaccaaagtcaatgagagagggaggcccaagtacctgagagtggagttgggtaaccatcca

SEQ ID NO: 53206 - DNA, 601 bp, Human
gagtttgtaatctagtggggcccactagaaacatcttcaggtattgtcatgaaggaccagattaaatctgtaccagcccaaagaatagaattagaactaatgattagaagttatgggaaggccaatttcactgcaatccaaggaaaaagtgtaaaatgatgtagctatttataagaatgaaatgagccactttgggagataagtgatccatccatgcttcctgcaaacactcaggaggcatccgtgttagggggctgtccaactctgaggcctaccatgaatttcagtcatcctagactataacaagggactgagcagatgccttcttaagcttcaaaggctaagctaaggtgtgagtatatataaaccaagggtctgtggcctgagggttcccagtgtaccgagatttctgttttatattcaaatagcatgtcttggccagacaccatggctcacgcctgtaatcccaacattttgggaggccgatgtgggtggatcatctgaagtcaggagttcgagaccagcctgaccaatatagagaaaacccgtctctactaaaaatacaaaattagctgggcatggtggcgcatgcctgtaatcc

SEQ ID NO: 53207 - DNA, 601 bp, Human
ggatctctttcctccattaggtgttagtgtcattgtcatttaaatcaatccctcaaggagtttgtaatctagtggggcccactagaaacatcttcaggtattgtcatgaaggaccagattaaatctgtaccagcccaaagaatagaattagaactaatgattagaagttatgggaaggccaatttcactgcaatccaaggaaaaagtgtaaaatgatgtagctatttataagaatgaaatgagccactttgggagataagtgatccatccatgcttcctgcaaacactcaggaggcatccrtgttagggggctgtccaactctgaggcctaccatgaatttcagtcatcctagactagaacaagggactgagcagatgccttcttaagcttcaaaggctaagctaaggtgtgagtatatataaaccaagggtctgtggcctgagggttcccagtgtaccgagatttctgttttatattcaaatagcatgtcttggccagacaccatggctcacgcctgtaatcccaacattttgggaggccgatgtgggtggatcatctgaagtcaggagttcgagaccagcctgaccaatatagagaaaa

SEQ ID NO: 53208 - DNA, 601 bp, Human
ggtattctaagaaagcaaagacatgtgcaatacattttgaaaatatttctacctgccactagtaaattgaagactcttttgttctttaaagtgagtttgcaaatcctcagcgatccagaaagctctgctaccaaaataactaaatccccatattttaagagactgagttttcctatacttggtcttgcttttcacagccctccttagttttttcctggtgctgtttcctgatctcctagcctgccagtcttattttgcccatgctttcatattctagcacctggatcaagaggagtatctygaaggagttcctgggaatcttagtccatagagttacagaactaggatgaagggacatgccagcctctgccaggaagtaggccgttgggagccacagactgtatcaccaggaaggcggtatagcccagagacaaagagctcaggctctgcagccagacaggccacattcaaaggcttctttaccatgttttagctgtggtttgggaagttacttcaactctgtaaacctcacctgtaaaacagagataaaagtagtccctatgtcttagctgttttgaggaacaaaggagctaagaagtag

SEQ ID NO: 53209 - DNA, 601 bp, Human
aagactgaccacagatctctttttatcctgtcttcccacacacatccatggcattaaaccatcaaacactgacctttctttatctgaccttctgactcccaactctgtaggggagtagcaggagcctaccagtcagtgagagcttgtcacatcctaagagacaattgatgaaacctccactctttttcattctagatgggaggaacggtccctacccacaaggctacaagaattatagtacaatttaaagttgaataaaaagctctcttctgttgtttacttctcagtccatccttattamctgtgtttccctagggactccatttgacccttagttactctagttgatctcaacttatgaactgggagcaagggaggagacaaggtctcaagaaattagtaaaatgaggattctaagagatgtcacaaaattcatgtagtaaaagtcatgcactgaactttcaggtacttcttcagagtcaattattcttgttttacacataattctaataaccctggttatctgatatcctagctaaagttgaaacgtaggaagagcctattagaagcaaataataaggagaagcaacagctgaaaact

SEQ ID NO: 53210 - DNA, 601 bp, Human
ctggcccagcccttttctctctccagaggaagctgggcctgactgagatgatgtcatgcttttgaatcccctcccccgaagggcctccttcacctagacaaacacttttgaacttttccagatgtggagtgagacctgctgctagttctgaggacagaggtgcctgttccagaagagcaaagcaactctggacccaagccagctactgacccactggggccaggctcgcagctgcagcagcccctccacccaccaccaggccgagcgctgtggaatgagtagcaggatccacctgcaaatragaaagggaccccaacttcagagtcagggctctgaccccagggtgagcagagcaccctctgagacaccagggggacaggacaagtgggagggcagaaagaccaaactgagtgactggaaatgcctgagctggtgcagagcaaggggacaccttagccaggggcctggagccaatcctggcataaacactgcggcacagcagggagagtgcatcttttaggttcacagtctctagagccctggaggaatgacatttatgagagtcaagactgaccacagatctctttttatcctgtcttcc

SEQ ID NO: 53211 - DNA, 601 bp, Human
gactcctcttcttgcctgctctcttcctcttcgcccccagcatactgattactggggaccccatctggtccaccctggcccagcccttttctctctccagaggaagctgggcctgactgagatgatgtcatgcttttgaatcccctcccccgaagggcctccttcacctagacaaacacttttgaacttttccagatgtggagtgagacctgctgctagttctgaggacagaggtgcctgttccagaagagcaaagcaactctggacccaagccagctactgacccactggggccaggctygcagctgcagcagcccctccacccaccaccaggccgagcgctgtggaatgagtagcaggatccacctgcaaatgagaaagggaccccaacttcagagtcagggctctgaccccagggtgagcagagcaccctctgagacaccagggggacaggacaagtgggagggcagaaagaccaaactgagtgactggaaatgcctgagctggtgcagagcaaggggacaccttagccaggggcctggagccaatcctggcataaacactgcggcacagcagggagagtgcatcttttaggttcaca

SEQ ID NO: 53212 - DNA, 601 bp, Human
tattccccacatctctgtagagaaaaggatgggctcccatctggcttaaacaggaggtgggttgatcaaaataaattgatgcagaagccaatccaggcttctttcctgtttagatgggaccctctcaccactctgactttaaggtcagattcatctgaattcatccaagggggcagtattcagacactgaattaaaggatcaccttctcaagacaccattccaagactcctcttcttgcctgctctcttcctcttcgcccccagcatactgattactggggaccccatctggtccaccctrgcccagcccttttctctctccagaggaagctgggcctgactgagatgatgtcatgcttttgaatcccctcccccgaagggcctccttcacctagacaaacacttttgaacttttccagatgtggagtgagacctgctgctagttctgaggacagaggtgcctgttccagaagagcaaagcaactctggacccaagccagctactgacccactggggccaggctcgcagctgcagcagcccctccacccaccaccaggccgagcgctgtggaatgagtagcaggatccacctgcaaatgag

SEQ ID NO: 53213 - DNA, 601 bp, Human
caaggtctggtttctcatcaatgtagtgggaaggtagacaagctttgttctggctcttccaataactaaccatgtaatttaatgcatgtatgtatctcagctctcttacctcttaagtaagggtcttttctggctaccttacatggattgctgggataaacaatgagataacaaatgctaagttattatagtattatagtataatgttttggatctcatttttctctgaagatcttcatgagtgtctttgcacatctcttctgtatatcctgggatacatactttttttttttttttttttaagacagggtcttgctctgtcatcacagcacccaggctagaatgcagtggtgagatcatagctcactgtaaccttaagctcctggcctcaagtgatcctcctgtcttggcctcccaaagctctgggattacagatgttactcaccattcccagtcagtatcctcattagacacaggaaggagaagcttcttgactgaaccctatgcctcaaagagcccacaccctgtcctgcttcctgtgaggaccaatcaggatgtaccctctcttctaggtcatactgtggggaccagaagtcctagc

SEQ ID NO: 53214 - DNA, 601 bp, Human
caaacttgcaggaaggccatataggcaaacagggataatggggtggaccagcagatgctggggtacctgttttttctcctggcctccaggactctccaaattcccattttggctcttttatttatttatttatttatttatttatttatttattttgagatcgagtcttgcccaggttagagttcagtggcatgatctcggctcactgcaacctccacctccctggttcaagtgattctcttgcctcagcctcctgggtagctgggactacaggtgcatgaccacacccagctaatttttktatgttttggtagagacggggtttcaccatgttgcccgggctggtcttgaactcctgacctcaagtgatctgcccacttcaggctcccaaagtgttgggattacaggcatgagccaccacgcctggccctggctcctttaaaaacagaaagcagaaagatccctcgggcatatctcatgactgaggccctcatattttctgtcctgcatgctgaaagctgttgacagtcataggccctaaggctgagaaggccaggctgagctcaccatccctggtctgcccagttcctgccattgccaa

SEQ ID NO: 53215 - DNA, 601 bp, Human
aagcagctatttgcaaccttggtaaacactggcttggatggtgcaggactgggagaggggaggatcttttcccatttgggttgttttctctccagtcaatcacaaacttgcaggaaggccatataggcaaacagggataatggggtggaccagcagatgctggggtacctgttttttctcctggcctccaggactctccaaattcccattttggctcttttatttatttatttatttatttatttatttatttattttgagatcgagtcttgcccaggttagagttcagtggcatgatctyggctcactgcaacctccacctccctggttcaagtgattctcttgcctcagcctcctgggtagctgggactacaggtgcatgaccacacccagctaatttttgtatgttttggtagagacggggtttcaccatgttgcccgggctggtcttgaactcctgacctcaagtgatctgcccacttcaggctcccaaagtgttgggattacaggcatgagccaccacgcctggccctggctcctttaaaaacagaaagcagaaagatccctcgggcatatctcatgactgaggccctcatatttt

SEQ ID NO: 53216 - DNA, 601 bp, Human
gggaggaagaggttgggtggggggttgacttacacagctggaggtcttattttgctccaggcagatgccctgagtcaatttcacttctctgatgcctgaacatttgatttctgcctgtattaaaacaaaaacaataacaaaaacaaagtaaataagccagtatctttgctcctcatttctttcccaactttttccagtttgctttctgtgaggtgctctcttaggaggttttaaggaaaaggacatttaaaatttgtcaggggactagagatttctaatagtcatactctcgtctatttcrtatctatcctcatcagatgacaaaacttttgttactagcctgggcttactggcaagcagctatttgcaaccttggtaaacactggcttggatggtgcaggactgggagaggggaggatcttttcccatttgggttgttttctctccagtcaatcacaaacttgcaggaaggccatataggcaaacagggataatggggtggaccagcagatgctggggtacctgttttttctcctggcctccaggactctccaaattcccattttggctcttttatttatttatttatttatttatttat

SEQ ID NO: 53217 - DNA, 601 bp, Human
ttgttattgtcttttttgcccaccagatggggcctcttactccctaaacagaaagctcagtattaaaggcaggctgaccaagctaaactccccggacccctactcaaatccagtgcaatccaagaaggtttaagggtgttcagaagggatggaggaaagggacaggggcgggaggaagaggttgggtggggggttgacttacacagctggaggtcttattttgctccaggcagatgccctgagtcaatttcacttctctgatgcctgaacatttgatttctgcctgtattaaaacaaaaayaataacaaaaacaaagtaaataagccagtatctttgctcctcatttctttcccaactttttccagtttgctttctgtgaggtgctctcttaggaggttttaaggaaaaggacatttaaaatttgtcaggggactagagatttctaatagtcatactctcgtctatttcatatctatcctcatcagatgacaaaacttttgttactagcctgggcttactggcaagcagctatttgcaaccttggtaaacactggcttggatggtgcaggactgggagaggggaggatcttttcccatttg

SEQ ID NO: 53218 - DNA, 601 bp, Human
cggttacatggaaaatataacattacagcaaaataaattctatatggattaaagagttacgtgtaaatatttaataataataaatgaaataataaatgaactgacattttaggtgactagtttatatctggtgagtgagaaggactttcttaaccaaaaagcaacttaaatctgactctctcagatttaaaagtactacagaggaggggaaaatttaaaaagtactatagaggagggggaaaaagtactatagaggatggaaaaataacaaaatttattaataattaaaattgttattgtyttttttgcccaccagatggggcctcttactccctaaacagaaagctcagtattaaaggcaggctgaccaagctaaactccccggacccctactcaaatccagtgcaatccaagaaggtttaagggtgttcagaagggatggaggaaagggacaggggcgggaggaagaggttgggtggggggttgacttacacagctggaggtcttattttgctccaggcagatgccctgagtcaatttcacttctctgatgcctgaacatttgatttctgcctgtattaaaacaaaaacaataacaaaa

SEQ ID NO: 53219 - DNA, 601 bp, Human
aataatttacattttttacagtgtaataaaaaaagatctgcctgactggatattacaaatactgtagtaaaaacatacaataattttgaaaatttaaaataggcaaaagtacagacaaactgaacaaataaaatatgtctgaagagtatgccctaagacatataaaaacttaatataagctaaaggatacatcccatgcaacagaagagggagtcattcaacaaataatgttaggaaaaacggttacatggaaaatataacattacagcaaaataaattctatatggattaaagagttacrtgtaaatatttaataataataaatgaaataataaatgaactgacattttaggtgactagtttatatctggtgagtgagaaggactttcttaaccaaaaagcaacttaaatctgactctctcagatttaaaagtactacagaggaggggaaaatttaaaaagtactatagaggagggggaaaaagtactatagaggatggaaaaataacaaaatttattaataattaaaattgttattgtcttttttgcccaccagatggggcctcttactccctaaacagaaagctcagtattaaaggca

SEQ ID NO: 53220 - DNA, 601 bp, Human
ttcacatccccactcacagatactacctcaatcttagaggaacatgcagagaccttctcagctgtggcacgaagtaggccagacagcaaagaccacagcagagttaggaggaattatttctaaaagagcagtaagtttctggcacttttctcatacagtgacccaagttacatgtgagctttgaagagcaacagaaaggcaaaggctctgcagttaactctaaattccaggcacaaagaattagcattctggcacatacctgtgtgatacacagcaaaatgtatgctccaccaagtcgatrgggttgcagggggaaagatcgtcattttccttggctacaactagcaaagaacttgacaattttttttctaatgagttgagttgaaaatcagcatcagaaacatgctgcatgttacttgtacattgtatgttcatgtttaagttaactattttgcagactgcatttagttattctactatgcaaactcatgtcttcactatttctgttgtttttagatgtcctaagttaaattctttcaggtataatttttacaaatttgtaagtcagagagacccaactgatgatcgtagtaaaactacc

SEQ ID NO: 53221 - DNA, 601 bp, Human
cctgaggctcccaacattagaaccaataccttaaggccctctgacaccgaaagtacaaatccaacctaaggaaaattaggaggctctgcagcattcgcagcttttggaacagattgtttatcagacaagcagggagtagggaccaaggaaaggtcatcttggacataatcgggagctgtggctaaacattttggaacaggatagcaagctgaggataaattaccttggggagtagcaggaggctttgccgcatgggggctgaggatgaggagccctcaggaagaaaggggatcaacactgstggagagaccaggggaacaaaagcactcatatgagctgccacagagttgctttatgaaggggcagtgtggatggaagtcttctttggcataggaactggaggggagctgctctcttttcacatccccactcacagatactacctcaatcttagaggaacatgcagagaccttctcagctgtggcacgaagtaggccagacagcaaagaccacagcagagttaggaggaattatttctaaaagagcagtaagtttctggcacttttctcatacagtgacccaagttacatgtgagctttga

SEQ ID NO: 53222 - DNA, 601 bp, Human
ggtgatgacttatgttatgtatattttaccacaattaaaaatattttggtgggtttctctggacaaatgggtgtagcataatagtataaagtaatcttacattttggaaactatttggggaaccacaaccacaaaaactaaattaagctgacactgctgccaaaagaatgacagttagactcaggaagacacatcctactaatgagggtgctgagatatggtaaaaggtgtttgagatgagagtggtatcaccttcccttcccctggctgcctagagatgatggctggggagcaaaaaaaraagagtgattgggatagacatgtctacagaatgcacatacagaagacacgcctacagaatccacatagggtgagctaacatattggtactcactatgtgtcagtgcagaatgagtgtctggatagctagactcatgcacatatattcctgttatgggcatatattagatgaggagcataccaacatacatcaaggatgtgatgctcggggaaaccaaatccttcctgctcttcaccagggtattaggtagggcctgaggctcccaacattagaaccaataccttaaggccctctgacacc

SEQ ID NO: 53223 - DNA, 601 bp, Human
ttcaaaaatagaattcccatgtggtccagccatttcacttttggatatatccccaaaaggactcaaatcaggttgccaaggagatatttgtacacttatgttaaaagcagtattattcacattagcctaaaggggaaaaagcccaagtgtccatcaacagatgaatggagaagcaaaacaaggtttacacttacaatggaatatcattcatccttaaaaaggaaggaaattctgacacgtgctacaacatggttggactttaaagacattatactgagtgaaatcaaccagtcacataacmagacaaacactatgactctactcatatgaggtacctagagtaggcaaagtcataggaacataggaacagaaagttgccagggtctggggagagcagggagttgtttcatgggtacacagtttcagtgatggaagatgcagacagttctagagattggttgtacaataatgtgaacgtacttactactactcaatggtacccttaaaagtggttaaggtgatgacttatgttatgtatattttaccacaattaaaaatattttggtgggtttctctggacaaatgggtgtagcataatagt

SEQ ID NO: 53224 - DNA, 601 bp, Human
atgtgaataagagtaaagtgagctagctgagtaattacaaactctgcatataaacagatgtggtactaaagataggtatacaaattggcggacaaaggacttgactagacttttccccaaagaagatatacaaatggccaacaaacacatgaaagaggctcaacatcactaatcatcagggaaatgcaaatcaaaaccaccatgaaataccaccgcatacccattaggatggctgctattttaaaaacccagaaaataacacgtgttgatgaggatgagaagaaattggaacccttgtacmctactggtgggaatgtaaaacggtctggtggttcctcaaaaattcaaaaatagaattcccatgtggtccagccatttcacttttggatatatccccaaaaggactcaaatcaggttgccaaggagatatttgtacacttatgttaaaagcagtattattcacattagcctaaaggggaaaaagcccaagtgtccatcaacagatgaatggagaagcaaaacaaggtttacacttacaatggaatatcattcatccttaaaaaggaaggaaattctgacacgtgctacaacatggttggac

SEQ ID NO: 53225 - DNA, 601 bp, Human
gccgagatggacaaatcagatgaggccaagggttcgagaccagcctggccaaaatggtgaaactttgtctcttctaaaaaatgcaaaaattagctgggcatggtggtgggcatctgtaatcccagctactcggcaggctgaggcacgagaatcgcttgaacccaggagacagaggttgcagtgaactgagatcacaacactacactctgcactccggcctgggcaacagagcaagactctgtctcaaaaaaaaaaaagtgtccaatgtggtgttgagaatctagtgggcactagataaatrgcagctgctactatcattattaataatagtaataccttatataccatatcatctagagtctacatattgatcatattctatgcattgttattgtcatttttctgtgactagattgtaagactcctaagtgtgtgttggggggagtgcacattatagcatttacaacccagactgcatgaaccgtggcaccaaacaaaagaactcagggaattgttgttcaacttaacatcccaaccagttggcctccacacagggtccctccaccccttgcacagtttcttggactagattcaagggaat

SEQ ID NO: 53226 - DNA, 601 bp, Human
ggtcctaccttcaaccagactgggcatcaatccttactctgctctttactggattctttgcaagtcatgcaactagtctgagtgtcatgttcctcagctgtacactaggttgttgtggtgactaaatagatattgtatgaaagtgtccagttgggtgcagtggctcatgcctgtaatcccagcactttgggaggccgagatggacaaatcagatgaggccaagggttcgagaccagcctggccaaaatggtgaaactttgtctcttctaaaaaatgcaaaaattagctgggcatggtggtrggcatctgtaatcccagctactcggcaggctgaggcacgagaatcgcttgaacccaggagacagaggttgcagtgaactgagatcacaacactacactctgcactccggcctgggcaacagagcaagactctgtctcaaaaaaaaaaaagtgtccaatgtggtgttgagaatctagtgggcactagataaatagcagctgctactatcattattaataatagtaataccttatataccatatcatctagagtctacatattgatcatattctatgcattgttattgtcatttttctgtga

SEQ ID NO: 53227 - DNA, 601 bp, Human
gagcagaggaagccagtggggaagagcatttggaactgaggccccacctccaggaagcccaagatggggacagcatgcattattccacaaccctcatttcaaagagaatgaagaacactaccttctccctggtattcactatccttcaagactcaactcagtttctacctcctcaatgaagctggtcctaccttcaaccagactgggcatcaatccttactctgctctttactggattctttgcaagtcatgcaactagtctgagtgtcatgttcctcagctgtacactaggttgttgtgktgactaaatagatattgtatgaaagtgtccagttgggtgcagtggctcatgcctgtaatcccagcactttgggaggccgagatggacaaatcagatgaggccaagggttcgagaccagcctggccaaaatggtgaaactttgtctcttctaaaaaatgcaaaaattagctgggcatggtggtgggcatctgtaatcccagctactcggcaggctgaggcacgagaatcgcttgaacccaggagacagaggttgcagtgaactgagatcacaacactacactctgcactccggcctgggca

SEQ ID NO: 53228 - DNA, 601 bp, Human
taagcaccataagaaaggtacaaccaaagtgctatggacatactaaggagcgtgaggacacgtctggttaaggttagcagacacatgtcactataggccttgaagaatggctggagggtgagcagaggaagccagtggggaagagcatttggaactgaggccccacctccaggaagcccaagatggggacagcatgcattattccacaaccctcatttcaaagagaatgaagaacactaccttctccctggtattcactatccttcaagactcaactcagtttctacctcctcaatgaagctggtcctaccttcaaccagactgggcatcaatccttactctgctctttactggattctttgcaagtcatgcaactagtctgagtgtcatgttcctcagctgtacactaggttgttgtggtgactaaatagatattgtatgaaagtgtccagttgggtgcagtggctcatgcctgtaatcccagcactttgggaggccgagatggacaaatcagatgaggccaagggttcgagaccagcctggccaaaatggtgaaactttgtctcttctaaaaaatgcaaaaattagctgggcatggtgg

SEQ ID NO: 53229 - DNA, 601 bp, Human
aaaatttagaaattcaaccgggtgtggtggcatgcacttatagtaccagctacttggggggctgaggtgggagggtctctccaccctgagaggttgagtccactgtactccaccctgggtgacagagaccctggctcaaaaataaagaaataaaaaataaagtaacagatgcctatgatatccaggcacagttctgagtgctttccatatattaactcatttaggcctcacacgacctacgagattggtagagttattctactaattttgtagatgaagaaatggaggcgtgaagagactycagaggccagagctactgccatggtaagcaccataagaaaggtacaaccaaagtgctatggacatactaaggagcgtgaggacacgtctggttaaggttagcagacacatgtcactataggccttgaagaatggctggagggtgagcagaggaagccagtggggaagagcatttggaactgaggccccacctccaggaagcccaagatggggacagcatgcattattccacaaccctcatttcaaagagaatgaagaacactaccttctccctggtattcactatccttcaagactcaac

SEQ ID NO: 53230 - DNA, 601 bp, Human
tgggcttggataaggccaggagagtgtggttagccaaactccaggtcacagagacacgagcccaaactggagcctcaaaaaacccccaggaaacaaggctacagagaaatgagttctcaggccactgctgcttcattcctcaggaaaaggagcaattctgcaggtctcccagtaagtccttggatagacgttctaactctggaaaaatccgtttttctgaacagcatttgaactaagtagtctgaatgccacactgaaccaatcaacagtctccacctctctaaacccagttgtctcaggrgagccttacatggcttccccttgagcacccccgctccccagcaccgagagtctggatgaggaggagggggtttcttgcctggatgactctgggcttctgaagtatctccagttgaaataggtctgcttcccaagagaggcagagggacagggctcctgcaggttgtaaactagccaaaccaaatggcaccttcctccacctgctgagtgcaagaagccacaccttgacaatgtatcaagccctgaatataggacactgcgtgaaagcctctgtgcaagtgtcatgtgtatgtgtgttgta

SEQ ID NO: 53231 - DNA, 601 bp, Human
catccactgaactccccagaaacccactatcttcctcatttcctttaccctggcccccagaactgaccagcctttctcctgtggggctccagctgcggcgattcatcaggaaatagccagtgatgcccaagacagccagcagggctcccgaggtgaccagtgcaatcagggtcttttgggaatagctctggtggcttgcaacatcttgctcagtgaaatctaggatccccagcttgaaaagaagacaaagaagatacagcctgtcacttgccaaaagtggagcccagcccgctccagcccyctgtgtgtgactcaacagtgaacagatgcttgagggcattgacctcaggaatttttgaaatgggatttgagactgacgtctcttaattcagtcataccccaccatttttggttcaagactagaaaggagaagactcagagaaggatggtaggtagaactggggaagataatgacttccccccttactccagggagcccccctgccccggcattccctctcaggcccatcatctcagaggacttacctttttcaggtcagattggtgctttttcataagttggagtttgctggaaatttct

SEQ ID NO: 53232 - DNA, 601 bp, Human
gcccacggtgggaaagttggatttttccagaaagcaggcaaattcttcagggcaagctgtccagctgtcagagggaaccagctgccccaccccaccccgcaatacacacacagcccttcctcccaaagcatacatacacattccagcaaactcagggtgagatgcattgcaggttgctaggcctgaagctggaggtgcatccaagttgccttttcctctcctcccatatttcctaggaatctgaaccctgaacccacccctcctacttgatgtcctagctgggacagaccctcactggatyactctcaaggcaagatgtgcaactagatgcaagtgggctggacttccctactgattaccatcgtcttttgctcatcatcctttgctccaaccctcaaggcagccatcgcctttgagggaagactctgaacctcatcatttcgcctcccctctgtcctagggaagaacctatgattagaggagttggagaaaagcaagaaggagatgggggtggaggagtgctgaagggaaaggtctggctttatggagataagaatggaagaatcaacctttgtttggccccaactgcctctgccactgt

SEQ ID NO: 53233 - DNA, 601 bp, Human
ctcaggcccacggtgggaaagttggatttttccagaaagcaggcaaattcttcagggcaagctgtccagctgtcagagggaaccagctgccccaccccaccccgcaatacacacacagcccttcctcccaaagcatacatacacattccagcaaactcagggtgagatgcattgcaggttgctaggcctgaagctggaggtgcatccaagttgccttttcctctcctcccatatttcctaggaatctgaaccctgaacccacccctcctacttgatgtcctagctgggacagaccctcactggatcactctcaaggcaagatgtgcaactagatgcaagtgggctggacttccctactgattaccatcgtcttttgctcatcatcctttgctccaaccctcaaggcagccatcgcctttgagggaagactctgaacctcatcatttcgcctcccctctgtcctagggaagaacctatgattagaggagttggagaaaagcaagaaggagatgggggtggaggagtgctgaagggaaaggtctggctttatggagataagaatggaagaatcaacctttgtttggccccaactgcctctgcc

SEQ ID NO: 53234 - DNA, 601 bp, Human
gcagcatcctgttgcacaaaatcgatgacctattactggttttgtgtgaagaggaagtgtgggattaatctacctagaagggatgagatggaagtgatctatttatctggacttagatggtattcccatttatccattcagatgaaaatctggctgaagataattccagatatgctctccatagtcaacagtgtaataccctacagctaattttcctgggctcactgtgggcgccgaagaagccgaacctcatggcctcctgtgatctttgtcctggggctcctccaggacctgcttggcyggccaggcctaggatagcttatgttgatgaaatgctccagaagtgaagtcccaaacctatcttcacactgccacactggcttcatgacatccaactggagtaacacggaggactcggcagaagagtaggatgatatgatggaagggaaaactacagattcaggactttggaattctgggtgattgggcaagccacctcccttctctgagccttagtttgtctttaactataccataagggagtttaattaaatgtatctttaaagttctcttcaacagtgacgttctatagttatatgag

SEQ ID NO: 53235 - DNA, 601 bp, Human; identical to SEQ ID NO: 18371

SEQ ID NO: 53236 - DNA, 601 bp, Human; identical to SEQ ID NO: 18372

SEQ ID NO: 53237 - DNA, 601 bp, Human; identical to SEQ ID NO: 18373

SEQ ID NO: 53238 - DNA, 601 bp, Human; identical to SEQ ID NO: 18374

SEQ ID NO: 53239 - DNA, 601 bp, Human; identical to SEQ ID NO: 18375

SEQ ID NO: 53240 - DNA, 601 bp, Human; identical to SEQ ID NO: 18376

SEQ ID NO: 53241 - DNA, 601 bp, Human; identical to SEQ ID NO: 18377

SEQ ID NO: 53242 - DNA, 601 bp, Human; identical to SEQ ID NO: 18378

SEQ ID NO: 53243 - DNA, 601 bp, Human; identical to SEQ ID NO: 18379

SEQ ID NO: 53244 - DNA, 601 bp, Human
cactgaagggagggtagcactggaagcaggggaagctccactgtggccccagtcctcagcagagagcccagtccctgtggcagccaggggccttgtcactcaaaccagccacagcctctgcagcccacctggtaatgagcattctggggcaccaggcagcaaaggctgcaatttatacattagcccagaataatcactctccaggcggagatgacacgcagtgaggcagccagcatttagcgggatcctctgatcacctcaaacctccctggttaagtacagtgtccgccctggcaccacygagcaggcagaacagctcctcggcggtggggagtacctggaacagcaggcaccatggagggtggaggagggtgcccagcagcccgagcctctgctctatctcacaggtgagccgggagggcaggacctgcgctgcgtccagaggaaggcagcaaataacacacccagcatatcagcgatgggcctcagagaggcggttccccgatccaaacccaacccaccaccctcaggcacgcacagggccatgccacacctgtcgatgccatgcaggagtgacggcctcgcagggccaaaccctcag

SEQ ID NO: 53245 - DNA, 601 bp, Human
tgtccagaaacactgctgtggccatttttggacaagacaatctgcctcctggaaccatccctgcctcatgtcagtgtcagagatacagtggccagcactgtaactccagtcctggggggcctccagagcagcatcacagagaaggaactggagccccaaacatgaccagacccacttgcaagccccacggcctctcagaagccacacttagccagcaggcaagctcagcctccaattgcagctccagcaagacctggctgcaggacctgcacaggtcacaccagcacgctgagccatctcytcttttgtaacagggcagtcataaggattccaccgggaatgggataaaggtcgacaataaagatcacgacaggatgggaaggcattgtcaggccagggcctccgaggggcagcccggcagaagccccaaaggcagttggcccgggtgtgtccactccgtgcccttcttcccaggggccgagccaggagaccacccccaggagaaacagtccccttttcttctgctgccaattgtgctccaggctgagtcctgcccagcaaagatcccagtcttgccaggctgggatcctgccaagtggcc

SEQ ID NO: 53246 - DNA, 601 bp, Human
cagcgagtgtccagaaacactgctgtggccatttttggacaagacaatctgcctcctggaaccatccctgcctcatgtcagtgtcagagatacagtggccagcactgtaactccagtcctggggggcctccagagcagcatcacagagaaggaactggagccccaaacatgaccagacccacttgcaagccccacggcctctcagaagccacacttagccagcaggcaagctcagcctccaattgcagctccagcaagacctggctgcaggacctgcacaggtcacaccagcacgctgagycatctcctcttttgtaacagggcagtcataaggattccaccgggaatgggataaaggtcgacaataaagatcacgacaggatgggaaggcattgtcaggccagggcctccgaggggcagcccggcagaagccccaaaggcagttggcccgggtgtgtccactccgtgcccttcttcccaggggccgagccaggagaccacccccaggagaaacagtccccttttcttctgctgccaattgtgctccaggctgagtcctgcccagcaaagatcccagtcttgccaggctgggatcctgcca

SEQ ID NO: 53247 - DNA, 601 bp, Human
cagaagggaaatagatgtcacctgcagacagcgagtgtccagaaacactgctgtggccatttttggacaagacaatctgcctcctggaaccatccctgcctcatgtcagtgtcagagatacagtggccagcactgtaactccagtcctggggggcctccagagcagcatcacagagaaggaactggagccccaaacatgaccagacccacttgcaagccccacggcctctcagaagccacacttagccagcaggcaagctcagcctccaattgcagctccagcaagacctggctgcaggayctgcacaggtcacaccagcacgctgagccatctcctcttttgtaacagggcagtcataaggattccaccgggaatgggataaaggtcgacaataaagatcacgacaggatgggaaggcattgtcaggccagggcctccgaggggcagcccggcagaagccccaaaggcagttggcccgggtgtgtccactccgtgcccttcttcccaggggccgagccaggagaccacccccaggagaaacagtccccttttcttctgctgccaattgtgctccaggctgagtcctgcccagcaaagatc

SEQ ID NO: 53248 - DNA, 601 bp, Human
ctcgctcgtcctgagtcgtgccccttgcaagaaaggctgaggccacaactctgctctgggtagagaggggatgctgggagaatcctcctgcagaaagcagacctaaactcttcgtcactgctgtcccagttacaacggctggggaataaacgactccaacacttagtggagtgcaaaaccaccaatcatgttcatggactctgaaggtcgggaatttggaccgagccccgagaggacagcaaagctctgctccacatctaggacctcagcagatggaaggctgggcctcatgcacgctggyggctggtgctgctggcggctggggtccccctatggggagtctgcgcttcctcatgatgtggcggctgggttcccagggcaagtaccccatgggagagaaccaggtggaagccacagtgcagtttacagtctagcctcagacgtcacacagcaacactgccacatccgtcatgaggcccagacctgggacaggcagaagggaaatagatgtcacctgcagacagcgagtgtccagaaacactgctgtggccatttttggacaagacaatctgcctcctggaaccatccctgcctcatgtca

SEQ ID NO: 53249 - DNA, 601 bp, Human
gcccagcatgtacacagccttttccaacaggggagacccctgttggaaacccctggaaaccccaggtggggccctgtttagcccctgatcagaccctccctgaagctgtttctccttctctgtccatccccacatctcacagaggaggcatccgacctgactgctgagctacttctctgagcagtgggacatgtcaacaggctctgagccagcagtgagggccatgaggaggcgagagggcagccaggtcaaaactgcaggtgtcacccggagccaagggtaccctggcacaggggccctygctcgtcctgagtcgtgccccttgcaagaaaggctgaggccacaactctgctctgggtagagaggggatgctgggagaatcctcctgcagaaagcagacctaaactcttcgtcactgctgtcccagttacaacggctggggaataaacgactccaacacttagtggagtgcaaaaccaccaatcatgttcatggactctgaaggtcgggaatttggaccgagccccgagaggacagcaaagctctgctccacatctaggacctcagcagatggaaggctgggcctcatgcacgctggcgg

SEQ ID NO: 53250 - DNA, 601 bp, Human
cctacacaccacacacactcccatcacaaacaccctacacaccacacatgcccactcacaacacagcacacacatgcccacacacactccctcacatgcaccctacacacctcacacacccacacacaacacagcacacacacactcccatcacaacctacataccacacaccacacacacacccatcacaaaaaacctacacaccacacacacaccccatcacaaacaccctacacaccacacacacaaaacacagcacacgcacacccacattcacccctcctcataaacaccctacayaccacacacccccatcacaaacaccctacacaccacaaacacagcacatgccccccccacacaacatactctacatgcatcacacacccccaacatatgtcctctccacatcacatccatacgtacccacccctccacatgcaccacaccacacacaggtgtgcactccatatgcacacacagccccccacacatacaccatgcatgtgcaaaccctcccaccatacccgcatccatctctcacacaagatgtgggtatggccctgggaaggctgagcgcccctccctgcatacccagag

SEQ ID NO: 53251 - DNA, 601 bp, Human
cggcccggcctgccttcagctacaaacaatgctgcctcgccgactctcactctgctctccacagaaggcagcggcatttgctctgcggtggaagccggcagccatctgaggatgttagctggtcagagacaaaagcagacctcgccacagtgacgcaggtgcctatgcccaaagaccactcccggagcaagcttcctcgcaggggccacagagggaacagcgctgcccgggaggctggagaccaggtccagtgaccaggcctgcccagggtcagtgcctcaaaccacccgggcagcagccraaggagctcctcagccccttctcagaggcctgcacggcaaagagggcccccgacaccctgccaatcacaaggagcgtgggagggaggcaccagagaggctggggaagcctcgatcctggggacacttagtggggcagagctgggaaaaacacacaacacacaacacacaacacaccctcatcacaaacaccctacacaacacacacacctgcacacaacacggcacactcacacccaccacaccccatcacaaacaccctacacattatttactcacacacccacacacccacatacacc

SEQ ID NO: 53252 - DNA, 601 bp, Human
atgaaatttcaaaaagcaggtcttgctggctggctgaccacctgcatgcgattaatgaataagtaacagggccaaattacagccatcaccatccatttcccgcggcccggcctgccttcagctacaaacaatgctgcctcgccgactctcactctgctctccacagaaggcagcggcatttgctctgcggtggaagccggcagccatctgaggatgttagctggtcagagacaaaagcagacctcgccacagtgacgcaggtgcctatgcccaaagaccactcccggagcaagcttcctcrcaggggccacagagggaacagcgctgcccgggaggctggagaccaggtccagtgaccaggcctgcccagggtcagtgcctcaaaccacccgggcagcagccgaaggagctcctcagccccttctcagaggcctgcacggcaaagagggcccccgacaccctgccaatcacaaggagcgtgggagggaggcaccagagaggctggggaagcctcgatcctggggacacttagtggggcagagctgggaaaaacacacaacacacaacacacaacacaccctcatcacaaacaccctacaca

SEQ ID NO: 53253 - DNA, 601 bp, Human
atcctaagggatatgcgtgccagactcccacgtcaaaccagccaccgaaggcttggcagccatgatttggtggggttgatgagaaaagaagaggtgtggccacacaagccctgcaaagctggctggagaggcccctgaggggctctggactccctgaggccaggctggccagggcaggaggcagccactcagagggagggcctgcaccctgccctgtggggagtctggggtccagcaacggtacttcatgtcaggccccatcgcatgggaagtctggatggaaacaaccagactggaggcygggcaccgtggctcacgcctgtaatcccagcactttggaaggccaaggtgggcagatcacctgaggtcaggagttcaagaccagcctggccaacatggtaaaaccctatctctactaaaaatacaaaaaaattagctgggtgtggtggctgtaatcccagctactcaggaggctgaggcaagagaatcgcttgagctagggaggtggaggttgcagtgagccgagatcgtgccattgtactccagcctgggtgatgagatcaaaactctgtctcaaaaaaaaaaaagaaaaagaaattac

SEQ ID NO: 53254 - DNA, 601 bp, Human
gcagggccatcagcgaaatgcgtggctgggatcaacacatcaactcggactttctggctccataacaaacaccctgcgtccctcagttgttcccagctctgcctctagccccctcccttcattgcctccagctgtgacaggagtggaaggcaacctcacggcagagtggggaagtacaaaggatctgattttgaggccagcgccctacagaggggcatctcagccatcagtgtggcacctgaccttgtcacttccactcccgttatgggcctgaaacctcccaactcaccccaactgtgcrgagggaagccaccaggaaatgcattcccgcccctcctgccaaaaagcgcctcccaagccagaggtctggttctcaacagaagagccattcgacagatacaacctgaaaagctgcaagcagcttttctggcaactgtgcattgcattctcttttaaagggcagagataattaagtttagatagtacttatttttcatgtttgggggctaattatagtaaaaaccatttaaacgtcatcctaagggatatgcgtgccagactcccacgtcaaaccagccaccgaaggcttggcagccatgat

SEQ ID NO: 53255 - DNA, 601 bp, Human
cttcggaggccccagacgcagggcttattgtgcagctggctcaagggaagcctacagaccctttgctactgagcaaccacactctcagcaccgagttgaccccacagcccggcacaaaagcaggtgtcagaaatacaaaaggcagggccatcagcgaaatgcgtggctgggatcaacacatcaactcggactttctggctccataacaaacaccctgcgtccctcagttgttcccagctctgcctctagccccctcccttcattgcctccagctgtgacaggagtggaaggcaacctcacrgcagagtggggaagtacaaaggatctgattttgaggccagcgccctacagaggggcatctcagccatcagtgtggcacctgaccttgtcacttccactcccgttatgggcctgaaacctcccaactcaccccaactgtgcggagggaagccaccaggaaatgcattcccgcccctcctgccaaaaagcgcctcccaagccagaggtctggttctcaacagaagagccattcgacagatacaacctgaaaagctgcaagcagcttttctggcaactgtgcattgcattctcttttaaaggg

SEQ ID NO: 53256 - DNA, 601 bp, Human
acggctgcagggagcaacaacaaggagcactgagggcccgggagacgctggtctcaccgtaatcaatggactgctcagtgcagcccacaatgccctttgctttctctcccttttggcttctctgaaatgatcacggggtatcaagctcctgctgttaattaaatttgcatgattcagtcacattcacttgtgcatttgagacaggactcaaaagttaaatggccaaggtctgacacctccattagcacggcctcgagcagttatggggcacgaattgatgacgagcgcctcgcctggactycggaggccccagacgcagggcttattgtgcagctggctcaagggaagcctacagaccctttgctactgagcaaccacactctcagcaccgagttgaccccacagcccggcacaaaagcaggtgtcagaaatacaaaaggcagggccatcagcgaaatgcgtggctgggatcaacacatcaactcggactttctggctccataacaaacaccctgcgtccctcagttgttcccagctctgcctctagccccctcccttcattgcctccagctgtgacaggagtggaaggcaacctcacggc

SEQ ID NO: 53257 - DNA, 601 bp, Human
aaccaatcagactgatggcaggccaccacttcatttacaccaggcgagcaccaagtggccaatgggaaacctcctgggggtatctggacctgagaagattctgtcactaggccttgagactctgctcagccggctcccacactgtggagtgcactttcattttcaataaatctctgctttcattctttcgttgcttcattctttcctttgtgtgttttgtccaattctttgttcaaaatggcaacaacctggacaacttgcagtcaagaccctctacggataactggggggcgggggggggtgttgtgggtgccaaggataatgtgcctggagaaccccacggaacacggtggagggagagaaccttgggacttggaggtgatgaacttcacgagtgagctcctgaactggtgtcctatgtgccattctcagcctttgtgacactaaggaccagcatcacctgcaggaaacagaatctgctcctctctctgagtcctccaccacttccctccccacccaaaccaggaagtactggccacagggcccagggacggctgcagggagcaacaacaaggagcactgagggcccgggagacgctgg

SEQ ID NO: 53258 - DNA, 601 bp, Human; identical to SEQ ID NO: 18380

SEQ ID NO: 53259 - DNA, 601 bp, Human; identical to SEQ ID NO: 18381

SEQ ID NO: 53260 - DNA, 601 bp, Human; identical to SEQ ID NO: 18382

SEQ ID NO: 53261 - DNA, 601 bp, Human; identical to SEQ ID NO: 18383

SEQ ID NO: 53262 - DNA, 601 bp, Human; identical to SEQ ID NO: 18384

SEQ ID NO: 53263 - DNA, 601 bp, Human; identical to SEQ ID NO: 18385

SEQ ID NO: 53264 - DNA, 601 bp, Human; identical to SEQ ID NO: 18386

SEQ ID NO: 53265 - DNA, 601 bp, Human; identical to SEQ ID NO: 18387

SEQ ID NO: 53266 - DNA, 601 bp, Human; identical to SEQ ID NO: 18388

SEQ ID NO: 53267 - DNA, 601 bp, Human; identical to SEQ ID NO: 18389

SEQ ID NO: 53268 - DNA, 601 bp, Human; identical to SEQ ID NO: 18390

SEQ ID NO: 53269 - DNA, 601 bp, Human; identical to SEQ ID NO: 18391

SEQ ID NO: 53270 - DNA, 601 bp, Human; identical to SEQ ID NO: 18392

SEQ ID NO: 53271 - DNA, 601 bp, Human; identical to SEQ ID NO: 18393

SEQ ID NO: 53272 - DNA, 601 bp, Human
ccaccacacagctgccagacgtggtccaggggggctcagcattctctctagaggaggagcaagcaaagctctcaccgctgagaaggccctcgactcactgacatctgggaaactgggaattggtgatcctggagcccacctggcccaccacgcagatggggagactgaggcacagaggagcaatgggatttgctggggtttgcatgcgggcaactgtcactgagcaccagctctgtgccaggctccaggtgagcatgatctcctccagtgcccaccacaagcccaggcagcaccaggttayacgtggaggagctgagggtccccctgctgcagagacccaaacagaggccatagagaggttccatggcatggtcgaggaaaggtgtgcaggacactggagacccagcaccaggtagtgctggggggattcagggagtcccgggactgggacaggcagcagctggctgtgcccgtagcccctctgagggcctgggggcctggggagagagagcagctccatggccagcatttcaacaagctgggctaattgctgccaggcgtgggaggcggggccgctttggggaaactcccaggaggacac

SEQ ID NO: 53273 - DNA, 601 bp, Human
ggaagaagtctcaagtctcttgctgcagggttcccctccccatctcagcccccactagcccccaaaccaaccccccatcatgcccccgccaggacctggcaatgagcacccgaccccatgcccacacccacccctcctgccagagcccgcagcaaagcctgctcttcccaaatcttccttgggactgctccaatcaagccacacacggaactgctgcctgggccggaccccaaactcacaagcccctacagaccatcccggcctacacccttcacgctactgtcatcacaccgagccacaycactgggtgagcccaggggcctcagtccacagggtctctctggccgtgtgcatgcccaccaccctcagcccacctctgccctgtcccctctgctccttgtcctctgctgtccccacacctcgagaccccacacactcttactgcaggcagcaggcggcctggccctgatctggggaggtggagggaggtctgagaccaaggctgagcccaaatgggacagaccccaggccaggcaccccgagtagccacacctggaggggtcctggcccaaccatccagctggaccagggtcccaagggt

SEQ ID NO: 53274 - DNA, 601 bp, Human
ccagggagcctatcttgccatccgcaggaagaagtctcaagtctcttgctgcagggttcccctccccatctcagcccccactagcccccaaaccaaccccccatcatgcccccgccaggacctggcaatgagcacccgaccccatgcccacacccacccctcctgccagagcccgcagcaaagcctgctcttcccaaatcttccttgggactgctccaatcaagccacacacggaactgctgcctgggccggaccccaaactcacaagcccctacagaccatcccggcctacacccttcaygctactgtcatcacaccgagccacatcactgggtgagcccaggggcctcagtccacagggtctctctggccgtgtgcatgcccaccaccctcagcccacctctgccctgtcccctctgctccttgtcctctgctgtccccacacctcgagaccccacacactcttactgcaggcagcaggcggcctggccctgatctggggaggtggagggaggtctgagaccaaggctgagcccaaatgggacagaccccaggccaggcaccccgagtagccacacctggaggggtcctggcccaacca

SEQ ID NO: 53275 - DNA, 601 bp, Human
agctcaggccacccagcccctgccaacaatcccccaacagaccatctctccttcatggtcagtctcctgctctcaggaaaacctgccctaacgtctacctccttagatgttttcagagatctaccatgtctgactttgctcccagccttcaggagccaagtgttccagggagcctatcttgccatccgcaggaagaagtctcaagtctcttgctgcagggttcccctccccatctcagcccccactagcccccaaaccaaccccccatcatgcccccgccaggacctggcaatgagcaccsgaccccatgcccacacccacccctcctgccagagcccgcagcaaagcctgctcttcccaaatcttccttgggactgctccaatcaagccacacacggaactgctgcctgggccggaccccaaactcacaagcccctacagaccatcccggcctacacccttcacgctactgtcatcacaccgagccacatcactgggtgagcccaggggcctcagtccacagggtctctctggccgtgtgcatgcccaccaccctcagcccacctctgccctgtcccctctgctccttgtcctctgctgt

SEQ ID NO: 53276 - DNA, 601 bp, Human
tctatgctcatagcagcattactcaggaacagccaaaagttggaagcaacccaggtgtccaccaactgatgaatggacaaacgaaatgtggtacgtatccatagaaaaaaatatttttcagccataaaacaaagtagtagtgacagaataagcaagcagggaaatcaggaaagatatagaagatataaacaagaaattaaccaacttgacgtaattgacatatacagaacactatggcccataactgcagaatacatgctttctttaagtgtatgtgaacatttatcataatggtcacgtrctggaagtttcaacatattttaaagggctgagatgcagagaacattcattaatcacagtagaattaaatgagaaatcaaaaaatatccatggctcaaagataaaaatacaatgaaattagaaaataacaatatgaaatatcataacctgtgagaaatgcagctaaagcagtgcttacaggaaaactcatagctctaaacatacacagcagaaaagaacactgaaaatcagcgatctaaacttccatcctaagaatgacccttgaagaaagcaatgaaataaaaaggaaccatataagaaa

SEQ ID NO: 53277 - DNA, 601 bp, Human
ggttctagccaaggcaaacaggcaagaaaagacatgaaaggcatccagacgaccctgcaattccacttctaggtatatacccaagggaactgaaagcatatgttcacacaagaagtctgacatctatgctcatagcagcattactcaggaacagccaaaagttggaagcaacccaggtgtccaccaactgatgaatggacaaacgaaatgtggtacgtatccatagaaaaaaatatttttcagccataaaacaaagtagtagtgacagaataagcaagcagggaaatcaggaaagatatasaagatataaacaagaaattaaccaacttgacgtaattgacatatacagaacactatggcccataactgcagaatacatgctttctttaagtgtatgtgaacatttatcataatggtcacgtgctggaagtttcaacatattttaaagggctgagatgcagagaacattcattaatcacagtagaattaaatgagaaatcaaaaaatatccatggctcaaagataaaaatacaatgaaattagaaaataacaatatgaaatatcataacctgtgagaaatgcagctaaagcagtgcttaca

SEQ ID NO: 53278 - DNA, 601 bp, Human
agcgtgatggtgcacacgtgtaatcccagctacttaggaggctgaggcaggagaatcacatggacccaggaggcggaggtgcagtgagctgagatcacaccactgcactccagcctgggagatagagagactccatctcaaaacaaacaaataaacaacaacaacaacaacaaaaacagaaaaggaggcaatacttttcaaccactctacaaggtcagtattaccttgatgctaagctagacaaagacaccttaagaaaacaaaattacacacccaaattccttgcgaatagagacaaaawtttttcaacaaaacactagcaaacagaatccagcaacatataaaaaggatatatatacatcatgaccaagtgggattttttcccaggaatacaagattccttcaacatacaaaaagaaatcaatgtaacacatcaatcatattaatagaacacataataaaaccatatgcttgtataaatagatggagaaaaataaactgataaaatcaaacaccttttcataataaatactcaatgaactagggagggaagggaacttcttcaacttgataaagagcatctacaaaaaactccctcaac

SEQ ID NO: 53279 - DNA, 601 bp, Human
acaaaggaatgaaaaagggggaaattactactgactttacagaaataaaaaagtttataagggaatattataaataacatacagtaacaaattggataacctatttgaaacaaatccctaaagacacaaactattaaattgatataagaaatagaaaatctaggctgggcgcagtggctcatgcctgcagtcccagcactttgggaggctaaggcgggcagatcacctgaggtcagtagttcgagaccagcctggccaacattgcaaaaccccatctctaccgaaaatacaaaaattagcygggcgtggtggcttgtgcctgtagtcccagctactcaggaggctgaggcaggagaattgcttgaacccaggaggctgagcatgcagtgagccgagatcgtgccattgcactccagcctgggtgacaagagtgaaactccatctcaaaaacaaaaaaaagaaagaaatagaaaatctaaacagaccttaacaagagatcaaatttgtaataaaaaacttctcataaagaaaagcccaggaccaaatgtcttctatgaaatgaatagaaattctatcaaatgtttaaagaattaacaccaat

SEQ ID NO: 53280 - DNA, 601 bp, Human
ggatcacgtatcaaaccttacaaaggaatgaaaaagggggaaattactactgactttacagaaataaaaaagtttataagggaatattataaataacatacagtaacaaattggataacctatttgaaacaaatccctaaagacacaaactattaaattgatataagaaatagaaaatctaggctgggcgcagtggctcatgcctgcagtcccagcactttgggaggctaaggcgggcagatcacctgaggtcagtagttcgagaccagcctggccaacattgcaaaaccccatctctaccgaaaatacaaaaattagctgggcgtggtggcttgtgcctgtagtcccagctactcaggaggctgaggcaggagaattgcttgaacccaggaggctgagcatgcagtgagccgagatcgtgccattgcactccagcctgggtgacaagagtgaaactccatctcaaaaacaaaaaaaagaaagaaatagaaaatctaaacagaccttaacaagagatcaaatttgtaataaaaaacttctcataaagaaaagcccaggaccaaatgtcttctatgaaatgaatagaaattctatcaaatgt

SEQ ID NO: 53281 - DNA, 601 bp, Human
tgacaaatatgtagaaattaaacagtagactcctaaataaccaatggatcacgtatcaaaccttacaaaggaatgaaaaagggggaaattactactgactttacagaaataaaaaagtttataagggaatattataaataacatacagtaacaaattggataacctatttgaaacaaatccctaaagacacaaactattaaattgatataagaaatagaaaatctaggctgggcgcagtggctcatgcctgcagtcccagcactttgggaggctaaggcgggcagatcacctgaggtcagkagttcgagaccagcctggccaacattgcaaaaccccatctctaccgaaaatacaaaaattagctgggcgtggtggcttgtgcctgtagtcccagctactcaggaggctgaggcaggagaattgcttgaacccaggaggctgagcatgcagtgagccgagatcgtgccattgcactccagcctgggtgacaagagtgaaactccatctcaaaaacaaaaaaaagaaagaaatagaaaatctaaacagaccttaacaagagatcaaatttgtaataaaaaacttctcataaagaaaagccca

SEQ ID NO: 53282 - DNA, 601 bp, Human
gaggaggcggagattgcagtgagccaagatcgcaccactgcactccagcctggcgacacagcaagactccgtttcaaaaaatatatatatatagcgtgtgtgtgtgtgtgtgtgtgtgtgtgtgtatatcaaaaacctaacacgtagctctaaaatactcagccaatagcagcagaacagccattttctcaagtgcacatggatcattctccaggatacactttatgttaggtcacaaaacaagttccaatacatttcaaaagactgaaatcacactaagcatgccctctgaccacaatgsaatgaaataagaaatcagtaacataaggaaaatagaaaaattgacaaatatgtagaaattaaacagtagactcctaaataaccaatggatcacgtatcaaaccttacaaaggaatgaaaaagggggaaattactactgactttacagaaataaaaaagtttataagggaatattataaataacatacagtaacaaattggataacctatttgaaacaaatccctaaagacacaaactattaaattgatataagaaatagaaaatctaggctgggcgcagtggctcatgcctgcagtccca

SEQ ID NO: 53283 - DNA, 601 bp, Human
tcgcagcactttgggaggccaaggcgggtggatcacgaggtcaggagatccagaccatcctggccaatatggtgaaaacccgtctctactgaaaacacaaaaattagcagagcatggtggtgagcgcctgtaatcccagctactcaggaggctgaggcaagagaatcgcttgaaccgaggaggcggagattgcagtgagccaagatcgcaccactgcactccagcctggcgacacagcaagactccgtttcaaaaaatatatatatatagcgtgtgtgtgtgtgtgtgtgtgtgtgtgtgtatatcaaaaacctaacacgtagctctaaaatactcagccaatagcagcagaacagccattttctcaagtgcacatggatcattctccaggatacactttatgttaggtcacaaaacaagttccaatacatttcaaaagactgaaatcacactaagcatgccctctgaccacaatggaatgaaataagaaatcagtaacataaggaaaatagaaaaattgacaaatatgtagaaattaaacagtagactcctaaataaccaatggatcacgtatcaaaccttacaaaggaatgaaaaaggg

SEQ ID NO: 53284 - DNA, 601 bp, Human
atcgcagcactttgggaggccaaggcgggtggatcacgaggtcaggagatccagaccatcctggccaatatggtgaaaacccgtctctactgaaaacacaaaaattagcagagcatggtggtgagcgcctgtaatcccagctactcaggaggctgaggcaagagaatcgcttgaaccgaggaggcggagattgcagtgagccaagatcgcaccactgcactccagcctggcgacacagcaagactccgtttcaaaaaatatatatatatagcgtgtgtgtgtgtgtgtgtgtgtgtgtgtrtatatcaaaaacctaacacgtagctctaaaatactcagccaatagcagcagaacagccattttctcaagtgcacatggatcattctccaggatacactttatgttaggtcacaaaacaagttccaatacatttcaaaagactgaaatcacactaagcatgccctctgaccacaatggaatgaaataagaaatcagtaacataaggaaaatagaaaaattgacaaatatgtagaaattaaacagtagactcctaaataaccaatggatcacgtatcaaaccttacaaaggaatgaaaaagg

SEQ ID NO: 53285 - DNA, 601 bp, Human
taatcgcagcactttgggaggccaaggcgggtggatcacgaggtcaggagatccagaccatcctggccaatatggtgaaaacccgtctctactgaaaacacaaaaattagcagagcatggtggtgagcgcctgtaatcccagctactcaggaggctgaggcaagagaatcgcttgaaccgaggaggcggagattgcagtgagccaagatcgcaccactgcactccagcctggcgacacagcaagactccgtttcaaaaaatatatatatatagcgtgtgtgtgtgtgtgtgtgtgtgtgtrtgtatatcaaaaacctaacacgtagctctaaaatactcagccaatagcagcagaacagccattttctcaagtgcacatggatcattctccaggatacactttatgttaggtcacaaaacaagttccaatacatttcaaaagactgaaatcacactaagcatgccctctgaccacaatggaatgaaataagaaatcagtaacataaggaaaatagaaaaattgacaaatatgtagaaattaaacagtagactcctaaataaccaatggatcacgtatcaaaccttacaaaggaatgaaaaa

SEQ ID NO: 53286 - DNA, 601 bp, Human
tgtaatcgcagcactttgggaggccaaggcgggtggatcacgaggtcaggagatccagaccatcctggccaatatggtgaaaacccgtctctactgaaaacacaaaaattagcagagcatggtggtgagcgcctgtaatcccagctactcaggaggctgaggcaagagaatcgcttgaaccgaggaggcggagattgcagtgagccaagatcgcaccactgcactccagcctggcgacacagcaagactccgtttcaaaaaatatatatatatagcgtgtgtgtgtgtgtgtgtgtgtgtrtgtgtatatcaaaaacctaacacgtagctctaaaatactcagccaatagcagcagaacagccattttctcaagtgcacatggatcattctccaggatacactttatgttaggtcacaaaacaagttccaatacatttcaaaagactgaaatcacactaagcatgccctctgaccacaatggaatgaaataagaaatcagtaacataaggaaaatagaaaaattgacaaatatgtagaaattaaacagtagactcctaaataaccaatggatcacgtatcaaaccttacaaaggaatgaaa

SEQ ID NO: 53287 - DNA, 601 bp, Human
gaaacgaaagtggaactagaatggctatactaacatcagacaaaataagccctaagatacaaagttttactaaagacaaagaagggcattttataacgataattaggtcaatccacaaagaagataaaacaattacaaatatatgcacataacagagccctaagatgtatgtatcaaaaactaacaaaattggagagagaaactgacaatagttggagacgtcaataatctactttcggtaatgaataaaacaattagacagaagattaaaaaggaaacagaagacctgaacaaaaacgcrgtggctcacgcctgtaatcgcagcactttgggaggccaaggcgggtggatcacgaggtcaggagatccagaccatcctggccaatatggtgaaaacccgtctctactgaaaacacaaaaattagcagagcatggtggtgagcgcctgtaatcccagctactcaggaggctgaggcaagagaatcgcttgaaccgaggaggcggagattgcagtgagccaagatcgcaccactgcactccagcctggcgacacagcaagactccgtttcaaaaaatatatatatatagcgtgtgtgtgtgt

SEQ ID NO: 53288 - DNA, 601 bp, Human
tttatccagtctaccactgatgggcatttaggttgattccatgtgtttgctattgtgaatagtgctgcagcgaacatacacatgcatgtgttgttagaacaatttatattcctttgggtgtatactcagtaacgggattgctgggttgaatggtatttctgtttttaggtctttgcggaattgccacgctgtcttccacaatggtttaactaatttacactcccaccaccagtgtgtaagtgttcctttttctctgcaaccttgccagcatctgttattttttgactttttaataaaagcyagacagaatgattttttaaaatatgatccaattatatgctctaaagagacacactttagattcaaagacacaaataggttgaaagtaaaatgatgagaaacgatatgctacacaaacagaaacgaaagtggaactagaatggctatactaacatcagacaaaataagccctaagatacaaagttttactaaagacaaagaagggcattttataacgataattaggtcaatccacaaagaagataaaacaattacaaatatatgcacataacagagccctaagatgtatgtatcaaaaact

SEQ ID NO: 53289 - DNA, 601 bp, Human
ggtgcataccataccacattttctttatccagtctaccactgatgggcatttaggttgattccatgtgtttgctattgtgaatagtgctgcagcgaacatacacatgcatgtgttgttagaacaatttatattcctttgggtgtatactcagtaacgggattgctgggttgaatggtatttctgtttttaggtctttgcggaattgccacgctgtcttccacaatggtttaactaatttacactcccaccaccagtgtgtaagtgttcctttttctctgcaaccttgccagcatctgttaytttttgactttttaataaaagccagacagaatgattttttaaaatatgatccaattatatgctctaaagagacacactttagattcaaagacacaaataggttgaaagtaaaatgatgagaaacgatatgctacacaaacagaaacgaaagtggaactagaatggctatactaacatcagacaaaataagccctaagatacaaagttttactaaagacaaagaagggcattttataacgataattaggtcaatccacaaagaagataaaacaattacaaatatatgcacataacagagcc

SEQ ID NO: 53290 - DNA, 601 bp, Human
actaattttaaaatggtagagtttttccttatcaataattactttagatgtaaatggattaaattctccaattacaaggcaaggattggcgaatgaattctttttttttttttaattttaagttcaggggtacatgtgcaggtttcttacataggtaaacttgtgtaatggggctttgttgtacagattattctgccacctaggtattaagtctagtgcccattagttattttgttatttttcctgatcctcttcctcctcccaccctccaccttccaataggccccagtgtgtgttgtcsccctctatgtgtccatgtgttctcatcatttagctcccacttgtaagtgagaacatgtggcatttggttttctgttcctgcattagtttgctgaggataacagcctccagctccatccatgttcttgcaaaggacatgatctcattcttttttatggttgcatagtattccatggtgcataccataccacattttctttatccagtctaccactgatgggcatttaggttgattccatgtgtttgctattgtgaatagtgctgcagcgaacatacacatgcatgtgttgttagaacaatt

SEQ ID NO: 53291 - DNA, 601 bp, Human
aaatgtattttttgtttgtaactccttttctctcctgacttaaaagacaactgaataaagcgataattgtaaatctgtattgataagtacaaaatgaataaagacgcaatccacatgccataacagcacaaaagagaatgaggaaaaggagacatataggggcaagcttttgcatgctatttaaattaagctgacattaatgcaaactagattttcaagtttaagtagtcaattgtaatccccataatcattaagaaaacagctaaaacatacagaaaaggaaatgagaaaccaaaatgtkacaataaaaaaaaaatcaaacacaaaaaaatgtaatggagaaagtgaggaacaaaaatgttataagacatatagaaaactaattttaaaatggtagagtttttccttatcaataattactttagatgtaaatggattaaattctccaattacaaggcaaggattggcgaatgaattctttttttttttttaattttaagttcaggggtacatgtgcaggtttcttacataggtaaacttgtgtaatggggctttgttgtacagattattctgccacctaggtattaagtctagtgcccat

SEQ ID NO: 53292 - DNA, 601 bp, Human
aaaacccaagagaatttattactagcagacctaccctgaaagaaaaaccaaagggaattgtttcaaataaaatgaaaaggtactgcagagtaacctgaatccacgtgaagagaaagagagcactggcaatggtaaccatacagataaatataaagacagtataaatgtattttttgtttgtaactccttttctctcctgacttaaaagacaactgaataaagcgataattgtaaatctgtattgataagtacaaaatgaataaagacgcaatccacatgccataacagcacaaaagagaawgaggaaaaggagacatataggggcaagcttttgcatgctatttaaattaagctgacattaatgcaaactagattttcaagtttaagtagtcaattgtaatccccataatcattaagaaaacagctaaaacatacagaaaaggaaatgagaaaccaaaatgtgacaataaaaaaaaaatcaaacacaaaaaaatgtaatggagaaagtgaggaacaaaaatgttataagacatatagaaaactaattttaaaatggtagagtttttccttatcaataattactttagatgtaaatggatta

SEQ ID NO: 53293 - DNA, 601 bp, Human
atcccagataagcaaaacccaagagaatttattactagcagacctaccctgaaagaaaaaccaaagggaattgtttcaaataaaatgaaaaggtactgcagagtaacctgaatccacgtgaagagaaagagagcactggcaatggtaaccatacagataaatataaagacagtataaatgtattttttgtttgtaactccttttctctcctgacttaaaagacaactgaataaagcgataattgtaaatctgtattgataagtacaaaatgaataaagacgcaatccacatgccataacarcacaaaagagaatgaggaaaaggagacatataggggcaagcttttgcatgctatttaaattaagctgacattaatgcaaactagattttcaagtttaagtagtcaattgtaatccccataatcattaagaaaacagctaaaacatacagaaaaggaaatgagaaaccaaaatgtgacaataaaaaaaaaatcaaacacaaaaaaatgtaatggagaaagtgaggaacaaaaatgttataagacatatagaaaactaattttaaaatggtagagtttttccttatcaataattactttaga

SEQ ID NO: 53294 - DNA, 601 bp, Human
agattattagctgatttctcatcaaaacctatggtggagagaaggcagtgggatgacatttaaagtgctgaaagattaaaaaaaaaagtccaccaagaattccatatccagcaaagccattattaataaatgagggagaactacaacatcccagataagcaaaacccaagagaatttattactagcagacctaccctgaaagaaaaaccaaagggaattgtttcaaataaaatgaaaaggtactgcagagtaacctgaatccacgtgaagagaaagagagcactggcaatggtaaccatayagataaatataaagacagtataaatgtattttttgtttgtaactccttttctctcctgacttaaaagacaactgaataaagcgataattgtaaatctgtattgataagtacaaaatgaataaagacgcaatccacatgccataacagcacaaaagagaatgaggaaaaggagacatataggggcaagcttttgcatgctatttaaattaagctgacattaatgcaaactagattttcaagtttaagtagtcaattgtaatccccataatcattaagaaaacagctaaaacatacagaaaa

SEQ ID NO: 53295 - DNA, 601 bp, Human
ctacaaaacaccagccctgatccccactaggcagacagcatagtctcttgtgtcaagtatatcaaaatacacacaataggagtaccagaaggaaagaatgcagagaaagcaaaaacctcaccaatttgatgaaaaacattaatctacatatccataaagctccatgaactccaagtaggataaattcaaagatatccacacctagacacatgataatcaaactgtcaaaaaagtatcttgaaagcagcaagagaaaagtattaataattcatcacttacaagggatcctcaattagattawtagctgatttctcatcaaaacctatggtggagagaaggcagtgggatgacatttaaagtgctgaaagattaaaaaaaaaagtccaccaagaattccatatccagcaaagccattattaataaatgagggagaactacaacatcccagataagcaaaacccaagagaatttattactagcagacctaccctgaaagaaaaaccaaagggaattgtttcaaataaaatgaaaaggtactgcagagtaacctgaatccacgtgaagagaaagagagcactggcaatggtaaccatacagataa

SEQ ID NO: 53296 - DNA, 601 bp, Human
cagacctggcagcctgggccatgtcctccaaatgcagtcagttggagagcaagctttatggctacaaaacaccagccctgatccccactaggcagacagcatagtctcttgtgtcaagtatatcaaaatacacacaataggagtaccagaaggaaagaatgcagagaaagcaaaaacctcaccaatttgatgaaaaacattaatctacatatccataaagctccatgaactccaagtaggataaattcaaagatatccacacctagacacatgataatcaaactgtcaaaaaagtatcttsaaagcagcaagagaaaagtattaataattcatcacttacaagggatcctcaattagattattagctgatttctcatcaaaacctatggtggagagaaggcagtgggatgacatttaaagtgctgaaagattaaaaaaaaaagtccaccaagaattccatatccagcaaagccattattaataaatgagggagaactacaacatcccagataagcaaaacccaagagaatttattactagcagacctaccctgaaagaaaaaccaaagggaattgtttcaaataaaatgaaaaggtactgc

SEQ ID NO: 53297 - DNA, 601 bp, Human
cagtatcaccatgggaaggaagaaggtgacagaagaatgcgtagaacagaatgccacctttgtcaagacacatgcgtgacatgtttacctttctggcaatgggattatgtgttatgtttatttctgcccttttcaccatctacctcgtgctggagctatctaagtttggtttacttatggtaggagtttttgtaagattgcaaataagggaaataagtttaactgatgtttaagtgactcacgtcctttcaaaaaaagtacggccagtcaaccaacaacaaagaacaagcaaaacagaaaaggctatgggagaaggttctgggaatctgctttctgaggggctctctgagacggtgtgggcaggaacaacagggcattccatccccatgagccgagcacaacaaacaggcaaggtgaccacaggccgtactcaccactcaacgatctctgggtgaagaatggtattgttgacttcgaacctgtagggcgaaaagaaatcaagcccattaatccaacggtctgtcatgtcccagcaagaactacctcattcaagacatgcacacgtgatgcattaaagagggtcccacactttaatttcatg

SEQ ID NO: 53298 - DNA, 601 bp, Human
catacagacttagggtcatatgtgagaaggctacacatctccttggcaagtgatgatgtggcaaaggcctggccttgcctctcttctacattctcagtacgtgcagccatccatcaaagaaaaaatgccttgctgctgtcaaagagcaatgcgatggcttaggaagaaaactggtggcacactgggatgcgagggccacctccagggcccacagaggtggcgcccagcataagacagctcactttgtaggcagctagtagaagccagttgtgcagcaggtaagggctaacagtatcaccaygggaaggaagaaggtgacagaagaatgcgtagaacagaatgccacctttgtcaagacacatgcgtgacatgtttacctttctggcaatgggattatgtgttatgtttatttctgcccttttcaccatctacctcgtgctggagctatctaagtttggtttacttatggtaggagtttttgtaagattgcaaataagggaaataagtttaactgatgtttaagtgactcacgtcctttcaaaaaaagtacggccagtcaaccaacaacaaagaacaagcaaaacagaaaaggctatgggag

SEQ ID NO: 53299 - DNA, 601 bp, Human
ccttctttttccacagccgatgcccattcatctttcaggatacctccttggtcccaagctctaagacgaggcgagtcagagctcccagctagacaggaaagaaaatgtgatcatacagacttagggtcatatgtgagaaggctacacatctccttggcaagtgatgatgtggcaaaggcctggccttgcctctcttctacattctcagtacgtgcagccatccatcaaagaaaaaatgccttgctgctgtcaaagagcaatgcgatggcttaggaagaaaactggtggcacactgggatgsgagggccacctccagggcccacagaggtggcgcccagcataagacagctcactttgtaggcagctagtagaagccagttgtgcagcaggtaagggctaacagtatcaccatgggaaggaagaaggtgacagaagaatgcgtagaacagaatgccacctttgtcaagacacatgcgtgacatgtttacctttctggcaatgggattatgtgttatgtttatttctgcccttttcaccatctacctcgtgctggagctatctaagtttggtttacttatggtaggagtttttgtaagattgc

SEQ ID NO: 53300 - DNA, 601 bp, Human
cacctagctatgcgggacaaaaacctggagtcaccttcaactctgcccttcactcacgcatcataaccggtccctcccaggagctttccctcttgactgcggcttcaccactcagatctgtcctgccacagccctccactgccagctggacccctgcaacagcctcctaacttgccacctgttcccacacttgccctacagctgggtctctagtctgaggccaaaatgatttcttattttttattttattttttttgagacagagtcttgctctgtcgcccaggctggagtacagtggcgygatctcagctcactgcaacctccgcttcccaggttcacaccattctcctgcctcagtctccctaagagctgggactacaggtgcccgccaccatgccctgctaatttttggtatttttagtagagacggggtttcactgtgttagccaggatggtctcgatctcctgacctcatgatccacccacctcggcctcccaaagtgctgggattataggcctgagccacctcacccggctcgaaatgattttttaaatgcaaacccaattctaccattctcctgcttaaacccttcaagggttt

SEQ ID NO: 53301 - DNA, 601 bp, Human
ctcctgggctcaagcgatcctcctgcctcagcctcccaagaagctaggactataggagtccaatgccgtgttcggctaattttttaaaattttgtttttgtagagatgggatctctctatgttgctcaggctggtctcaaactcccggcctcaagtgattctctcgtgtttgtctcccaaagtgctgggattacaggcgtgagccaccagcttggctttgttactttataaaaacaagaggtggctgtgaacttgaagaacaccagccctgtcttcacagagtgtggctgtgaggggcgtyggacccactggcctctaaccccgagggtcagtattagcgcctgtcatcggccctcagttctccacccccagctcagccctctctcccactggcacctacctcagactcaacacaccccaagtcccagatctgccccggtatctggccctcccagttgtccccatctcagtgacacaccacctagctatgcgggacaaaaacctggagtcaccttcaactctgcccttcactcacgcatcataaccggtccctcccaggagctttccctcttgactgcggcttcaccactcagatctgtcc

SEQ ID NO: 53302 - DNA, 601 bp, Human
gaggcagtataagtggacatggcccattctaagtacccaggatttattcttctgccaaatgggggctacagataggacaggctctctggtttctcttcagatcctatgaatcatttgccttttacggacaagtcaggcatttgttactttatttttttgagacaaggtctcgctctgtcactcaggctggagtatggtagcataatcatggctcactgcagcctcgacctcctgggctcaagcgatcctcctgcctcagcctcccaagaagctaggactataggagtccaatgccgtgttmggctaattttttaaaattttgtttttgtagagatgggatctctctatgttgctcaggctggtctcaaactcccggcctcaagtgattctctcgtgtttgtctcccaaagtgctgggattacaggcgtgagccaccagcttggctttgttactttataaaaacaagaggtggctgtgaacttgaagaacaccagccctgtcttcacagagtgtggctgtgaggggcgtcggacccactggcctctaaccccgagggtcagtattagcgcctgtcatcggccctcagttctccacccccagc

SEQ ID NO: 53303 - DNA, 601 bp, Human
acccaggctattaaaacatacccctgagcagcagggacaatgtgacatttctaaaatggttctactgccatcaactttctgctgcttgctttaataaagttgggaggtatgcttaggaacgcgggctcgacctcaaagcctcgaaaatgtcacttgaattaaagcatgcttctttgaaagtgacgaattaatgacttatcccttaggagatggcaggagtacaggacccagccatggtctccaaggcacccaagctgtaagtgaccacaagggaatgtcccatgtgaggcagtataagtgracatggcccattctaagtacccaggatttattcttctgccaaatgggggctacagataggacaggctctctggtttctcttcagatcctatgaatcatttgccttttacggacaagtcaggcatttgttactttatttttttgagacaaggtctcgctctgtcactcaggctggagtatggtagcataatcatggctcactgcagcctcgacctcctgggctcaagcgatcctcctgcctcagcctcccaagaagctaggactataggagtccaatgccgtgttcggctaattttttaaa

SEQ ID NO: 53304 - DNA, 601 bp, Human
gctacttggaaggctgaggtgggaggatcgcctgagcccaggaggtcaaggctgcagcaagctacgatcatgccactgtactccagcctgagagacaaagtgagatcctgtctcttaaaaaaaaaaaaaaaaagacatgccagtccttcacttatactctcattcaatctttgagcctactttgcaggtgaggaaactgaggctgggtgaatcttcacatccgtaccatgagttaggtttcaccacatctccgttttacagatcaagaagctgaggctcagaaaagtcaagtgacttcctsagcagggaggagatagggctagaattcacatgtgcccgagttgatggtttcctgttatccccataaccctcccacagagagagggtggtgaaggcattcaagacctaagggcaaaagatgagtccctgagtcgtaatctaacatcatggaaagcccacccattcctgttaataaaggacccgcccgctgccccacacagcatccttccttcagtgccccagggagtgtgatgatcatgactacagtggacccaccgagagtgactgggacccaggctattaaaacatacccctgagcagc

SEQ ID NO: 53305 - DNA, 601 bp, Human
ggaggcggaggttgcagtgagccaagatcatgccattgtactccagcctgggtgacagagcaagacttcatctcaaaaaaaaagtgccaggctgggtgcggtggctcacgcctataatcccaacactttgggaggctgaggtaggaggatctcttaaggccaggagttcgaggccagcctgggcaacacaggagaccccatctctacaaaaaacagaaaaattagctggatgtggtggcgtgtacctggagtcacagctacttggaaggctgaggtgggaggatcgcctgagcccaggagrtcaaggctgcagcaagctacgatcatgccactgtactccagcctgagagacaaagtgagatcctgtctcttaaaaaaaaaaaaaaaaagacatgccagtccttcacttatactctcattcaatctttgagcctactttgcaggtgaggaaactgaggctgggtgaatcttcacatccgtaccatgagttaggtttcaccacatctccgttttacagatcaagaagctgaggctcagaaaagtcaagtgacttcctgagcagggaggagatagggctagaattcacatgtgcccgagttga

SEQ ID NO: 53306 - DNA, 601 bp, Human
ggcaagtcactaacttccctgtacctcagtttcttcatctgtagcatggaaataactagaacacttacctaatacaccacaaatatctttaaatacagtgacatgtgttaagtgcttagcacaacaccttgtacacatggagtctcaacaggtgacagtcagtgttatcaagatgtgccaggctgcagcctggctaacatgatgaaaccccatctctactaaaaatgcaaaaagtagccgggcatggtggtgcgcacctgtagtggggaggcgggggctgaggcacaagaatcacgtgaayccgggaggcggaggttgcagtgagccaagatcatgccattgtactccagcctgggtgacagagcaagacttcatctcaaaaaaaaagtgccaggctgggtgcggtggctcacgcctataatcccaacactttgggaggctgaggtaggaggatctcttaaggccaggagttcgaggccagcctgggcaacacaggagaccccatctctacaaaaaacagaaaaattagctggatgtggtggcgtgtacctggagtcacagctacttggaaggctgaggtgggaggatcgcctgagcccag

SEQ ID NO: 53307 - DNA, 601 bp, Human
atcaataagtcctctccaagaaaccaaagccatgaagaaaatgatggtttagctcagctgcgagctgagtgtgcctgaaacctagccagggacgggcagacgtggggcagaggtccacctccacgctggaccagggcctggccacgcctttccttctgtctgatgctcccacatccatctcctgcctcctggcgcgcagtgactcaagttctcactctcccctaggagtcccacttcccatgtggctttcttgctggcgtagggttaaatgcctattcatgaggacacaaagatgagcaaygctactggaatccttttcacagacacaccgagaatttaggtcatcatctacgtatcttttctaatttgggacatgttacccaggatgtagaatcctgggacacgtctacctgtgaaccaaccacagcttcccatctcctgtgcacacagagaggccggggagcagaaatagacatgttacccaccgcctgattaatgcatgcaggacacttttcgttctgtgtaattaacagctctaaaaccggcagatgactcaatttaacacagtctcgcttaaaacccaagaaggcacacggcaatt

SEQ ID NO: 53308 - DNA, 601 bp, Human
ggaattccatctctcctggagatggatgtgcagggaatgattctattggagccaggtgggcgggaattcaacaccactgaacccgcaacaactatccctcccacactccatgacccagtgatgcaaaggataaaatcccacaaggggaaggacagaaagaaaagagctggttggaattacatatcctctggggaatcaatcaataagtcctctccaagaaaccaaagccatgaagaaaatgatggtttagctcagctgcgagctgagtgtgcctgaaacctagccagggacgggcagacgtggggcagaggtccacctccacgctggaccagggcctggccacgcctttccttctgtctgatgctcccacatccatctcctgcctcctggcgcgcagtgactcaagttctcactctcccctaggagtcccacttcccatgtggctttcttgctggcgtagggttaaatgcctattcatgaggacacaaagatgagcaatgctactggaatccttttcacagacacaccgagaatttaggtcatcatctacgtatcttttctaatttgggacatgttacccaggatgtagaatcctgggaca

SEQ ID NO: 53309 - DNA, 601 bp, Human
ggcaaagatgtacttgtgcaaccttatttttttccttaaacattcacaagtcacagcactgcctctgagcattaaaccctgaattaagatatcaattaactgagatctaaacactccactgattaaaatagtagtgagacaaggatgaaggatttccaaaatcagcctctaagcatcaaagtggcaccgtgttgaacaaaactcatttaaagggccaggaattccatctctcctggagatggatgtgcagggaatgattctattggagccaggtgggcgggaattcaacaccactgaaccygcaacaactatccctcccacactccatgacccagtgatgcaaaggataaaatcccacaaggggaaggacagaaagaaaagagctggttggaattacatatcctctggggaatcaatcaataagtcctctccaagaaaccaaagccatgaagaaaatgatggtttagctcagctgcgagctgagtgtgcctgaaacctagccagggacgggcagacgtggggcagaggtccacctccacgctggaccagggcctggccacgcctttccttctgtctgatgctcccacatccatctcctgcc

SEQ ID NO: 53310 - DNA, 601 bp, Human
ccatctccaccactcaccccatgtgctctcccagcctcctccctcctctgcctggaacttgttcctgcccacctctagcacccacccgaaacacacttttctaggggtcggagacgacccccttctaccctcccaccctgggctaaatcccttctctgtgttccctgggtagtctagacgaatcctcagaaacctctaacacttagaattcttttaatttaagtctcttctgaaaggccatatatagtcctggaagacagggtcctagcaccggcacagacacacagtaactatgtgtcawcaaagctacctgtccttccaccgaagccagacaacagctcatttccaacaaggagagctgatggcctcatttcaaagagaaaaggaggcctctccacccaaccttccccaccccatggcagcatgggatgttgccaaaccgggcacagcaggggcaaagcctcctcaggctccagcagcccaaaatccctctgccactgcctcgtcccagtcccacaggtaggaagagcagcccagggtggaccacaggagcccacactcccaggctctccactctgcctcccactgcagctggggcatc

SEQ ID NO: 53311 - DNA, 601 bp, Human
aacctctagtagagcacaactcacgtaggtgcaggccatctccaccactcaccccatgtgctctcccagcctcctccctcctctgcctggaacttgttcctgcccacctctagcacccacccgaaacacacttttctaggggtcggagacgacccccttctaccctcccaccctgggctaaatcccttctctgtgttccctgggtagtctagacgaatcctcagaaacctctaacacttagaattcttttaatttaagtctcttctgaaaggccatatatagtcctggaagacagggtccyagcaccggcacagacacacagtaactatgtgtcatcaaagctacctgtccttccaccgaagccagacaacagctcatttccaacaaggagagctgatggcctcatttcaaagagaaaaggaggcctctccacccaaccttccccaccccatggcagcatgggatgttgccaaaccgggcacagcaggggcaaagcctcctcaggctccagcagcccaaaatccctctgccactgcctcgtcccagtcccacaggtaggaagagcagcccagggtggaccacaggagcccacactcccagg

SEQ ID NO: 53312 - DNA, 601 bp, Human
ccgctgcttcccacatccaattcacggccaagggctgccactccccctccacgacctccctcaggcccccccatttctctctatccagccccagcctctctggcctggacaagccctccagcctctaggcctccagcccacctgccctgatagcagctggggatctttaggaaatgcaaaccttatcaggcttcccctcgtttccagtggcctttaggtttccagtggcctcaggatgaaggtaaacctctagtagagcacaactcacgtaggtgcaggccatctccaccactcaccccaygtgctctcccagcctcctccctcctctgcctggaacttgttcctgcccacctctagcacccacccgaaacacacttttctaggggtcggagacgacccccttctaccctcccaccctgggctaaatcccttctctgtgttccctgggtagtctagacgaatcctcagaaacctctaacacttagaattcttttaatttaagtctcttctgaaaggccatatatagtcctggaagacagggtcctagcaccggcacagacacacagtaactatgtgtcatcaaagctacctgtccttccac

SEQ ID NO: 53313 - DNA, 601 bp, Human
gcccttctctatggccactactgttgccagtgctgtagactcctcagccctgtgcccacccatccccacaggctcggcctgtgcctgctccaggagcactgagcactgccaggggaagtcatgcactggcaatggccaagcaagccccagtcacctcagcgaggccccagctctgccgtgagctgcaggggaacccgcaggagggctattctcaacttcccgcaccttccgaagatatctacccccaacttctgccccccacgggagccgccacagatgaatgaattccactcctacttcytggagcgcgcagcagccagcagatgggtccactctcacctctcctcctccaaactcccaggactccccatctgtcctctcctccctcccttttaagggaaggtgcatcctcttcccaagctcacacgcccacctggggatcccagctccaacctccaccagctcctgctagaagctccatggccaccgaaacagcttcctctacaagtgaagaatcctcccctcacttgcctccttctcctcttccagtcaagcctcccctacgctgcctgccaggccctaaccgtccttgccttggggg

SEQ ID NO: 53314 - DNA, 601 bp, Human
gccctaaagcctgacagcatgctgttaatcatcatgaaggtgtctctgatgccgccgtatggcgggtgcagtcccattatctgggaccaggcacttgctcctgtccccagagggtgacagttcagagccatgggcaggacaggggccagcagctcaggctcccgaggtccgaacccacttgtggtccctcaggtgtcattcccactgccaccctctatgacgccagcccggggaacccgctgtcagggagcaggtctctcttctctcaaatgcagtgatgatcactgggtgacagcatgggtgagggccaggatctcccgccctccaaccccttactttctcctggagccgccctctgccttcattcggcttagatccctggcccttctctatggccactactgttgccagtgctgtagactcctcagccctgtgcccacccatccccacaggctcggcctgtgcctgctccaggagcactgagcactgccaggggaagtcatgcactggcaatggccaagcaagccccagtcacctcagcgaggccccagctctgccgtgagctgcaggggaacccgcaggagggctattctcaacttcc

SEQ ID NO: 53315 - DNA, 601 bp, Human
ctgggaaacgaggcgggcaccctgcagcgcagcgacaccttcccgagaccacagaaccttctggggaatgtggaaaaaacaaacccacaagcccagggagactttctcgaatgaacgccctttctctcggcggaggcagccctaaagcctgacagcatgctgttaatcatcatgaaggtgtctctgatgccgccgtatggcgggtgcagtcccattatctgggaccaggcacttgctcctgtccccagagggtgacagttcagagccatgggcaggacaggggccagcagctcaggctccygaggtccgaacccacttgtggtccctcaggtgtcattcccactgccaccctctatgacgccagcccggggaacccgctgtcagggagcaggtctctcttctctcaaatgcagtgatgatcactgggtgacagcatgggtgagggccaggatctcccgccctccaaccccttactttctcctggagccgccctctgccttcattcggcttagatccctggcccttctctatggccactactgttgccagtgctgtagactcctcagccctgtgcccacccatccccacaggctcggcctgt

SEQ ID NO: 53316 - DNA, 601 bp, Human
gagatcaagactatcctggctaacacggtgaaaccccatctctactaaaaatacaaaaaattagctgggcatggtggcgggcgcctgtagtcccagctactcgggaggctgaggcaggagaatggtgtgaacccaggaggcggagcttgcagtgagccgagatcacgccactgcactccagcctgggtgacagagcaagactccgtctcaaaaaaaaaaaaagaaagaaagaaagaaaaagaaaaacagtttatgtgctcttgatgctaggagcctcctcttgagggaggccctgggcttgtgacatccgacccaaagagaaggcactcccgccctgatacattccttagttctgcatagaccacggtcacagtcatcatagaaacacagttttatggcttttttttttaaccttttagagttaatgtctcccccaaacaggtaagatttactgctcacataaatgcaatggaaatattacaaaccctaacaaggaaacagcaacagaagtcgggaggtaaagacgggttggagaaaagatgtgtagagagagcagggccccatctgtgcagcctcagctcacccagggcaaaggcaagat

SEQ ID NO: 53317 - DNA, 601 bp, Human
cagtctaggccgggcgcggtggctcaagcctgtaatcccagcactttgggaggccgaggcgggcagatcacgaggtcaggagatcaagactatcctggctaacacggtgaaaccccatctctactaaaaatacaaaaaattagctgggcatggtggcgggcgcctgtagtcccagctactcgggaggctgaggcaggagaatggtgtgaacccaggaggcggagcttgcagtgagccgagatcacgccactgcactccagcctgggtgacagagcaagactccgtctcaaaaaaaaaaaaagaaagaaagaaagaaaaagaaaaacagtttatgtgctcttgatgctaggagcctcctcttgagggaggccctgggcttgtgacatccgacccaaagagaaggcactcccgccctgatacattccttagttctgcatagaccacggtcacagtcatcatagaaacacagttttatggcttttttttttaaccttttagagttaatgtctcccccaaacaggtaagatttactgctcacataaatgcaatggaaatattacaaaccctaacaaggaaacagcaacagaagtcgggaggtaaa

SEQ ID NO: 53318 - DNA, 601 bp, Human
ataaaaatttttttctaataaaaaaaccattctttaaacagagaataaactaaaatatggagtgattttgtatagctggtggttatataagaaaaacagtctaggccgggcgcggtggctcaagcctgtaatcccagcactttgggaggccgaggcgggcagatcacgaggtcaggagatcaagactatcctggctaacacggtgaaaccccatctctactaaaaatacaaaaaattagctgggcatggtggcgggcgcctgtagtcccagctactcgggaggctgaggcaggagaatggygtgaacccaggaggcggagcttgcagtgagccgagatcacgccactgcactccagcctgggtgacagagcaagactccgtctcaaaaaaaaaaaaagaaagaaagaaagaaaaagaaaaacagtttatgtgctcttgatgctaggagcctcctcttgagggaggccctgggcttgtgacatccgacccaaagagaaggcactcccgccctgatacattccttagttctgcatagaccacggtcacagtcatcatagaaacacagttttatggcttttttttttaaccttttagagttaat

SEQ ID NO: 53319 - DNA, 601 bp, Human
cagccctaataggagcagaaggccaatggagctctccagagctctttatgggccatttaaccatccctcaacccagtcgcccgagcacagcagacataatggcagtgtttacacataaaaacggcaagctgttttactggcggctttcagagtcataagagcagcaatttggtaaagtttcctgcaaatggcagaaacaaagtccgagagtagaatggtggggcactaaaccaccctgaaaagtcatcgaaaaccattacatcaaacactctgccaagagccagggaggcgggcgcagtcrgaagaaaaataatctttgcttgtgatcctgaagccctgttcataatctccgctcacggtgtgtgtgccactgcggcgtctcatctgttactcactcagggaacataaattactgttttttaccttttaattttacccggagaaacatggtggcttacctttccaactcatattctttcattcccacttttacagccttcattacctggaggacggatattaagcaaagacatttgtattaagcagatcagtaacacagcgtgataaataacatacagcacttcttcaaaagcacctcttc

SEQ ID NO: 53320 - DNA, 601 bp, Human
ctgaacagagcaggccctgaggacatctggggtggacttgggccctgcaaggggggtaagggataccagaaaccaagctctcacaaggacaggcaggaaaggaaagcccagagtgaggacatggggatggcagcctcttcagtgtcacctccccagagcttccaggtggtaccaacactggtgggaggtctcggaatgggggcctcctgccccaggacacgggtgggaagggagccactgaggcagtttgggtctgacccaaaggtttccttgtaccatgggtggcagcacactgacttckgggtcctggagcggggctgagctggccaggccacacccgccacggctgggcagccgccggaagctccccgggtgccactggctcgctgcagccctaataggagcagaaggccaatggagctctccagagctctttatgggccatttaaccatccctcaacccagtcgcccgagcacagcagacataatggcagtgtttacacataaaaacggcaagctgttttactggcggctttcagagtcataagagcagcaatttggtaaagtttcctgcaaatggcagaaacaaagtccgagagta

SEQ ID NO: 53321 - DNA, 601 bp, Human
gccagcatgcagaggacggcagggttccacactgggctcagctattcctgccccaatttctcagttatttttatttgaagcatcagctatgggtcactgtgattcaactcaagctgggacaggtttccggggcagtgccaatctgagggacccactgtccagcccacctcgctggaggagccccacaacacacttcccatcccagatcctcggagcgggcagggggtcctgggaatgctgggccacagacaccgcactgcagaaggagaccacgcagacgcaagtgctgggatagctctgygagcccttctcagcctccccggctgacggagctgggcttctgattaacgtgtgttacacggcccctcccaggatgccaagcacctgggtcaggccattttaacctcctcctgggcggggtaaggagagaagcacaggcactgactgctcagaactccttccagggcaagaccttaaaaagacactcgtcccctaagcacagccacagcgaactgaagcatccaagcagcccactacgggccccatccgacctcggccctgcaccccactgatggcaggcaggccagcctgggagggtgat

SEQ ID NO: 53322 - DNA, 601 bp, Human
ctcaccaactggaatacctactgaggtatttacaggtgctatgacacgatgtctaggatttggctttaaaatgctctagcaaacaaaactaaacacaaaaacctggtggggactttggggttcattatacttttctattattttggatattgaaatttcctgtttaaaaaaaaaaaaagacctccattacctggaaggcatgagggctaaggaacggcgggtattccaggtcccctggcccctgacccatagcccatgcagccctgtccccaggttgggcagggtcgggctctgggacgcygtggggagggaggctcagggcccctcccagtagccaccttgggagcaggactgcctgcagcacggggctcaagcagccagcatgcagaggacggcagggttccacactgggctcagctattcctgccccaatttctcagttatttttatttgaagcatcagctatgggtcactgtgattcaactcaagctgggacaggtttccggggcagtgccaatctgagggacccactgtccagcccacctcgctggaggagccccacaacacacttcccatcccagatcctcggagcgggcagggg

SEQ ID NO: 53323 - DNA, 601 bp, Human
actctgtgtggatcctgacttgaacaaaccaatgctaaaaagagtttaggatcaatatggactagatattcatgacatgaaggagttacggttcgtttgtgataatgaatgtgatattggcatggtggttatgtaaaagtagaaaaaagttctcaccaactggaatacctactgaggtatttacaggtgctatgacacgatgtctaggatttggctttaaaatgctctagcaaacaaaactaaacacaaaaacctggtggggactttggggttcattatacttttctattattttggataytgaaatttcctgtttaaaaaaaaaaaaagacctccattacctggaaggcatgagggctaaggaacggcgggtattccaggtcccctggcccctgacccatagcccatgcagccctgtccccaggttgggcagggtcgggctctgggacgctgtggggagggaggctcagggcccctcccagtagccaccttgggagcaggactgcctgcagcacggggctcaagcagccagcatgcagaggacggcagggttccacactgggctcagctattcctgccccaatttctcagttatttttat

SEQ ID NO: 53324 - DNA, 601 bp, Human
agcaccctgtgggaggctgctcctggctgagagcttcccggtgcactcggctgtggcctctggcttcgagctcatctctccaagagccactctggtccacgcaggaggcggcagcaaggccaacccagggtcttgggatgggggtggagggaaggtggagcagtttgtagacaggggtgacatctccccagagctcaggttcacgacaccctgcttccaacagcagccaagtacaacatgtggactctgtgtggatcctgacttgaacaaaccaatgctaaaaagagtttaggatcaatayggactagatattcatgacatgaaggagttacggttcgtttgtgataatgaatgtgatattggcatggtggttatgtaaaagtagaaaaaagttctcaccaactggaatacctactgaggtatttacaggtgctatgacacgatgtctaggatttggctttaaaatgctctagcaaacaaaactaaacacaaaaacctggtggggactttggggttcattatacttttctattattttggatattgaaatttcctgtttaaaaaaaaaaaaagacctccattacctggaaggcatgagggc

SEQ ID NO: 53325 - DNA, 601 bp, Human
tctaagctctcaggggcccacagatcagatagcttccctggtgggcacggtttcccctccctatgtcctgtggcctgcagcaggtgggtgcacatggcaggtgcacagcatgggcagcaggtacacacgctgacccgatgccactcagcaccctgtgggaggctgctcctggctgagagcttcccggtgcactcggctgtggcctctggcttcgagctcatctctccaagagccactctggtccacgcaggaggcggcagcaaggccaacccagggtcttgggatgggggtggagggaagrtggagcagtttgtagacaggggtgacatctccccagagctcaggttcacgacaccctgcttccaacagcagccaagtacaacatgtggactctgtgtggatcctgacttgaacaaaccaatgctaaaaagagtttaggatcaatatggactagatattcatgacatgaaggagttacggttcgtttgtgataatgaatgtgatattggcatggtggttatgtaaaagtagaaaaaagttctcaccaactggaatacctactgaggtatttacaggtgctatgacacgatgtctaggattt

SEQ ID NO: 53326 - DNA, 601 bp, Human
cacccatcttcccaccatcttcagagggggtgacccctctctcccaactcggtcccctcaggaacagcctccatctcttgttcttcctgtctcagtccccgtacccacccccctgctctaagctctcaggggcccacagatcagatagcttccctggtgggcacggtttcccctccctatgtcctgtggcctgcagcaggtgggtgcacatggcaggtgcacagcatgggcagcaggtacacacgctgacccgatgccactcagcaccctgtgggaggctgctcctggctgagagcttccyggtgcactcggctgtggcctctggcttcgagctcatctctccaagagccactctggtccacgcaggaggcggcagcaaggccaacccagggtcttgggatgggggtggagggaaggtggagcagtttgtagacaggggtgacatctccccagagctcaggttcacgacaccctgcttccaacagcagccaagtacaacatgtggactctgtgtggatcctgacttgaacaaaccaatgctaaaaagagtttaggatcaatatggactagatattcatgacatgaaggagttacggttcgt

SEQ ID NO: 53327 - DNA, 601 bp, Human
agatgtcccaggggcttcaacctggacactggcaatcggggcgcctcctcaaatctggccagggatactccatgatgtgacactttccccagacacccatcttcccaccatcttcagagggggtgacccctctctcccaactcggtcccctcaggaacagcctccatctcttgttcttcctgtctcagtccccgtacccacccccctgctctaagctctcaggggcccacagatcagatagcttccctggtgggcacggtttcccctccctatgtcctgtggcctgcagcaggtgggtgcrcatggcaggtgcacagcatgggcagcaggtacacacgctgacccgatgccactcagcaccctgtgggaggctgctcctggctgagagcttcccggtgcactcggctgtggcctctggcttcgagctcatctctccaagagccactctggtccacgcaggaggcggcagcaaggccaacccagggtcttgggatgggggtggagggaaggtggagcagtttgtagacaggggtgacatctccccagagctcaggttcacgacaccctgcttccaacagcagccaagtacaacatgtggact

SEQ ID NO: 53328 - DNA, 601 bp, Human
caagttggttttctccacatgcccattcctcagttactcctagaggcaaaatgagccatccctgctttaagccacagggtcccacagcctgaccccgctgagagccccagtttcattctcggatccctggctctgtcgaatctctggtggagagactctccacactcgcctgtccccaactccctccctcatgccaagtggtgtagacacagcaggatggacgggcacacaggacctgccctgccagcacagggtaggctctggactaaggaattctccacccaagacagccctggctctygggaagggctcagcttaaatccccctaggcatggccagccagggtgcaggactcaaggactgccctcctagggcttggacacgcagatggtgtttcctgactgctctcatgataggctggggcccgtctccaacagccaagcaagtgctagcagcaaacctactccaagccacctgaggcaaagagggtgtttctccagcccagacctgtgtctgaaggggccctcttctctgaatgggctgtgccagtgccctcacccatcaacacagccttcagagaaaggatgtgtctgctcagcgg

SEQ ID NO: 53329 - DNA, 601 bp, Human
ttttttttgtagaggcagaggtctcctatgttgcccaggctggtcttgaactcctggcctcaagcaatcctcctgccttggactcccaaagtgctgggactacaggcatgagtgtgtaattaccatgcctggcaatatcaggtttaatggtgaaacactagaggaaaatccataaagatgtccacagggagcacagttccttatgatttctaatatgattctccaggagcaatgcgcccagcatttgaaaagacaatgcctatttatgttagttttgccccaaaatctctagtccttcatygaccaggttacacatttgcagaaagctcttctctctggttctctgtccagctttctggctggacaccaagttggttttctccacatgcccattcctcagttactcctagaggcaaaatgagccatccctgctttaagccacagggtcccacagcctgaccccgctgagagccccagtttcattctcggatccctggctctgtcgaatctctggtggagagactctccacactcgcctgtccccaactccctccctcatgccaagtggtgtagacacagcaggatggacgggcacacagga

SEQ ID NO: 53330 - DNA, 601 bp, Human
cactaccttagccaggtgatcaaggtcaacatcatcagtgataagtcatgctgatgtgatgtgatgacaatggcacttctgtgctctccttcccagtaactcataactcctgtctcgctgaaagaaaaactaaaattgaaaggcattcttcaaagtacctagccatactcctcgaaagtgtcaaggtcatcaaaaccaaggcaattctaagaaactgtcacagcccagaggaggctaaggagatgtgacaatggaacgtgatatggtctcccagatgggatcctggaacaggaggagggcrttaggtaaaagctaaggccgctggaataaagcatggacttaagataataattaagtatcaataacgtgcatccatggtaacaaatgttctaaagtaatgttaataactttactaatacataatagggaaaatgggtgccaggtacatggaactctctaatgttcctgtgacttttccgtaatccaaaactatcctaaaataaaaagtttactgattaaacacacacgtggaaaaggccaagggagatgctgaaaaggcagctgataaaattcgacatcctttcctgataaaatctagtaa

SEQ ID NO: 53331 - DNA, 601 bp, Human
gcatggtggcacgtgcttctagtcccagctactccagaggctgaggggggaaggtcacttaagactgggaggttgaggttgcagtgaactgtgattgcaccactgccttccagcctgggcagtagagcaaaacactgtcataaaaaaataaataaataaataaataaataaaaaagcaacaacaagcaccataaggatgcttagtggatgtccatctgctccatgtgttatgcatacaggcatgcctcatcttaccgtgccttgctttctttttttagaaattgaaggtttgtggcaaccytgcgtttagcaagcctactggtgccatttttccaacagcatgtgttcactttgtgtgtgtcagcattttttagcaataaagtctttttaaattatggcatgtacattgattttttgagacataatgttattgcactcttaagagactacagtatactgcaaacataacttttatatgcactaggaaacacgaaaatttccaatatttgctttattgcagtagtctggagctgaagccgcaatatctctgaggtatacctgtatatcaattcattggatcctcctaatcctcctatgaagt

SEQ ID NO: 53332 - DNA, 601 bp, Human
tgaaaagttaccaaagaaatcttccccagagaaacaacagggtctgagagattcaaaggacttcatgccttcaagaaacagccaagccctatgctttccaagttgtttcagaaaacagaaaaacatgggggtgcttcccaaaacatgatctcaaaaaccttggtctcaaaatatggctaagagagttaaaggaaaaaaatatatagctcaatttcctattttgagcctgtataaaatgctagtgaaaaaataacaacaatggccaggcatggtggctcacgcctataatcccggcacttcrggaggccgtggcaggaggatcgcttgagtccaggagttggagaggcaatataatgagatcccaagtccacagaaaaataaaaaattagccaggcatggtggcacgtgcttctagtcccagctactccagaggctgaggggggaaggtcacttaagactgggaggttgaggttgcagtgaactgtgattgcaccactgccttccagcctgggcagtagagcaaaacactgtcataaaaaaataaataaataaataaataaataaaaaagcaacaacaagcaccataaggatgcttagtgga

SEQ ID NO: 53333 - DNA, 601 bp, Human
aaacaatcccataggaaaatctgaaaagttaccaaagaaatcttccccagagaaacaacagggtctgagagattcaaaggacttcatgccttcaagaaacagccaagccctatgctttccaagttgtttcagaaaacagaaaaacatgggggtgcttcccaaaacatgatctcaaaaaccttggtctcaaaatatggctaagagagttaaaggaaaaaaatatatagctcaatttcctattttgagcctgtataaaatgctagtgaaaaaataacaacaatggccaggcatggtggctcaygcctataatcccggcacttcgggaggccgtggcaggaggatcgcttgagtccaggagttggagaggcaatataatgagatcccaagtccacagaaaaataaaaaattagccaggcatggtggcacgtgcttctagtcccagctactccagaggctgaggggggaaggtcacttaagactgggaggttgaggttgcagtgaactgtgattgcaccactgccttccagcctgggcagtagagcaaaacactgtcataaaaaaataaataaataaataaataaataaaaaagcaacaacaagc

SEQ ID NO: 53334 - DNA, 601 bp, Human
atttatcatggaaatgagtaagacaaaatctatcatgaatcacaaagaattataaaaccatctctctaaatcttagagcaaatatacaaaaataggggagggggcagaggactggaattagataataaacctgattcatgtacaccaaagtatatattctaaagataaaaactaaacactttccagtattccataaaatactgaccaaaatatttttaaataagccacgaagaaaaacttcaaaattaaaaaccaaaaagattcacaccagctgcattctctagctccaatggtgacagamctagcagctaaaaaccaaaaggtcaccaagaaaaattcaaccacatctactgggaaatgaaaagaaatacactaggttagttcttaggttcaaaaacaaatcactctagacataccaggatatagctaaggcagtattcaaaaataaactagccaaaatctatttattactaaagaggaaaaaataaaaaataaactaagattcaactaaacaagttaaaagacagatgcgtcaaaacaaggttcaggaagagaggagaaaggaattaataataaaactggaaatcaatgagtttgacca

SEQ ID NO: 53335 - DNA, 601 bp, Human
ttagaaaattaaaattgtttaacttttgaacataagtagaaaacagaaatacaggtctttttttcttgatttaaaggtgattctacatttaacatggcatacatataaaagtgagcaaaggaaatttcaccaaccttccaaagatagaaaaacttttttaaagccacaaaggaaaaaacagaaaccagaaaacacaaaataaggctgtagaaaagagaacagatgctgattatcactgtgaattcaaacagctctcctaacacggggaggctctccatttgaacaatgagtatgctgcacyttataaacaacctattttaaaaagttaaaaatacagggataagcaaagatatgccaggaaaatgtaacaacaacaacaaacatagcaacaccagtgtcaggcaaagtcagattcaagacatagattaaataggttaaaaggggtttcttgaaagctataaaaagcaaaatatataataaagacataacaatcatcaacttttatgcctcaaacaatttatcatggaaatgagtaagacaaaatctatcatgaatcacaaagaattataaaaccatctctctaaatcttagagcaaatata

SEQ ID NO: 53336 - DNA, 601 bp, Human
ctctgcatgtaattaaaagtgggtataaatatgactgcaaaaccgccctgagctgcggctctcagcacactgcctgtaggtagccctgctctgcaggggtagtcacggagctgtcacaatgcctgaactgtaacaccgctgctttaataaagctgtttcttcctaccctactactggctcacccttgaattctttcctgggtgaagccaagaaccctcgtgggataagccccactttagggcttgcctgccttgcatcaaaactatgctaagtttctaattttttaaggaaaattttctarttttttaaggaaaattagaaacttaaaattgttaaattgttaaaattagaaaattaaaattgtttaacttttgaacataagtagaaaacagaaatacaggtctttttttcttgatttaaaggtgattctacatttaacatggcatacatataaaagtgagcaaaggaaatttcaccaaccttccaaagatagaaaaacttttttaaagccacaaaggaaaaaacagaaaccagaaaacacaaaataaggctgtagaaaagagaacagatgctgattatcactgtgaattcaaacagctct

SEQ ID NO: 53337 - DNA, 601 bp, Human
acaaagagtcaatacccactgaagccaccattcacgcaggagacaacaaaagaaccctccaacaagcaaggcactgaaagtactgaatcaaaacttaaagcactcacacgagcaaagggaaaacatggtacaaaattgaggtccacattggattgagtgagacagtgctcactaaataaccgttggtaaaatgatggtaagacaatgcaaatgttgaaaataaaggaaaaagaagttatataataaaaaactagaaggtaggggaaagggagattataaagtaaaactgaggcaggaggcrggacttgactctggaggcggggctcggacaccagaccaaatggagaactagccaaaacaggtcccaggtaaaagcagctttccatcagacacgcccaccagtgcgccatgtcagtttaccattgtcatggcaacaccagggagttaccacccctttccatagcaatgacttgatgaaccaaaagttactaacccctccctaaaaatgtctgcataaactgccccttactctgcatgtaattaaaagtgggtataaatatgactgcaaaaccgccctgagctgcggctctcagcacactgc

SEQ ID NO: 53338 - DNA, 601 bp, Human
ttctaagccctgaagtgcagcccctgcccagaaaggcagtgagacagatcctcaggaaatactgttacttccaagaatcaatagtcctataagcatccagggcaagaaaatgaaaagttccctggaaagaaggaggaatatgatttgctaaagatctctggcaacaaaggagggaatggttttatggaacaaagagtcaatacccactgaagccaccattcacgcaggagacaacaaaagaaccctccaacaagcaaggcactgaaagtactgaatcaaaacttaaagcactcacacgagsaaagggaaaacatggtacaaaattgaggtccacattggattgagtgagacagtgctcactaaataaccgttggtaaaatgatggtaagacaatgcaaatgttgaaaataaaggaaaaagaagttatataataaaaaactagaaggtaggggaaagggagattataaagtaaaactgaggcaggaggcgggacttgactctggaggcggggctcggacaccagaccaaatggagaactagccaaaacaggtcccaggtaaaagcagctttccatcagacacgcccaccagtgcgccatgtc

SEQ ID NO: 53339 - DNA, 601 bp, Human
tttttctcttttgatagagatgctggtatgagaaggctttctcatttatgaaagaaccaacagcatgaaagccatgaaaagagtcggcttcagtgctcggggaggtgacggggagcggtggggcctgtggcgtgcaccctgaacgaaagctatgtagcaagcaccacgctgctgctctgtggaaattccagcccacggttaccagctactctgattttcaggaaaagccaaaaaaatctgatttttcaaatttggttgacttcaatgaaccaaaataaagtgttaaaatacctattgcctsggccaaacggaaactgcgtgtgtactggatgtggcccagaggccaccagtatataaactctggcctttctcttgctagaaaattcttcctggagaatgagaggtggggacccagggtttccccacactccccaaccaagaccctgacgggacagaggcccccagaggctgcagtccactctcacaggggcctcgggggaaggcaggcagcaaatgggggtgtggccaaagccaactccaggtagctggcccactgtagagaagacatcttccatgtccaccgaggtgactcggtactgtc

SEQ ID NO: 53340 - DNA, 601 bp, Human
atctaggcctgttcaaaacctgtaacacggaagccaacagaaatccacagccagagggagctgcgagaggacggtggctgagtgggtggggccaggccagtttccctcctgctcagccacccccaagatgcttcctcaccctactctggggcagctgaagaaggcagctgtggccaggcccatggctccctcctggacagctgccagaggaagcacgaagacccacactgcccatcctccatgccacagacagagtccaaaccctcagcctgaaccacaaaggcagaggatggccttgtgygggaggttcctgaggacgcaaactcagcttcacagccccggaacacagagcctgctgtcggagtatctaacagggatggggaggagcctcaactttggttttatcataaattacctccaggcttcaagagcagacatgcctgccggcaggtatggagacagcccttcctggatgaaaccattcatgtcatccacagaactcagagctaggaggagaaaaactcacggcccggaataattactcccgcagggagcgtctttcgcaccagcaggtgataggtctggatgaggattttctaaa

SEQ ID NO: 53341 - DNA, 601 bp, Human
cttcaaccagcaccaggtgcccatgccatccccaagcctctgcgacctctcagcacagggtggccgagagccccacagtcacatgctggcctagcagaagtgaggggtcccctgtttgcacagtgcatccaggaggaacttcggtccccagccttgaagctgggaccccttttgcaaaagcagcatgctctcagccacggctgctcaccacccagaggggagggcccagcgggcatcaggaccccgcaccgagggtggtgaggcctttctgccacctctgctgatagggtcccaggaccayggctttccgatgtgcctcccactgtccagtctatgcgccagtctccacagccatcagcaggccccacgaagggcatctagcccctcttatcttgctgggatggacagtaagaaagtaaaacagcaccagcaaagcccagccaggctccgactcaaccagccacccagacattggctgtgtgggggactagaccgccagggccctccagcaatgaactgcggtcaccttgggctggagaagtagctatggtgcacttcgccctagctgggatgcccaggagggccacctgtgccaccgtgc

SEQ ID NO: 53342 - DNA, 601 bp, Human
ttacctacttagaattccccgagttcttcctgggaagccatttctcatctgtttgatctcggagccaccagcactatctccaggcacgccacccatcacggcagccgccagacacttttttcttctgggctcctttctcagcacctagatgaatttctacctttctccagctttaagaagagctgccaagataaatgattcaaagactccagctcatgctgaaaatatatggactgcttaaagcctattatgaatcagccaacactggggagagacgcactggctgcatcctcaccggacrggtcatcctggctgctaagacctagacccacccgggcacgtggacactctctggagtcttttcacccgtgggatcatgacacttgcccagcttcaaccagcaccaggtgcccatgccatccccaagcctctgcgacctctcagcacagggtggccgagagccccacagtcacatgctggcctagcagaagtgaggggtcccctgtttgcacagtgcatccaggaggaacttcggtccccagccttgaagctgggaccccttttgcaaaagcagcatgctctcagccacggctgctcacca

SEQ ID NO: 53343 - DNA, 601 bp, Human
ttgattgccaagtcttgccgtaaatcaaaagacagtcactactcattacctacttagaattccccgagttcttcctgggaagccatttctcatctgtttgatctcggagccaccagcactatctccaggcacgccacccatcacggcagccgccagacacttttttcttctgggctcctttctcagcacctagatgaatttctacctttctccagctttaagaagagctgccaagataaatgattcaaagactccagctcatgctgaaaatatatggactgcttaaagcctattatgaatyagccaacactggggagagacgcactggctgcatcctcaccggacgggtcatcctggctgctaagacctagacccacccgggcacgtggacactctctggagtcttttcacccgtgggatcatgacacttgcccagcttcaaccagcaccaggtgcccatgccatccccaagcctctgcgacctctcagcacagggtggccgagagccccacagtcacatgctggcctagcagaagtgaggggtcccctgtttgcacagtgcatccaggaggaacttcggtccccagccttgaagctggga

SEQ ID NO: 53344 - DNA, 601 bp, Human
tgaattattccccgtggcagaagagagaaatccacgacctctagcctgcctgcccctgcccccaccaccaaggaagggccgcctgtccaaaccacctggaccccgcagcctgttcgggattcatttctttcctcttcaaagcattacagattgattgccaagtcttgccgtaaatcaaaagacagtcactactcattacctacttagaattccccgagttcttcctgggaagccatttctcatctgtttgatctcggagccaccagcactatctccaggcacgccacccatcacggcagcygccagacacttttttcttctgggctcctttctcagcacctagatgaatttctacctttctccagctttaagaagagctgccaagataaatgattcaaagactccagctcatgctgaaaatatatggactgcttaaagcctattatgaatcagccaacactggggagagacgcactggctgcatcctcaccggacgggtcatcctggctgctaagacctagacccacccgggcacgtggacactctctggagtcttttcacccgtgggatcatgacacttgcccagcttcaaccagcacca

SEQ ID NO: 53345 - DNA, 601 bp, Human
atcctcaggcagggtgagaagagtgtgtaatgggtgtacgtaccacatgcacttgcatgcatacaagtgcacgcgcgtgcgcgcgcacacacacacacagtgtgtcctcaggcagggagggtgagaagagtgtgtaatgggtgtatatatcacacgcacttacgttcgtacatgggtgcgcgcacacatacaaagtgtgtcctcaggcgggtagggcgagaagagtgtaatgcatgtacatatcacacgcacatgcacacacacacgctgtatgtcctctggcaggcagggagaggggtgygtgcaataagcgcatacaccacatacatgcatgcatgctctcaaggctgggacatggaacccagccaggctgggacagaaagcgcagcgccagcaccctggggatctctctccattcaaaatcatggacttcataaaagcataggctgtgggcagagcctcagaggtttaagcaggaaacagcgactgtgaggctgggatggaaaaggcagcgactgatacagccccggctgtgtcccagtaaggggccaggcagcggatgcatgccatgtggggcctgacttagtctagacactggctc

SEQ ID NO: 53346 - DNA, 601 bp, Human
gctgaacaaatgaatgggctgaaagaggagtgatctgacaggcaggtgcagggtgagggggtgcgcgtaatgggtgtaccatacgcacatgcgcatgcacacaagcacacagtgtgtcctcaggcagggagggtgagaagagtgtgtaatgggtgtacatatcacacacttgcgaacatgcgcgtgcacacacacacacagtatcctcaggcagggtgagaagagtgtgtaatgggtgtacgtaccacatgcacttgcatgcatacaagtgcacgcgcgtgcgcgcgcacacacacacaccgtgtgtcctcaggcagggagggtgagaagagtgtgtaatgggtgtatatatcacacgcacttacgttcgtacatgggtgcgcgcacacatacaaagtgtgtcctcaggcgggtagggcgagaagagtgtaatgcatgtacatatcacacgcacatgcacacacacacgctgtatgtcctctggcaggcagggagaggggtgcgtgcaataagcgcatacaccacatacatgcatgcatgctctcaaggctgggacatggaacccagccaggctgggacagaaagcgcagcgccagcaccc

SEQ ID NO: 53347 - DNA, 601 bp, Human
aggttgcagtgagctgagattgctccattgcacttcaggctgggtgacagagtgagactctgtctcaaaaaaaaaaaagcctgggcgcggtggctcacgcctataatctcagcactttgggaggctgaggcgggtagatcatgaggtcaggagatcaagaccatcctggctaacacagtgaaaacccatctctactaaaaataaaataaaaaaaaaaaattagccgggcgtggtggcacacacctgtagtcccagctactcgggaggctgaggcaggagaatagcttgaacctgggatgcrgaggttgcagtgagccgagattgtgccactgcactccagcctgggcaacagagcgagactccatctcaataaataaataaattaattaaataaataaaaatttaaaaataaataaataaaataatggtccccttactcagagggttgctctgagaattaaaccgatcttacctgtcacttaattatagacacgtgcagggcccacaccagaggctggtatgtggtcaggcctcggggaacgtccaccggggctgtccactggctctccccacagaactgtgctccacgggggctgggcct

SEQ ID NO: 53348 - DNA, 601 bp, Human
aaaattagccgggcatggtggagggtggggggcacctgtaatcccagctacttgggaggctgaggcagaagaattgcttgaacccgggaggcggaggttgcagtgagctgagattgctccattgcacttcaggctgggtgacagagtgagactctgtctcaaaaaaaaaaaagcctgggcgcggtggctcacgcctataatctcagcactttgggaggctgaggcgggtagatcatgaggtcaggagatcaagaccatcctggctaacacagtgaaaacccatctctactaaaaataaaawaaaaaaaaaaaattagccgggcgtggtggcacacacctgtagtcccagctactcgggaggctgaggcaggagaatagcttgaacctgggatgcagaggttgcagtgagccgagattgtgccactgcactccagcctgggcaacagagcgagactccatctcaataaataaataaattaattaaataaataaaaatttaaaaataaataaataaaataatggtccccttactcagagggttgctctgagaattaaaccgatcttacctgtcacttaattatagacacgtgcagggcccaca

SEQ ID NO: 53349 - DNA, 601 bp, Human
tatgaaaaattagccgggcatggtggagggtggggggcacctgtaatcccagctacttgggaggctgaggcagaagaattgcttgaacccgggaggcggaggttgcagtgagctgagattgctccattgcacttcaggctgggtgacagagtgagactctgtctcaaaaaaaaaaaagcctgggcgcggtggctcacgcctataatctcagcactttgggaggctgaggcgggtagatcatgaggtcaggagatcaagaccatcctggctaacacagtgaaaacccatctctactaaaaawaaaataaaaaaaaaaaattagccgggcgtggtggcacacacctgtagtcccagctactcgggaggctgaggcaggagaatagcttgaacctgggatgcagaggttgcagtgagccgagattgtgccactgcactccagcctgggcaacagagcgagactccatctcaataaataaataaattaattaaataaataaaaatttaaaaataaataaataaaataatggtccccttactcagagggttgctctgagaattaaaccgatcttacctgtcacttaattatagacacgtgcagggc

SEQ ID NO: 53350 - DNA, 601 bp, Human
ggctggcctttggccctgggaccacctgggaacggttgccacatgcacctcattacaacaccaacacgtgccccttatcagccagcccagtagtgcagacctgattcctcgataaccactgggctatcaggctcactggggttggtgaccacatccccaggaaatacggccgcctgcaagagtgcacagtcccggggaggccgccaccttgctcagacctgcacgtctttgcgcccagccaggctgaatccctggagggctgagtgaggagcccacccagtcctccttccccaccaccagsgtaggaggcagccctgttccttcccttcactcaggagcatttatgagcgcctgctgtatgcctgactctgccacagagaaaacagtgttggggctgcagcaatggcccctggcttcctggctgaggccgaccttgacccagaggtggctgggggatctgagccccttcccaggcagtctctttccacttcatcaggcagaaacttcttcctcactagagctggcctgactctggtaacatgtcatttgtcatcataattcataatgcaataggtatttgtcctttttatgggtattttaa

SEQ ID NO: 53351 - DNA, 601 bp, Human
cccacctatggcatctggaaacgatgtctgatcctgaagggatgatgagcctggttctactatctccaccaagcccagggagctcagccctggctctccaaggcctcctgagatggcaccttcagaaacacgccctggcatttaacatctttcgggtgaggctggcctttggccctgggaccacctgggaacggttgccacatgcacctcattacaacaccaacacgtgccccttatcagccagcccagtagtgcagacctgattcctcgataaccactgggctatcaggctcactggggytggtgaccacatccccaggaaatacggccgcctgcaagagtgcacagtcccggggaggccgccaccttgctcagacctgcacgtctttgcgcccagccaggctgaatccctggagggctgagtgaggagcccacccagtcctccttccccaccaccagggtaggaggcagccctgttccttcccttcactcaggagcatttatgagcgcctgctgtatgcctgactctgccacagagaaaacagtgttggggctgcagcaatggcccctggcttcctggctgaggccgaccttgacccag

SEQ ID NO: 53352 - DNA, 601 bp, Human
aacaggggcctatgctcaaggccaggccagtggcacagttctcctccctggcagtgcagaagtggctgcccaaggacaggacatggagtcgaggttggaggggctgcttgagacgtcatggactgtttaccccacgtgcttcccctgaggagggaaaagtgcgacgtggacagggctcccataacctgggcacatctcacatgcatcacagccctgagggtgccccactagcaccttagtcctgtgcctcctggccttcctgccccctgcctccctctgggctgggcacctgagccgaggsgtcctggctgttggtggccctgacttctggcaggaccctgaggagcagcaccagagcctgcagatcctgtcccagaggggccagacctcaggcataggcgggtccgagtaaagactcctcccctttgtgcacatgggcctgggagtgcgtgggcctaggccagggcgggctggcctctggtgtgggctggctgtgaggttcattgagcctccccagctgctctcactagcagggctgcccggcaatgcctctggggcccaggtcatttgctttagctccttgggagctctcagcaaagga

SEQ ID NO: 53353 - DNA, 601 bp, Human
gaaaatattctccccaagctttctcctcctcggagctgaactgtgacacctcagtaccaaccaatggcaaccctgggacaaaggagtgcttcctgcccttttgagacggagtctcattctgtcgcccaggctggagtgcagtggcacgatctcagctcactgcaacctctgcctcccgggttcattcaagagattctcctgcctcagcctcctgagtagctgggattacaggcacgcaccaccatgcccagttaatttttgtatttttagtagagatggggttttgccatgttggccaggytggtctcgaactcctaagctcaagtgatccacctgccttggcctcccaaagtgctgggacataagagacaggtggcgtgccttctagtcaaacaggggcctatgctcaaggccaggccagtggcacagttctcctccctggcagtgcagaagtggctgcccaaggacaggacatggagtcgaggttggaggggctgcttgagacgtcatggactgtttaccccacgtgcttcccctgaggagggaaaagtgcgacgtggacagggctcccataacctgggcacatctcacatgcatcaca

SEQ ID NO: 53354 - DNA, 601 bp, Human
agggtccaaactctgaataacacatggagtctgacaccctggctctcccctcagcaacaatgaagtcacagcagagccagagaaagggacagaaaaaacaatgcaggaaggacaatgtggtgaaatgtctaaccgtgaaacaggagccggtgcatgagagccacgggcaattctcctgggctcctggaagtagccctccaatcacaccagctggctccctgcccagacacaggctgcagggatgtccaggaacccagctgggatctcagagggcagacccagggtgctgggtttctagcayggaccctcagctgggcacagagagaagagagccacctgcttgctgggcccagaacgactccccacagttctcccagggtacaggctgtgcccactctgcagggaaaacaatgcccatcttacaatcctgccctgcagggggccccagaccaacacagctggctatctcttctctgagccagaccagggtgactcttgtggttgccagaaaatgccaactgcgggacatcaagagaagaggcaggtccaagggtctctctcccctgccctttgccttatgaggtctgatgccaagacctac

SEQ ID NO: 53355 - DNA, 601 bp, Human
actcccctgcaggggcagaggggctgggagaagaagatgtttaggtcctgccaggaaggtcctctcaccacaaattccacctttatgggaaaatcaatgttattacctcctccatcttcccacacttgctgctggtctaaagcaatcacctcatgggcactgagccagaactgagccagcgctctggggtcactggcctgcccacccctgccttccgggagggccaggaagggaattggttggagagagtcagcatgcctagctctctgggtgcgaagagaggcccctggggccggttcaytgggtccgagcaccagccatgtgatgcctcgctcacagcactagcaaggcaggcccctagtccacagggaggagggagatcttgcttaactacaagagcgttaaagtccgatgaggcagaagccacagggtttgatggaagacttcctggaggaggaggaaagaaaaagtgggaaatccagagaagctggcacggaagaggagcagcaaccaggcagagcagccagtgctccaggggccacgggagaagcaaaacaagtgggggtctctgagaacacggcccaggagcctaaagaagaga

SEQ ID NO: 53356 - DNA, 601 bp, Human
aggaggagtgagaagagaaagaagcatgggaggaagagaaggaatgagggtactcaccaggcagccttcccagcaggccccatgccctgcctaagaggcaggcgggagccgtcctcagcatctcccaatggccgagtacaggggtgcttctgcctcatcatgatgggcctggtctgagggctccagtcctgcctgggctgcaaggctgcatggctgcatgggctatgagccaagttcctgcctggcaggccgcactcgagagacccaccccactcccctgcaggggcagaggggctgggakaagaagatgtttaggtcctgccaggaaggtcctctcaccacaaattccacctttatgggaaaatcaatgttattacctcctccatcttcccacacttgctgctggtctaaagcaatcacctcatgggcactgagccagaactgagccagcgctctggggtcactggcctgcccacccctgccttccgggagggccaggaagggaattggttggagagagtcagcatgcctagctctctgggtgcgaagagaggcccctggggccggttcattgggtccgagcaccagccatgtgatgcct

SEQ ID NO: 53357 - DNA, 601 bp, Human
ctcccatggcgtccctggattggtcactgggatgctcaggtgagtctgaggccagggggtgccctccaggctctcagcaggtcctcggccttcccagggctgtaaacactggtggaaggtgggggcatgggagaggcatactggcctccaagaagcggtgagcagggaagggtgtgggcagctgctggaggagaatatgggtctgaggttagcgcagcccagggctccctctgacatctctgcccccatcttggtttcagggcactgcttttggcctagaagagcagaggagaaagaagcrgaggagtgggaggaggagagcggggagaaaagaagggagaagggaggagaaggaagatggaggaagaggaaggagagggagaaagaggaggaagaggagaaggaagaggaaagagaagagggagagggagagggagaggagggagagaaggagaggcgagcaggaagaagaggaggagtgagaagagaaagaagcatgggaggaagagaaggaatgagggtactcaccaggcagccttcccagcaggccccatgccctgcctaagaggcaggcgggagccgtcctcagcatctcccaatg

SEQ ID NO: 53358 - DNA, 601 bp, Human
gcagaagcctggcacatcacacatacggtccagccctcctcggtccctgaccctccctgttctgggagtgaaggactgagacagggcactcaggtgttaaggttggggggtggtggggtggagggggcaggtacaaacccctgaggacggcctggagggaaggcagctgggtagacagcagcctccatgcccagggactcgggaaagatcaaagtgtgagccggaatgcgatgccagaggaagacgagggatggaagaggcagagaaccttgggcgctggggaggccaaatgaggtggccragacggtagctccctcatccatccggcatctccaggcagaggagagcaaaggcctggccacccgcggctgcccgaaagccaccaggatgggatcctttgttttcatttccaaacccaaaggcccctcggctgggccggcgtctgatcccgactcaaagccacagggagcctcagctgggacgcaacctgagggcttggaaaatggaggacccagagccagttttagcagttgatgaataataaatgtaattaacatgatggaaaacagaagctggaggcccggctgaggccccagagagt

SEQ ID NO: 53359 - DNA, 601 bp, Human
agcagaagcctggcacatcacacatacggtccagccctcctcggtccctgaccctccctgttctgggagtgaaggactgagacagggcactcaggtgttaaggttggggggtggtggggtggagggggcaggtacaaacccctgaggacggcctggagggaaggcagctgggtagacagcagcctccatgcccagggactcgggaaagatcaaagtgtgagccggaatgcgatgccagaggaagacgagggatggaagaggcagagaaccttgggcgctggggaggccaaatgaggtggcygagacggtagctccctcatccatccggcatctccaggcagaggagagcaaaggcctggccacccgcggctgcccgaaagccaccaggatgggatcctttgttttcatttccaaacccaaaggcccctcggctgggccggcgtctgatcccgactcaaagccacagggagcctcagctgggacgcaacctgagggcttggaaaatggaggacccagagccagttttagcagttgatgaataataaatgtaattaacatgatggaaaacagaagctggaggcccggctgaggccccagagag

SEQ ID NO: 53360 - DNA, 601 bp, Human
gtgtaacggcgatggttctagcatctctgttttctgcttttttatcccccctggcagagaagaaactttgaagctcatcactttgtgggcctaggctggaggcatcggggcacctcagtaggcccaggggctactgggcattcctccactgcaccatccctggcagggcaggcgggaatggggttctcctaatgtcaggattccccgcaggacgagggcgcatctggcctcccttggtctcgggggtgaacttcacagaaatggaaagtttatcgtgaatgaggaaagggcagtaaaaccyaaccccatttactgggtggggagaaagctgccacccagggtgtccaaatcagctgggaaaggtcacgccctttgggtggtcactgggccttgggaacggggccagaacccagccaggtggagcagcagaagcctggcacatcacacatacggtccagccctcctcggtccctgaccctccctgttctgggagtgaaggactgagacagggcactcaggtgttaaggttggggggtggtggggtggagggggcaggtacaaacccctgaggacggcctggagggaaggcagctgggtagac

SEQ ID NO: 53361 - DNA, 601 bp, Human
gcccactccacaaacacacaaggtacaccaaagcccttgagacactcttggaataatgatgcccactctgtacctccaggggacttaactaatttataaggcaattttaataataaccatatattaattttacatccccttttttacctatttcagtggctatgaactgttaggaattaggtaatatattacaatgggctcctggggtctttttattaactaatgccccatatttaaaaaccttcttgtcaaatgagaaacattaagaagcgctgtcccttttataattgcttctaatagrctcgatattcaggtcctggcctgaacagagagcccaggcgatacttccttaaattgcatttaacttttcattttctttctgtcatcggccaaccgaataattctgcaagtgcacaaatggtcattttaccgtgtcggtctgtagctctggagatgtctgtaaatctgcaagttaggaggaccactcaggtcaagagatgcacagcgtttctgcccggagtctggccgcaggagcaatgcttggccattttggtgtgtgtgtgcaagcctatttatcaaaatatatgccagtaaaccacac

SEQ ID NO: 53362 - DNA, 601 bp, Human
agtctgatggctggctctcctctctttcagtgtgagctgctgttttctccttaaactgcagagccagagctctcttctccctgccaagggggcacgcccactccacaaacacacaaggtacaccaaagcccttgagacactcttggaataatgatgcccactctgtacctccaggggacttaactaatttataaggcaattttaataataaccatatattaattttacatccccttttttacctatttcagtggctatgaactgttaggaattaggtaatatattacaatgggctcctggsgtctttttattaactaatgccccatatttaaaaaccttcttgtcaaatgagaaacattaagaagcgctgtcccttttataattgcttctaatagactcgatattcaggtcctggcctgaacagagagcccaggcgatacttccttaaattgcatttaacttttcattttctttctgtcatcggccaaccgaataattctgcaagtgcacaaatggtcattttaccgtgtcggtctgtagctctggagatgtctgtaaatctgcaagttaggaggaccactcaggtcaagagatgcacagc

SEQ ID NO: 53363 - DNA, 601 bp, Human
gaacatccccgggaaggacatggtatctgctcaccagacactaacccagccccagccgtgaagggagaacaacttttctagatggcactgggctttgggcatcaacatttttccagcaattccatttgcaggagtttaccccaaggacacggtcagtttgacacccgagagacggcgaggtagggttgacggtcgaagtgtcgttcacactgggaaccacctggcttccgggggcagtctgggtaagtggattatgatgcagccccagtgtgccccagttcactgccaggaagagacttcygctgcaaaaactctgcccagtgtgagcccagcagatcaaagcccgtctgtctgtgccccagagagaccggaagcctgtttgctacagcaataaggttttgtgtgcctctgcatcaaagggtttttttcctatcttgtttataatgttctgtactgactggatttcctactggcatatgtatctttttatcagagtaaagctattttcattttgaaaacacttttgggaagaaataaaagctacctgtcaaagacctgctcccctcgccccagcctcgccccactggccccagggggcttc

SEQ ID NO: 53364 - DNA, 601 bp, Human
gagaggccacctggctcctctaagacccatctgtctactgtggggtctctataatgcagagaggatgccacactcctctccgctccccctcacgggattaaatgagaacatccccgggaaggacatggtatctgctcaccagacactaacccagccccagccgtgaagggagaacaacttttctagatggcactgggctttgggcatcaacatttttccagcaattccatttgcaggagtttaccccaaggacacggtcagtttgacacccgagagacggcgaggtagggttgacggtcgmagtgtcgttcacactgggaaccacctggcttccgggggcagtctgggtaagtggattatgatgcagccccagtgtgccccagttcactgccaggaagagacttccgctgcaaaaactctgcccagtgtgagcccagcagatcaaagcccgtctgtctgtgccccagagagaccggaagcctgtttgctacagcaataaggttttgtgtgcctctgcatcaaagggtttttttcctatcttgtttataatgttctgtactgactggatttcctactggcatatgtatctttttatcagagt

SEQ ID NO: 53365 - DNA, 601 bp, Human
tatctattaaactatacacagcagtgtttgaaatatttcataattatgcaaaaactgttatttaaaagaaagtcatcagactataaagatagaaaaaacatgctgataactggattatattgaggtagtagaaaaagcaatttcgcaaaggcataaactatacaggaaaggaccaacatgacaactgatatttacaatttctgtacatcaaattgggaaaaatatttccaacacacagaacaatagtacaaagagcccaattacagagcaataagtcacccacaaatgtcccgattgcaamtgggcaaaggactgaaaacccacaaagataaatgcccaagaaatacttacaagagaagtttaagctcgtcagtaatcaaatcagcaaaaataaagacggggtattacttttccctaatcagaatgataaaggtgaataatggaaataacacaattaatcttgaggcctgggtgggcacaccggcactcatggtttgggaggaggggtgtcctgcacgctggctgagaacatggcttctggagagaggccacctggctcctctaagacccatctgtctactgtggggtctctataatgcag

SEQ ID NO: 53366 - DNA, 601 bp, Human
ccgcagggagcccaggcatcacacacctgtccagcataccccgagctccctcttccaggacccacagcaacacctatcccaagcccacccacttctagcaccttctatcggacaccttccacactgaccctcaaccacctgccagtctttaacaggtcccctcctggcccaccttcccaccaggaggtcatggctagaggggtctcagtggactcctggcagctgctgcccttcaggagctgggaggatgtccacgctccacctcctgctcaccgccagttaccatccaaaaccaccgtgsgccaggctgacgcccctctccagaaatctccctgggttccccaaggggcttctcccacctctcaccaccaaaagccctctgtaggcaagtccctccccacacttctacactgcagaactttcagcctggcaccctcccgttccctcccagtcttgaagggcactcctagaggcaggcccatgtcacccatacccaaggctggccacagtgatgagcacacagtaggtcctcagtaaacatgtgaagaaagggtaacggatggcaggaacagcaggcctgaacatgcccaacaatccaaag

SEQ ID NO: 53367 - DNA, 601 bp, Human
tttggggtagcttaaacctatttatcaatagctaattaataaagtctaagtctttggatgacaggatgattaaactggtttttaaataatccatttttaattaaaatgctaccctcttttggcttctggatatattcaaaaggaagccttaacagatcttgtttttaaatatacattatacgaagccaataattagaagaatttgtgcttttaattatatcttaattattctttgcctatcgatgcaaagttaaatatcctttctttatgacaccaacactactccccaaagccagtagaytgctagcaggaattgtgtgtgtgaagcctgctcccggagatccgtgcagcagtgacggtgcctgtaggcaacccatacccccgtcctggcaggcggcaatctgatcatggcaaagcactggctctgggcagcactctcctggcccccaccttgtaagagacacgcttgaagacagaagtggtcgttatgtgatgagggtctgggcccccctcctgcatagccaggagccaggaagttccttgactttactcgccagcctgcacacactctgaagcatctcgccagcgccacccactgaaa

SEQ ID NO: 53368 - DNA, 601 bp, Human
agcctgggcgacagagtgagattcagtctcaaaacaaacaaacaaacaaacaaacaaaaaggcttgccagagtggcagatgatcctagttcaacacaacccagaggccacattgtccctctaaggaacgctggcaccctgtctccatcctccccaggaaggtgtgggggaagcaagccaggtatgcagggagctttctggaggggcgagcaggggcaaggggagggaaggggctgcttttaagttcacatttcccaaagcacaatacgagtccacgggatgacattatgtagtaccccacyagcatatttccttcatgcactaggtatttatcttgaagcgctaatgtctgttaatggcaaattagattgggtttcattcatgacgaggataaaaagcatcttaaaacatatatttaaaggaaaaaaaatgagtcaattgaaagaaaacgattaagcagataatagtagaggtgagacaagaacttgaccaaaactgccagggtgtctcatggaatgactaactctgggagatcccgccttaaggcttctttgaggaaaagcctggtttttcgttcttgggcaaggcctttggttcagaag

SEQ ID NO: 53369 - DNA, 601 bp, Human
ccctccccaagcagctggccctgcagtgaccccctccagtaagtaccttctctactgattcccaggaagaaggacaggacaccagaggcagaacttgactggtgcctgggaggctgacaacacagaaccgaaagaaattcaaagctcgcagtacccgccttgagggaaattcgcaatgctgtgactctagacctgtgtttggcaccttgagccagcgagggagctccggctttggaaggcctgggaagagctgtgtaaacacaagcaccattggccaactgttctctgacttattctgggrtccacacctgttcgcgtctgacccaatctcactaatccatgctgactgtagagatgacacctttcttggccctagaacaaaaactcccccttttaaaaaggaccagaaggccagtgtggtggtgcatgtgtgatggtgtactcaggaggatgaggcgggaggatcgctggagtccaggagtttaagcccagcctggacaatctagtgagacccggtattcgtccattttcaagctgctgatgaagacatacccgagactgagtaattataaaggaaaagaggtttaatggactcacagtt

SEQ ID NO: 53370 - DNA, 601 bp, Human
caatactctgtcaattatctgtttctatgtctacctacctacctatcgtctatccatccagccatcatcctatctatccatccatcatctatcaaggtgatgatcatctatatcagcctacatacttacctacttatcatccatccatccatccatccatccatccatctatccaaccatctctagcctcccattaggcttgagctttatctttttgttcactgtagtatccctcaagagaccagaacagtgcttggcacatcagaagtctttggtatacctctgttgagtgactgaatawgtgaatggctgtatgagcagcaccacagcctctaatttacttaaccaacttcctgctgttagagatggaggcttcttctgcctctctgtatgatggccacgcatggccttgtgcctcttcactgtcctcgggctaaattcctagaagggagattattgaccaaatgcacatttccaattctcagggcatgttctgcaaaaaggacccctgaacactcataaggattttggggtcctgagcagcacactgcaaggctcgtctgcccacaggaatgggaacctggtgggtaaaacacaaaag

SEQ ID NO: 53371 - DNA, 601 bp, Human
gataaaacattctatctccttctccgtccccaaagccctggctcatcagactgtaatatacttatgttttatatgtacatggagaagtcttagaaattctctgcacaaagaaaaaaagtcactgatcgtgttaacacccagaggtcttctctatccaatattttgttgaacattcttccaggcattttttttaaaggtataaacacagattaatatttaataattattttaaaaataattagctgtggccgggcgtggtggctgacgcctgtaatcccaacactttgggaggccaaggtgygtgaatcacctgaggtcaggagttcgagaccagcctggccaacatggtaaaacccgtctctactaaaaacacaaaaattagccaggcatggtggcaggtgcctgtaatcccagctacttgggaggctgagacaggagaattgcttgaacctgggaggcggaggttgtagtgagccgagatcgcaccagtgcactccagcctgggcgacaaagccagactctgtctcaaaataaataaataaataaataaataaaaatgattagctgtaattaaaaaaaaaactcacctttttacagaagt

SEQ ID NO: 53372 - DNA, 601 bp, Human
ctatcttgtattaagcataactgaggacataacatgacattcaattaacaaatcttcccctttattttcaacgtgcttgattaggttgagtttcggagttcctcggatcagttacggataaaacattctatctccttctccgtccccaaagccctggctcatcagactgtaatatacttatgttttatatgtacatggagaagtcttagaaattctctgcacaaagaaaaaaagtcactgatcgtgttaacacccagaggtcttctctatccaatattttgttgaacattcttccaggcattttttttaaaggtataaacacagattaatatttaataattattttaaaaataattagctgtggccgggcgtggtggctgacgcctgtaatcccaacactttgggaggccaaggtgcgtgaatcacctgaggtcaggagttcgagaccagcctggccaacatggtaaaacccgtctctactaaaaacacaaaaattagccaggcatggtggcaggtgcctgtaatcccagctacttgggaggctgagacaggagaattgcttgaacctgggaggcggaggttgtagtgagccgagatcgca

SEQ ID NO: 53373 - DNA, 601 bp, Human
tcggagtccacgcagggtctccgactgcaaagcttatggttttgacccggatgcctctgaaacctcaggtctgtcagtaggtgggggctggaacagtgctgacctcggggcttgctgtgaaggctgaagaagatgcagggaaaagcttcaactccataaacactggcagtgggtgatgccatggctaacgccttccggagccctgaccttgcacccatgcacaaggccagaactgagcagaaaagggtctgcaaggacaactggcccaccaagtcctgggcgaaggagccccaggccagcyggtggaaagcaggagctggggtctgagagaggcctgggatgctgaggccccgcccagaaggggggatccgccaatcacaggcaagggcagcggccaagacagcagcggtcacagcaggaggaagagacacaacagacaggagcagctcactctctctctgagagctgccttatcaaggcacaagataattagcattttaattggataattgggaattctaaattgcctatcttgtattaagcataactgaggacataacatgacattcaattaacaaatcttcccctttattttcaacgt

SEQ ID NO: 53374 - DNA, 601 bp, Human
agcatttagcatgataacaaccctttgggggctgagggatcttcccactgcacagaggatgctgcagtcagaacaatgacgggctggggtcaggaaacccactgaatccgtgttcgggctcggagtccacgcagggtctccgactgcaaagcttatggttttgacccggatgcctctgaaacctcaggtctgtcagtaggtgggggctggaacagtgctgacctcggggcttgctgtgaaggctgaagaagatgcagggaaaagcttcaactccataaacactggcagtgggtgatgccatggctaacgccttccggagccctgaccttgcacccatgcacaaggccagaactgagcagaaaagggtctgcaaggacaactggcccaccaagtcctgggcgaaggagccccaggccagccggtggaaagcaggagctggggtctgagagaggcctgggatgctgaggccccgcccagaaggggggatccgccaatcacaggcaagggcagcggccaagacagcagcggtcacagcaggaggaagagacacaacagacaggagcagctcactctctctctgagagctgccttatcaaggcac

SEQ ID NO: 53375 - DNA, 601 bp, Human
ccaggccctgctgcccactcagtctgaggcttgaggcaggttgtgtagctgctccagtaagaaaaactgaacagtcaactgcagcatttagcatgataacaaccctttgggggctgagggatcttcccactgcacagaggatgctgcagtcagaacaatgacgggctggggtcaggaaacccactgaatccgtgttcgggctcggagtccacgcagggtctccgactgcaaagcttatggttttgacccggatgcctctgaaacctcaggtctgtcagtaggtgggggctggaacagtgcygacctcggggcttgctgtgaaggctgaagaagatgcagggaaaagcttcaactccataaacactggcagtgggtgatgccatggctaacgccttccggagccctgaccttgcacccatgcacaaggccagaactgagcagaaaagggtctgcaaggacaactggcccaccaagtcctgggcgaaggagccccaggccagccggtggaaagcaggagctggggtctgagagaggcctgggatgctgaggccccgcccagaaggggggatccgccaatcacaggcaagggcagcggccaaga

SEQ ID NO: 53376 - DNA, 601 bp, Human
caccgtgtagccggcaccaacatggcagcgtcagacacaggccgtctgcagcagatgcggtgctcggcttcagcagcttgctctgctgcccggagctcctcactccctcttcctgccgctcctacaccagtcctggcccacagacagagactgtttgacctggggcaacaccttcccaccagggcttccagaaggccagccagcatggtcacagggtatatggggccaggcttcttgggcttgcatggaccatctccatgtgggcaagcagatgaagtcacactcctggagccccactgcygcccagatcactctccctgactactcagctcctgccagggagccccacaaggcactgcactgtggggatgggtgggcagactgattcaatccaggccctgctgcccactcagtctgaggcttgaggcaggttgtgtagctgctccagtaagaaaaactgaacagtcaactgcagcatttagcatgataacaaccctttgggggctgagggatcttcccactgcacagaggatgctgcagtcagaacaatgacgggctggggtcaggaaacccactgaatccgtgttcgggctcggagtcc

SEQ ID NO: 53377 - DNA, 601 bp, Human
cagaaggcacaggcgaaggcgcccaagccctacccttggaatcgccgcctgggtggcaccagcgacctatccaggaccccaactcccaggcaggtcctggctcttttagcactgttccccgtaggtcttccaaagagcaggtactgggacttggcagtgaactgggggactgctgcgtgcctccccttccccaggccccagcatgacgacaaacacagacaaagctaggaatgagcaccctctgaggctccgagtgcctgaaatgagcaagaggcattcacgtgatgtgtcaccaagaagrgactgacctgaagcctcggactaaagccagaaatgcatgattaataaaactggtgctagcggagagctggtcagcatcaccgtgtagccggcaccaacatggcagcgtcagacacaggccgtctgcagcagatgcggtgctcggcttcagcagcttgctctgctgcccggagctcctcactccctcttcctgccgctcctacaccagtcctggcccacagacagagactgtttgacctggggcaacaccttcccaccagggcttccagaaggccagccagcatggtcacagggtatatgg

SEQ ID NO: 53378 - DNA, 601 bp, Human
attcccatggaaggaggggagctgctccacgcccttcttctggggtgaccagtgggtcatcagaaggcacaggcgaaggcgcccaagccctacccttggaatcgccgcctgggtggcaccagcgacctatccaggaccccaactcccaggcaggtcctggctcttttagcactgttccccgtaggtcttccaaagagcaggtactgggacttggcagtgaactgggggactgctgcgtgcctccccttccccaggccccagcatgacgacaaacacagacaaagctaggaatgagcaccckctgaggctccgagtgcctgaaatgagcaagaggcattcacgtgatgtgtcaccaagaagggactgacctgaagcctcggactaaagccagaaatgcatgattaataaaactggtgctagcggagagctggtcagcatcaccgtgtagccggcaccaacatggcagcgtcagacacaggccgtctgcagcagatgcggtgctcggcttcagcagcttgctctgctgcccggagctcctcactccctcttcctgccgctcctacaccagtcctggcccacagacagagactgtttgacctgg

SEQ ID NO: 53379 - DNA, 601 bp, Human
cacatgaccataattgtgtcattaacgtgatacaccacttactaagggaaaatccttttcagagtaagggccatacagtcctgcaggggatgccctgagacacctcaggccgagcagagcgtgccttatggtccccaaagtgggagcagctactatggaggacttggagccaaaaccggatgtttctaccagtggagccctggcatagctccttttgcatggaaccagaagcacgtactacattcttcttgaattcccatggaaggaggggagctgctccacgcccttcttctggggtgascagtgggtcatcagaaggcacaggcgaaggcgcccaagccctacccttggaatcgccgcctgggtggcaccagcgacctatccaggaccccaactcccaggcaggtcctggctcttttagcactgttccccgtaggtcttccaaagagcaggtactgggacttggcagtgaactgggggactgctgcgtgcctccccttccccaggccccagcatgacgacaaacacagacaaagctaggaatgagcaccctctgaggctccgagtgcctgaaatgagcaagaggcattcacgtgatgtg

SEQ ID NO: 53380 - DNA, 601 bp, Human
tgctgctggccagctgaatggcctctccgtgcctcagtttcctcatctgtaaaatggggatgatagcggtgcctccctcccagggctgctatgccagtcgaatgatttaacatacatggagtatacacaatggtgcctggtacccaaggagctctgtgtacagtgacctagccatcgtggtcactgttcagaggcctggagggaggctggagaatggggatccctcctcaggcagcaggagaggaggtcgtgggcatcctgtgccaggctttgagaaacagcctcttgactattcctttamaaccaaacagaatctgcataggtccacggcccggacacccactcccgcaccctccaggcagccaagttctctacagaagtccttcctgggcccacacactcccagcatctccaggatgttcaccagcaaaaacgcggaggtgtgtcctctgcaccagctaccgggacacgtgcgcacagacaggcttctggctggacagagggggcctgtgcccaccatcccttcacagctgcccctcgccctcacggagctgacccagggtccccgccttcccggggtgcgcccaggactggggcacat

SEQ ID NO: 53381 - DNA, 601 bp, Human
tgcctcgagcatgggtggggtagcgccgaagaggttagtgaggcagtgtaaggggtggccctggccacatcattccctttccccggctgggcctcaatggatctcaggtactcaagaggtggagaggggaggctgggccggaaacagaagcttgggagtgaaaatgcgcagagctggtggagccccctcagctgggcagagggcttaggaaagcaggtagttgggacatggggttacaaacctgaggtggggagggtgtgttccgcaccccggtccctgtgctgggctccctgctctgggycccacatacccagccttctgggactcaacaccaacctcaagggcaaatcttggctctgctgctggccagctgaatggcctctccgtgcctcagtttcctcatctgtaaaatggggatgatagcggtgcctccctcccagggctgctatgccagtcgaatgatttaacatacatggagtatacacaatggtgcctggtacccaaggagctctgtgtacagtgacctagccatcgtggtcactgttcagaggcctggagggaggctggagaatggggatccctcctcaggcagcaggagagg

SEQ ID NO: 53382 - DNA, 601 bp, Human
agtcatccctggagcaggctagctactacccacccaaaataattaacacctggaacaggctctccagcagagggcagcagccagcaagacaggcaggagtgtcaccgccccactgcgaccatctccataggctccttccataaatttatgactcacatcgtgcagccccggaccagctgggtctaacagcccctgctccctcctgctcacctggaaggcggatggggtggtacacacaccccagccaggctcaagcccagcgcgcacctcctccccagcagcagggaggggcttcctgatyggctgagaggaggccgtggtctgcctaagtcccagccaacgacatcccggctgctgtgtgggccccgttgtttttccttatgtggccattcctctaacaccctcacctataaatttctcccaggcaagactcgggtagaagaggcttgtatccaggcataagtgagagagcccttaagcaacctgggggaactgcatgagtggtgaataacgaggtggatggagttactgcagtgtcagtggggcaggcacatctgtcagtgccaggagatgacaaatggggcaggagcagcaagttccc

SEQ ID NO: 53383 - DNA, 601 bp, Human
aaggcacagctcacagaagcatcaaactaaagaaaggctgacccagttttcacctgcaaagtgcagcccgacactggtcacctttgccggccacgttgacaactccacacactgttccataggaaggagttgaaaagaggaggagcaccacgtgctggatattcacgcccgcctaaaaaaagctgaaatgcttcacagtggacttcagtcctgaattttgttttaaatgaccttttctgacgcaacttgaggacacactggtgctttggtggcaataacaggtgggcaaaacgagcccacrttttctgcagactttaggcttggggtgtggacgcacaagggcacccaagttctgggcagctgtggcggcacagggggcctgtggaagcgtgtgagcccggcgcggcacagttctgatcttcaagcggtgagcactgaggggtggacattccaaactggggcccatgcttgatgtggacgcaacgtgtgcccccgcacagctgggccagagcttggcaagtggtgctgggatgaccaggagcaagtgtgggctatgaggacaggctaacagcctgtcccgtggatgaccgacatgccatgg

SEQ ID NO: 53384 - DNA, 601 bp, Human
gcagtgaggaaacttggctctctcgcctgcagcaagcttccccctgcataacccactcagtggagacaactgtctttgaatgcctttgctgctttttaagaaaaaaatagtgccttcaagaaggcacagctcacagaagcatcaaactaaagaaaggctgacccagttttcacctgcaaagtgcagcccgacactggtcacctttgccggccacgttgacaactccacacactgttccataggaaggagttgaaaagaggaggagcaccacgtgctggatattcacgcccgcctaaaaaargctgaaatgcttcacagtggacttcagtcctgaattttgttttaaatgaccttttctgacgcaacttgaggacacactggtgctttggtggcaataacaggtgggcaaaacgagcccacgttttctgcagactttaggcttggggtgtggacgcacaagggcacccaagttctgggcagctgtggcggcacagggggcctgtggaagcgtgtgagcccggcgcggcacagttctgatcttcaagcggtgagcactgaggggtggacattccaaactggggcccatgcttgatgtggacgc

SEQ ID NO: 53385 - DNA, 601 bp, Human
tcagccgcccccgtattcgtggtgcaagcgctcaggaggccgcttccacctcgctcctgggagtctcagcgctgagtttcgccacagtccaggcacgttcctaccaaggcaggcaagggcagtgccccacatggcaagccctgtgcgccaggccagacaggcggcctcagaagccacttcacacctctgtggcgccctcccagaaagcccgagaagaggcctgacccacgccgtggaacaggggtgctcccttggctttgtgagatgtggtcctgcaccaacagaagcgaacctcagaggycacatggtcattctcgacgtgatggcgacagcggacctctgtgggacaagtgacctgcagacaaccacgggctgcgctgggactggccggcttcagaaaagacaggcagagggacagagatgccatccgcatgtgcagaggaactcacatattctacaagaaaggagcggcaggccgggcgcagtggctcacacttgtcatcccagcactttgggaggccaaggttggaggactgcttgaggccgggagttcaagaccagcctgggcaacacagcaagaccccagctctcaaaaaatcaa

SEQ ID NO: 53386 - DNA, 601 bp, Human
catgctcctctcctcagccgcccccgtattcgtggtgcaagcgctcaggaggccgcttccacctcgctcctgggagtctcagcgctgagtttcgccacagtccaggcacgttcctaccaaggcaggcaagggcagtgccccacatggcaagccctgtgcgccaggccagacaggcggcctcagaagccacttcacacctctgtggcgccctcccagaaagcccgagaagaggcctgacccacgccgtggaacaggggtgctcccttggctttgtgagatgtggtcctgcaccaacagaagygaacctcagaggtcacatggtcattctcgacgtgatggcgacagcggacctctgtgggacaagtgacctgcagacaaccacgggctgcgctgggactggccggcttcagaaaagacaggcagagggacagagatgccatccgcatgtgcagaggaactcacatattctacaagaaaggagcggcaggccgggcgcagtggctcacacttgtcatcccagcactttgggaggccaaggttggaggactgcttgaggccgggagttcaagaccagcctgggcaacacagcaagaccccagct

SEQ ID NO: 53387 - DNA, 601 bp, Human
gaaagccacatgctcctctcctcagccgcccccgtattcgtggtgcaagcgctcaggaggccgcttccacctcgctcctgggagtctcagcgctgagtttcgccacagtccaggcacgttcctaccaaggcaggcaagggcagtgccccacatggcaagccctgtgcgccaggccagacaggcggcctcagaagccacttcacacctctgtggcgccctcccagaaagcccgagaagaggcctgacccacgccgtggaacaggggtgctcccttggctttgtgagatgtggtcctgcaccracagaagcgaacctcagaggtcacatggtcattctcgacgtgatggcgacagcggacctctgtgggacaagtgacctgcagacaaccacgggctgcgctgggactggccggcttcagaaaagacaggcagagggacagagatgccatccgcatgtgcagaggaactcacatattctacaagaaaggagcggcaggccgggcgcagtggctcacacttgtcatcccagcactttgggaggccaaggttggaggactgcttgaggccgggagttcaagaccagcctgggcaacacagcaaga

SEQ ID NO: 53388 - DNA, 601 bp, Human
ctgtggtagattcaatgggctttcagacttgccttccaaacctcacaggataattgggtatctgcgagtgaaatatttcctgaaaagaaaggatttcaggagctgccagggaagcaagaaagccacatgctcctctcctcagccgcccccgtattcgtggtgcaagcgctcaggaggccgcttccacctcgctcctgggagtctcagcgctgagtttcgccacagtccaggcacgttcctaccaaggcaggcaagggcagtgccccacatggcaagccctgtgcgccaggccagacaggcrgcctcagaagccacttcacacctctgtggcgccctcccagaaagcccgagaagaggcctgacccacgccgtggaacaggggtgctcccttggctttgtgagatgtggtcctgcaccaacagaagcgaacctcagaggtcacatggtcattctcgacgtgatggcgacagcggacctctgtgggacaagtgacctgcagacaaccacgggctgcgctgggactggccggcttcagaaaagacaggcagagggacagagatgccatccgcatgtgcagaggaactcacatattctacaagaa

SEQ ID NO: 53389 - DNA, 601 bp, Human
tccatccaccagagaagaacatttccaaggactgagatttcacatgtattattcatgtgccggggacgtgcacattggcagagctgcctggctccatcctggccgggcaggggccagacccgaggggcagagagcagggagactggctgggagagcgcaggagacgagggggccacgcccacagccaggacgcatgtgggggcagacacaccccaagggacacatgccgctgtgcatggcccacacagcatggcaatgatcccatatcactgtcatttctaccatgtgtgtgcctccaagmacacccagccaggtgttgatggcacacacccaagcgcacacacccacacagagccctgcccctcggcaccatgtgccacgagcaggcacaccaacagtgacatgcacacccacatacagcagcactggtccccacgcagccacacccacatagacacaccaccaccactttctgcactgacccttccacactccacccctgctgcacacagaagctgcccagcctgagctcacagcccggtccccacatgctgtgtgtgtgcccgtgtggaggagtggccttcctgtgcttagctgctgt

SEQ ID NO: 53390 - DNA, 601 bp, Human
ggttttctctccatccaccagagaagaacatttccaaggactgagatttcacatgtattattcatgtgccggggacgtgcacattggcagagctgcctggctccatcctggccgggcaggggccagacccgaggggcagagagcagggagactggctgggagagcgcaggagacgagggggccacgcccacagccaggacgcatgtgggggcagacacaccccaagggacacatgccgctgtgcatggcccacacagcatggcaatgatcccatatcactgtcatttctaccatgtgtgtscctccaagcacacccagccaggtgttgatggcacacacccaagcgcacacacccacacagagccctgcccctcggcaccatgtgccacgagcaggcacaccaacagtgacatgcacacccacatacagcagcactggtccccacgcagccacacccacatagacacaccaccaccactttctgcactgacccttccacactccacccctgctgcacacagaagctgcccagcctgagctcacagcccggtccccacatgctgtgtgtgtgcccgtgtggaggagtggccttcctgtgctt

SEQ ID NO: 53391 - DNA, 601 bp, Human
gccatagaagaaagggcaccaaagaactgggagggacaaggcacatcctctgctagtcagtgaccacagtgaaatgtctggaggccaagacagggcctgcgtggctgtggctgagccccagggctccagcactggggtagctctcaggagctctgcactgcctgggctggccctggctgacatctgacgtgcagggcacaggcaaagaacgcggagggactgagcagaggccaggctgcaagtactcacacacctcctccctgccccggggcagcggcccagctgctctgccctgcacacygaggggctgtgggtaggactgcaagtcctccaatgagagaaaagactacccgaggggcggaggccgcagggcctgcccacatctccttgtcgtggcttctatgaagaactgtgagcacggcacatcgtgctcaggaaagccctgcacgcagccacgggtcagcactgctgacttgctgaacgcagggccgcagaggccacgggctcctgcagcaggaggatggcaggtttcagagcgtgggaggctccctgcggtcttcccagctccagaccaagaggcctgccctcctggcaccaagac

SEQ ID NO: 53392 - DNA, 601 bp, Human
ctgcctctacagctgcagctgggagatgcaggtgccatgtgctgtcccggagggccgaggccacagcatctgggattatgccaggaccctctccggggcagataaagagggtcataaaggagcagtcacttcttctggggtgtgctgagcccacagaggagaaaagctcatggccacgtggctctggcacagggctctccagccacccagaagtgccccctggactgtggggacccactgatgtggcctctgccgtgagactgggttcccatgtcctgtcctccaggcccagccagaatgsgctacagggttaaagagctttagaaaaggtttcagggctgggcaccgtggctcacatctgtaatcccagcacttttgggaggccgaggcaagaggatcacttaagtccaggaattccagaccagcctgggcaacatggtgagaccctgtctttttaatattaaaaataaaaaaattagctgggcatggtggcttgtacctgtagtctcagctactcgggaggctgaggtgggaggatctcttaagcctaggagtttgaggctgcagtgagctatgattgtgccactgcactctagcctgg

SEQ ID NO: 53393 - DNA, 601 bp, Human
agtcccgtccctcacccctgcgtgcatgcgagtgggtgtggtggcatcacacccagagaagcgggaaggggcccgggggtggctggctgggggtgagggacggccctcaggaagtctgtctcagtccttggctgacaagcctgacctgaagcaggaaccagggtgtctggttcataggccctcttggaccatgactgtggccaacagtggactcagcctagctccagggaagctgctggaagggtaaggacggagcagtaggaggggggcctagccagccccaaaccccgcttgatgtacrcatcatggaggacacttttgggtcgaagacacggaacaggacaaccaggggacgggagctgtctgagaataaaccaggcctggcctgagctctgcctgtggctcccacctccagcctgtgctgcagaaccagctgctggaagtgggcatcagggcctggcctgcccagctcggtgaggacaccgggcctgctgctcttgcccgaagagggcccacgctgtgccaggtggccactgcgagagagggaggcaggggcttacactgtgatcattgcaacgcagcacagcctcggtcagttccc

SEQ ID NO: 53394 - DNA, 601 bp, Human
gcaggagtaggctggccgcatcccaggctgcagggcccatgtgaggccaaggtggctgctgaggtcctgggtgagcgggcaccccatggcctgcagggtcgaggtctcgccattatctagccagggaaggaggggaagagggcactggtggctgctgagtgtgagggctgggacaggtctctcctcctagccaggctggccacccaccccccatgcccaggagcaacacaaaagaccaggcccagcaggggtgaggcctggcccatcgtcctgagacaacactgccctcttctggccagtkctggaaggacaggcttgctgcccaccagctgcatcccgactgggacaaccaaggcctggggcatcctgggacacgtgctctagaaactctgcgaggggccacagtagattaaggcccccctccaacccccaccacctgatcgggaagtgagggaggcaggaggagtgtcccagctgctttcccaaccagagccctccacctctgccctgtggggtgagcctctccaggacctggggcggcctcaggcccggagtgctgcaagggatggtccctctctgggcgcactgcttcccagaatcg

SEQ ID NO: 53395 - DNA, 601 bp, Human
caggtggagtggggcaagggggtccccaggagcttgtcacccatggggtccgcagcgcgatggtggcagacagactcaggctgagtagacagcaggagtaggctggccgcatcccaggctgcagggcccatgtgaggccaaggtggctgctgaggtcctgggtgagcgggcaccccatggcctgcagggtcgaggtctcgccattatctagccagggaaggaggggaagagggcactggtggctgctgagtgtgagggctgggacaggtctctcctcctagccaggctggccacccacccsccatgcccaggagcaacacaaaagaccaggcccagcaggggtgaggcctggcccatcgtcctgagacaacactgccctcttctggccagttctggaaggacaggcttgctgcccaccagctgcatcccgactgggacaaccaaggcctggggcatcctgggacacgtgctctagaaactctgcgaggggccacagtagattaaggcccccctccaacccccaccacctgatcgggaagtgagggaggcaggaggagtgtcccagctgctttcccaaccagagccctccacctctgccctg

SEQ ID NO: 53396 - DNA, 601 bp, Human
ctggctggtgacaacaagtctccctcggaggaaacagcaaggtggtgggggagagctgggctgggacaggcagcagagagcaggcctgggggcaacgctctaccctggagctcaccaaagcattgggccccaggtggagtggggcaagggggtccccaggagcttgtcacccatggggtccgcagcgcgatggtggcagacagactcaggctgagtagacagcaggagtaggctggccgcatcccaggctgcagggcccatgtgaggccaaggtggctgctgaggtcctgggtgagcgggyaccccatggcctgcagggtcgaggtctcgccattatctagccagggaaggaggggaagagggcactggtggctgctgagtgtgagggctgggacaggtctctcctcctagccaggctggccacccaccccccatgcccaggagcaacacaaaagaccaggcccagcaggggtgaggcctggcccatcgtcctgagacaacactgccctcttctggccagttctggaaggacaggcttgctgcccaccagctgcatcccgactgggacaaccaaggcctggggcatcctgggacacgtgct

SEQ ID NO: 53397 - DNA, 601 bp, Human
ccccaagagcatgtctttaagaccgcagagtgctcagggcagggctggctggtgacaacaagtctccctcggaggaaacagcaaggtggtgggggagagctgggctgggacaggcagcagagagcaggcctgggggcaacgctctaccctggagctcaccaaagcattgggccccaggtggagtggggcaagggggtccccaggagcttgtcacccatggggtccgcagcgcgatggtggcagacagactcaggctgagtagacagcaggagtaggctggccgcatcccaggctgcagggsccatgtgaggccaaggtggctgctgaggtcctgggtgagcgggcaccccatggcctgcagggtcgaggtctcgccattatctagccagggaaggaggggaagagggcactggtggctgctgagtgtgagggctgggacaggtctctcctcctagccaggctggccacccaccccccatgcccaggagcaacacaaaagaccaggcccagcaggggtgaggcctggcccatcgtcctgagacaacactgccctcttctggccagttctggaaggacaggcttgctgcccaccagctgcatc

SEQ ID NO: 53398 - DNA, 601 bp, Human
ccagaggcagaaggcctccaagatgggtcggccagtgacggaaggcttgggaacagttttctgggggaaatgctgcaatgtttatatgagagccactttggacttggtttgcagtttcatttgaatctcctgagtagtggcacggctcttagctgttcaatccaacagtttacacgcgctcatattcggggctgcagaagcactgcagactccgatgtgcagctgccctggtcagtgtcccaggccaggctgggggattgctgagcagcaggaagcacttgcttctcctcagtgtgagacygaaagggaggcgtatgggtcactcttcccttcatctgccccagtgggcggcccctgcagacacggtggcgagctgtggtctccagggtgcatgggccggctgcctgctcccagccaggccttccgtggagtgccaagctccaagcgtggccagcagggacaaaggccaccactcggagtccctgaggctccccgtgccatggcctaacccaccaaggggacctctctccagtgcgttcctgggcatctctgcccccttttcgtgtgacggccactcctccagggcctcggcagacaggaa

SEQ ID NO: 53399 - DNA, 601 bp, Human
gccccatggcagggacccgccagcccagaggcagaaggcctccaagatgggtcggccagtgacggaaggcttgggaacagttttctgggggaaatgctgcaatgtttatatgagagccactttggacttggtttgcagtttcatttgaatctcctgagtagtggcacggctcttagctgttcaatccaacagtttacacgcgctcatattcggggctgcagaagcactgcagactccgatgtgcagctgccctggtcagtgtcccaggccaggctgggggattgctgagcagcaggaagcmcttgcttctcctcagtgtgagaccgaaagggaggcgtatgggtcactcttcccttcatctgccccagtgggcggcccctgcagacacggtggcgagctgtggtctccagggtgcatgggccggctgcctgctcccagccaggccttccgtggagtgccaagctccaagcgtggccagcagggacaaaggccaccactcggagtccctgaggctccccgtgccatggcctaacccaccaaggggacctctctccagtgcgttcctgggcatctctgcccccttttcgtgtgacggccactc

SEQ ID NO: 53400 - DNA, 601 bp, Human
ccatcctctgaatgcaaaccgacaatggagaattcggtcatacgttggctcaatcgagaacaggcacgcaggatccctccttcctggctgtctggggaccctaccatctttggccgagtgagtcgatgataatacaagacatctgggagacaggatgcatctccaaacaacgtgctggcgtctcactccccacatgtgttctgagggctctgtttctggctccttctgggtagctttgggcctgggctacctgccaccactggcccacccagaccctccctgggccccatggcagggaccygccagcccagaggcagaaggcctccaagatgggtcggccagtgacggaaggcttgggaacagttttctgggggaaatgctgcaatgtttatatgagagccactttggacttggtttgcagtttcatttgaatctcctgagtagtggcacggctcttagctgttcaatccaacagtttacacgcgctcatattcggggctgcagaagcactgcagactccgatgtgcagctgccctggtcagtgtcccaggccaggctgggggattgctgagcagcaggaagcacttgcttctcctcagtg

SEQ ID NO: 53401 - DNA, 601 bp, Human
aggaatgtaaaaacaagactgttctccagtgcagaccagactcagatcccagttccccaaactcccgccagcaaagcagaaagaccatgggatggtgggtgcctggatatcatccgccagcctgactttatcttccagcttgtagaagactgtaactgcatttcttgtttgaaaatgatctgctttctggagggggaagtatacacccagccagccagctccatcctgcccagcgaggctcgggtatggagctgaagtctattttcgtgctcctctcagttccctatctttttctgccttaaaaaaatccccctagagtttctacacacataagttattcagatgcaagcttttctggaatccagggacgaaagccatggctttgataaatcatctccctcccgctcctctgcgtccacttcatccatcctctgaatgcaaaccgacaatggagaattcggtcatacgttggctcaatcgagaacaggcacgcaggatccctccttcctggctgtctggggaccctaccatctttggccgagtgagtcgatgataatacaagacatctgggagacaggatgcatctccaaacaacgtgctg

SEQ ID NO: 53402 - DNA, 601 bp, Human
agtgctcaaccttcacggcctcagtttttccatctgtaaaatgggaccctcccactgctgtagctctggggagtggagccatatggaacacagcccagttttgcctggggacagctaagcattttcatttaggttccccagagtcaaccaagaaaaatggtttgtggtttgttggttttagaacatgcaagaatagcctgggcagagaggacagggccaggagtatgggggacacggattcctaggaggcgccaaatcagaaggtgacctgcaacagcagccggggcagaaagtcctaccrgactgtgctgacacaaaagaaaaagcagaaactgaactatcgtttaaaaaacaacaacaacaacaacaaccaggaagcccacaagaataccccgaacaatgaaatcatctaggaatgtaaaaacaagactgttctccagtgcagaccagactcagatcccagttccccaaactcccgccagcaaagcagaaagaccatgggatggtgggtgcctggatatcatccgccagcctgactttatcttccagcttgtagaagactgtaactgcatttcttgtttgaaaatgatctgctttctgg

SEQ ID NO: 53403 - DNA, 601 bp, Human
ggacaggcagcgtcagccgccccatggaggcagatttctaaaggaaaaacttgaatgcacggccaggacgctttgctgaaatccaaagtccccagccgggcactttttaatctcctgtcttttctgattgcaaaacaccataagcagtgtcaacagggcagaaaggtccagataacacctcaggtgactctcaggctggggggaggagccccgcctgcatgacagggagctttggggtgggtcagagtcacaggatctctggatgcagtgggctgcttaggccaacaactgcctggaagtytactcctgcacagggcctaggcttccccacggctggccgggaaggcggggcacatggaagctctaaactgaagggaaactgaggctcagatcacgggtccaggaaagccctgagtcaggagggtaaacaactcgaagcccagcaatgggttcttaggtcctggcggcagtgctcaaccttcacggcctcagtttttccatctgtaaaatgggaccctcccactgctgtagctctggggagtggagccatatggaacacagcccagttttgcctggggacagctaagcattttcatttagg

SEQ ID NO: 53404 - DNA, 601 bp, Human
ggaccccgcccgctgcctggcctccacccggcaccccaacaggctctcccaggtctccctgcacccagcacagagcacaggctgaggccgtgcttgtgggaagcagaggaggagggggctgggcagggaccccggatgggatgcacggcctagaactccgggcctgaatcacaccacctgcttcttccaggacccagagcatctgggcagacactcagtcggcggctagggcctctggctctgctgcagctctggggccccctagctggaggggtgtgcccgacactacccctctgcccayggggatgggacggacatattctgccagggcccaaggggagggcagggaggaagtgccagacagcctcatgtccagcaaggctttcccagggcctgctggccacatgtccccgaagccaggtgggccccctcaccctgtccacctgcaccctggcaccctccggtggcaggcagagaccagcaggacacaggcaggggcgtggagaatggggcagaggtgccagctgtccaggacgggaggggcctgggggccagcagagaggcaggatggcatgggacagatggcgtgggacagacagtg

SEQ ID NO: 53405 - DNA, 601 bp, Human
tttacagatgtggaaacggccacccagaggagggctttccatccaaggtcacagagcgctgagcggcacgtgaacctgctctgaccccatgccagtgtccagagtgggttgagccctccctggagtagacaccgcttaaggacaaagcaggagacaggctggcgtgctagtggccagtggagatgcgcaggtggaggccagcagaccggggagccttggcctgagccccgcaattcctggttctgtctgtccctgcctggtggtcagccttgtttcctaggagtgaccctggagacctgaygccactggaatctcagggactaagcatctggagtgtggcagattcaagtcacacaatgcagacccgttccctgcaggcacctgccacatagcagcgcccccaacgccacgtcagatgcgcctccccccaccgacccgctgctcacctggcttcatggcacccatgacggcacgggagctccgcagcactgcctcatagacggccttctggtctgcagtgaacttgccgttggcgggaaaggagcaggtgatgtcggaagcgaagcagtaatactcaccgcccatgtcgaacaggctgcgg

SEQ ID NO: 53406 - DNA, 601 bp, Human
accacaggccaggcggccttgcaggtgctttacacagcttaactcagtctccatgagtcggctgcttccccatttacagatgtggaaacggccacccagaggagggctttccatccaaggtcacagagcgctgagcggcacgtgaacctgctctgaccccatgccagtgtccagagtgggttgagccctccctggagtagacaccgcttaaggacaaagcaggagacaggctggcgtgctagtggccagtggagatgcgcaggtggaggccagcagaccggggagccttggcctgagcccygcaattcctggttctgtctgtccctgcctggtggtcagccttgtttcctaggagtgaccctggagacctgacgccactggaatctcagggactaagcatctggagtgtggcagattcaagtcacacaatgcagacccgttccctgcaggcacctgccacatagcagcgcccccaacgccacgtcagatgcgcctccccccaccgacccgctgctcacctggcttcatggcacccatgacggcacgggagctccgcagcactgcctcatagacggccttctggtctgcagtgaacttgccg

SEQ ID NO: 53407 - DNA, 601 bp, Human
gtgtgatcttggctcactgcaacctccgcctcctaggttcaagcgattcgattctcgtgccttggcctcccgagtagctgggattacaggcatgaaccatcacgcccagctaatttgtgtaattttagtagagacagggtttctccatgttgcccatgctggtcttcaactcctgacctcaagtgatccgcccgcctcccaagtgctgggattataagtgtgagccacagagcccggcctgctgctttttaagcaaagcaattccgcagaaaatgctgttttcctcggcagctgctaaacyaggtgagtccgatcagcgctgtcaccccatcacaagcttattgacttttggattttctgtcctgtcttccttttggggcacatctggggtccccctgcttgcactcatgcgtttgtcaagctctgttcctgttggatgcgtgaaggtgtggggctggggcctggcactgcccccagcgtccctccgcggctcctcagcctctggtgggggctctggaggctggactgggcaccatctgcaaaggcctgcccacagtctgcctcctctgaaagcgacggtggctgagggcccctctgaagc

SEQ ID NO: 53408 - DNA, 601 bp, Human
cacccaggctggagtgcagtggtgtgatcttggctcactgcaacctccgcctcctaggttcaagcgattcgattctcgtgccttggcctcccgagtagctgggattacaggcatgaaccatcacgcccagctaatttgtgtaattttagtagagacagggtttctccatgttgcccatgctggtcttcaactcctgacctcaagtgatccgcccgcctcccaagtgctgggattataagtgtgagccacagagcccggcctgctgctttttaagcaaagcaattccgcagaaaatgctgtyttcctcggcagctgctaaaccaggtgagtccgatcagcgctgtcaccccatcacaagcttattgacttttggattttctgtcctgtcttccttttggggcacatctggggtccccctgcttgcactcatgcgtttgtcaagctctgttcctgttggatgcgtgaaggtgtggggctggggcctggcactgcccccagcgtccctccgcggctcctcagcctctggtgggggctctggaggctggactgggcaccatctgcaaaggcctgcccacagtctgcctcctctgaaagcgacggt

SEQ ID NO: 53409 - DNA, 601 bp, Human
tgtgatggtgacacagttcgcaatgacacagcccaccttggcacagctacagagtgggaggccagccctgtacgtgaagggtgtctgagagactctggcccacctgagaggctgtgcccggcggagggctctccgtggagggtacaggagctgggctcacagatactaggtgaatacaccacaggccacgctcacctgccaaatcctcctgctggatctgaaacactgatcattcattcgagtgactagtggtatttaaaactgagcaagaaattctcatccccagaatgaaggaaggagraggagtggcgcccctgggcgactgcttcgtggaggctggattggatttgacagctaacgggggatgcttcccatggctgaagagtcagaaagaataagaagggacgcagcaagcaaactgtcccgtcccttcctgcacctcctttatggttttcacaggcgcacgggaattcacgctctcactccctcttccttttacccacaagggcccgctggccataccctctggcgctcttctgtcctcacccacccatctgcctggagacacctgtatattcatactcaggggtggcagctcctt

SEQ ID NO: 53410 - DNA, 601 bp, Human
cctctggcaccctgatgggcccggcactgcctgctgaccaagctgagctcctcagcctgatgcttgggtgtacagggttgctgggcttggtgggcccccgcccctcacaggctgcaaagctctgcttcgccgctgggaggctcagccccttgcagcctggggctctgactttctggacatctggatttcacgactgcccgtggatgtctgacactaccacttgatgtgatggtgacacagttcgcaatgacacagcccaccttggcacagctacagagtgggaggccagccctgtacgtgragggtgtctgagagactctggcccacctgagaggctgtgcccggcggagggctctccgtggagggtacaggagctgggctcacagatactaggtgaatacaccacaggccacgctcacctgccaaatcctcctgctggatctgaaacactgatcattcattcgagtgactagtggtatttaaaactgagcaagaaattctcatccccagaatgaaggaaggagaaggagtggcgcccctgggcgactgcttcgtggaggctggattggatttgacagctaacgggggatgcttcccatgg

SEQ ID NO: 53411 - DNA, 601 bp, Human
tttcctgcaggtgaggccagccagggctgggccatccctggtttcagcacaggagactgaggggtaagacaatggctttcccaccaaacaccccccaggccttggcccctatgctgcgtcaatccgccgccctgctccccgtggcctggtgctacctctggcaccctgatgggcccggcactgcctgctgaccaagctgagctcctcagcctgatgcttgggtgtacagggttgctgggcttggtgggcccccgcccctcacaggctgcaaagctctgcttcgccgctgggaggctcagcyccttgcagcctggggctctgactttctggacatctggatttcacgactgcccgtggatgtctgacactaccacttgatgtgatggtgacacagttcgcaatgacacagcccaccttggcacagctacagagtgggaggccagccctgtacgtgaagggtgtctgagagactctggcccacctgagaggctgtgcccggcggagggctctccgtggagggtacaggagctgggctcacagatactaggtgaatacaccacaggccacgctcacctgccaaatcctcctgctggatctgaaa

SEQ ID NO: 53412 - DNA, 601 bp, Human
gcctgtgcctgccccaagagtcagcatgaaccaggcagcaccacgggatgggagacccagctcaggcctttctcagtgccacatggggcctggggacttgccccgaggtctggccactttctggacagaattggggctgctgagttgggccagggagctggccaggatgccagctgtggagatgccacccaggtcctgcccaggccgcagcaggctttcctgcaggtgaggccagccagggctgggccatccctggtttcagcacaggagactgaggggtaagacaatggctttcccaccraacaccccccaggccttggcccctatgctgcgtcaatccgccgccctgctccccgtggcctggtgctacctctggcaccctgatgggcccggcactgcctgctgaccaagctgagctcctcagcctgatgcttgggtgtacagggttgctgggcttggtgggcccccgcccctcacaggctgcaaagctctgcttcgccgctgggaggctcagccccttgcagcctggggctctgactttctggacatctggatttcacgactgcccgtggatgtctgacactaccacttgatgtgatgg

SEQ ID NO: 53413 - DNA, 601 bp, Human
acgggaggcgacctgccccatccggagggcagctctgtgggcccagggcctgccccacgggccttcactgtgtgtgatccagatggagtccaactctgcccttgggggacaccaatgccacacagctcagtgtgggtggtaggtgtgggggggctgctggggggctgctccattcccttacacagggatcctccagaccccaggctgggtctgggcagcgaagcccagtggtgggtgggagcggggctgggggaggacctgcctcccatggtctgagatgagcctagctggatttggcctkgtggccccagacacccctgccaggcctgaggcctgtgcctgccccaagagtcagcatgaaccaggcagcaccacgggatgggagacccagctcaggcctttctcagtgccacatggggcctggggacttgccccgaggtctggccactttctggacagaattggggctgctgagttgggccagggagctggccaggatgccagctgtggagatgccacccaggtcctgcccaggccgcagcaggctttcctgcaggtgaggccagccagggctgggccatccctggtttcagcacaggag

SEQ ID NO: 53414 - DNA, 601 bp, Human
ccaggaattgaacccacgaacccagggcatttccgctgggacaaggcagggggctgacctggccacggcctcctcgatgctacgggaggcgacctgccccatccggagggcagctctgtgggcccagggcctgccccacgggccttcactgtgtgtgatccagatggagtccaactctgcccttgggggacaccaatgccacacagctcagtgtgggtggtaggtgtgggggggctgctggggggctgctccattcccttacacagggatcctccagaccccaggctgggtctgggcagcraagcccagtggtgggtgggagcggggctgggggaggacctgcctcccatggtctgagatgagcctagctggatttggcctggtggccccagacacccctgccaggcctgaggcctgtgcctgccccaagagtcagcatgaaccaggcagcaccacgggatgggagacccagctcaggcctttctcagtgccacatggggcctggggacttgccccgaggtctggccactttctggacagaattggggctgctgagttgggccagggagctggccaggatgccagctgtggagatgccacc

SEQ ID NO: 53415 - DNA, 601 bp, Human
aaggtcacaggatgcagtcgggcagtctcggtggggtgtttgtcttggcccaggaattgaacccacgaacccagggcatttccgctgggacaaggcagggggctgacctggccacggcctcctcgatgctacgggaggcgacctgccccatccggagggcagctctgtgggcccagggcctgccccacgggccttcactgtgtgtgatccagatggagtccaactctgcccttgggggacaccaatgccacacagctcagtgtgggtggtaggtgtgggggggctgctggggggctgctcyattcccttacacagggatcctccagaccccaggctgggtctgggcagcgaagcccagtggtgggtgggagcggggctgggggaggacctgcctcccatggtctgagatgagcctagctggatttggcctggtggccccagacacccctgccaggcctgaggcctgtgcctgccccaagagtcagcatgaaccaggcagcaccacgggatgggagacccagctcaggcctttctcagtgccacatggggcctggggacttgccccgaggtctggccactttctggacagaattggggctgc

SEQ ID NO: 53416 - DNA, 601 bp, Human
ccccagggtcctgaccattctttcctgcctctcctttgggcttagctatggggtttcctgctttatttactctccctggaaggtcacaggatgcagtcgggcagtctcggtggggtgtttgtcttggcccaggaattgaacccacgaacccagggcatttccgctgggacaaggcagggggctgacctggccacggcctcctcgatgctacgggaggcgacctgccccatccggagggcagctctgtgggcccagggcctgccccacgggccttcactgtgtgtgatccagatggagtccractctgcccttgggggacaccaatgccacacagctcagtgtgggtggtaggtgtgggggggctgctggggggctgctccattcccttacacagggatcctccagaccccaggctgggtctgggcagcgaagcccagtggtgggtgggagcggggctgggggaggacctgcctcccatggtctgagatgagcctagctggatttggcctggtggccccagacacccctgccaggcctgaggcctgtgcctgccccaagagtcagcatgaaccaggcagcaccacgggatgggagacccagc

SEQ ID NO: 53417 - DNA, 601 bp, Human
gcctgtggactcccagccgccagggtagggtctccgtctgagcgagcgcagcctccttcctcgccgactgtgaatgacagtgaggaatgctcccccaccagccctaggatcaggggccaaggcctgcattcctcaaccccccagggtcctgaccattctttcctgcctctcctttgggcttagctatggggtttcctgctttatttactctccctggaaggtcacaggatgcagtcgggcagtctcggtggggtgtttgtcttggcccaggaattgaacccacgaacccagggcatttccrctgggacaaggcagggggctgacctggccacggcctcctcgatgctacgggaggcgacctgccccatccggagggcagctctgtgggcccagggcctgccccacgggccttcactgtgtgtgatccagatggagtccaactctgcccttgggggacaccaatgccacacagctcagtgtgggtggtaggtgtgggggggctgctggggggctgctccattcccttacacagggatcctccagaccccaggctgggtctgggcagcgaagcccagtggtgggtgggagcggggctggggga

SEQ ID NO: 53418 - DNA, 601 bp, Human
cgcgggacagggacagctgtgctgcttctaggaacagccttcctgctgtggctgtgccaatgcagaccctgactcagggccaccctgccgggctcgcccatccgtcccagcagcgcctccccccattcccctcaccatgcatgcaggggtctgcatggggtgggcagcctgccccaacacaggagccgcgctgagcttggatcccacccaacctcccgtgcatggcactccccgaggtcctgcagctgctgggcctgccctgccacccgcctgtggactcccagccgccagggtagggtcyccgtctgagcgagcgcagcctccttcctcgccgactgtgaatgacagtgaggaatgctcccccaccagccctaggatcaggggccaaggcctgcattcctcaaccccccagggtcctgaccattctttcctgcctctcctttgggcttagctatggggtttcctgctttatttactctccctggaaggtcacaggatgcagtcgggcagtctcggtggggtgtttgtcttggcccaggaattgaacccacgaacccagggcatttccgctgggacaaggcagggggctgacctggccacg

SEQ ID NO: 53419 - DNA, 601 bp, Human
atgcctatctgcctgagccctgcactccacgccgtctcggaggatgaggactgacaggaagtctagctgctgggcccctgcccctggcgctggctgggaggggagcaaagctggcagaggtgccccctgaccacggggccacaggagacacatgccaggtgggccggggcaggtgctgctgggcccctctcccagccacctggtcatcccgcgcctcagtgcccctctctcgccccgtcaggactgttttggaggtggggacacttcctgccacttctttcccctcctctgacctcacatyggcagcacccccgtcactcacaagtggccaggaccctgagggcagggacagagccaggagcgggggaacgaaacacaaaagagctcatgaatcgtgggccaccattgctgttccaggttgataggagctgggcccccagtgacaggggcacaggaggctcctgggtgagcacaggaaagagtagagaaaggcggggaggccagggagggtgggggggtgaggagagagggagctgggtcggggctgggaggcgaggctacaggaggctctggggcttgcaggcggagggcatggggccct

SEQ ID NO: 53420 - DNA, 601 bp, Human
gccagaaattctggggacccactcaccctgcgtgagagcagggtgctgtgttggcccaggctgctcctcgagtctcctcccccacaccctggcagagtgccccgaggagtaagaagaggccaaggaactggctcaccattgcggccggcaggaggggtggacatggtgcccacactgaagacagtcctccccgtcctggcacctgccgcagagggtatctatgactggggtggcacatggccgccatgcctatctgcctgagccctgcactccacgccgtctcggaggatgaggactgacmggaagtctagctgctgggcccctgcccctggcgctggctgggaggggagcaaagctggcagaggtgccccctgaccacggggccacaggagacacatgccaggtgggccggggcaggtgctgctgggcccctctcccagccacctggtcatcccgcgcctcagtgcccctctctcgccccgtcaggactgttttggaggtggggacacttcctgccacttctttcccctcctctgacctcacattggcagcacccccgtcactcacaagtggccaggaccctgagggcagggacagagcc

SEQ ID NO: 53421 - DNA, 601 bp, Human
acagcaggctccggccggggtcccagggcaggccctgagggctggctgagctggcacggggctgaggacctccagctcaccccaccctgcacgggacgtgagtagaagaaccccatctgctgccagaaattctggggacccactcaccctgcgtgagagcagggtgctgtgttggcccaggctgctcctcgagtctcctcccccacaccctggcagagtgccccgaggagtaagaagaggccaaggaactggctcaccattgcggccggcaggaggggtggacatggtgcccacactgaaracagtcctccccgtcctggcacctgccgcagagggtatctatgactggggtggcacatggccgccatgcctatctgcctgagccctgcactccacgccgtctcggaggatgaggactgacaggaagtctagctgctgggcccctgcccctggcgctggctgggaggggagcaaagctggcagaggtgccccctgaccacggggccacaggagacacatgccaggtgggccggggcaggtgctgctgggcccctctcccagccacctggtcatcccgcgcctcagtgcccctctctcgccc

SEQ ID NO: 53422 - DNA, 601 bp, Human
agaggaacaagccccgctgctcctgccacccaggccccaggtgtggccagcgtagcccctgagtggtcttctgggtccacttggtctcctcaggcagcacccgctcctgctgggcctagggcccaggccagctccttggagcctcaaagcatccatcacagccccgaggcctcctacccggagtgtgacagccccagggggctcccgggcctgaccgagctacaaaggcagcatcctcagagctgcctccagacaaagagcgcacttcatctgtggaacatggccctcgggatggatgggwgtgagccaggctctaggggtgtaggacagcaggctccggccggggtcccagggcaggccctgagggctggctgagctggcacggggctgaggacctccagctcaccccaccctgcacgggacgtgagtagaagaaccccatctgctgccagaaattctggggacccactcaccctgcgtgagagcagggtgctgtgttggcccaggctgctcctcgagtctcctcccccacaccctggcagagtgccccgaggagtaagaagaggccaaggaactggctcaccattgcggccggcaggag

SEQ ID NO: 53423 - DNA, 601 bp, Human
atccaaggggtctctgcataaaagctgtcccctctcagaggagaccttcctgccttgctgtcccaggcctggtgatttctccttgcacggtccatccagcctgcagccgtcccctggacggatctgctcgtttgcttctcatgtctcactccgagggtgggggtctcccgagggcaccgctgggcctggcataaagtgagtgcccctcaggtctcccaacagcctgcaaagttggcacatggggctgggaggcctcctgtgagtggctcgtgccccaagcccagctcaactgcttcctctyggacgcgcccttctctggtcaccaaaggggagccccgggaagtgcagccagctttccaaccaggctaacttcagcagtgggctacgttcttggcccagcctccgcagagggcgggaatcaggtataaatcatgctctgcggtggcccttcccgggggcaggcccggcgccgcccagatgtgccggcccgggggtccccttggcgccgctggtcttccttgcctgtgcaccctcggggaaggccttgcacacagctctcttggccgggagcagggagtttctgcctgtgtgtggttagggt

SEQ ID NO: 53424 - DNA, 601 bp, Human
gcagggagcaaaggtttctggggagaaggtgcggctggcacggccccacgagctggctggcaggggttcggggccccgcctgccaacagcaggggcaccatctccaggggagccagatgtccaactcccggcttcaaatccaactcatctctgccgcatgtttgtggggcaaaggccaccaaagagagaacttcctaagcacagagctttgggggccacacaggctctgtggggctctggagcatggccgctaggaaggaggcccttagagagctctccacgtagagcctcagcagcccaygggtgcgcccgtcccatccccggactctgtggaatcccagcatcagcctctcctcatggtagcttccactgctggacttggcttgagcaccagataaggactcgaggccggtgaggcctcctgccctggccccatgggggctgggtttgggcaggccacgtgctggcagaggccggggccccaggacactctggccaggcacgtggcggggggcccctatcaatgtgcagctcactggctggagagggcgcccagcaagtccctgcggcacctcctggagaggtccagccccaccaggcg

SEQ ID NO: 53425 - DNA, 601 bp, Human
gaggggtccctgcacatcccagaatggggatgaaacacccctggagctgctgcagggagcaaaggtttctggggagaaggtgcggctggcacggccccacgagctggctggcaggggttcggggccccgcctgccaacagcaggggcaccatctccaggggagccagatgtccaactcccggcttcaaatccaactcatctctgccgcatgtttgtggggcaaaggccaccaaagagagaacttcctaagcacagagctttgggggccacacaggctctgtggggctctggagcatggccsctaggaaggaggcccttagagagctctccacgtagagcctcagcagcccacgggtgcgcccgtcccatccccggactctgtggaatcccagcatcagcctctcctcatggtagcttccactgctggacttggcttgagcaccagataaggactcgaggccggtgaggcctcctgccctggccccatgggggctgggtttgggcaggccacgtgctggcagaggccggggccccaggacactctggccaggcacgtggcggggggcccctatcaatgtgcagctcactggctggagagggc

SEQ ID NO: 53426 - DNA, 601 bp, Human
aaacatgcacgtctccccagtagcagacaccaggagactctgtgggctctggccctgaggctcagacccaaaccctggctcagagctccgatggggttttgctgctgtggtgcagtggggaagcccgaggctgaaaagaggggtccctgcacatcccagaatggggatgaaacacccctggagctgctgcagggagcaaaggtttctggggagaaggtgcggctggcacggccccacgagctggctggcaggggttcggggccccgcctgccaacagcaggggcaccatctccaggggagccagatgtccaactcccggcttcaaatccaactcatctctgccgcatgtttgtggggcaaaggccaccaaagagagaacttcctaagcacagagctttgggggccacacaggctctgtggggctctggagcatggccgctaggaaggaggcccttagagagctctccacgtagagcctcagcagcccacgggtgcgcccgtcccatccccggactctgtggaatcccagcatcagcctctcctcatggtagcttccactgctggacttggcttgagcaccagataaggactcgaggccggt

SEQ ID NO: 53427 - DNA, 601 bp, Human
aaatccctgggcaccaggagaaacatgcacgtctccccagtagcagacaccaggagactctgtgggctctggccctgaggctcagacccaaaccctggctcagagctccgatggggttttgctgctgtggtgcagtggggaagcccgaggctgaaaagaggggtccctgcacatcccagaatggggatgaaacacccctggagctgctgcagggagcaaaggtttctggggagaaggtgcggctggcacggccccacgagctggctggcaggggttcggggccccgcctgccaacagcagkggcaccatctccaggggagccagatgtccaactcccggcttcaaatccaactcatctctgccgcatgtttgtggggcaaaggccaccaaagagagaacttcctaagcacagagctttgggggccacacaggctctgtggggctctggagcatggccgctaggaaggaggcccttagagagctctccacgtagagcctcagcagcccacgggtgcgcccgtcccatccccggactctgtggaatcccagcatcagcctctcctcatggtagcttccactgctggacttggcttgagcacca

SEQ ID NO: 53428 - DNA, 601 bp, Human; identical to SEQ ID NO: 18394

SEQ ID NO: 53429 - DNA, 601 bp, Human; identical to SEQ ID NO: 18395

SEQ ID NO: 53430 - DNA, 601 bp, Human; identical to SEQ ID NO: 18396

SEQ ID NO: 53431 - DNA, 601 bp, Human; identical to SEQ ID NO: 18397

SEQ ID NO: 53432 - DNA, 601 bp, Human; identical to SEQ ID NO: 25654

SEQ ID NO: 53433 - DNA, 601 bp, Human; identical to SEQ ID NO: 25655

SEQ ID NO: 53434 - DNA, 601 bp, Human
gtaggtaaggaaatgcgttgtggaatgactggatttataatattttcttttgggaaaaagagtttacagctgtgtttatagcaatgtctggaagccctggccagaaatgaaaaatgctgctttctatagagaggctgcacacatagcaagtgataatcatttgtttctagagaaattctgaaccaaagctacaactaatgtttcctaaaggtgtaccaatataaaaaggtgtctaaatggaatgtttattgtctttagaaatgataagatttgactttatttgaaaaacttgggtatccttggtttacttagctctttgcctgtttctctttcatccccttttgcatgtaaattaagcaataacttggaaaaaagttagtatgcaataattttcatttcaaactgaaagcactctagttcccttaatgcaaggttctttttcagtaaccgtatgttagccaattattttcttgtctcaatgttaatctattaaaatatgtggttgttttatgatagacaaaaattttaatttcagaaaatatgtttcttaaatggcttaaatacttcctttgactagaaatgacatagtatgccatagaat

SEQ ID NO: 53435 - DNA, 601 bp, Human
tcatccccttttgcatgtaaattaagcaataacttggaaaaaagttagtatgcaataattttcatttcaaactgaaagcactctagttcccttaatgcaaggttctttttcagtaaccgtatgttagccaattattttcttgtctcaatgttaatctattaaaatatgtggttgttttatgatagacaaaaattttaatttcagaaaatatgtttcttaaatggcttaaatacttcctttgactagaaatgacatagtatgccatagaattatcaaccaatttaaaaggagaatgttacgyatataacatacctcttctttgatagtagaggtttttaattttttagacgctgttaactgtcagcatgtcattggatgaatgtctctcagataactatggaggtaaatcagaaaagacaacttctcactcaggcagcttctactttgaaaacctttctccctcaaccccatgcatgacagtccaataaagtcagaactggggttagcaaactggggaggaattttatgcaatcttagggtttagaatgtaatcattaaatcgcaaaacacttaaccctcctgtaaattatacagtatatat

SEQ ID NO: 53436 - DNA, 601 bp, Human
acatacctcttctttgatagtagaggtttttaattttttagacgctgttaactgtcagcatgtcattggatgaatgtctctcagataactatggaggtaaatcagaaaagacaacttctcactcaggcagcttctactttgaaaacctttctccctcaaccccatgcatgacagtccaataaagtcagaactggggttagcaaactggggaggaattttatgcaatcttagggtttagaatgtaatcattaaatcgcaaaacacttaaccctcctgtaaattatacagtatatatttttttgcttgtctgtaactatgtttcttgtttttagatgatagggaaattggtgacttcagcatgagagagactttctagaataaactagagtgattcaataaactaattaatatgcactgatgcagaaaagccaggatttggggccatttaactatttatttttagaaaaatgttatacttttaatatttatattttctaataatactgtgtttttaaattataaagggctgattataattaaagtcaataaaacaccttctgcatgaaattagctgctgtaattgaggatgagtgggcaggta

SEQ ID NO: 53437 - DNA, 601 bp, Human
aaaaaaaaaaatacctctgctttcttttttcctttcactttttgaaacgaagagagcgcgataggaagtaggaaagggtgggcgaggggccctgggcggctgctttcgctctgcgcgagttgggtctttgtgatataaaattcgccgagcgccgcgagccgtgctttgccaatggcgcgctcggcgcggggcgcgggctccgggttggggcgagccaacgccggggtttctttgtgtttctgcgagagcgactctcccggtccggagtcagataacagcctgggcccgagcctcgccggcwttccccggcccttacaggccctgcccaggctccgctagtgccggccggcctgctccctgcctctcccggcttcctctctctttagccggcctctctctctccgccctctccctccgtctctttctccgagcacactgattagacagacgccagacctccgctctctgcttgtctctcactgggggggttccccgccgggctggggctggggcttcggggtttgtgggagagtcgttccggagtggccacaggccgtctggggtggaccctcgtgccttttgcaaaagcgcctcaccctcc

SEQ ID NO: 53438 - DNA, 601 bp, Human
aaggccaaactgttgagtgcaacttaaagtgggaactttttatagctgctgggcactaccaggcctgtcctggggagaggagaggaaggctggattgcaggaaggatgcttcagatagattccccacatgggccatagggcagcctctgctgcctgtttcccccacctgcagtatccagattgggatgccctctcctgctccctttcctgagcccaggccccccgggcctgctgggccccagggaatctcctcaagccctcggttttctctagcgccctggctgggcctccaggagatgcyctgggcagtggagcagccctgacattgtctctgcagggaaaagtttgcctgctaactcaataggagttggagctccaggcaaatccaacctgagggcagcaattttcaaaatcatattcttactggaataatgcagactgccaggagaggcgaaaagatgtgtcaggatggggcaacaggaggaaagggaccgtcataactcttcagaatgtctgcaggaggttgaagactctggcctcttgcttcccctgcccaagcaaacacttaaggcaattttcaaacaacccaaagtgtatgcca

SEQ ID NO: 53439 - DNA, 601 bp, Human
aggcctgtcctggggagaggagaggaaggctggattgcaggaaggatgcttcagatagattccccacatgggccatagggcagcctctgctgcctgtttcccccacctgcagtatccagattgggatgccctctcctgctccctttcctgagcccaggccccccgggcctgctgggccccagggaatctcctcaagccctcggttttctctagcgccctggctgggcctccaggagatgccctgggcagtggagcagccctgacattgtctctgcagggaaaagtttgcctgctaactcartaggagttggagctccaggcaaatccaacctgagggcagcaattttcaaaatcatattcttactggaataatgcagactgccaggagaggcgaaaagatgtgtcaggatggggcaacaggaggaaagggaccgtcataactcttcagaatgtctgcaggaggttgaagactctggcctcttgcttcccctgcccaagcaaacacttaaggcaattttcaaacaacccaaagtgtatgccaacttgggctggatatggatgttgctagagatataaaaccatcattgactgcattatgcaa

SEQ ID NO: 53440 - DNA, 601 bp, Human
tagattccccacatgggccatagggcagcctctgctgcctgtttcccccacctgcagtatccagattgggatgccctctcctgctccctttcctgagcccaggccccccgggcctgctgggccccagggaatctcctcaagccctcggttttctctagcgccctggctgggcctccaggagatgccctgggcagtggagcagccctgacattgtctctgcagggaaaagtttgcctgctaactcaataggagttggagctccaggcaaatccaacctgagggcagcaattttcaaaatcayattcttactggaataatgcagactgccaggagaggcgaaaagatgtgtcaggatggggcaacaggaggaaagggaccgtcataactcttcagaatgtctgcaggaggttgaagactctggcctcttgcttcccctgcccaagcaaacacttaaggcaattttcaaacaacccaaagtgtatgccaacttgggctggatatggatgttgctagagatataaaaccatcattgactgcattatgcaatctaattagtttgcatgtagtttaacctgtgtgagtaatagagctgatactaatt

SEQ ID NO: 53441 - DNA, 601 bp, Human
tttcctgagcccaggccccccgggcctgctgggccccagggaatctcctcaagccctcggttttctctagcgccctggctgggcctccaggagatgccctgggcagtggagcagccctgacattgtctctgcagggaaaagtttgcctgctaactcaataggagttggagctccaggcaaatccaacctgagggcagcaattttcaaaatcatattcttactggaataatgcagactgccaggagaggcgaaaagatgtgtcaggatggggcaacaggaggaaagggaccgtcataactcytcagaatgtctgcaggaggttgaagactctggcctcttgcttcccctgcccaagcaaacacttaaggcaattttcaaacaacccaaagtgtatgccaacttgggctggatatggatgttgctagagatataaaaccatcattgactgcattatgcaatctaattagtttgcatgtagtttaacctgtgtgagtaatagagctgatactaattaacttgaggcaaaatgatttttgaaggtgtctggctttccattttgggccacacctgagctttttggctgcctccaggctgagttcag

SEQ ID NO: 53442 - DNA, 601 bp, Human
caccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataat

SEQ ID NO: 53443 - DNA, 601 bp, Human
caaagctggtctatcatattcagtcccattacagtaaatcatgtttcatcaaatttaaagttgcttcaaagtctcccaaaataaagcctgttctttgatgtgttcacttctctgcttagagtaactagaaatatacgtgatgagatggacttcaacccctggacatcagtgcttttccaaattcatatttccctcctatttttctagccacgactcccgtttctttccaacttcccttcccctcccatctcagtaatcagttttctttctgggcaaacgcaaagtggattctgtctacagsactgcggtaggcaatagtaaaacagaaaaaatggagggagattgggaaagaaactgaggtagccaccagaaccggaaaggagaaaacgtgcattctaacattccatgaataagaaggaaggcgtcgcccccatcagaactgcagagtcatagcaggccccagccatttccaagcacactcccgcaatcttcctagtcagacagcgggaactcacacacaaagacaagaggactgcaggaaaaaagttgatgaccagatgccaattccctacaagaattgtagtccactgcgggtatacga

SEQ ID NO: 53444 - DNA, 601 bp, Human
atccaaaggtcaaacacacaccaaaagggactaaaataaccaagtgattcgaacaatttaacaatctgaaacaccacaggattatgatttgacatgtcaagcagtttaagagacttttaagtttaataaagctgaaagtgagttcatacgaatattctatcgtagaaacaaaatcaggatctaagaggccaggtcatagatgctgtagagtaggtaaaactaaagcagtgcttctccatagtgctgggcagttcacaaaaaccaccttaatagccattatggactaacttttattcaaaaygttaaaagaaactgcttaataagttgtaatgtggcatgcaactttaaccaaaagaatgccttactcacctctaccagctctgccgacagccacattgtatgttggctccccaccttgactctttgtccggatgtccattgtgcagtcaccatcgacgtatagactatctctgatcactgagcatttcttcgcgccaagagtcaaaccgttggtaaagaaaccttcccggtcttttcctacaatcatatctatttctattggctgccccccaccaaaaagaaaaaaaaaaaaacacacaca

SEQ ID NO: 53445 - DNA, 601 bp, Human
ttcaccgtagtagccttgtttttaattgcgtctaaaaaaataggtttacgatttctaattgctcttctatgatgcaattcaaaggtgtataacccaaaatatatgtatatgtcaaattttatattcactaccactagatgtcagtagtgctgtatcgtataaaatattctggttttttgtcttgtgtttgacgcttcttttcagcgtatagtgcagctaaggtttaaagagatttgtcactatttcaaagtcatctaattttcttataaatccttataaacatcaactcacaccagaatasgagtaacttttaggataatcacagggagctggtagagccatagcattaattataactcacagcagcttcaactcccctcacatggtagagctgttattaaaattagatgtgccaagtcagctatgtgaggctacagaagcactctctatttacaaaatattcgtatgcgttaacacattaaaatgtatttgtaaatcaattagatgtcataataaaactcaatttcaaaagtttattttgaaaaagtagggagacttctttagtgcaattaagagtttctataatgctgacaacagtctg

SEQ ID NO: 53446 - DNA, 601 bp, Human
ccagaggaaaatgaagatcaaattttaagtagcatactcagtatcattcagaaaaggccaaattaaattatttaaggtgtttgcttactgataacttcaccgtagtagccttgtttttaattgcgtctaaaaaaataggtttacgatttctaattgctcttctatgatgcaattcaaaggtgtataacccaaaatatatgtatatgtcaaattttatattcactaccactagatgtcagtagtgctgtatcgtataaaatattctggttttttgtcttgtgtttgacgcttcttttcagcrtatagtgcagctaaggtttaaagagatttgtcactatttcaaagtcatctaattttcttataaatccttataaacatcaactcacaccagaatacgagtaacttttaggataatcacagggagctggtagagccatagcattaattataactcacagcagcttcaactcccctcacatggtagagctgttattaaaattagatgtgccaagtcagctatgtgaggctacagaagcactctctatttacaaaatattcgtatgcgttaacacattaaaatgtatttgtaaatcaattagat

SEQ ID NO: 53447 - DNA, 601 bp, Human
tttttgtagacacaaggtctccctatgttgcccaggctggtcttgaactcctgggctcgagcgatcctcttacctcggcctcccaaagtgctaggattacagatgtcagccactttgcctggcctcatgttatcatcttacattatcacaagaagagtgagtacagtactataagatgttttgagagaaagggaccacatacaaatagctcttattacagtatattgttgtaactattctattattgttgttgttaatctcttcctattgttcttaatttataaatttaactttatcatagatatgcatatatgggaaaaaacatagcatatataggattcggtactatctgtggttttaaggatccactgagggtcttgaaatgtatccccttggacaagggggaactactgtatatctaagcatgatggccccataccagtcccagagccaggcctggggaacatcaagagagtcgctttgcctctggcctgagcctacctggaatcctgtggactaggtctgtctcctccacccgaagacttttgggatggagccagcattgattttggagtcagatacatgtggctttcccactatt

SEQ ID NO: 53448 - DNA, 601 bp, Human
ccatcatgtaggcatcttattatctttttttttttgaggtgagctctcactctgttgctcaggctggagtgcagtggcatgatcatggctcactgcagcctccacctctcaggtgatcctcccaccttagcctcccaagtagctagaattatagccacatgccaccacacccggctaattttggtattttttgtagacacaaggtctccctatgttgcccaggctggtcttgaactcctgggctcgagcgatcctcttacctcggcctcccaaagtgctaggattacagatgtcagccacyttgcctggcctcatgttatcatcttacattatcacaagaagagtgagtacagtactataagatgttttgagagaaagggaccacatacaaatagctcttattacagtatattgttgtaactattctattattgttgttgttaatctcttcctattgttcttaatttataaatttaactttatcatagatatgcatatatgggaaaaaacatagcatatataggattcggtactatctgtggttttaaggatccactgagggtcttgaaatgtatccccttggacaagggggaactactgt

SEQ ID NO: 53449 - DNA, 601 bp, Human
aaaaataaagtgggtcaatttaaagataaatattacattatgacagttcaagtggtacaccaaattggtaaaaggcgaaagacttatacaatctgaagagtaaccagagtatagtacaccaaactggggggaaaaaaacctggggtggtgattcatggatgcccagagtctgggaaacacagtaatatagcctgggaaggaggtttagacctaaagtcctttccttgtctatttcttttgtgaaaaatgccggtcgcagctcaataagtggacttcatactctgctaacatgtggctgcasctggcagagcactgctctcgcctgagcttggggtgaggctcttgaccccaccgccctgagctccttccctgctcagccacggctctgtcactcgctcaaggtgggcagcttggcttcaccatgtccaaggccgtggcaggcagcatgttggctcaaacaagttggacttgttttgtgaatgtgccttcgtgtgagtgtgaatgtgtgtacctacagagggtgcagcaaagtggggtgcagggggaacaaacgggtccaggccttctccctgggggaagggccaggatgctcccatccaag

SEQ ID NO: 53450 - DNA, 601 bp, Human
cctggagcttgtgctgaccctggggtggccatggaactgcagtgacctgggccctggatgccccaccagctggccctagcttcgtcctccaggtgagactcgactggcaccacagcaggccagagtgtagaagcccctgcaggtggtagagggcagtgactgttgattgctcaggcaggctcccctgggatgcccccttagaggccaagtgatctcaacccctccagtaagtcgacttctcggctctactctgctcagaaggtggcggcagttcagcaaattccccaagcatcagtttttmtcagaccggctttccaagatgggctgagctcaagatgttcccggtcctgggtagggtggaaactccaagtctttctgcacttagatctcctccttattgtccctccccatttaattattcaagcccttaagctctgaatggccagagcccaaagtcttacagacccatgtgtggctgaatctgtggacttctcagccatgctgagacagacaagccctgtggaattaaaacatggcatcgagaccttcacacatcaaggttaccccaacactagtggctgacgagtcaggcttgccttct

SEQ ID NO: 53451 - DNA, 601 bp, Human
gtgtgagccacaatctgtgaatatgctacctgacttttcaaaagggactctgcagatgtcattaagtgaaagatcttgagatgagattatcctggatcatctaggtgggtccagtgtgaccccgagtgtacttctaagtggaagatggatgtaggagcatcagtcgtaggaggagacgcagcaacagaggcagaggctggcatgatgagattgctggctgggccaagagccaaggaatgcaggcagcctccagtagctggaaaaggcaggaaaaaagaatctcccctagagcatccagaargaatgcttccctgcagattcattttttactttggaactgtaagagagtaaatgtgtgttgctttaagccaccgagtttgtgataatttgccagagaagcaatcaaaaatgaattcaggtggaaaactaaaagggtatggcatccagcagccaggtgaagaaagtgtactggaggggaggaagggtgatcaatggtgtcaccagttgctgccaggccatgcaaggtaaggtgagcactgaccaccgggtggaggaaggcgaaggtcctggtaacgccagcaagggctgtttctgtgatgtg

SEQ ID NO: 53452 - DNA, 601 bp, Human
ctactaaaaatacaaaaattagctgggcgtggtggtgtgtgcctgtaatcccagctacttgggaggccgaggcaggagaattgcttgaacctgggaggcggaggttgcagtgagccgagattgtgccattgcactctagcctggtgacagagggagactcataaaaaaaaaaatcactgagctgtatgtttaaactttgtgcacctttctgggaaatgagaagtgagagaaactaacaatggagactgagaagtcacaaccggggtctggatggtgtgtgagccacaatctgtgaatatgytacctgacttttcaaaagggactctgcagatgtcattaagtgaaagatcttgagatgagattatcctggatcatctaggtgggtccagtgtgaccccgagtgtacttctaagtggaagatggatgtaggagcatcagtcgtaggaggagacgcagcaacagaggcagaggctggcatgatgagattgctggctgggccaagagccaaggaatgcaggcagcctccagtagctggaaaaggcaggaaaaaagaatctcccctagagcatccagaaggaatgcttccctgcagattcatttt

SEQ ID NO: 53453 - DNA, 601 bp, Human
catcctggccaacatagtgaaaccccgtctctactaaaaatacaaaaattagctgggcgtggtggtgtgtgcctgtaatcccagctacttgggaggccgaggcaggagaattgcttgaacctgggaggcggaggttgcagtgagccgagattgtgccattgcactctagcctggtgacagagggagactcataaaaaaaaaaatcactgagctgtatgtttaaactttgtgcacctttctgggaaatgagaagtgagagaaactaacaatggagactgagaagtcacaaccggggtctggrtggtgtgtgagccacaatctgtgaatatgctacctgacttttcaaaagggactctgcagatgtcattaagtgaaagatcttgagatgagattatcctggatcatctaggtgggtccagtgtgaccccgagtgtacttctaagtggaagatggatgtaggagcatcagtcgtaggaggagacgcagcaacagaggcagaggctggcatgatgagattgctggctgggccaagagccaaggaatgcaggcagcctccagtagctggaaaaggcaggaaaaaagaatctcccctagagcatcc

SEQ ID NO: 53454 - DNA, 601 bp, Human
cactatgctgcccaggctggccttgaactcctggtctcaagctctctttctgccttggcctcccaaagtgctgtgattacaggtatgagcccatacccagagcattcaaatatttattagtacctattggtatgtaccagtggtgcctgtgtgtgctagagaaatccaggtgaactagacaagtccagtccttggggagtttacagattagtagacaaaacaatagggaagacaagagccacagtggaaatatgttaaataagaaagaatgttatctgctgggtgtggtggctcacacctrtgatcccagcactttgggaggccgaggcaggtgaggtcaggagttcaagatcagcctggcaaacatggtgaaaccctgtctctagtaaaaatacaaaaattagctgggcatagtggtgggcacctgtaatcccagctactcgggatgctgaggcaggagaatcacttgaacctgggaggcagaggttacagtgagctgagatcgtgccactgcactctagcctggggccgggggaacacagcaagactctgtctcaataaaaaaaaaaaaaagttatgaatgctgtaagataggttcagg

SEQ ID NO: 53455 - DNA, 601 bp, Human
atggcgcgatcttggctcactgcaacctccgcctcctgggttcaagcgactctcctgcctcagcctcccaagtagctgggattataggcatgcaccaccacacctggctaatttttgtatttttagtagagacgaggtttcaccatgttggccaggctggtctcggactcctgacctcaggtaatccgcctgccttggcctcccaaagtgctgggattacaggcatgagccaccgtgcccggctatgtttcattcttaaagtatcttgcatatgctaatatttccttttcaattatgcacatacctcagttttccaagcaactcattcatccacttattcaaacatttatttattcattcattcatttttttgagacagggtctcactctgctgcccagactggagtacaaatggtgcagtcacggctcactgcagccttgacctcctgggctcaagcaatctcccaaatagctgggactacagacacatgaccacgcctggctatgttggaaaatttttttgtagacctaaggtctcactatgctgcccaggctggccttgaactcctggtctcaagctctctttctgccttggcctccc

SEQ ID NO: 53456 - DNA, 601 bp, Human
atacctatgagtgtcacccaggtacttatagctacatgaggactgggggggtcttaaccctgagagcaatgtgggtcttgattgagattttctatggttaacttcacttctaacccctgaaggagactcatgggacgggtagactgtaagagcctgctaagggagaggttttgctaactctctccggctgcaaagaaccgaggacaaaggcagaaatgagtgacttgcttgatggttctccatcctttccatcaactcccaaccttttaacaagacacagaaaagagatttttcttaatcttttttttttttttgatacaaagtctcgctcttgtcccccaggctggagtgcaatggcgcgatcttggctcactgcaacctccgcctcctgggttcaagcgactctcctgcctcagcctcccaagtagctgggattataggcatgcaccaccacacctggctaatttttgtatttttagtagagacgaggtttcaccatgttggccaggctggtctcggactcctgacctcaggtaatccgcctgccttggcctcccaaagtgctgggattacaggcatgagccaccgtgcccggctatgt

SEQ ID NO: 53457 - DNA, 601 bp, Human
ggagcaggaaacataactaatgggtactagacttaacacctgggtgacaaaataatctgtactacaaacccccatgacatgagtttacctatttaacaaacctgcacatgtattgctgaacttagaagtttaaaaaaaaaaaaagaataggagcaattagagaagattgagaaccactgttctgagtctatgtgctttagagaattttgcatgaaaagacaccagaaagagtaaacaggactagaaacccaggcaacctgggacatacctatgagtgtcacccaggtacttatagctacaygaggactgggggggtcttaaccctgagagcaatgtgggtcttgattgagattttctatggttaacttcacttctaacccctgaaggagactcatgggacgggtagactgtaagagcctgctaagggagaggttttgctaactctctccggctgcaaagaaccgaggacaaaggcagaaatgagtgacttgcttgatggttctccatcctttccatcaactcccaaccttttaacaagacacagaaaagagatttttcttaatcttttttttttttttgatacaaagtctcgctcttgtcc

SEQ ID NO: 53458 - DNA, 601 bp, Human
agaacacagagaactagaattctactccccctcttaaaggagaaattacaactaatttacttaggtaattttcaagcaagtttattgcaggttgcatggttcactctaagtatataatgacatactttcatgaatgaaattggtggctactagttttactgtaacaggattttaaaaatactttctatgcatcagacttcaaatatgttaaagcaaatcccaccaccttcaaatttgcttgcctggtattgctgtttaaatactttgcaatataccatcaaggtaagaaactgaagttatytggataatagtgttttggaggcagtgtttcacaatataaagtactgagttggaagttcatatttctcagttataagctttatgagtgttgctagcatcaagtttgttgttctcgaattttgttgttgtggctgagctctttttccatcagagagaaagagcaggtggggaaagtggtcattagagtcttctgcccaccttacaataccatgtcacccagcaatccagttactgggtatatacccagaggaatataaatcattccatcacaaagacacatgtacatgtatgttcattgcag

SEQ ID NO: 53459 - DNA, 601 bp, Human
ctctaattccatttctcattaggtaatctgaacatcattcaatgctaagcaacactggaaaggtcctactgggcacaagagaacacagagaactagaattctactccccctcttaaaggagaaattacaactaatttacttaggtaattttcaagcaagtttattgcaggttgcatggttcactctaagtatataatgacatactttcatgaatgaaattggtggctactagttttactgtaacaggattttaaaaatactttctatgcatcagacttcaaatatgttaaagcaaatcccrccaccttcaaatttgcttgcctggtattgctgtttaaatactttgcaatataccatcaaggtaagaaactgaagttatttggataatagtgttttggaggcagtgtttcacaatataaagtactgagttggaagttcatatttctcagttataagctttatgagtgttgctagcatcaagtttgttgttctcgaattttgttgttgtggctgagctctttttccatcagagagaaagagcaggtggggaaagtggtcattagagtcttctgcccaccttacaataccatgtcacccagca

SEQ ID NO: 53460 - DNA, 601 bp, Human
caccacacccggctagtttttgtatttttagtagagacgaggtctcaccatgttggccaggctgttcttgaactcctggcctcaagcgatccgccttcctcagcttcccaaagtgccgggattacaggcgtgcgccaccgtgcccggcctggaatttataaactaaaaccagccatttctagagatccctaaaaactctaattccatttctcattaggtaatctgaacatcattcaatgctaagcaacactggaaaggtcctactgggcacaagagaacacagagaactagaattctactccccctcttaaaggagaaattacaactaatttacttaggtaattttcaagcaagtttattgcaggttgcatggttcactctaagtatataatgacatactttcatgaatgaaattggtggctactagttttactgtaacaggattttaaaaatactttctatgcatcagacttcaaatatgttaaagcaaatcccaccaccttcaaatttgcttgcctggtattgctgtttaaatactttgcaatataccatcaaggtaagaaactgaagttatttggataatagtgttttggaggcagtg

SEQ ID NO: 53461 - DNA, 601 bp, Human
ctgggattacaggcacgcaccaccacacccggctagtttttgtatttttagtagagacgaggtctcaccatgttggccaggctgttcttgaactcctggcctcaagcgatccgccttcctcagcttcccaaagtgccgggattacaggcgtgcgccaccgtgcccggcctggaatttataaactaaaaccagccatttctagagatccctaaaaactctaattccatttctcattaggtaatctgaacatcattcaatgctaagcaacactggaaaggtcctactgggcacaagagaacamagagaactagaattctactccccctcttaaaggagaaattacaactaatttacttaggtaattttcaagcaagtttattgcaggttgcatggttcactctaagtatataatgacatactttcatgaatgaaattggtggctactagttttactgtaacaggattttaaaaatactttctatgcatcagacttcaaatatgttaaagcaaatcccaccaccttcaaatttgcttgcctggtattgctgtttaaatactttgcaatataccatcaaggtaagaaactgaagttatttggata

SEQ ID NO: 53462 - DNA, 601 bp, Human
ctttgatctttgtgagtaaacgatgccatttcatagatttctgttattacctaagactaggggctatgtacaagtacctaagtgggttattataagttattaacgtttggaatttttttttgttttttttgagacagagtctcattctgttacccaggctggagtgcagtggcgtgatttccattcactgcaacctcagcctcccaggttcaagcaattctcgtatctcagccttccgagtaactgggattacaggcacgcaccaccacacccggctagtttttgtatttttagtagagaygaggtctcaccatgttggccaggctgttcttgaactcctggcctcaagcgatccgccttcctcagcttcccaaagtgccgggattacaggcgtgcgccaccgtgcccggcctggaatttataaactaaaaccagccatttctagagatccctaaaaactctaattccatttctcattaggtaatctgaacatcattcaatgctaagcaacactggaaaggtcctactgggcacaagagaacacagagaactagaattctactccccctcttaaaggagaaattacaactaatttacttag

SEQ ID NO: 53463 - DNA, 601 bp, Human
tttcctgcttcagcctcccgattaactgggactacaggtgcatgccatcacacccagctaatttttgtatttttagtagagatggggtttcaccatattggtcaggctggtcttgaactcctgaccttgtgatccacccacctcagcatcccaaagttctgggattacaggcatgagccactgcacccggcctagagtagaaaaacttaaaaaagtggccttttattaggattcaaggactcttctacttgggtctaaggaacaactgaattttttatggcaccttgtctccaaccagcaraagtcattatggttgtttccagaagaccttgcctggcacaagagaaagcaaccatgaaaccaagctgatctgtccttttccctgtttgggggcaacacaggatcatggaagctggatttattcagtccagcgaggtgctccttattcctccacaacagggtcccaaagtgtaggccttgatcaaactgactttaaaatttgaggtctttctttgatctttgtgagtaaacgatgccatttcatagatttctgttattacctaagactaggggctatgtacaagtacctaagtgggttatt

SEQ ID NO: 53464 - DNA, 601 bp, Human
aactttttttcaagatggagtctcactctgtcacctaggctggagtgcagtggcacgatcttggctcactgcaacctccgcctccctggttcaagaattttcctgcttcagcctcccgattaactgggactacaggtgcatgccatcacacccagctaatttttgtatttttagtagagatggggtttcaccatattggtcaggctggtcttgaactcctgaccttgtgatccacccacctcagcatcccaaagttctgggattacaggcatgagccactgcacccggcctagagtagaawaacttaaaaaagtggccttttattaggattcaaggactcttctacttgggtctaaggaacaactgaattttttatggcaccttgtctccaaccagcagaagtcattatggttgtttccagaagaccttgcctggcacaagagaaagcaaccatgaaaccaagctgatctgtccttttccctgtttgggggcaacacaggatcatggaagctggatttattcagtccagcgaggtgctccttattcctccacaacagggtcccaaagtgtaggccttgatcaaactgactttaaaatttga

SEQ ID NO: 53465 - DNA, 601 bp, Human
cttcatttagaatagagtaactttttttcaagatggagtctcactctgtcacctaggctggagtgcagtggcacgatcttggctcactgcaacctccgcctccctggttcaagaattttcctgcttcagcctcccgattaactgggactacaggtgcatgccatcacacccagctaatttttgtatttttagtagagatggggtttcaccatattggtcaggctggtcttgaactcctgaccttgtgatccacccacctcagcatcccaaagttctgggattacaggcatgagccactgcrcccggcctagagtagaaaaacttaaaaaagtggccttttattaggattcaaggactcttctacttgggtctaaggaacaactgaattttttatggcaccttgtctccaaccagcagaagtcattatggttgtttccagaagaccttgcctggcacaagagaaagcaaccatgaaaccaagctgatctgtccttttccctgtttgggggcaacacaggatcatggaagctggatttattcagtccagcgaggtgctccttattcctccacaacagggtcccaaagtgtaggccttgatcaa

SEQ ID NO: 53466 - DNA, 601 bp, Human
gcgaactttaagtccttttcagtttcttttttaaagataatcaatttccctctcccaaccccttgtcctatgtctatgaaatattggtcttcatttagaatagagtaactttttttcaagatggagtctcactctgtcacctaggctggagtgcagtggcacgatcttggctcactgcaacctccgcctccctggttcaagaattttcctgcttcagcctcccgattaactgggactacaggtgcatgccatcacacccagctaatttttgtatttttagtagagatggggtttcaccatrttggtcaggctggtcttgaactcctgaccttgtgatccacccacctcagcatcccaaagttctgggattacaggcatgagccactgcacccggcctagagtagaaaaacttaaaaaagtggccttttattaggattcaaggactcttctacttgggtctaaggaacaactgaattttttatggcaccttgtctccaaccagcagaagtcattatggttgtttccagaagaccttgcctggcacaagagaaagcaaccatgaaaccaagctgatctgtccttttccctgtttgggggcaac

SEQ ID NO: 53467 - DNA, 601 bp, Human
cacattgtgcttccacacaattttttttttgagacagggtctcactgtcacccaggctggagtgcagtggcgtgatctcggctcactgcaacctccacctcccaggttcaagtgattctcctgcctcagccgcctgagtaggtgggactgcaggtgcccaccatcaagtctggctaatttttttggatttttagtagagacggggtttcaccgtattagccagggtggtctcgatttcctgacctcgtgatccacccgcctcggcctcccaaagtgttgggattacaggcgtgagccaccrtgcccggcccatacaatttttttggaaaaaccacacatgtgcacaaaaccaacacgacttgactcattatttgctcaactaaaaatcagtgcaacactgcgaactttaagtccttttcagtttcttttttaaagataatcaatttccctctcccaaccccttgtcctatgtctatgaaatattggtcttcatttagaatagagtaactttttttcaagatggagtctcactctgtcacctaggctggagtgcagtggcacgatcttggctcactgcaacctccgcctccctggttcaaga

SEQ ID NO: 53468 - DNA, 601 bp, Human
ttggggtgttttgcaggccctaatgctcataaaggaagtattctctagactggctaaactaaaattgtctaaattaaagactttgggatacaactgcagcaaccaggcatttcctaagcgcctgtgatggcaggtaaagcttttcaagccaacacatcatcccagcttacactctgacccacactccctcaccccatgaaagggcagctgccaggaagctggagtgatccgctgattgatcagtaactgagcgtgcagggagtcaatgacacgtcagaggaaggcatgcctgctccccccaggaaatccccatcacatgagtatactcattgcctcacgtcatcctagaagacaagtttatgaagtctagaaagcaaacagcttccgcctaaggatccttctccttctgtcttcagaggcctgacttcagcccagtcagaaggatcagaggtgaccttggatggtacctcatccctcctagatctgaaagaaatgtatttggtacccctcggcttaatctcatgtctaagatttgtccctaatgagtatgcattgaaaatactgggcacttggagacccatattgcaggatctctctgaaa

SEQ ID NO: 53469 - DNA, 601 bp, Human
cacacctgtaatcccagcactttgggaggctgaggtgtgcagatcacttgaggccaggagctcgagactagcctgggccacagagcaagaaccccatctctacaaaatattaaaaaataatttaaaaaaatgcaagtgtctaggacacagtggatttgaaacagtccaggaaaaatctccttcccagccctttcagcaggtaccgcttcctgtatctagaacattccaggggaatcctcctgaaggccttgggatcttggctgcatgcaaggctcaaagccaggtagctgcctacaaactmtgctctcatcatggctgcctggctctgcactaaagttcatgagtcaccttggtcccctgccttatcaggtcacgtcccactctgttgcacctggcaggttctcccttaacacgggtctagactcatgacatctagtctgggacattctttatactcttatcctgaaggagaagatacttaggtgggaccagcaattagaactccaggattcatttatttctataagggaacttcgatgtcagtcttcaatgtctttaaatgtgcaccaacatactacacacgtttcattcatgacacatc

SEQ ID NO: 53470 - DNA, 601 bp, Human
taattattatgatagaaaaaatctactctaattttattcaactatcctatccattccctgaacaaacagaatactgcagaatgtgataaaactttgacatcaatcctaacgaaatgccattagagagtattaattaatgtcgattagaatgagagtttctaggccaggacggtggctcacacctgtaatcccagcactttgggaggctgaggtgtgcagatcacttgaggccaggagctcgagactagcctgggccacagagcaagaaccccatctctacaaaatattaaaaaataatttwaaaaaatgcaagtgtctaggacacagtggatttgaaacagtccaggaaaaatctccttcccagccctttcagcaggtaccgcttcctgtatctagaacattccaggggaatcctcctgaaggccttgggatcttggctgcatgcaaggctcaaagccaggtagctgcctacaaactctgctctcatcatggctgcctggctctgcactaaagttcatgagtcaccttggtcccctgccttatcaggtcacgtcccactctgttgcacctggcaggttctcccttaacacgggtctagact

SEQ ID NO: 53471 - DNA, 601 bp, Human
agcatcaataggaacagctgttaaaaagaatggagtaaaattatattgctgatatggaaagaggtacaaaatatgtcattgggtgaaaaagacagcaagttgtcaagcagtctgcctcatatgattcctttatgtgagaaataaaaagataatactatatgtgtggctgggcgtcgtggcacatgcctgtaatcctggcactttgggaggctgaggtgggtggattgtttcagcccaggagtttgagaccagcctgggcaacatggcaaaaccctgtctctacaaaaaaaatacaaagacyagctgggagtggtggcttgtgcctgtagtcccagctatttgggaggctaaggtgggaggatcacctgagccggggaggtcaaggctgcagtgagctgagatagcaccactatactccagtctgggtgatagagtgagagcctgtctttaaatatatatatacgcatgtatatgggtagaatctctgtgagattacacaaaaaatgatggtatttatagagggactagagtgagagggaaacaattctttttttttttttttttttttgagacggagtctcggactgtcgcccgggctgga

SEQ ID NO: 53472 - DNA, 601 bp, Human
acacgtctgtgaatgatttccacagggtaactacttagtattttgtccaacattttgttaggaaaatttcaaacatacagcaaactgggagaatctcaccaggagcacctgcatcccctctaacctggatttcaccattcacattctactttttctttccaaagcagtctttataaggcttgtgtataccagcactaactcttgcaaatgtgaggtcacctgcttaggagtgactataaagctggtgttaaatttatttggctctcttttccccctactaagcgtaattttcatatagttaaaaaaaaatcaaccgtaagggtatagtctgacaacgatatgcctccttacagccaatgcccaaatcaagatacagaccagttccatctccccagaaagtcccaggaatctattttaatatgctcctcatgcaattctgatgaaaggaacgaggaggagatgcggaatacatgtccagttccctcggccagagggagagtaaagtttgagattcaagtggctttccagtagaggtgccatgttccccctagcaatcatggctgcccctctgccgtcctagccttggtcatccacgcacacg

SEQ ID NO: 53473 - DNA, 601 bp, Human
atgaggtcatgctagattagggtgggttctaacttcagtatgactagcatcctcctaagaggggactgaggagacattgacatagagccacccgtatgggaagaacacccataaagatggaggcagagatggaagcgatacaactacaagccaagaaacaccaaaggacagcagcccccctagaagcccggagaggggcttgaagtggattcttcctcgcagcctctagagggaaccaaccctgttgaaatcttgatgtccgctgtccagcctctagaagtgtgagagaatacatttgtgttttttttttttggcagggctggggggtgttggtgggtggggatggagtcttgctctgtcacccaggctggaatgcagtgatgccatctcggctcactgcaacctccacctcacagatttaagtgattctcccacttcagcctccagagtagctgggactacacgcatgtgctaccacacccagctaatttttgtatttttagtagagacggggtttcgccatgttggtcagactggtctcaaactcccgacctcaggtgatccacccgcctcggcctcccaaagtgcatttctgttgttt

SEQ ID NO: 53474 - DNA, 601 bp, Human
gaccatagttctccaatgagcattcatattcactttcatctaggttgtttgagtggcagaagttgtttaataataactgtattggggccaggcacagtggctcacgcctgtaattgcagcactttgggaggccaaggtgagtggatcacttgaggtcgggagttcaagaccagactggccaatatggcaaaaccctgtctctactaaaaatacaaaaattagccaggtgtggtggcacgtgcctgtagtcccagctatgtgggaggctgaggcaggagaactacttgagcctgggaggtgsaggttgcagtgagccaagattgggccactgcactccagcctaggtgacagagcaagactccatctcaagaacaaaaaacaaaaaacaaaaaacaaaaaaaatttactgggaggaatagtgttcctcctccaattccccctgccaactcatgtccgcccagagcttgtgaatgtgactttatttggaaacaggatttttatttatttatttatttttgagacagggtctggctctgtcacacaggctggaatgcattgacgtgatctcagctcactgagacctctgactcctgggctcaag

SEQ ID NO: 53475 - DNA, 601 bp, Human
ccagcctgggtgacagagcgagactccagctcaaaataaataaataaccccataagcactgcctgccaagccacacccagcacctccaatttccccatctccatttttcttctgtccttatccttctaggacaatgggttacaacaaacttcatggtgctccggagtcacaaagggtatttacaaaaaatacagatttctgaggtcttgactccagagatttacattttgtaggtttggagggtggccttataatcttttaaaaatataatctacgcacattaattctttagttacacacrgatttttttcactcaagtgaagcatcaaacttttcacatgagtcttcgacattgaactctctgtcttggagtcatttttcttcaatagaccatagttctccaatgagcattcatattcactttcatctaggttgtttgagtggcagaagttgtttaataataactgtattggggccaggcacagtggctcacgcctgtaattgcagcactttgggaggccaaggtgagtggatcacttgaggtcgggagttcaagaccagactggccaatatggcaaaaccctgtctctactaaaaatac

SEQ ID NO: 53476 - DNA, 601 bp, Human
taagaccagcctggccaacatagtgaaccccgtctctactaaaaatagctgggtgtggtggcacgcacctgtaataattccagctacttgggaggctgaggtgggagaatcgcttgaacccaggagttggaggttgcagtgagctaagattgcacctctgtactccagcctgggtgacagagcgagactccagctcaaaataaataaataaccccataagcactgcctgccaagccacacccagcacctccaatttccccatctccatttttcttctgtccttatccttctaggacaatgrgttacaacaaacttcatggtgctccggagtcacaaagggtatttacaaaaaatacagatttctgaggtcttgactccagagatttacattttgtaggtttggagggtggccttataatcttttaaaaatataatctacgcacattaattctttagttacacacggatttttttcactcaagtgaagcatcaaacttttcacatgagtcttcgacattgaactctctgtcttggagtcatttttcttcaatagaccatagttctccaatgagcattcatattcactttcatctaggttgtt

SEQ ID NO: 53477 - DNA, 601 bp, Human
ctcatgcctcccagcactttgggagtccgaggcggatggatcatgaggtcaggagtttaagaccagcctggccaacatagtgaaccccgtctctactaaaaatagctgggtgtggtggcacgcacctgtaataattccagctacttgggaggctgaggtgggagaatcgcttgaacccaggagttggaggttgcagtgagctaagattgcacctctgtactccagcctgggtgacagagcgagactccagctcaaaataaataaataaccccataagcactgcctgccaagccacacccascacctccaatttccccatctccatttttcttctgtccttatccttctaggacaatgggttacaacaaacttcatggtgctccggagtcacaaagggtatttacaaaaaatacagatttctgaggtcttgactccagagatttacattttgtaggtttggagggtggccttataatcttttaaaaatataatctacgcacattaattctttagttacacacggatttttttcactcaagtgaagcatcaaacttttcacatgagtcttcgacattgaactctctgtcttggagtcattttt

SEQ ID NO: 53478 - DNA, 601 bp, Human
cgcaccacgacaagagcttgaggatgtggcttctttaataaccccacgaacagcagggcgaggtggctcatgcctcccagcactttgggagtccgaggcggatggatcatgaggtcaggagtttaagaccagcctggccaacatagtgaaccccgtctctactaaaaatagctgggtgtggtggcacgcacctgtaataattccagctacttgggaggctgaggtgggagaatcgcttgaacccaggagttggaggttgcagtgagctaagattgcacctctgtactccagcctgggtgamagagcgagactccagctcaaaataaataaataaccccataagcactgcctgccaagccacacccagcacctccaatttccccatctccatttttcttctgtccttatccttctaggacaatgggttacaacaaacttcatggtgctccggagtcacaaagggtatttacaaaaaatacagatttctgaggtcttgactccagagatttacattttgtaggtttggagggtggccttataatcttttaaaaatataatctacgcacattaattctttagttacacacggatttttttcact

SEQ ID NO: 53479 - DNA, 601 bp, Human
aactgatcaaatgtagagaaaatctgtcagtcttctgcttaaaatcctccagtggccgcccttggttctcagcataaaatctaaatccctggccatgacccatgagccccaccaagtagggctcttgcccacctccttccacttcagcccccaccagactccatccctccccatgctccagcaatgccagagtctcctctcggtcctgtcatgcctcagggcctttgcacctgctgttccctctgcctggaatgtttctgacccagggtattggtccatacagaatgtttctattctattscatcacttgctgccacctgtaattatcatgtctgtctcactcctctgaggtaatccccatgagtgtctcagccaggtgtctttttgtccccagcaccaagcagggtgcctggcacagaggaaatattagcatatttgcggctgaatggaggaagggatggtggggagcaggaggcagccccgtgagcccccaagacaaactggggccttggccagcctcacctttggggactgtccttccctgaccagggtaagtgtcctgggtatagtgctgcacctgtccaggtgaagatggagtgaa

SEQ ID NO: 53480 - DNA, 601 bp, Human
tgtgatcaagcagagagggcaagaaagagccatttgcaaatgacacacggacagcagcttcgtagacagcaccatcagattgggtgccattatcccagagagaaatgcctatggtgctgggctgggacacagctctagaccagtgccacccggcaggattttgtccagtgatggaaatgttctatatgtgtgctgtctaatatggctggtggttcccaccttggacagctcagctctggactcacatattcaatcagtattcaaaatctctactgatgtttccctggcatctcaaacctgrccccggtgagctttgatagtcctatcccaaacatggacacccaccccagtattaatcatttccataaatcaaatcgcccagttgctcaagccaaaaccttggtgtcatcctcaacttcttcctttccctcgctgctgacatccaatgcatcagcaagttctaatggttccatgtccacgacaatttcaaattctctccatcctcacagtcaccaatccaggccacccccatctgccacctggacaatagcaatggcctcttaactctcttgctgcttccactcttgactccccccaagcc

SEQ ID NO: 53481 - DNA, 601 bp, Human
ggcagcggatccgcttgcttccatctttaataagctgccctctgcctttctagatccaatccaggagtcaggaccggccaggagctgagctctggatgcctgtggtggcctaagaaaccatatctggcaagtgagaagcctcagaacccccgaagcccacccacccctcgccctccccgcagtcattgcaaggcgatgggccctgcaggccaccgtcctggtattcacgggagcaagaggaaaggaggaaagaaaaccagcaggaaacctgtgcctgagctgtgaccaactctccagctcrggtgtgtggagaacaaaaagacagtcttgggccctggggcgttgactctattcaccacggacccagcattgcttctgctcgtgaagtgaactccctctgatgccattgccagcaacctcgacaccggaagcctaagccagcacaggtgggcaggcaacccaggacgtaggaaaaggggccagtggtttgaaaaaatgaaattaccactcgctaggataccccctgtgggttttcaagccactaactccattctttaccaaatgttgccactgactgttggcagccaccgggatccttagc

SEQ ID NO: 53482 - DNA, 601 bp, Human
tctgtatctgcagcaagagcctttcttggggaggagccttttgcattaacaagcccacctctgcggcccccagggagcagtccccttcgagctggttgtttttggtaaaagctttcggctgaaatgaaggcagcggatccgcttgcttccatctttaataagctgccctctgcctttctagatccaatccaggagtcaggaccggccaggagctgagctctggatgcctgtggtggcctaagaaaccatatctggcaagtgagaagcctcagaacccccgaagcccacccacccctcgccstccccgcagtcattgcaaggcgatgggccctgcaggccaccgtcctggtattcacgggagcaagaggaaaggaggaaagaaaaccagcaggaaacctgtgcctgagctgtgaccaactctccagctcaggtgtgtggagaacaaaaagacagtcttgggccctggggcgttgactctattcaccacggacccagcattgcttctgctcgtgaagtgaactccctctgatgccattgccagcaacctcgacaccggaagcctaagccagcacaggtgggcaggcaacccaggacgtaggaa

SEQ ID NO: 53483 - DNA, 601 bp, Human
gcatgagccacagtgcctggcctgtcactgcatcttcgtatcaaggaggctgcagggaatgaagcagactacagtgaaatagaggggccacaccctgttacaagagggcagctctgacttaggtccaagtcataggaggatggggaccaagggttgtcagaccttcagatttcttttcttttctctttttcttttcttttgacacagggtctcacttcgttgcccaggctggagtggagtggtgtgatcatggcttgctgcagccttgaactcctgggctcaattattattattattattwttttttttttggtagaaaagggggtctcgctatgtggcccaggttagtctcaacctcctagcctcgaaatcctggcctcaggtgatcctcctaccttggcttcctaaggtgctaggattacaggcataagccactgcgcctggccctgatttctatgaaaagctggaaaaatatatttttatgtaaaatctccagattttaaaatttgacttgcatttaaaacaaatgatgtgggccgaaccaacacatatgaatataaatgtggcccttggtttgccagtttgaaactcccaggcaagc

SEQ ID NO: 53484 - DNA, 601 bp, Human
ctggtcagtccaagccacaaggatggtatcgagtcactgtcaatggatttttttttttttttttttttttgagacagagtcttgctctgtagccctggctagaatgcagtggcaccatcttgtctcactgcagcctctgtgtcctgagttcaagcaattctcctgcctcagcctcctgagtagttgggactacaggcatgcaccaacatgcctggctaattttttgtatttttagcagagacggggtttcaccgtgttgcccaggctggttttgaactcgtgaactcaggcaatctgcccrcctcggcctccttgggattacaggcatgagccacagtgcctggcctgtcactgcatcttcgtatcaaggaggctgcagggaatgaagcagactacagtgaaatagaggggccacaccctgttacaagagggcagctctgacttaggtccaagtcataggaggatggggaccaagggttgtcagaccttcagatttcttttcttttctctttttcttttcttttgacacagggtctcacttcgttgcccaggctggagtggagtggtgtgatcatggcttgctgcagccttgaactcctgg

SEQ ID NO: 53485 - DNA, 601 bp, Human
ccttccagccacagtccaaggccacacaggagagaagcctttgagacagaagtaccaaccctcactgctcccagcacaacgccaattcctggctcatcaccaggcgttatttcctctctggtcagtccaagccacaaggatggtatcgagtcactgtcaatggatttttttttttttttttttttttgagacagagtcttgctctgtagccctggctagaatgcagtggcaccatcttgtctcactgcagcctctgtgtcctgagttcaagcaattctcctgcctcagcctcctgagtagytgggactacaggcatgcaccaacatgcctggctaattttttgtatttttagcagagacggggtttcaccgtgttgcccaggctggttttgaactcgtgaactcaggcaatctgcccgcctcggcctccttgggattacaggcatgagccacagtgcctggcctgtcactgcatcttcgtatcaaggaggctgcagggaatgaagcagactacagtgaaatagaggggccacaccctgttacaagagggcagctctgacttaggtccaagtcataggaggatggggaccaagggttgtcag

SEQ ID NO: 53486 - DNA, 601 bp, Human
aaaaggatgggcacaagcaatggccaaggtgctctgccaaggagacggggtcagcaggcactgctcattcccagccaagagccactggacgtgccgggcaatggagggtagggagggcacttcaacctccttagagccttccagccacagtccaaggccacacaggagagaagcctttgagacagaagtaccaaccctcactgctcccagcacaacgccaattcctggctcatcaccaggcgttatttcctctctggtcagtccaagccacaaggatggtatcgagtcactgtcaatggatttttttttttttttttttttttgagacagagtcttgctctgtagccctggctagaatgcagtggcaccatcttgtctcactgcagcctctgtgtcctgagttcaagcaattctcctgcctcagcctcctgagtagttgggactacaggcatgcaccaacatgcctggctaattttttgtatttttagcagagacggggtttcaccgtgttgcccaggctggttttgaactcgtgaactcaggcaatctgcccgcctcggcctccttgggattacaggcatgagccacagtgcctggcctg

SEQ ID NO: 53487 - DNA, 601 bp, Human
tggcagaagcccaggttcttatcacaagatgggacacacctccaacatgggaggagactccaaggaaaaccagagccagcgtcacgcggtgtcagtagcaggaatactcctaggtacagggacacgtcctccggtgcattgttcattaatcgattttctcaagtctagttgtgagattctaggtctaaaaaccctccctacacacagctaagacaaagacccttctgaagaaggtctcccattcccacctggggcacgccaggactccaggaactgggtcctgccaggagcagctgtgccrcacgcatgccacacacgttgatctgggccacgttttccagactcccgccccggtgtttattttatagttgagccagctcacccttgaattccacaggcgaacaccatccatgaatcaggagtgtgtagaggtcattcctgggaactagggtacaaccccagctttaaaaggcttttagaaagtttcttggaaactttcacattcattatttaaaaggttctcctggtcctggaagcaagccaaagggtggtttttaaacactttaaaaaccaaaaagtgcctcaaatgaagatatgtgtg

SEQ ID NO: 53488 - DNA, 601 bp, Human
taagccaagctcacagatgcctctctctgcagctccttccagtaccatccactggccactcaggacaggaccctgagccaggacacactgtagctcaccctttggtcccctcatcagtccccaaactctccccattcccctccgatctccccctgttccagactgaggtcctgaccctgccagtgcccagggcccaagctgggggttgaggttcggaaaccaggtcccagctcgccggctgcatggccgggcagcctttcctctggctggcctccatcttgccctgggttctgcacctctyaggaggggacatggcacagcacaacttccttcggcctctctggttggatcctgaggcgtctgtgctgtgggcggatgggttctcccagaggcggctgtgatctcatgcgacaggtgggatctctgtgttcccagtgtcagggccaagggggcccagcagacagtcagctttgtggggtccccaccccactctgctcacctgtgttccttgggcgagcatcccatgccacctcctggggtaataactctttatggcggtggtggggaggggttactgtcccctgcaccaggctgtgagctc

SEQ ID NO: 53489 - DNA, 601 bp, Human
actgaagggatgatttagaaactgttctggtaaaattccacacagagcccaaaagtaagaccatccctcacctctgagcagagcggggcaccagggtttgcttcctggcccttcttcctgtcttttcagatccttctaactctgccctggctcccctggcctgttgtcctctcactcttcccagcattctcactcaccccttctcacacacaccttcccactctgtccccaccttctagggccagggaaactgggccccgggaggccaggactccagtctttggcagcaatcacagtactsagcttggaggtaaagccagaagagttaacaccagcaagcccttctgccccaggggcaggtgtgcaaacccaccccaggcctggggaccctcggctgagacaaagctgccaccttcatggcctctttcccagctcctccatgtcccgatccaaaagacctaccccagcccccgctgcctgggtcagcaacagagagagggctcaggttggagcaccgcgggctcccccagcctctctgttcccactaacggagctgggattgcccgtgaggtgaacgaggcagcagcagcacccttttttg

SEQ ID NO: 53490 - DNA, 601 bp, Human
agggctcccaagggagggctccgaaaaggacatggcgaagtggcaaaaagaggctgctggaccagggggacacgtgtgtccaggagctgagagtggtgggcagctctggccacctcacctggctgtgttctagaaacagggagggatgtggagggtgagaatccacaacctggcttcttgtcccataaggaagcctggaccctgcctggctgggtgactgaagggatgatttagaaactgttctggtaaaattccacacagagcccaaaagtaagaccatccctcacctctgagcagagcrgggcaccagggtttgcttcctggcccttcttcctgtcttttcagatccttctaactctgccctggctcccctggcctgttgtcctctcactcttcccagcattctcactcaccccttctcacacacaccttcccactctgtccccaccttctagggccagggaaactgggccccgggaggccaggactccagtctttggcagcaatcacagtactcagcttggaggtaaagccagaagagttaacaccagcaagcccttctgccccaggggcaggtgtgcaaacccaccccaggcctggg

SEQ ID NO: 53491 - DNA, 601 bp, Human
ctggatgctatcttcctgagttctcagtgactgatctgggggtcctaaatgggcaaaacactatggccaacttcaatagcctttccaggccctggggaccctggtggtctgtgttatgtcaggcagggggcagggacagggagtttggggatgcctgctggatgcgtctatctgtcccttgagggaagaggctgatcacacccattggccagccccagcagctggttatgccagcatctggcttagcctgaggaaggatggggaagaggatgtggctggcttgggagacactgctggtatstgctcagcctcctccctccctctgccactccctctcctactcaccggcctcagggtcttattcatggtcagctgttggggtgggaaggttccaggaccttgtggaggggaggggccgctatctgggctgctagtgtgcccagaggtgactttgggcgggagatttaagctcttccttatcagttaaatcaggataattataatccttatccctcgtgctgtcagcaggattaaagcagataaccaataatacattgaaagcggctggcacacagtgagggctcagtacaagagatgtgaa

SEQ ID NO: 53492 - DNA, 601 bp, Human
caagcctgggaggttgaggctgcagtgagctgcaatcttgccactgtactccagcctgggtaacagagtgagaacctgtctctaaaaaaataaaaaagatagagggaatagctttctgcatcatactggaacactgtggcatctcttgcctcccagcctgccctgtccactgccctcccagggtgtcctctaagacccacggaagcagagggcagtgcccagcccacctgcctgctttctgccttggggtattttttgagcaccgctgagctcctctgaagaggggccaggagctctgagyaaggaggcaggcagagaggagactcagggactctaagcccagtatggacagccttggggaggccctttggatgttgggccctccagacccctactctggctgggagggattatagagagaaaggaggcccaaggggacccaaggcgactaggcaggcagggtgcctagaggagagccaggccagtgcccacggtgccaaggctggtccccccgagagtgtgttggccaaaagggccctttctctgatctggatgctatcttcctgagttctcagtgactgatctgggggtcctaaatggg

SEQ ID NO: 53493 - DNA, 601 bp, Human
cactgatagggtgtcctttcttaatcatcttccagtcgtgagcactgaaggagaaaggctcagctgggtgctgagaggttccaggcctctcacttgctggtcgtttccaacatggcagttggcgggaccgggttttgagatgggaggacagcagacgatgacggcttgggatccaatgagatgggaagcgatgcaagacacatttcgcttcctgctctacctgaccaaacaattgccttagctcattgccatgggggtgggcagcgctgctgacactgagcagctgccccgtcccccgccwgcccccgctcaccacatttgccaccttggggagcagattctggacacacccttccccaggaaagcgtcctatgccacctggccctgtattgcctgggaggaggggtcctggggaggcagaggaggaaagcagggaaggcccccttctacctgggcaccacgcccttccacccaccctcttctacctgaccgaagacccctctcctactcccaccacattagtgggtctcttccttccagctcgttcctggtccgggccccatttacttcttatgtcccaaggctcgggggacagagggaa

SEQ ID NO: 53494 - DNA, 601 bp, Human
tggcttttttttttttttttgtatttttagtagagatgggatttcaccatgttggccatgatggtcttgaactcctgacctcaggtgattctacccgcttccacctcccaaagtgctgggattacaggcatgagccaccacacccggccatctctgcctttcaattgaagcattaaatctatttacatttaatgttggagtaggtctcctctggttttcttttctcattctttccttctttttttgagacagggcttgctctgtcacccaagtgggagtgcagtggcccaatcttggctcrctacagccttgacctctgaagatcaaataatcctcccgcctcagccttctgagtagctaggactacaggtgggcgccaccacacatggctgctattttctatttgtctcctctgttcttcctttgtcttgtttgtatgaaatatttaacaatattccatactatctcctctattgactttttagctatgcttttggtattttccttgcagttgttgctgtaaagataataatacacatctgtagcttacgaccatctctctcaaatgaatcccctggtcctttctttttctttttgagac

SEQ ID NO: 53495 - DNA, 601 bp, Human
attttttttttttttttgagaaggagtttcactctttttgccatctcggctcatcgtaacctccgtctcctgggttcaagcgattctcgctgcctcagcctcctgagtagctgggattataggcgcccaccaccacgtctggcttttttttttttttttgtatttttagtagagatgggatttcaccatgttggccatgatggtcttgaactcctgacctcaggtgattctacccgcttccacctcccaaagtgctgggattacaggcatgagccaccacacccggccatctctgcctttyaattgaagcattaaatctatttacatttaatgttggagtaggtctcctctggttttcttttctcattctttccttctttttttgagacagggcttgctctgtcacccaagtgggagtgcagtggcccaatcttggctcactacagccttgacctctgaagatcaaataatcctcccgcctcagccttctgagtagctaggactacaggtgggcgccaccacacatggctgctattttctatttgtctcctctgttcttcctttgtcttgtttgtatgaaatatttaacaatattccatac

SEQ ID NO: 53496 - DNA, 601 bp, Human
aaaataataacggtacctgcattaagtgctcaatgagatgtggcatgccaagcaggatagtttagtggagatacaaagcaggctgagatccagaggcagaatggctggtacaaatgcccgggtcacggtaggcgaggagggctttgcagaggatctgggttttggtttggagttcatcaacatgggggatttgacaagggggagagaggaaaggatgacagggagtgtgggcacagatgtaaagttgaatatggttgtggcctttctggcaccttaacagtgctctgtgggcagcaggaaraaagctgctgaaggcttagatgatagaacaccctgtaccacatccaggagttgcttattctccaggcctgttgtctccaaggcaaggatgtacgtgtactccatcggtactcacaggctaatccccagaggcagggagaaaatattaacgaccctatttctattgctattatttctatttatttgtgtttgtaatatatttatctctttctttttttttttttttttttttgagacagagtctcgttctgtcgccaggctggagtgcagtggcatgatctcagctcactgcaacctccgc

SEQ ID NO: 53497 - DNA, 601 bp, Human
atatatatttatttctatgctaggtgctgggaagaatcaacaggaatgaaagaggccaaccttgtttcatgtagcttagtgcttacagttagactcggaagtcaggcctgggtacaaatccatttgccatttactgtgtgatttctggaaaattacttaacctctctgagcctcagtttccccagctataaaatggaagtaattgttggttgcagtagctcatgcctgtaaaccctgcattttgggaggctgaggcaggataactgcttgaggccagtagtttgagaccagcctgggcaayagttcgagactccgtctcttcaaaaataaaaaaataataacggtacctgcattaagtgctcaatgagatgtggcatgccaagcaggatagtttagtggagatacaaagcaggctgagatccagaggcagaatggctggtacaaatgcccgggtcacggtaggcgaggagggctttgcagaggatctgggttttggtttggagttcatcaacatgggggatttgacaagggggagagaggaaaggatgacagggagtgtgggcacagatgtaaagttgaatatggttgtggcctttctggc

SEQ ID NO: 53498 - DNA, 601 bp, Human
gaggcttcaccaaaaatgtctgtgatgtagtttggggttctgtgctctcagaaactctgggccagggaaagcactgaggtctcctccctctaggatcctcagggcaagtcaggaaagaaactggcattacctgttgtaaatgacgtgaagagtcggacgttgccctgggcaaaggttcggtagtaggaccagctgagatacagcaccaggggcacccagatgatggggacactgtacctgcaggaaggccatcagggtgagagagatacatgcacaggagcttgacagagtacagctttctttttttttttgagacggagtttcactcttgttgcccaggctggagtgcaatggcgtgatttcggctcactgcaacctctgcctctggggttcaagtgactcttctgcctcagcctcccaagtagctgggattacaggcatgtgccaccacacccagctaattttgtatttttagtagagatggggtttcaccatgttgtcaggctggtctcgaactcctgacctcaggtgatccacccaccttggcctcccaaagtgttgggattacaggcgtgagccaccatgcccggcagggtccagc

SEQ ID NO: 53499 - DNA, 601 bp, Human
cccagtctcataggctctttagacactgccccatatcagcctgtcttttcatcctctgccccccagctagaagctggggcgcacctggtatccacatcctagccacacgcctttcagctactcccttgatatctctgaggctccatttcctcagctctaaaaggggataatgacaggacccttcttatggggctgctgggaggggtaaatgaggcggtcctgggagaacacgtggccccgcacatggcaagtgtcccatagaggttagtgggccattactcccagtctgggggtctgctgyctgagcctttgccttggacacactctaggacactcccagatctttctctcccaagttctctgctaatctgtgctgggttcataggccagtccgagtctagctctcagctgtgtcacccgatgaagtgatttcatttagtttcttagcaaagaatcccacatcatgtgtcttttggtgtgacactcaatgagaggcactcaatctctctctctctctttttttattgctatgccacccgatgattccatttagtttctgctgatgtgttgttgggttttgtatccatttggggggtagatg

SEQ ID NO: 53500 - DNA, 601 bp, Human
ctgtattgattccagtgcgtcctttgtccagcagctgcactaggatcccgccgagtctccccttgccttgctttgtgggctcttattttctctgcctgtggcttgtgccttgcatgacaagctgggggctgagggaggcacgtggagacgttatctctcatgcccccatcactggcatcatggtcacaggcttactaaccctctacactggacctttataagacaggcacattttagctctctgccaaggccgtgtggctgatagagccctcaaatcatcctccctgccatgcaggaaagwcctctcctataggtcaagcctctgcccgccccctcaccccagcatcacccctgtctgcccatccggccggagctggtactgagtggcatctctggaggaatccggcggagggacctgggccaaagcttcagcatccccttccccctccggctgccagccctggcggccctgccactgtttgtgattgttaggggagtgccgggcggacagtgggtgattcagcgagcaggccttctgagcaacaagctccgtgctgtgcctgagctattcagcgtgggcagaacagggcaaccatggctc

SEQ ID NO: 53501 - DNA, 601 bp, Human
ccttgaactggtgtctgcgttcagcttccactgcttcttggcaccctgactcttctgtattgattccagtgcgtcctttgtccagcagctgcactaggatcccgccgagtctccccttgccttgctttgtgggctcttattttctctgcctgtggcttgtgccttgcatgacaagctgggggctgagggaggcacgtggagacgttatctctcatgcccccatcactggcatcatggtcacaggcttactaaccctctacactggacctttataagacaggcacattttagctctctgccraggccgtgtggctgatagagccctcaaatcatcctccctgccatgcaggaaagacctctcctataggtcaagcctctgcccgccccctcaccccagcatcacccctgtctgcccatccggccggagctggtactgagtggcatctctggaggaatccggcggagggacctgggccaaagcttcagcatccccttccccctccggctgccagccctggcggccctgccactgtttgtgattgttaggggagtgccgggcggacagtgggtgattcagcgagcaggccttctgagcaacaag

SEQ ID NO: 53502 - DNA, 601 bp, Human
cctccttcttcccgcccacctcctcttgggtttccttcctgggaggctgtggttactgacatccacatattaccaaaggagtcaggttcaagtgacccctctcccatggagtcttagctgggctggtctggttggtgagagaccctgcttccagagaaaccctgatacctctggggtccataaggtcattccggtgaagtgcagagagcacaggcattggatttgcagacctggattcaaatcctggctcagcaccgcctaggtgttacagtttcctcagggaaacaccctacccatcttrgaggggtgtagttaggatggaggtaacagagtatctgattatatgatgagtatatacattgtattatataataatattaatattatattttctttttttgagacggaatctcactctgtcatccaggctagagtgcagtggcatgatcctggctcactgcaacctctgcctcctgggttcaaacgattctcctgcctcagccttccaagtagctgagattacaggcacacaccatcatgcctggctaatttttatatttttagtagagactgggtttcaccatgttggccaggctggtct

SEQ ID NO: 53503 - DNA, 601 bp, Human
tcacacagctgtgggtctggcacctttaacctctgcaagaccctagacacagcctgatggatgatccctgtgcatcttcaagttcagctccctccccactgcccttgaacacgctctactcccctttactgcctctccttccacccagcttcctacttcacagagaagagaggccctggggttggggaggaactatcccctccacatacttcccccaacttccaagcacaccacattctgccggtaccctggcgcatcctccttgcttctcagggaagaggtgtgcaccggcacgcgggcrctggatgatcagagcaacagtaacggcagatgtgtcctgactgattcctgtgtgccaggcaccgcccaagggccttccatggattacttcctatttcatctcaccacagccttacaagggaagccctgcattgcctgcatgattaaggacgtggaggcccaaagtccatgacttgcctggctccccctgctcggcagtgcaaagccctcagccgcctcctcccaccctccctcccaagggactcctctgggctccttcagtctctccttttctcctggctcttctgctcatctttctgag

SEQ ID NO: 53504 - DNA, 601 bp, Human
ttgagctcctgacctcaaatgatccacccaccttggcctcccaaagggctgggattacaggagtgagccatcatgcttggcctagccgttctcttttaacccttactccatctccctcacctgcacccatgaaccctcacccctgggtcagcgcaggaacctgcctttgtaccccatacccaagctgctgagcatggagactcacacagctgtgggtctggcacctttaacctctgcaagaccctagacacagcctgatggatgatccctgtgcatcttcaagttcagctccctccccackgcccttgaacacgctctactcccctttactgcctctccttccacccagcttcctacttcacagagaagagaggccctggggttggggaggaactatcccctccacatacttcccccaacttccaagcacaccacattctgccggtaccctggcgcatcctccttgcttctcagggaagaggtgtgcaccggcacgcgggcgctggatgatcagagcaacagtaacggcagatgtgtcctgactgattcctgtgtgccaggcaccgcccaagggccttccatggattacttcctatttcat

SEQ ID NO: 53505 - DNA, 601 bp, Human
gtgcgccaccatgcccaactaatttttgtatttttagtagagacagagtttcaacatgttggtcaggctggtcttgagctcctgacctcaaatgatccacccaccttggcctcccaaagggctgggattacaggagtgagccatcatgcttggcctagccgttctcttttaacccttactccatctccctcacctgcacccatgaaccctcacccctgggtcagcgcaggaacctgcctttgtaccccatacccaagctgctgagcatggagactcacacagctgtgggtctggcaccttkaacctctgcaagaccctagacacagcctgatggatgatccctgtgcatcttcaagttcagctccctccccactgcccttgaacacgctctactcccctttactgcctctccttccacccagcttcctacttcacagagaagagaggccctggggttggggaggaactatcccctccacatacttcccccaacttccaagcacaccacattctgccggtaccctggcgcatcctccttgcttctcagggaagaggtgtgcaccggcacgcgggcgctggatgatcagagcaacagtaacgg

SEQ ID NO: 53506 - DNA, 601 bp, Human
ttccaaagctagccattctctctctcttttttttttgtgaggcagagtttcgctcttgtcacccaggctggagtgcaatgggacgatctcggctcactgcagcctccacctcacgggttcaagtgattctcctgcctcagcctcccgggtagctgggattataggtgtgcgccaccatgcccaactaatttttgtatttttagtagagacagagtttcaacatgttggtcaggctggtcttgagctcctgacctcaaatgatccacccaccttggcctcccaaagggctgggattacaggwgtgagccatcatgcttggcctagccgttctcttttaacccttactccatctccctcacctgcacccatgaaccctcacccctgggtcagcgcaggaacctgcctttgtaccccatacccaagctgctgagcatggagactcacacagctgtgggtctggcacctttaacctctgcaagaccctagacacagcctgatggatgatccctgtgcatcttcaagttcagctccctccccactgcccttgaacacgctctactcccctttactgcctctccttccacccagcttcctacttcac

SEQ ID NO: 53507 - DNA, 601 bp, Human
tagagagggggtttcaccatattatccaggctggtcttgaaatcctgacctcaagtgatctgccctcctcagcctcccaaagtgctgggattacagatatgagccaccgtgcccagcccatcctcatcctcttatctttgtttcttttctctacaaaccatagctttggccatatcttctctcttcttaacggctttatctaaatctaattcacatccatataattcatccaaataaaatatataattcagtgctttttagtacactcacaaagttgttaaaccgtcaccccagtcaattktacaacatttttatcacttccccgccaagcccctgtacccattagcagccactccccatttcttctcagaccctcccaaccctaggaagctacaggtctacttcctctttgttggatttgcctattctggacatttcacgtcaattgaatcatatgacatatggtcttttatgaccggcttctcttaccgaatatgttcaacattcacccatgttgtaacatgtattacaactccattcctttttaagactgaatgatattcaaactttattcatccatccatcagttgagggacacctg

SEQ ID NO: 53508 - DNA, 601 bp, Human
gtagccgggattacaggtgtgtgccaccacacctggctaatttttatatttttagtagagagggggtttcaccatattatccaggctggtcttgaaatcctgacctcaagtgatctgccctcctcagcctcccaaagtgctgggattacagatatgagccaccgtgcccagcccatcctcatcctcttatctttgtttcttttctctacaaaccatagctttggccatatcttctctcttcttaacggctttatctaaatctaattcacatccatataattcatccaaataaaatatatawttcagtgctttttagtacactcacaaagttgttaaaccgtcaccccagtcaattttacaacatttttatcacttccccgccaagcccctgtacccattagcagccactccccatttcttctcagaccctcccaaccctaggaagctacaggtctacttcctctttgttggatttgcctattctggacatttcacgtcaattgaatcatatgacatatggtcttttatgaccggcttctcttaccgaatatgttcaacattcacccatgttgtaacatgtattacaactccattccttttt

SEQ ID NO: 53509 - DNA, 601 bp, Human
agcggctttcagctctttcctccacctcattcattctttgacctcatggagatttcagctctcattcctgtttgctccatatattcatcctcatccttttttttttttttttttttttttttttttttgtgagatagagtcttgctctgttgcctaggctggagtgcagtggtgtgatctcagctcactgcaacctccacctcccgggttcaagtgattctcctgcctcagtctcctgagtagccgggattacaggtgtgtgccaccacacctggctaatttttatatttttagtagagakggggtttcaccatattatccaggctggtcttgaaatcctgacctcaagtgatctgccctcctcagcctcccaaagtgctgggattacagatatgagccaccgtgcccagcccatcctcatcctcttatctttgtttcttttctctacaaaccatagctttggccatatcttctctcttcttaacggctttatctaaatctaattcacatccatataattcatccaaataaaatatataattcagtgctttttagtacactcacaaagttgttaaaccgtcaccccagtcaattttacaac

SEQ ID NO: 53510 - DNA, 601 bp, Human
cacagccagactcccaggaggctccgcagcacctgaagctgcggctggctgccgggccctctcgggctgcacatgctaggtccgggctgggaccccgccccgctcaccttgtggtgctggccgtgcatgacgaagtgcagcatgatgaggtaatagctgtcgctggggggcttcatgtggaacaggaagcggtggatgaggtactcgatgaggctccagaggaatgtccccagcatgaagagcccggggaacatggacttgggcactgccaccgtgtactctgcagggtggcagggagagygaggtgaggaccggtgcatagcagcctggtagctccaggtgtccctgcctcaccatccccatcagctcgggagctgctgccctctgttggacagctacagggccaggccatactgctggggtccttgagtcaaaatgggaaggaggctgtaggactctggtctgggtctgggaagtcctttacaggagtgatgggccactggctggaggcctgacatcctccttacagaggctgtgggaggagtggctgtggctggggctgggcctttacctggaagggtgaccttgccccaaggacatt

SEQ ID NO: 53511 - DNA, 601 bp, Human
ttgttcaatgatgtctagaacagtgtctcgcacacaggaggcactcactgggcatttgctgaatgaatgaacgaatgaatgagttgttttgaggattaaaggtgatgcgtaaacaagggtgcagagggcctggggtcagcttgatgctgcacacccacgctgtccccgcctggcttaggttcggatgcccaacccagttgccccgtgagtcacatcaaacgtcccgtccctcccaacccacagccagactcccaggaggctccgcagcacctgaagctgcggctggctgccgggccctctsgggctgcacatgctaggtccgggctgggaccccgccccgctcaccttgtggtgctggccgtgcatgacgaagtgcagcatgatgaggtaatagctgtcgctggggggcttcatgtggaacaggaagcggtggatgaggtactcgatgaggctccagaggaatgtccccagcatgaagagcccggggaacatggacttgggcactgccaccgtgtactctgcagggtggcagggagagcgaggtgaggaccggtgcatagcagcctggtagctccaggtgtccctgcctcaccatccccat

SEQ ID NO: 53512 - DNA, 601 bp, Human
cccaggactgggcacccaccctgatactggcccctaggaaagccccctaggatgcagatcaactctggggagagccgggaggaccacagccaaccaacctgagaactgtcccaggcggccgatcaaaccccgaatcggctcatcgagatgaaccggattaagttgctgctgggaaaccaaggtgaaacccacgttcagtatcagcgacatcagggtctaaactggtgtcccgaaagtatcatatctgccatattttctctgatttatgcccagcagagaacagagtgtggagacgggctgsggaacagcctgggatgggccaaggacagcacaatgcagggacagagaagcagcggggggtacaggggaggtagcttcctttgggcagacctatcttctcgggccagcttctgggactgtcgtggagtccttgaagggcctcaggggaagggtgattgagagcgcagactctggaatccccagaatggggtacgacatcctggctgtgccaagtgtgacctggggcaagttccttagtcctcctaggcctcagtctcctgctctgtggaacggggagaaccatggggctgttttcagcaca

SEQ ID NO: 53513 - DNA, 601 bp, Human
agatcttagctatggcttggtgaggagtctgagaagagaatcctgcagcctctctgggctggaggagagagagagaaagcaggtgacagtgacacaatgagatgctggcgtgggcctccctcccttcagaccaggaacaacaggaccagtgatgtgctggaaaaccagctctcaggaaaaggaggaagggagagagctggggaatgagggagggggaaataaagggagggagggagagccctgattggtagtgtttgccaattcctgcagtgtgaaaactgccctggcgctttcaagcgcygaggtggcgtcactggaacagaaacaggaaaggatgtgcatgggtgctcttgtgagctggtatgggccagatccgggtcacagctggatcaggatccttagatggataggtctggggatctgagaacacgttcctgattggagcccacgtggctacaggccatacagtctcctcgggtcctcatggtgtggcagcaggggactggacagactggggtggaagtgtctcaaaagagggagcctgagacagcccctggggccccagaatggcctgagcaggttcccagaaggttctggtgtc

SEQ ID NO: 53514 - DNA, 601 bp, Human
ccggaagtgtcactagaggtgtcctccccacccccatgtccaaacaggaggccttttttgttccaagggggtgtcgccacagtgaaccagagaacaccgcttcaccgtggccctcgagcttcagaagccaagggcctggcatagaggtgagatcttagctatggcttggtgaggagtctgagaagagaatcctgcagcctctctgggctggaggagagagagagaaagcaggtgacagtgacacaatgagatgctggcgtgggcctccctcccttcagaccaggaacaacaggaccagtgrtgtgctggaaaaccagctctcaggaaaaggaggaagggagagagctggggaatgagggagggggaaataaagggagggagggagagccctgattggtagtgtttgccaattcctgcagtgtgaaaactgccctggcgctttcaagcgctgaggtggcgtcactggaacagaaacaggaaaggatgtgcatgggtgctcttgtgagctggtatgggccagatccgggtcacagctggatcaggatccttagatggataggtctggggatctgagaacacgttcctgattggagcccacgtg

SEQ ID NO: 53515 - DNA, 601 bp, Human
aaggcactgagggcaactgaggttaatgcagcctctgtggcgggatgacccggaagtgtcactagaggtgtcctccccacccccatgtccaaacaggaggccttttttgttccaagggggtgtcgccacagtgaaccagagaacaccgcttcaccgtggccctcgagcttcagaagccaagggcctggcatagaggtgagatcttagctatggcttggtgaggagtctgagaagagaatcctgcagcctctctgggctggaggagagagagagaaagcaggtgacagtgacacaatgagakgctggcgtgggcctccctcccttcagaccaggaacaacaggaccagtgatgtgctggaaaaccagctctcaggaaaaggaggaagggagagagctggggaatgagggagggggaaataaagggagggagggagagccctgattggtagtgtttgccaattcctgcagtgtgaaaactgccctggcgctttcaagcgctgaggtggcgtcactggaacagaaacaggaaaggatgtgcatgggtgctcttgtgagctggtatgggccagatccgggtcacagctggatcaggatccttaga

SEQ ID NO: 53516 - DNA, 601 bp, Human
cagggaagagagtagagggaaccctctgtatatgccccgtacatggaacagtgccttgccgttcccaggagctcgatggtagttggcaaataaatcaatgaacacacatagggggctgggaagcacaggcccatcctcacctgacttctgatgtgcaaagtggtgcttgacgtggtgggccttcaggctgtacaggtaggagcccttgtgcggcgagccaaagtgcaggtagtaatgggtcatgtcatagaggacgtagcccaggaggccccccgcaaacacagtgccccctactgcctcrggcaggatgagctgcatgcacaagtagaagacgccgatcaccagggaggctggcacaggggggaagaccaggcgggagccgtcgaagggtgcctgcagatggagaggcttgggcatcaggaggcagccaggggccccggcagctggccaaaccctggccactccctgcagaggacaggggcacagcggcccagacattccactgcgtaggcttggcacctttggtggctttggggagggcgggccaccacgtctggaagatctggagagactgtcttacttcccatttgtgagccaggaa

SEQ ID NO: 53517 - DNA, 601 bp, Human
tgtctgcaccagggaagagagtagagggaaccctctgtatatgccccgtacatggaacagtgccttgccgttcccaggagctcgatggtagttggcaaataaatcaatgaacacacatagggggctgggaagcacaggcccatcctcacctgacttctgatgtgcaaagtggtgcttgacgtggtgggccttcaggctgtacaggtaggagcccttgtgcggcgagccaaagtgcaggtagtaatgggtcatgtcatagaggacgtagcccaggaggccccccgcaaacacagtgcccccyactgcctcaggcaggatgagctgcatgcacaagtagaagacgccgatcaccagggaggctggcacaggggggaagaccaggcgggagccgtcgaagggtgcctgcagatggagaggcttgggcatcaggaggcagccaggggccccggcagctggccaaaccctggccactccctgcagaggacaggggcacagcggcccagacattccactgcgtaggcttggcacctttggtggctttggggagggcgggccaccacgtctggaagatctggagagactgtcttacttcccatttgtg

SEQ ID NO: 53518 - DNA, 601 bp, Human
agttactggaatttttttttttttttttttgagatggagtttcgttcttgttgctcaggctggagtgcactggtgtgatcttggctcactgcaagctccgcctcctgggtccaagagattctccttcctcagcctcctgagtagctgggattacaggcgcgcaccaccatatccagctaattttttgtgtttttagtagagagggggtttcaacatgttggccaggctggtcttgaactcctgacctcaggtgatctgcccgtctcggcctcctcaagtgtgttaccggaaaatgtttaaccatgtttggagcaacttacctatgtgaactactgtttgcaaattttataaaatctagatatggatctagtatttctaatgaaactttagtatctgaattgagatgtgctgtaagtacaaaatacaccttagatttcaaagacttagtataagagttgctaattatttttttttaaagagactttacaaaaagggtctcactctgtcacccaggctggggtgcagtggcatgatcatagctcattgctgcctcaaactcctgggctcaaatgatcctcttgcctcagccttctaggtagct

SEQ ID NO: 53519 - DNA, 601 bp, Human
ggccagggccgggctgagggcaggacggagggggtgggagttgtcactgcgtcttcaggtggggtttctctggagtgagggtgtggaaacagtaatcccacaatttagtgctgataccaaatcctagagagggagacaaacggggagaagatgaggcattgaaggagcaggcgtgcgctggcttgggaagggtgccagggtagggataagaggtggagacaatgtcaatatctgtccccttggccttcccaactcccgaggccattctggcagaagtcaagggtggggaacctgtgtcttytattgtccccagcatgaagctggaataaaccctaattccttatctggccttcgtttctaggctacgtggccccctcccaccccccacctccatctccttccccttccttggggcccaagttcattcctgcctcagggctttgcaccagtcgctcttgggacgccagatgctgatttctcttcattagggtcttagctctaatggcacctctgcaatgacacctggaccatttaatctctttgctgtccaactagcccttagccacacatggctactgagcactagaaatgtggctagagc

SEQ ID NO: 53520 - DNA, 601 bp, Human; identical to SEQ ID NO: 32399

SEQ ID NO: 53521 - DNA, 601 bp, Human
gatcttggctcactgcaagctacgcctcccaggttcatgccattctcctgcctcagcctccggagtagctgggactacaggtgcccgccaccacgcccggctaattttttgtatttttttagtagagacaggtttttaccatgttagccaggatggtctcgatctcctgacctcatgatccgcccgcctcggcctcccaaagtgctgggattacaggcgtgagctaccacgcccggccccttggttctactcttaggaacctggtccccagttctgtggaccaccatacccagcacccccmaagcctggcctctgcgagctcagaagttgggcctggctggcacctgcattcacactggctgtgttcttccagggacatctcccccagctgactgctcgggtaccggatcatgaggatctgtgctcaggagaagaacaggggggacagtgagggagagagagaaaggggatgctctaagactgaagggagaaaagctcacccaacagccgggaggctggccaccagccctccccccaaccctgtctcctgtgcatcagtctccaggctgccccagccccagagccagccagcatccaccct

SEQ ID NO: 53522 - DNA, 601 bp, Human
caagtgctcaatccttcccttacttacccctgcaccccttcttctatgctgtaagatgtttcccacagcagggatgtgagccagggtaaggaggcaagccactggaaggaagcagagaaaagaaaaagggaaaagagaggagagagtctccaacagaaatgcttcttgggccaaggccccaagtgaggcaacttcctcacctagcttcttccctgaaggataaagaggtaagagtatgcagtggctaatatggagagagagtttctcttttttggttctggctgcaccattcagcttggcyctgggtctcaccaacaggatggcaggctgaggattagctgccctgctgggccaactcaataggacctggcaaaagccacgctctcccctctaccaccatcctccctgcttatagtaagacgtggcacaccaggcactcccaaagctctggcctatatcatactctagacaggccctaaaggatggaggaggtctgtcaagagtagaccctatggctctcaagtagcctttagaaagaataaggggtcaccctgcaaggcagttatttggaaccaaaaggcaaaccaagtagttactaagc

SEQ ID NO: 53523 - DNA, 601 bp, Human
agaatcaggttcaagccctggctcccccacgtacaagctttaatttccttatctgtaaagtggcaataaacattccctactttacacaggtagatgaaagagcacatgtaaaatgccttatccgatgttcaataagagcaatcattatgtccccaaatactactgtctgccaatccagaagtctcactgtcaaaacaaccttccaaatcgaagttgagcccgctaagccagctacagctcagctgaaggctgacaagagatgctacgggcctttccgcagaaggggccaggttgagtgccygctctcctccagacctggtgaaatgccacactccctcaacctgttgctagccgacaccagcacctctagccttcaaaagagggaaggaggagagtcaggaactcaagacagggtggctgtgaagggctggtcccacgctgggtatccaggacagggaaagagaggaggttctgcttgttcaggagccagagaagcaacaagcactggtgcttgctctttgatcccctgctccaaagtcaccaacccccttttcgggactgaaccatccaactcagaggactccaagtgctcaatccttcc

SEQ ID NO: 53524 - DNA, 601 bp, Human
tgaggcaggagaattgcttgaacccaggaggaggaggttacagtgagctgagatcgcaccactgcactccagcctgggcaacaagagtgaaactccgtctcaaaaaaaaaaaaaaaaaaaaattaagaaatcaactgggtgtggtggcatgcacctatagtcccagctgctctggaggatgaggcgggaggatcgcttgaacccaggaggagttcgaggctgcagtgagccatgatcatgccattgtactccagcctgggtgatagagcgagaccctgtctcaaaaaaaaaaaaaaaaaaatgcagagtctggtctaactcctgattagcgccctggtttacatctcacaaagaacatctggagcgatcgctccagcatactgcaacaaagcatatgaggccagagcctcatcccagaaccatccagagctgccttggaaacttcaaggaaacagtctggagggcagcagggtgaccagaggagtgtgagtgaaagttcttcctttcatggcccctgctggctgtacgtgaagcactcaaaaaccacagagaaaaaaagaatgacttgctactacccaaggaactgtccagcattcctaga

SEQ ID NO: 53525 - DNA, 601 bp, Human
gtctcccgcgtaggagacgaaatttctgccgctgaactacgaatgccccactgaacctttgttatttatcactttacatttatttgccatctcccccagtaaaaatggaagcacatgaaagcaggcatatattctttattcactgatacatcccagcacttagagagactggcttatgtttgctgctcaatgaatacttgtacaatgaaagaactgaacgattaggtctgagcaaggcagcagtctgccctgctctgccacccggctcaaatgaggggatgaggaagcagaagctacaackaccagcactgaagaggcatataaacataatacgggttgaatatcctttatccaaaatgcttaggaccagaaacgtggcagattttaaattgttttggattttggaatatttgcatatacataatcagatatctcagggatgggacccaagtctaaacatttatttttcatgtgtacattatatacatggcctgaaggtaatttcatgacattttaaaataattttgtgcatgaaataaagtgattgaattttgcttataacctgtcatatggggttacgtgtagaattttccacttgtgg

SEQ ID NO: 53526 - DNA, 601 bp, Human
tctcagctcaccgcaacctccacctcccgggttcaagcaattctcccacctcagcctcccgagtagctgggattacagtcatgcgccaccacgcctggctaattttgtattttcaatagagatagggtttctccatgttggtcaggctggtctcaaactcctgatctcaggtgatccgcccgccttggcctcccaaagtgctggaattacaggcgtgagccactgcgtccagccataataactttgttgggtagaaacgtagtagcccttcctgcatggaaggactgcatggccgaagtcraacccgagtctcccgcgtaggagacgaaatttctgccgctgaactacgaatgccccactgaacctttgttatttatcactttacatttatttgccatctcccccagtaaaaatggaagcacatgaaagcaggcatatattctttattcactgatacatcccagcacttagagagactggcttatgtttgctgctcaatgaatacttgtacaatgaaagaactgaacgattaggtctgagcaaggcagcagtctgccctgctctgccacccggctcaaatgaggggatgaggaagcagaag

SEQ ID NO: 53527 - DNA, 601 bp, Human
agatgatccaaccaaagccccgaaggtagcagagccatgggagggaatggttgggggacggtgagcgaaatggccagaaaatttaaactaggaattcaagagaaggtctaaatggggtcagtagatcattgaccccagaagagagatttagaaagggacaggtgggctgggggcagtggttcacgcctataatcctagcactttgggaggccgaggcgagcggatcacttgaggtcaggagttcgagaccagcctggctaccatggtgaaaccccatctctactaaaaatacaaaacttakccaggtgtggtggcgggtgcctataatcccagctactcgggaggctgaggcgggagaatcgcttgaaaccaaaaggcggaggttgcagtgagccgagatcacaccattgcactccagcctgggcgacaagagtgaggctctgactcaaaaaaaaaaaaaaaaaaaaaaaaaaagggacaggaggtgccatgtgcttactttctggaggctggaggagttcagttgagtcttgtcaatgatcttcacagctacctgaggatgagacaaaaaggccccaaatcacttctctgaccagcgaaa

SEQ ID NO: 53528 - DNA, 601 bp, Human
agggagaaaaacaaggtcaggaataagatggcttggtggactggcgattattacgatggcaggctagactgctcccaaggccaaatggcctaccccacgctgacttcttctgtggggctggagccaggatgtcataagcagccctttttcccttcctcctggaaagcttcaagcagagacaccctgatgatgacaacaatgtttctactgaactgaagaacccttgaagggatcccaggggtaacaataaataggaaacaccttggttctggctatttgcatgtccggagaacaactcatycactctaattccatgagcatcgccctcaacaacaatcctcagcccttactcctaaggttcccagtatcactatctgactctgttagcacgaatcatgccttctcctaactcaactgccacaatatgcttatggagaaaatatctgatttgccacaagatgaacagaactaggttttgttcagaaaatttgagctggagctcattctctaaaaggtagctggcacagaacccaccggcaggttccctgcttcctcttattcttgtatttctaaagccactcccctgtatcattccagatct

SEQ ID NO: 53529 - DNA, 601 bp, Human
agagtctcaaaaggttttgaaaatggctctatttgtctggtgttggtgccttccagagagtcaggaagaattagggagaaaaccaagaagaattagggagaaaaacaaggtcaggaataagatggcttggtggactggcgattattacgatggcaggctagactgctcccaaggccaaatggcctaccccacgctgacttcttctgtggggctggagccaggatgtcataagcagccctttttcccttcctcctggaaagcttcaagcagagacaccctgatgatgacaacaatgtttctmctgaactgaagaacccttgaagggatcccaggggtaacaataaataggaaacaccttggttctggctatttgcatgtccggagaacaactcatccactctaattccatgagcatcgccctcaacaacaatcctcagcccttactcctaaggttcccagtatcactatctgactctgttagcacgaatcatgccttctcctaactcaactgccacaatatgcttatggagaaaatatctgatttgccacaagatgaacagaactaggttttgttcagaaaatttgagctggagctcattct

SEQ ID NO: 53530 - DNA, 601 bp, Human
ggggttttctgggcttgtctagacccctgagggggctagcttcttcaatgttcatttttcagggatcattgctgagatcacatttttggccagaatcagactggctttagtaacaaagagtctcaaaaggttttgaaaatggctctatttgtctggtgttggtgccttccagagagtcaggaagaattagggagaaaaccaagaagaattagggagaaaaacaaggtcaggaataagatggcttggtggactggcgattattacgatggcaggctagactgctcccaaggccaaatggccyaccccacgctgacttcttctgtggggctggagccaggatgtcataagcagccctttttcccttcctcctggaaagcttcaagcagagacaccctgatgatgacaacaatgtttctactgaactgaagaacccttgaagggatcccaggggtaacaataaataggaaacaccttggttctggctatttgcatgtccggagaacaactcatccactctaattccatgagcatcgccctcaacaacaatcctcagcccttactcctaaggttcccagtatcactatctgactctgttagcacg

SEQ ID NO: 53531 - DNA, 601 bp, Human
agctgaaggccggggtttcagggtgatggtgtcgccttccagctgaaagaaacagaaaacagcttcaagggagggcagaagtcatgtggagatccctatggatggacacatttacacataccgccctctcccaacactcaaacaccccaggatcataccggacatccacttgtaagaccaatacatcccccctggaggagaccctggagacacacatgctctgacacagacactgacaaacacagtctcagaaaggaatacataagcccacacacccagagacacaaacatccgcaagaayacatgtccagactcaagtccactcccctcaacacagagcaatatgggcctataccaagtgtcaccaggtgcctcttaaggatcccaccaccagagggagagcagggcagggaggctgggagttcatgtggggatactcagatgatgaacaaaacccaaatgggcagaagaacaatcacaaagtctccagatccacagacgggaagacggacacatacacacacacacacacacacacacacacacagatacacacacccaaacataaagcactagacagaagcaacagactcaatagccg

SEQ ID NO: 53532 - DNA, 601 bp, Human; identical to SEQ ID NO: 53522

SEQ ID NO: 53533 - DNA, 601 bp, Human; identical to SEQ ID NO: 53523

SEQ ID NO: 53534 - DNA, 601 bp, Human; identical to SEQ ID NO: 53524

SEQ ID NO: 53535 - DNA, 601 bp, Human; identical to SEQ ID NO: 53525

SEQ ID NO: 53536 - DNA, 601 bp, Human; identical to SEQ ID NO: 53526

SEQ ID NO: 53537 - DNA, 601 bp, Human; identical to SEQ ID NO: 53527

SEQ ID NO: 53538 - DNA, 601 bp, Human; identical to SEQ ID NO: 53528

SEQ ID NO: 53539 - DNA, 601 bp, Human; identical to SEQ ID NO: 53529

SEQ ID NO: 53540 - DNA, 601 bp, Human; identical to SEQ ID NO: 53530

SEQ ID NO: 53541 - DNA, 601 bp, Human; identical to SEQ ID NO: 53531

SEQ ID NO: 53542 - DNA, 601 bp, Human
ttttttttttttttgagatggagtctcactctgtcacccaggctagagtgcagtggcgtgatcacagctcactgcaacctacgcctcccgggttgaagcaattctcctatctcagcctctccaatagctgggattacaggcctgcgccatgacccgctaatttttgtacttttagtagagagggggtttcaccatgttggccaggctggtgtagaactcctgacctcaggtgattcgcccaccttggcctcccaaagtgctaggattataagcgtgagccactgcgcccagccgagatccttttttttttttttttttttgagacggagtctcgctctgtggcccaggctggagggagacggagtctcgctctatggcccaggctggagtgcagtggcgcaatctcggctcactgcaagctgcccccagggttcacgtcattctcctgcctcagcctcccgagtagctgggactacaggctcccgccaccacgcccggctaatttttcttctgtatttttagtagagacggggtttcactgtgctagccaggatggtctcgatctcctgacctcgtgatccgcctgcctcggcctcccaaa

SEQ ID NO: 53543 - DNA, 601 bp, Human
tgtaatcctagtgctaatgaagtgggaggccaaggctagaggattgcttgagcctagaaattcgagaccagcctgggaaacagcaagagccccgtctctacaaaaaatgttaaaattagccagttgtggtggtgtgcccagctactcaggagagtgaggcaggaggatcgcttgaggccaggaacttgaggctgcagtgagctatgatcccaccagggcacttcagcctgggccacagaaccagaccctgtctctaaaaaaaatacaaaataaatttggtaacagaaatcgtttcttttctttttttttttttttgagatggagtctcactctgtcacccaggctagagtgcagtggcgtgatcacagctcactgcaacctacgcctcccgggttgaagcaattctcctatctcagcctctccaatagctgggattacaggcctgcgccatgacccgctaatttttgtacttttagtagagagggggtttcaccatgttggccaggctggtgtagaactcctgacctcaggtgattcgcccaccttggcctcccaaagtgctaggattataagcgtgagccactgcgcccagccgagatcc

SEQ ID NO: 53544 - DNA, 601 bp, Human
ttttcattaaaaaaaaaaaaaaagtgaggcaggccttggccctgtcagaacagtgtcctcactaaagggtttctccttactgagctgccccacaaaaggtcaggtgccccacagcagcctacctgagggcaggcaaccccttgagaagctcattgtatttattattattattttttgagacagagtcttgctctgtccccagactggagtgtagtggcacaatcttgcctcacggcaacctccgcctcctaggttcaagcgattctcctgcctcagcctcctgagtagctgggattacagwcacccgccaccacgcccagctaatttttgtatttttagtagagatggagtttcaccatgttggccaggctggtctcgaactcctgacctcttaatccacccatctcagcctcccaaagtgctgggattacaggcgtgagccaccgcgcctggccatatttatttttttttaaagatggcatctcactctgttaccagcctggagtgcagtggcatgatcacagctgactgtaaccttgagctcctgggctcaagcaatcctcctgactcagcccttttttttttttttttttgagacaga

SEQ ID NO: 53545 - DNA, 601 bp, Human
aaagagaaaaaaaggagaggagtaggctacgaggccaaggctgctactgtaaggatccatccaaatagcagaggcacatccgccccgccttgttcacctctgatcgactgtggtcagtttctttggcaacactttttcccttatttttttggtaaagacagggactccttatgttacccaggctggtcccaaacctttgggctccagtaatcctcctgcctcaacctcccaaagtgctgggattataggcgtgagccactgtaccgggcctcttcctttttttttgagacagggtcttgcygtgtcacctgggctggatgcagtggcacgatttcagctcactgcaacctccgcttgccaggctcaggtgatcctcctgccttagtctcctgagtagatgggactacaagcacatgccaccatgcctggctaaatttttttgcatttttagtacagacagggtttcaccatgttggccaggctggtcttgaactcctgacctcaagtgatccgcccacctcagcctcccaaagtgttgggatcacaggcgtgcgtcaccgcgcccagccctggcctcttccttcttagtaccaaaaataaa

SEQ ID NO: 53546 - DNA, 601 bp, Human
agtacaagatttagacacatctttacacatgaacttcaaccctgtttccactctgatataccaacagagaaagtagggcctaagtagatggaaaggatggggttgacgctagatcagagttctagaagagcaggagagaggtgtatacagatgacaaagaacattctagattactgtgaaatatgctcccctgaccctttctataattacaaataaacgaccaccacctactgctctgcagagaataagcaaaggcaaaaactctgcagtttagaccagggaaccctctgctgtgaggttrcaggaagaaagcataacattccccgatttccagaacctcagtgagcggcgtccacttacgtgcccaggtcagaaggcttgtttcgtagctgctctatcagctcccggtaggtaggatcactgagtagtgtccttgtcctgggatcactctccaacttctgatacagattaggcatgttgaaagggttcatgaattttctctctgtccaaataaaggaaagcacatcactatgaaatgagttcactagaattactgtgtcccataccctaccagactgacatttctcaggggtgaagactc

SEQ ID NO: 53547 - DNA, 601 bp, Human
gatgaataccagtacaagatttagacacatctttacacatgaacttcaaccctgtttccactctgatataccaacagagaaagtagggcctaagtagatggaaaggatggggttgacgctagatcagagttctagaagagcaggagagaggtgtatacagatgacaaagaacattctagattactgtgaaatatgctcccctgaccctttctataattacaaataaacgaccaccacctactgctctgcagagaataagcaaaggcaaaaactctgcagtttagaccagggaaccctctgytgtgaggttacaggaagaaagcataacattccccgatttccagaacctcagtgagcggcgtccacttacgtgcccaggtcagaaggcttgtttcgtagctgctctatcagctcccggtaggtaggatcactgagtagtgtccttgtcctgggatcactctccaacttctgatacagattaggcatgttgaaagggttcatgaattttctctctgtccaaataaaggaaagcacatcactatgaaatgagttcactagaattactgtgtcccataccctaccagactgacatttctcaggg

SEQ ID NO: 53548 - DNA, 601 bp, Human
ggattgatgtggacaacattcttcggatcacgacaaggacgtgaattactctcaactttccagtcttgctaggaccaacattcacactggcagcaatgaagccgctgtggtgaccacgggaagggcaactcccgcagctcactctttgctacacattactcctaggaatgctcttgtgaagctttttttttttttttttttgagatggagtctcgctctgtcacccagcctggagtgtagtgatgagctctcagcttattgcaacctctgcctcccgagttcaagcgattcttctgcctcrgcctcccgagtagctgggactacaggcgcccaccatgacacctggctaatttttgtgtttttagtgaagatgaggtttcaccatgttggccagactggtcttgaactcctgacctcaggtgatctgcccaccttggcctccaaaagtgctgggattataggcatgagccaccgtgcctggcctgaagctgattttttaacatgctggccattctaatgaataatagccataagcttagcgcatactaaagcactcaaaatagttttaggtgggcacagtggctcgtgactgtaatcctag

SEQ ID NO: 53549 - DNA, 601 bp, Human
acaccctaaacaaccaacgcttacccatttcaaggtgctaaatttggcaacaatctgctgttccagtttacaaggagggaaatgaaatcgttgaggcacatgccttctgctctaaaagagtgctgcttagcggacactcccaaccacacaccatgtccagccaggaagcaaaggcctagggattgatgtggacaacattcttcggatcacgacaaggacgtgaattactctcaactttccagtcttgctaggaccaacattcacactggcagcaatgaagccgctgtggtgaccacgggamgggcaactcccgcagctcactctttgctacacattactcctaggaatgctcttgtgaagctttttttttttttttttttgagatggagtctcgctctgtcacccagcctggagtgtagtgatgagctctcagcttattgcaacctctgcctcccgagttcaagcgattcttctgcctcagcctcccgagtagctgggactacaggcgcccaccatgacacctggctaatttttgtgtttttagtgaagatgaggtttcaccatgttggccagactggtcttgaactcctgacctcaggtg

SEQ ID NO: 53550 - DNA, 601 bp, Human
ccaacaattcccttgccccttgtttctgggcctcacctgcttgattggtaatgtaagtcatgttagtggggtccagctccttggctttgtcgtaatgcttcaaggctgtgtcaaagtctttcttcttgtaggcatcgttccccagctctttttctttcagtgcctagatgaggtttagaagtgagtgctgagcaaatctaactcaggtgacaaagcaagaatctatgatctgtcacaagttctgaaatacaactaacatgaatagaattctatcaagttctcctgaaggcctcttcatcartcagctatagacaataaagtatcagccgttagaatgaaaactaacttcatctttgcttgctctgaaactcccccttttccacctactctcctagatctttgtcaggaagcagagcgcttctttaggggagaggaaatcccttcgacttgaagcaaccggtgaggacagcagagttttggaccaggctttattctgaggctgcagcagatctggtgtcagtcttgtggttgcctcagggtcttagttgtcagggaaccatagcagagggggtggtgagaggatgagaagcggctgagtggc

SEQ ID NO: 53551 - DNA, 601 bp, Human
tgaggagggcggatcacttgagttcaggagttcaagaccaacctgggcaacacagtgagaccccttctctacaaataaaaaaattagctggacgtggccaggcgcagtggcctgtaatcccaggactttgggaggttgaggtgggtggatcatgaggtcaggagtttgagaccagcctggtccatataatgaaaccccatctctactaaaaatacaaaaattagccgggcatagtggcgtgcacctgtagtcttagcaattcgggaggctgaggcaggagaattgcttgaacctgggaggwggaggttgcagtgagcagacaccatgccactgcactccagcctgggtgacaaacagactccatctcaaaaaaaaaattagctggacgtggtggcacgtgcctgtaatcctagctactcaggctgaggtgggaagatcactgaagcccaggaggttgaggctgcagtgagccacgattgtgccactgtctttcagcctgggtgaaagagtgagaccctatctcaaaaaaaaaaaaaaaagtcaagttcattattaaataaaacagtaagaaacaatggctcaattattaggaaaacaagaa

SEQ ID NO: 53552 - DNA, 601 bp, Human
aaatgtagcaggatgtggaggcatgagcctgtggtcctagctcctcaggaggctgaggcaggacagagtgagacactgtctcaaacatcatgatcatcatcaactcaatgttgatgaggagagagagagaaaacccactcctcatgtgcaggctttcagtaatggccgcccccacaggtctcgtcaccttgagtgccagctggaactccaggagtttggtgtagcaggcagctcgattgctgtataatttggcatctttcgggttccttttgatggcttctgtataatgcttcatggcctggggatagtcccctggggaagaaaaacaaagactgtcttttaaaaagcaaaaagcccccatgtgtagccggccatttaccccacagccaggcacgggaggcacacccagcactgctcccccaatcccccagctgcaggcagtacctttctgaaaacactcgttgcctttgttcttctcctccaaagccaggtcggggtttatgtaggccagccgctcttgctccttcaggattttctctgcctacaaaacataattcttgaaataataatttaaacgctcataatcatctaaatattgggc

SEQ ID NO: 53553 - DNA, 601 bp, Human
acacacacgaccagttagatacaggtcccatattttacacacgcacacacacatacacacacacacccctataaatctgggcaacacagcaagaccccaactctacaaaaaaaataaaaaatgtagcaggatgtggaggcatgagcctgtggtcctagctcctcaggaggctgaggcaggacagagtgagacactgtctcaaacatcatgatcatcatcaactcaatgttgatgaggagagagagagaaaacccactcctcatgtgcaggctttcagtaatggccgcccccacaggtctcstcaccttgagtgccagctggaactccaggagtttggtgtagcaggcagctcgattgctgtataatttggcatctttcgggttccttttgatggcttctgtataatgcttcatggcctggggatagtcccctggggaagaaaaacaaagactgtcttttaaaaagcaaaaagcccccatgtgtagccggccatttaccccacagccaggcacgggaggcacacccagcactgctcccccaatcccccagctgcaggcagtacctttctgaaaacactcgttgcctttgttcttctcctcca

SEQ ID NO: 53554 - DNA, 601 bp, Human
gggcgcagtggctcatgcctgtaatcccagcactttgggagtccaaggcaggaggctcgcttgagcccaggagtttgagaccagcctgggaaaacatggtgaaaccctgtctctataaaaaatacaaaaattagctgggtacagtggtgcacacctgtagtcccagctactcaggaggctgaggtgggaggatggtttaagccagggaagtagaggttgcagtgagctgagattgtgccactgtactccagccagcctgggcgatagagccagaccttgtctttttttttttttttttttwaaaaaagggggccaagcgtggtggttcacgcttgtaatcctagcactttgggaggctgaggcgggtggatcacctgaagtcaggaattcaaggccagcctggccaacatggtaaaaccccgtttctactaaaatacccgggagatggtggttgcagtgagccgagattgtgccacggcactccagtgtgggcagctgagtgagactgtctcaaacaaaccaacaaaaaaagtaaacacagacaccacatgacccagcaattccacttcttaaaaatggttaaaaaggcaaaaacaaagaa

SEQ ID NO: 53555 - DNA, 601 bp, Human
caaaaataaaacataggccgggcgcagtggctcatgcctgtaatcccagcactttgggagtccaaggcaggaggctcgcttgagcccaggagtttgagaccagcctgggaaaacatggtgaaaccctgtctctataaaaaatacaaaaattagctgggtacagtggtgcacacctgtagtcccagctactcaggaggctgaggtgggaggatggtttaagccagggaagtagaggttgcagtgagctgagattgtgccactgtactccagccagcctgggcgatagagccagaccttgtctttttttttttttttttttaaaaaaagggggccaagcgtggtggttcacgcttgtaatcctagcactttgggaggctgaggcgggtggatcacctgaagtcaggaattcaaggccagcctggccaacatggtaaaaccccgtttctactaaaatacccgggagatggtggttgcagtgagccgagattgtgccacggcactccagtgtgggcagctgagtgagactgtctcaaacaaaccaacaaaaaaagtaaacacagacaccacatgacccagcaattccacttcttaaaaatggtta

SEQ ID NO: 53556 - DNA, 601 bp, Human
actcgggaggctgaggcaggagaatcgcttgaacccgggaggcggaggttgcagtgagccaagatcgtgccactgcactccagcctggcgacagagtgagactcatctcaaaaaaaagagttaagagaatccggagtcacaggggcggggggagtgatggtagcagaggtggtcagcactcaccttggtgagaagcaccactggagccaaggccacagggatgatgggaagagagttccaggcagagagaagggcagatggtaaggcctcgagggcaacacctgctcctggctagggtggrcctaggggagggggtttaggaaagggtatttggagacctaaagttgaaggtcattctaaggactctggcattgcctttgagtaaaaacctggaaaggatttgagcagaagcagcatggtcagatttagacattcagagagtcaccagggaggtggtgagaagtagctgatccctggatttatttttaaagcagaactggcaggatctgctgatggactggatgtggggtgcgagggaaagagaggagtcaggatgatgccaaggaattttaaaaaaactattaggctgggcgcggtggct

SEQ ID NO: 53557 - DNA, 601 bp, Human
aaaaaaaagagttaagagaatccggagtcacaggggcggggggagtgatggtagcagaggtggtcagcactcaccttggtgagaagcaccactggagccaaggccacagggatgatgggaagagagttccaggcagagagaagggcagatggtaaggcctcgagggcaacacctgctcctggctagggtgggcctaggggagggggtttaggaaagggtatttggagacctaaagttgaaggtcattctaaggactctggcattgcctttgagtaaaaacctggaaaggatttgagcagargcagcatggtcagatttagacattcagagagtcaccagggaggtggtgagaagtagctgatccctggatttatttttaaagcagaactggcaggatctgctgatggactggatgtggggtgcgagggaaagagaggagtcaggatgatgccaaggaattttaaaaaaactattaggctgggcgcggtggctcacgcctataatcccagcactttggtagttcgaggtgggcagatcatgaggtcaggagatagagaccattctggctaacacggtgaaccccgtctccactaaaaataca

SEQ ID NO: 53558 - DNA, 601 bp, Human
acttccacctcctgggttcacgccattctcctgcctgagcctccccagtagctgggattacaggcatgcaccatgcccagctaatttttgtgtttttagtggagacgggggtttcaccatgttggccaggctggtctcgaattcctgacctcgtgatccacccgcctcagcctcccaaaatgctgggattacaggcatgagccaccgcgtctggccgctagaggtggcttttaagcatctggtgggatttttagcagggtgctagtgggagctggcagggacttggagtctgaaccagagwtgtgcttgtctcagtccagttaggggtaggggcttcaggtgtgtgcaaaggaaggaatggtagatgtggggtccaagctggctgagcttcagggaagggagcaagccctgggaagccgcagcatcgttggagttggggtcccgggggcatgatccacacaggttgggtcagctggtgggaagcttgggatggagttatttgatggtgacaaggcctaggttatgtccctgggaatgagtctgaggggagagtgggacaagatcatggtagaaggagtagcaaggtacagaaaggagacag

SEQ ID NO: 53559 - DNA, 601 bp, Human
taagcatctggtgggatttttagcagggtgctagtgggagctggcagggacttggagtctgaaccagagttgtgcttgtctcagtccagttaggggtaggggcttcaggtgtgtgcaaaggaaggaatggtagatgtggggtccaagctggctgagcttcagggaagggagcaagccctgggaagccgcagcatcgttggagttggggtcccgggggcatgatccacacaggttgggtcagctggtgggaagcttgggatggagttatttgatggtgacaaggcctaggttatgtccctgrgaatgagtctgaggggagagtgggacaagatcatggtagaaggagtagcaaggtacagaaaggagacagggtgctggtggagtggcagaggacaggagtaacattctgcacaggccagggacgacacctccccccagccccagctgcagacccgtaggaaagagggctgcgggagaagacagctgccaggtgaggacagagctggatttcttaaccttttgatttagttttcagtgtctccaaaagcaagtggtttcccagaaaagatcagcaagtgccagtgccccgccagagccacgg

SEQ ID NO: 53560 - DNA, 601 bp, Human
tctctacctgcgcagagcaactcacacttggttcggtcactcctcatagtccctgccaccaggcccccctgctggatggctgaggtgtccccagggcagggactgcagccaccttgtgctgtgacagcccacacagcccagtgtctgaaacaggtgtggacagtggagaggcagaaagaagcagcccagtgctagcccctgggccagactgcagggttcaaacgtggctctacccttcctagcaggttgagcttgagcaggttaattaactccatctgcctgagtttcctcatctgtaaaygggaatagaactagtcccacctcgcagggctgtggcgaggacctgatgagttaatataggaaaagtgcttggaaacagtgcctggcgcagaggaggggctaagtgtttgcggctcttattattagaactgccattgttattatttatgtatatatatatttatatataaatatatatatataatttttttttccaagatggagcctcactctgtcgcccaggctggagtgcagtggtgcaatctcgcctcgcagcaacctctacctcccaggttcaagtgattttcttgcctttatgtac

SEQ ID NO: 53561 - DNA, 601 bp, Human
ctgcttgttctgatccctgggcaaggggcagtgcccaggccaagtgcctgggtgcaagtcactcaccttccacctgtggggccttgtgtccggcaagcgtagtggtcctgtggccccactcagagctagtggaggagaacagctgccgtttcctgcgtatttaggtggctaagcaggctgtcccagccacacggcctcaggcaagttcttaacctctgcctctgtttcctcatctgtacaacagggagagctggatattcacctggctgggactctcagaggcctcaggctatgaggggcyggtagggggctttcctgctctcatttgttgtcatggcgatcctggcagatggggaactgcccccatttcacagaagacactggggccccaaagggttggagaatgggctaaggtcagagcaggaatgtggccagggcctggcccacctagctgacccctgctccacagtcaccgcaccacagaactggaaattactctgcagacaggcctgttccgtcagtgccccttctgttcccggctctcctgcccctatccgaaatccttcagcctcccaaggtgctgggattataggcatgagcc

SEQ ID NO: 53562 - DNA, 601 bp, Human
tttcaccatgtgggtcaggctggtctcgaactcctgacctcgtgatccacctgccttgggctcccaaagtgctgggattacaggcgtgagccaccacacctggcctttttttgtatttttagtagagatgggtttttgccatgttgggtcaggctgatctcgaactcctggcctcaagtgatccacctgccttggcctcccaaagtgttgggattactggcgtgagccactgcgcctacttgctttttttttttttctcgaggtagagtttcactctgtcacccaggctggagtgcagtgrcgtgatctcagctcactgcaagctccgcctcccgggttcacgccattgtcctgcctcaccctcccgagtagctggaactaaggcgccagccaccatgcccagctaattttttgtacttttagtacagatggggtttcaccgtgttaggatggtctcgatctcctgacctcgtgatgcgcctgcctcggcctcccaaagtgttgggattaaaggcgtaagccaccgcacccggccacctacttgctttcttagtcatgtgtctcatttatgtgtcctagctgggacccctggaggccctgc

SEQ ID NO: 53563 - DNA, 601 bp, Human
aatgtctcggcctacacgtaagtgcaccatcaatggtacctaaaaacgtcaacagttccagacactgtctccagagaaggctctgtgggggatgcggacatgtagcggccaagttcttgttctccaggggctctgcaggtcccttgcagaggaggcattcaatcctgccggctgtggcaggacactttcctatccaagggattggcttcctccgatgtagaacagacactatgaaatagctaccaacccaggggttgccaggaggccccatgaaggtcttgcactaataatacttcttgctttttttttttttcttttgagaaaaaaagcctgtcgcccaggctggagtgcagtggcgtgatctcggctcactgcgacctctccctcctgggttcaaacgattcttctgcctcagcctcccgagtaactgggactataggcacgtgccactatgcccagctaatttttgtgttttgagtagagacagggtttcaccatgttggccaggatggtctcgatctcctgaccttgtgatgtaactagtatttcttatgcccttattttgtgctaggcacagggcctcacccattattggcactcg

SEQ ID NO: 53564 - DNA, 601 bp, Human
taacctaaatcttcaccaaaggcccctgagcttcccctcgattcacatacaagggactggggctctgagaggtgggctgtgatgcgcccctggaagacccacgagtgggcctgcagagctgatggggagggttcaggcagggccaggggcttagaggagctgagattaacgtcgcccccctacccactgaccctctgcaggcgctggggctgtggagatccggagtcgccacagctcctaccccgcggggacggaggacgacgaagggatgggggaggagcccagcccctttcggggccgytcgcgctcggcgccccccaacctctgggcagcacagcgctatggccgcgagctccggaggatgagtgacgagtttgtggactcctttaaggtgagcgccagtccccagcgtgccaggacctgaagtaccaggccgccccccgccggtctgtccctgccttgtcccaaggcacgcccggatctggagtcccacgacccctccccaaagccgtcctgttccttcctagctccagagcattctgggatttgtagtcacaagacttccccgcccccactccccagctcttcccccgcctggtgt

SEQ ID NO: 53565 - DNA, 601 bp, Human
ctaggaaccaaacctaagtctgggaacccctgatgtaaatgaagtgggagagaaatgtaaggagatggacaaggttacttagtctggcttgttttttatttcctttgaagcatttcctaaggctgttttttccttctcatctgattctgaccaccctcagcaatcagagaatagggacttgaatattctgggtaacagaatattgcccttatgtaacatgacctgaaacagacgtaaataaagacaaacctttccataagttgttatggattagaaacctttatgtttaggatggggtgagagtggtgtaaaagtaaacaggtatcttcatttattgtataattgcttatggactctgaaggaatatagtttaaaaaaaaatatggcccttcctaggagctttcaccttatttagagacagaatatagacattcattaatcagcagacaatgtatgtacaaagcagtttatccacgagactccattctaaagcatgagtcacacttagtatgcataggtccttcggtttcttgaatcagcttagttttctgctctcatttcacaagaatcactctcttccctcagaaatactgcattctag

SEQ ID NO: 53566 - DNA, 601 bp, Human
ctaacctacagaaaataataagagagccagataagtaaaggtatgaataaatggaaaattcttttttctcatttgttagtttctttaaatgaaaaataactgtttaaagcaaaaataataacagtgaattatatatgtaatatgtagaagaaaaatgtatgacagtaatagtaccaaaaatggggtagaataaatgagacaatactcttttctacaaaatagtataatatttgaggctagaggctaaagttaaaaatgcatttttttaacagaaaaatattctataagtgtcctgcatgtrgaaaatcctaaagaagtgagaggaaaagctacttgaactaaatgaacttagcaaagtcacaatatgtgtactcagtattttaaaaaatcaattgtatttctgtatatcagttacatacaattggataatgatatagaaaaagcaatttacaaaatacataaaatattaagacataaattttagatggaataacatgtgcattactctacactgaaaactactttgctgagagaaattagaggggggccaaataaatggagagggataccattttcatggattgtaagacacaattttgtc

SEQ ID NO: 53567 - DNA, 601 bp, Human
taacaatcccagcaggcggccgggcgcagtggctcacgcctgtaatcccagcactttgggaggccgaggcaggcggatcacaaggtcaggagatcgagaccatcctggttaacatggtgaaaccccgtctctactaaaaaaatacaaaaaattagccgggcgtggtggcaggtgcctgtagtcctagctactcgggaggctgaggcaggagaatggtgtgaacccaggaggcggagattgcagtgagccgagattgcgccactgcactccagcctgggtgacagagtgagactccgtctcaaaaaaaaaaaaaaaaaaaatctgagcaggcattttagtaaaatttgacaagctttttctaaagtgtatatgagaatgcaaaggtcctgaaataacaaaaaccacttaaaaaaaaaaaaagaaaacttgggagtatttatactgcttgattttaatacttctataaagcaccagtcatcaagatggtgtggttttggaataaaaatagacatatagatcaatgcaaaataatggagagtccagaaacagacccacatttatatggcgaattgacattcaacaaagacaccaaggtaattaa

SEQ ID NO: 53568 - DNA, 601 bp, Human
tattacataggatgaattactcttggaaacatgctaagtgaaaaaagccatatatattcagattttttttaagctctcaaacaggcaaaactaatctgtagtaatagaagtctgatcattgtttgcctgagttaggaagattgatagccaaggaacatgaaggaaattttagaggtgatagaaatattctgttttcttgatttgagtggaaagtcctgggtttatacctttctcaaaatttgttgaactgtacaaaatttgttgaacttaaaatgggtgcattttattgtatgtaaattatacatcaatgaagtttagtttagaaatatctgagagtagaatgatttccagccaataactatcacatttcttgtagttgtaaagatagaataaagcattttcagatataaaagacctcagattttatctgcttgatatattcaccttttctagcaaaggtcctggaagatgtccttaaacaggggaaaaccaaaagagacaaaaccaaaagagacggaggaagcaaaggatctgaaaggaagcccaggaatgacagctgatccacaagattagggaacaaccagtgcatattgaaccgggg

SEQ ID NO: 53569 - DNA, 601 bp, Human
ctgagttaggaagattgatagccaaggaacatgaaggaaattttagaggtgatagaaatattctgttttcttgatttgagtggaaagtcctgggtttatacctttctcaaaatttgttgaactgtacaaaatttgttgaacttaaaatgggtgcattttattgtatgtaaattatacatcaatgaagtttagtttagaaatatctgagagtagaatgatttccagccaataactatcacatttcttgtagttgtaaagatagaataaagcattttcagatataaaagacctcagattttayctgcttgatatattcaccttttctagcaaaggtcctggaagatgtccttaaacaggggaaaaccaaaagagacaaaaccaaaagagacggaggaagcaaaggatctgaaaggaagcccaggaatgacagctgatccacaagattagggaacaaccagtgcatattgaaccgggggcctggcgaatcctctagaaaggaggcctccagagaagaaatgaattgatctccttgagtttatagaaaatattattgatagatttatgtcagaatgttgaaacatctgataaattctagaaccgc

SEQ ID NO: 53570 - DNA, 601 bp, Human
agttacatttcatggtttttgtatatttgtttatttatttttagtgattaagatattcacggttcaacattcaaaaaagtttttaaaatatatagtgaaaaatatctttcctggcagtatcgttttttctgtaccttcaaaaattacgtacatagacttccctttttaaaatacaaatagtgtcatactatacacattagctgttctgtatcttagtcactttttcacttaatgttctatggatgtcattctgtatcagtgcataaagagcatctttattctttttttatagctgtacaayttcttacagttgtaccagaatttacttaaccagtagcctgataggcatcttttgctatcacaaagctgtaatgaataatcttatgtagagataatttaccacatgtgacggtatatctgagatacaagttctgaatagaattgctgggtcaaaagatagatattgccaaatagtcctttccagcagttgtttcagcttacaccctaactgataatgtttccatttctgcatatccttgccaatacattgaattatgtactttctcatttttgcccatctgatggttttattcttttaggt

SEQ ID NO: 53571 - DNA, 601 bp, Human
cctagtgatttgagaaaagaaaacgggtgtactcagatatacattatagtttccttctttttggtgaattttaaggtcagtttaaaaacagatgttgaaaaaatatatatatataaatagatatcatttattggccatgagtatatctcactggctggtatatactttttactccttgtgtaaaggagtaaaaagattgtaacattttaaattcaattacacagtaatgaataaatccccagttgggaggagagagatgaaaaacatcctaggaaactagtgtatctgtattggttgagayttttaaaaagagcaacaagaaggaaggagctgatgattaaaaagcaatacgaagttacaagcctttaggtgtaatacccgcttactcctcaaataagcaaagacccaagaaatatatccgtaatatcagtaaaggacttctaaaattctattttgggaaaaagaacaacagcaaaaatgggtagacctgctgcttttagaaaatggtatcataggctgggcacagtggctcatgcctgtaatcccagcactttgggaggccaaggcaggtggatcacctgaggtcgggagtttgagacca

SEQ ID NO: 53572 - DNA, 601 bp, Human
gggaggccaaggcaggtggatcacctgaggtcgggagtttgagaccagcctgaccaacatggagaaaccctgtctctactaaaaatataaaattagccaggcatggtggcacatgcctgtaatcccagccacttgggaggctgagacaagagaatcgcttgaacccaggaggtggaggttgcagtgagctgagatgtcactgttgcactccagcctgggcagcaagagtgaaactccgtctcaaaaaaaaaaaaaaaagaaaaagaaaaagaaaatggtatcattagctgacaaaagataygatttttccactccagttttgttttcttccccagcaaggatcatgatcttcataactatcaagaggagaataatataaagagaaagtgacagtgagacacataaacaaatatggtatacttagcaatcttaaaacaagtcaagtccagatacgtatgtgttagggtactgaacaaatgtacgtatctgacattataagaaccactattgatcatcttttatatattatagagaatagaagtgatcagaaaacagaattaggattaaaggacagaaaaaaagagagaaacattttaccttc

SEQ ID NO: 53573 - DNA, 601 bp, Human
aaactgtgtgaacggtacccgaaacctgatcaaaacccagtcacattgctaagctgtcttaactatcttgtgtactatgttcaatttgaacatcagcattttctagcttgtatttattttttaaatccctttttttttttaataaacccagagccattagaactttaaacataaaaagaactaggtggacttctaaatgttacctagtactcactctctactttaccccatacatacctaaaaattttttgtttcaactacttacttttatttcataacaaagttgatgtaaaaatcttgkagataaggaattttagagaggatttaaacaatactcttttcctctccacaatatggaactagatggattaggagcaaataaagccagcacctgtattattaaagagataaatacagccatgcatgacttaaagacagggatatgttctgaaaaatgtgttattaggcaacttcataattgtgcaaaggtcatagagtgtatttacacaaacctacatggtatagcctacttagcatcctggctatgtgtatagcctattgctcctaggctataaacctgtactgcatgttactctactga

SEQ ID NO: 53574 - DNA, 601 bp, Human
tgtaaggctggttgatgggagaatcccattgcttattagcattttaaaggataagaagtcctgttgtttaaccttttgtttctcagacttatttgaccagggactcccctgcttgttaatacctgtaatatctgtggaacccactctgggccagagtattcatccttctctttttcccatcatttagtgactaccaaatacctagtgctaccctgagaaaactgtgatagctgctacaaagcaggcaggaaagcagagtgaggaagagggcctgtgaatgttggactttaggtgtcagtgracccagacgtctttctaggacctaggacagtgattgcagctgcagaagagcttggtctccttcccttaatgggagatgctaaaatggaactattggcaggagcagtttgaaagaacttaaactaatatacagtcccaaatattaatttgaaaggaaattaagctctaaatttttttcaataagtatgacatcattgcagtccttgaagtttccacatgcattaacttacatagccttgctcctccgcagtggtgacttatgtatcaattgacaaatgagtactgtcttaggcagaaatgt

SEQ ID NO: 53575 - DNA, 601 bp, Human
ttctcacctttagttgtaggatcactgccccataagcatacacactgtgcagacattaatggtccacaggtgtattactgactatttcctaggcatataattttctgtgggcatttttgttttataattacttgggggaaaattctgtacttttcttcagacatgataaataggctgtttattggcctgtcaattcagtatgattaccttagtctactggaaactgtaaatgtcagtatatccttcttaacactaagagctagcgaggaatagataaactattgatggggaaaattatttytaaaatcaaattctatagaattaatattaaaataggtggaattttaccagcagtttattgttaacaattaatatatagtcataaaatatttgatgtttatagaacttaggaaagacagaattaatatcattatcctttagatgtgcatatctgtatcaatgaaaattttcagggttcaaatacaaagtgtcaagttgaattcccatggagtttattgcttactattctacttcctaatagagactgattttacatttgagatctttggtgtaacaacagtccagaacttggccatgaaga

SEQ ID NO: 53576 - DNA, 601 bp, Human
ttttttgtatttttggtagagatggggtttcactgtgttagccaggatggtctcaatctcctgacatcatgttctgcccgcctcggcctcccaaagtgctgggattacaggcgtgagccaccgcgcccggccttggctttaacatttttatagtgcaggcctgcggctaatgagcttttctatgtctgaaaaagtctttcaccttcatctttgaatgttctttcccctaaactctagcttggcagttttagctttcagtactttaaagatgttgctccactacagtgttgctgatgagacrtctgctgtcattttatctttgttcttccatgtatgattgatgtttttcccctctggctgattttgatttttctctccaccactggttctaagtaatttgattatgatatgcttcagtgtattttcttcatatttcttattcttggggttcattgagcttcttgattcattaccatataattttcattaaattttggaaaaaattttttgttgtcgttttttgtttttttgtggtttttttgagacagagtctcactctgtcacccaggctggagtgtaatggcgcagtctccactcactg

SEQ ID NO: 53577 - DNA, 601 bp, Human
gccttctgagtagctgggagtacaggggtgcgccaccacacccagctaatttttatgtttttagtagagacgggattttgccatgttggccagactggtctcaaacccctgacctcaggtgatctgcccacctcggcctcccaaagtgctgggattataggcgtgagccaccacacccggccaaattttggaaaatattgatcattatttcttcaaataatttttgtcaccatccttattcctctccttcagagacttcagttgcatgtatagtgcacttgaaattgtctcacattcaccrattctctaggtttgggggctttcgagcactgggatgaggttcagttatttttttctttgattttagaacatttatattactgtagcctcaggttcactaattctttattttgcaatatctaatctgtttatacagtgtatttttcatctcagacatagcagttttcatatctagcagtcatatttggatcctttttatatcttccatatctccaacatttttttcatatctgttcagcctttcctcttatttcttaaacaaatggaatatggttattataattgtcctgatatttctcac

SEQ ID NO: 53578 - DNA, 601 bp, Human
cacagttaattgctaagcttttcatttttgctgtgctcctattacttttctgtcagtgagattgtttttcattggagaatttggttttcagtttaaacaactagcttgtaatttgatcttgtatttatctttaatagataaatgatcccgcactgagacacacaggcctctactgcaaccagctctcatccactgaccttctcaaaacagaagcagatggaacccaggtcagtaaggaaattctaagcccagagctgtcaaatgtactctagatgcacagaggtcattgtgtagcatcatkaagagcctgaccttgggagtcagacctgggtgtgagtcctggctctgctcttcttagctgtgtcgtcctgggcatgttatggagctttcctgagctgctgtataaccacagaactaacatgacacctgcttataggattgttgagaggattcaatgagatcagttcagatggcttaactcagtgcttagataggataaagtgatcacaaatggtggccactaattgttattttgtaaataagcacagtgctaaaaactcatctgtaatcaaaatacctcagaagatctcagtaattcaga

SEQ ID NO: 53579 - DNA, 601 bp, Human
ctgaggttcaaacccaggtctttctaccgccagagtccacactgttcctgccataccagttagggactgctgaaagataaaacacatcaatatatgcacctaaactgtcacaaaaccaaagaaggcaaattattaaatttatgttacaattaatgaaccataagcattcaaagaaaggagaatttgctgagatggtcacaagagcatttttgcaagagatagagctgagctgagccttgaaggacagttaccaaggcaaagggaaggaaaagggtatggtagttgttggaggctggtgcasaggtagatttagaagtagaaggaactggaaggccacagaaacagggaaatagtaatatctcaacatagtcctgggaaaccaaatcaactgaaggtaaagggtttataataagtattcataggaattaaaattggtaaagtggcttggggcaaatttccagaggccttgaatgctaaactgagggatttggattcaaccctatggacagaagagtcatccctgaaagggaacatcgatagaagtgctagtttagacttcatcttgggaagaaggtgaaggaagatatattggccagttgag

SEQ ID NO: 53580 - DNA, 601 bp, Human
agctagaagccacatttgggaaactagggaaaggggaagagaaggagagaaaagcagtgcaaatctaactagagatttgattccttaggcactaggaaagctcagcttgggggctgtctgcctcatctgagaggaaggaaagtggagatataaacggattaagaggataggagaccaggggacagactggtgtccaaatttgatgcataccacatttgacatttggctaatgaaggttgatggaaaacaacttttactcgattaggatagaaaagttttttaaaaagctgagtgtaattgrcatgaattagtgataaatgaccaaaaaaaatacaccactaatctaaaatactttatgacctatcaaacaggagacacaagtttgtcaaaaagtttgagacacttagatgcacttagatgccttagaaggcatctccattcctggtctggaacattcacaagtgtggtattggccctaatcagttctacgaacaactttttaataaggctggttggtaaagactaacttctggctttgttttcccaatagaatatgctagaactgtgcaactttagacatttttaaggaataagtgtatta

SEQ ID NO: 53581 - DNA, 601 bp, Human; identical to SEQ ID NO: 24623

SEQ ID NO: 53582 - DNA, 601 bp, Human
gatgaggcctcggggcaggggtcggttggtttgctgctcagattaatataggccatagaattatcagataggtagagcctcagagatcacccaggccaaccctctattttacagaaaggtaaactgaggcctgagaaaagagagaagcaacttacacaaggccactcaatgagctgtagaatggctaggccagtctcttggtctctggtatagagtttggtgctttttccaccctacctcctgcataacccccaaatctctttcctaatgatagcaagcaatggctcctgcactgtaaggyccaggggaccattttcccagggagcagaatctgttcatggtcccactttgcccagctaagaactgaaacagcatgaggtccatgggttccagctcagctctgccacttcataggatggaaccttggtcacgtcacttctccaagctttaattcctcacctctgaaatggggatttcagaactgtgaccctggatggccaaaggatccaatgagatcatgtatggatcatatatatggggcattttttgaactgaagcactaaccaaatgatattattaaaacgacgtgaggtttgaagat

SEQ ID NO: 53583 - DNA, 601 bp, Human
gcaatattttgctcttcccagcaagctcatggcttcctgtgtccttccttccacccctagtgttgaaggctccaggggcctggaaatgcctggaacattgagttgtggcatcctcagcaatgcaacttaataggtctatgactggacagggaggggcctctgtagttagccccattagagcctggaaggtcccgggggtgaggaaacagctcaggaaggatgctgaggtcctgacatctctcagggttatggggaattggatattaactgtgatgaggcctcggggcaggggtcggttggyttgctgctcagattaatataggccatagaattatcagataggtagagcctcagagatcacccaggccaaccctctattttacagaaaggtaaactgaggcctgagaaaagagagaagcaacttacacaaggccactcaatgagctgtagaatggctaggccagtctcttggtctctggtatagagtttggtgctttttccaccctacctcctgcataacccccaaatctctttcctaatgatagcaagcaatggctcctgcactgtaaggcccaggggaccattttcccagggagcagaa

SEQ ID NO: 53584 - DNA, 601 bp, Human
gctgataagacactcactccacctccccagccttagttttcataactgttgaatggaaataatagtacccaccccttggggttgttgggaggatcgaatgagattaagatgtcaacgccttatataaaaatgaattactctgattatcaagtagcacaggtaacattaggactcaagcagtggaaagaggctgggctcttccatatataaaggggctaggctctcctcaactcacctgtgtggccctgggcaagtccaggtctcagttttccaaagctcctgccaactctaagactgtgakattttgtgggctatgcctctggtgcaagaattctggtgctggccgccctgatctcttggccgttctatcatctgtgccccatactgccttagatccaaggatctcactgagggaaactggtcagttcccaacaacggaaaccttcaccccatccctcaggcagccgaagtgtgttattgcattttcctcccttcttagcctttgttgccttccagctttcagggaggtggggggtcttcttagcaaaatcaatggcagattgaccaggtaagcaaacactggattccctccctcctaggg

SEQ ID NO: 53585 - DNA, 601 bp, Human
agcctagaaacatccgacactgaaccaggcggtgccttggggctatggggaacttgggtcctctgtctaggttccattttgggttgctggctgctgattgtcctaggctgagtgtgatgagaagtcacagggtatggaatcattcctgttgtggaatttcccaggcactcctccccctttgcttccatctgaacacctggtacatagtgactgtttcacccactccccagggagcaaggtcaggcttctcctcctcattaggtgaatggaagcctgagggctggagagggaaaggcggttkccctgagtcacacagtgagcaaacatggaggaatctgagatgccttggaaagagcacagggctgggggcatcagaagacctgggttccagtcctggctctgctgcctatcacccagggtcacgagctgataagacactcactccacctccccagccttagttttcataactgttgaatggaaataatagtacccaccccttggggttgttgggaggatcgaatgagattaagatgtcaacgccttatataaaaatgaattactctgattatcaagtagcacaggtaacattaggactcaa

SEQ ID NO: 53586 - DNA, 601 bp, Human
tagtccaactccttgaaaaaattaactaagccagatgcagtggctcatgcctgtaatcccagcactttggaaggctgaggtgggcaaatcacaaggtcaggagatcgagaccagccttgccaacctcatgaaaccccgtctctactaaaaatacaaaaaattagctgggcatggtggtgggcacctgtaatcccagctactagggaggatgaggcaggagaatcccttgaacccgggaggcagggttgcaatgagctgagatcgtgccattgcactccagcctcagcaacaagaacgaaaytccatctcaaaaaaaaagttaatttcaaaattaaagcagtcatttaaaaattgtcttgcatgattacatttgaataaagtaggccttctcccaaccaatctacgtgtgttcacctgtcctcactgcagtatgtatactgcgcacaaatatttgggttttcactgcgcagtaccaaatatttgaagttttcactgtgcattgtgggtctgtgatgttacctattcctcctacctcacaggcctagtatgttatcaagctcccaccagcatttcccgcccacaccctccctcccccagacac

SEQ ID NO: 53587 - DNA, 601 bp, Human
gatcctcccacctcagtctcctgcgtagctgggactacaggtacacaccaccatgcctggctaattttttgtattttttgtcaagacagggtttctccatgttgtccaggctggtctggaactcctgggctcaaggaatccacccaccttggcttcccaaattgctgggattacaggtgtgagccactcctactcctataatttgcccagcctactcctataatttttcagcacctcctcaggaaccagttcccaacctgatattcctaattttttaagcctaaaagagcatcagattttrtgtcaaatccagctgggtttacatagttttactataccaaccatgtggccttgggagagttatttcacctcaatggagctctgttttctcatctataaaacaagaacaataaggccaggtgcagtggctcaggcctgtaatcccagcactttgggaggctgaggcgggtggatcatgaggtcaggagatccagaccatcttggctaacgtggtgaaaccccatctctactaaaaatacaaaaagtaagccgggcgtggtggtgggcgcctgtagtcccagctactcgggaggctgaggca

SEQ ID NO: 53588 - DNA, 601 bp, Human
caggacacaaaaacagtgcaatcagcagtaggatagggaggcccatgttgatttcaaaggaaggggtagaacagctggtgcagggttttcctattggagtaaccggcttgggcaggcaagatagaagagatgcattgcagtcagactctgaagcgccttgaatgccaaactaaaatgtgatgtgtttaatatatcaggaaggtggccaagtgaaaacatctattaggtggtttgacatagcaataataattatttacttaacacttgtgtgccagaaactgtgcaaagtgctttatgttcrttctcttgtttaattctctttttttcttttttgagacggagtctcactctgtcaccaggctggagtgcagtggtgtgatctcggctcactgcaacctctgcctcccgggttcaagtgattctcctgcgtcagcctcctgagcagctgggactacagacgcgcgccaccaagcccacctaatttttgtatttttagtagagacggggtttcaccatgttgtccaggctggtctcagtctcctgacctcgtgatccacccacctcggcctcccaaagtgctgggattacaggcatgagccac

SEQ ID NO: 53589 - DNA, 601 bp, Human
agaaatagctcagcccagggcctgggactcttctgttgagtatatctgggaagaaagtgagacaactagaaagtaattttttagtatgaggtggagttaatgcccaggaacttctcaggatattaaaaattctagatataccaaaccacaagtgtgggtgtcctataaggtctgagcatgagggtgtgccttgtacagcctctatagctgcagagctggatctgtggaaagagagaccattttgtttcattttctttttttgtgagttggggtctcgctctgttgtccaggctggagtgcsgtggcaagatcaaggctcactgaaacctcgaactcctaggctcaagccatccttccatgtcagcctcctgagcagctaggactacaggcatgcagtaccatgcctagcttttttttttttttttttttttttttttacttttttgtagagatggggtctggctttgttgtccagtctggtctcaaactcctggcctcaagtgatcctcctacctcaccctcccaatatactgggatttcaggcatgagccactgcacctggggaagcatttccttattcattcaaacatgccacctggtt

SEQ ID NO: 53590 - DNA, 601 bp, Human
gcttgcagttagctgagatcacgccactgtactccagcctggtgacagagacagactacatctcaaaaaaaaaaaagaaaaagaaaaaagaaatagctcagcccagggcctgggactcttctgttgagtatatctgggaagaaagtgagacaactagaaagtaattttttagtatgaggtggagttaatgcccaggaacttctcaggatattaaaaattctagatataccaaaccacaagtgtgggtgtcctataaggtctgagcatgagggtgtgccttgtacagcctctatagctgcaragctggatctgtggaaagagagaccattttgtttcattttctttttttgtgagttggggtctcgctctgttgtccaggctggagtgcggtggcaagatcaaggctcactgaaacctcgaactcctaggctcaagccatccttccatgtcagcctcctgagcagctaggactacaggcatgcagtaccatgcctagcttttttttttttttttttttttttttttacttttttgtagagatggggtctggctttgttgtccagtctggtctcaaactcctggcctcaagtgatcctcctac

SEQ ID NO: 53591 - DNA, 601 bp, Human
aggacgtggtggcgcgcacctgtagtcccagctactcaggaggctgaggcaggggaatcgcttgaacccgggaggcagagcttgcagttagctgagatcacgccactgtactccagcctggtgacagagacagactacatctcaaaaaaaaaaaagaaaaagaaaaaagaaatagctcagcccagggcctgggactcttctgttgagtatatctgggaagaaagtgagacaactagaaagtaattttttagtatgaggtggagttaatgcccaggaacttctcaggatattaaaaattctwgatataccaaaccacaagtgtgggtgtcctataaggtctgagcatgagggtgtgccttgtacagcctctatagctgcagagctggatctgtggaaagagagaccattttgtttcattttctttttttgtgagttggggtctcgctctgttgtccaggctggagtgcggtggcaagatcaaggctcactgaaacctcgaactcctaggctcaagccatccttccatgtcagcctcctgagcagctaggactacaggcatgcagtaccatgcctagcttttttttttttttttttttttttt

SEQ ID NO: 53592 - DNA, 601 bp, Human
ttatacgaacgaatggtgctgggctgaggttagaagctgggggtttgcatcatacagaaggacaaagatgagttaaatatctcaggagacaagagttcccactggggcttattagtcagggatctggcataaatccttcctgtctgagctggcattacagtgtggaggtgaagatcatgggttatggagtcaggcagacatgggctcgtaactctggccctaccactttctaggtgtgcgaacttggaatgttcattccttaatgtgcctcagtatcctcactagtcagatgaagattcaygctaccgtgaggatgaagcaaaatgatacacataaagaacacatcagaacacatcaggccgggcgcggtggctcacgcctataatcccagcactttgggaggccgaggcaggcggatcagctgagatcaggagttcggcgccagtctggtcaacgtggcaaaaccctgtctctactaaaaatacaaaaattagccaggtgtggtggtggccactataatcccagctactctggaggctgagacagaagaattggttgaacccgggaggtggaggttgcagtgagccgaggtcacgccatc

SEQ ID NO: 53593 - DNA, 601 bp, Human
cacgttggtcaggctggtctcgaactcctgacctcaggtgatctgcctgctttggcctcccaaagtgctgggattacaggcgtgagccaccgcgtccggtcaggaatcatctattggtcattccttacagctcctgggagggaaagtgacttgtccaaggtcacaggattaccaataactgagtataattgagcattattatcaaccctggattttcctcaattattcattacctttaagcaaatcttccaactaggcattaacatatatcttttatatgtcccccccgtcttttttaaamcatagaaccctgacaaagggctttttcctttaaaaaattcagattaatttttgtttaattttttaaaagtgggtgatgggtgcaccaaaatctcagaaatcaccactaaagaacttatccatgtaaccaaacaccacctgttcccccaaaacttttgaaaaaataaaaaaaagtcccagatgactttttaaagtattacatgcttattgtgaaaaataaaataaaaaggtataaagtgaaaaataaaaattcccctccatattaaaatccctagcaataaccattattgcgagttcttat

SEQ ID NO: 53594 - DNA, 601 bp, Human
tcccttgcttatttgtgactttctagagggtttctcttcagcaaatccagacaacagaatgttccagtgtcagaactggatgaacctaaggatatatatagtgtagtctgagcagtttacagatcaggtgcggggcccagaggggttaggttcgtggtcctgggtcacacagcctctaggctcccagtcaaggctgggtcattcctctctgtccttcactgtccttcactcaggctggtttctaaccctggcctgcttccaaggtgaatcagcaaatggtacagaaagcaaggaatcatcttttttttttttttcttttttgagacagagtcttgctctgtcacccaggctggagtgcagtggcgtgatctcggctcaccgcaacatccgccttccgggttcaagtgattctcctgcctcagcctcctgagtagctagaattacaggcgtgtgccaccacacccagctaatttttgcatttttagtagagacagggtttcgccacgttggtcaggctggtctcgaactcctgacctcaggtgatctgcctgctttggcctcccaaagtgctgggattacaggcgtgagccaccgcgtccgg

SEQ ID NO: 53595 - DNA, 601 bp, Human
tgagatcaggaaactattggccaagggatgaggcgagctggactccagtaccagccttaaactgaacaaggcaaggatgcccagaagtgcctcagctcaccttgaaaaaaagcaggaaggaaactaatcagcccttctactttagtgaaaaaaccatgagcccctcagatcaatgcttatcttcacctttccgccctatttcccttgcttatttgtgactttctagagggtttctcttcagcaaatccagacaacagaatgttccagtgtcagaactggatgaacctaaggatatatatartgtagtctgagcagtttacagatcaggtgcggggcccagaggggttaggttcgtggtcctgggtcacacagcctctaggctcccagtcaaggctgggtcattcctctctgtccttcactgtccttcactcaggctggtttctaaccctggcctgcttccaaggtgaatcagcaaatggtacagaaagcaaggaatcatcttttttttttttttcttttttgagacagagtcttgctctgtcacccaggctggagtgcagtggcgtgatctcggctcaccgcaacatccgccttccgggtt

SEQ ID NO: 53596 - DNA, 601 bp, Human
aggtggaggctgtagtgagctgagattgcactactgcattcctgcctaggtgacagagtgagaccctgtctcaaaaaacaaaacaaaacaaaaaacagaaacaaaacaaaacaaccagcgagtttgagaatagatgtgaaagtgttggtaagtgataaattacacccaaatggtagtcgttactcgctgtttcggtatctcattggtattttacccaccacttgccacaaaaagcaaaaccaaaacaacaatctcaacagaccccgcttccatctcttagaaaatatagccaccccttccytcacagacctatttctccttttccagcgccctgattgtacatcttgaggagtcagcagtaagggaagaagaaatgaaagagacaatggggaggggatgaagagtaccattttcagatgaataatgctattttcaatgatatccttccctgggagacaaaaatcaggagactgagtctgagtctccgccttggatggctcaaaacacaacaaaaatgacgaatggttcaagtgctaggaatttccttatcaagaagaaagaacaatttgagatcaggaaactattggccaagggatgaggc

SEQ ID NO: 53597 - DNA, 601 bp, Human
agaatcctggacgatgactaactggccactatcactccacccgtctgtccaatgcccctgtgtttctctgccagccctgccgggacccagcacagacgtggtctgaatgtcaactgaatttgccttatcagtcactggccaagtcttgcccacttgctcaaacccacactctcagccaagcctggctgacagaccagtcttgtgctgggaagatggggttggctctggcatgaaatctgtgggtgggcctcagtccaggtgcagggtctctgctccctccttctccccagtctcaccccawgctgtctgcttcactcccatgctcggaaatatgtcatgcatgagattcctttcttggcttagaaatagatttttttcctttacttttttatttccacatttgtctgaggataccagtggccatctcctcctttctctcagagatcttgagccttttcttttcttttgagacacgggatctcgctctgttgtccaggctggagtgcagtggttcactgcagcctggatgttccagactcaagagatcctcccacctaagcctcccaaatagccgcatgagccaccacacccgactaatttt

SEQ ID NO: 53598 - DNA, 601 bp, Human
attttccctggtttttttttgtttgtttttgtttttttgagacggagtttcgctcttgttgcccaggctggagtgcaatggcacgatctcggctcacgcaacctccacctcctgggttcaaatgagtctcctgtctcagccttccaagtagctgggattacaggcgcgcaccaccacacccggctaattttgtagttttgtagagacagggtttctccatgttggtcaggctggtcttgaactcccgacctatggtgatccacccacctcagcctcccaaagtgctgggattacaggcatragccactgtgcctggcccttttttcacctctatggacatagtataaacacaagcttatgtcttgctatttccactttacctaatatatatataatataatatatatataaaatatatgttatatatataatatatattatataatatataatatatataatatataaaatatataaaatatataatatataatataatatataatatatataatatataaaatatatataatatataatatatataatatataatacatataatatataatatataatatataatatatataatatataa

SEQ ID NO: 53599 - DNA, 601 bp, Human
aattgcacaaacatcaaaatcaccaaagaaataaaatgacaaatgccacatattccctaccatggctacttggtttctttcattttccctggtttttttttgtttgtttttgtttttttgagacggagtttcgctcttgttgcccaggctggagtgcaatggcacgatctcggctcacgcaacctccacctcctgggttcaaatgagtctcctgtctcagccttccaagtagctgggattacaggcgcgcaccaccacacccggctaattttgtagttttgtagagacagggtttctccaygttggtcaggctggtcttgaactcccgacctatggtgatccacccacctcagcctcccaaagtgctgggattacaggcatgagccactgtgcctggcccttttttcacctctatggacatagtataaacacaagcttatgtcttgctatttccactttacctaatatatatataatataatatatatataaaatatatgttatatatataatatatattatataatatataatatatataatatataaaatatataaaatatataatatataatataatatataatatatataatatata

SEQ ID NO: 53600 - DNA, 601 bp, Human
ttagcacactgcttggcagataaccatctgtgagctttcactggaaaaatgatagttatatgcctctcattaaatttaaatggagatccagctgagcaggatggcttatgcctgtaattgcagcactttgggaggctgaagtgggcagatcccttgagtccaggagttcaagaccagcccaagtaacatggcaaaacccgtctctataaaaaatataaaaatgggtcaggcatggtggtgtgggcctgtggtcccagctactcgcaaggctgtggcaggcggatcacttgagcctgggagrttgaggctgcagtgagctgagattgcgccaatgcactttagcttgggcaacagtgagaccctgtctcaaaaaaagaaagagaattaaaaacaaaaaacttaaatggagacctggcctaggcctgcctggctccaaagcccaagctcttcctattgcaggggctgtggtgactcctttaggaagcagaacctgctaaaggaaatcaacatgtttccggcaagaggaaatggtgtctgactaatctctgagagttctttcagaatgggacggaataggttattacagcacatggggaagcca

SEQ ID NO: 53601 - DNA, 601 bp, Human
cacgcttgtccatttcaaccctgagacccttcattttccccagcattttatgtggctctagcattctttattctttataatcaaaagacacttgctctcaaatatcactgcatgttagaaacacctggggagattttgtaacactccagagccaggtgtggtggcttatgcctgtggtccccattgtttgggaggctgaggcaggaggatcgcttgagcccaggggttcaagatcagcttgggcaacatagcaacgccctatctcaaaaataaataagcaaatcaaataagaaattcagayctagtgaattgagatccatattgtactgagattcccaggtaatttggatgcacataaatgtctgaaaaggactggtgtaaggggcatgcatattattagcactatcatttttccagtgaaagctcacagaggttatataacccatccaaggtcacatgatggccccctcagtaaccaggccatattcctactatttctcatgatagaatcattattcgtttacatgctctctcgcctgtaagctcccttaggacagcaatcatatcttactcgtatctcagggtccctggacttagcaca

SEQ ID NO: 53602 - DNA, 601 bp, Human
tcaatccacactcactgtcatggggcccgatcatctggggaacctggcaggaggggtggggtgggtgtgagagaaaagagaagaaccacatggaggaggcccctactgttgtggaccatggatacctgatcccctaactactgggtcacaggtcttcaggagcctgctgtctggcctggcctctgaatctgggacacgcttgtccatttcaaccctgagacccttcattttccccagcattttatgtggctctagcattctttattctttataatcaaaagacacttgctctcaaatatcrctgcatgttagaaacacctggggagattttgtaacactccagagccaggtgtggtggcttatgcctgtggtccccattgtttgggaggctgaggcaggaggatcgcttgagcccaggggttcaagatcagcttgggcaacatagcaacgccctatctcaaaaataaataagcaaatcaaataagaaattcagacctagtgaattgagatccatattgtactgagattcccaggtaatttggatgcacataaatgtctgaaaaggactggtgtaaggggcatgcatattattagcactatc

SEQ ID NO: 53603 - DNA, 601 bp, Human
cccccctgtgagctccctcatggcagcagtcatatcttactcatatctctgggtccctggacttagctcagtgcttggcagataacaagtgctcaatacgtatttgatgaaccaaacagaatccttgggggttgtcccagagtgggttccaggtcccttccttgggctctcttttttttctgcagtggcgcgatcttggctcactgcaaccttcacctgccacgttcaagcgattctcctgcctcagcctcccacgtagctgagactacaggcacatgccaccacacccagctaatttttstatttttagtagagatggggttttgccgtgttggccaggctggtctcgaactcctgacctcaagtgatccgcctgcctcagcctcccaaagtgctgggattacaggtgtgagccactgcacccggccaccttgggctctctttatcccagtttctcctcccattcatcaatccacactcactgtcatggggcccgatcatctggggaacctggcaggaggggtggggtgggtgtgagagaaaagagaagaaccacatggaggaggcccctactgttgtggaccatggatacctgatcccc

SEQ ID NO: 53604 - DNA, 601 bp, Human
ttcctactatttctcataatagaataattattcatttacatgctgtcccccctgtgagctccctcatggcagcagtcatatcttactcatatctctgggtccctggacttagctcagtgcttggcagataacaagtgctcaatacgtatttgatgaaccaaacagaatccttgggggttgtcccagagtgggttccaggtcccttccttgggctctcttttttttctgcagtggcgcgatcttggctcactgcaaccttcacctgccacgttcaagcgattctcctgcctcagcctcccaygtagctgagactacaggcacatgccaccacacccagctaatttttctatttttagtagagatggggttttgccgtgttggccaggctggtctcgaactcctgacctcaagtgatccgcctgcctcagcctcccaaagtgctgggattacaggtgtgagccactgcacccggccaccttgggctctctttatcccagtttctcctcccattcatcaatccacactcactgtcatggggcccgatcatctggggaacctggcaggaggggtggggtgggtgtgagagaaaagagaagaacca

SEQ ID NO: 53605 - DNA, 601 bp, Human
caagagaattccagctccctgggggcccggtgcggtggctagcgcctgtaatcccggcactttgggaggccaaggcaggcggatcacctgaggttgggagtttgagaccagtctgaccaacatggagaaaccccatctctactaaaaatacaaaattagctgggcataatggcacatgcctgtaatcccagctactcaggaggctgaggcaggagaatcgcttgaacacgggaggcggaggttgtggtgagccgagatcacgccattgtactccagcctgggcaacaagagcaaaactccrtctcaaaaaagaaaaaaaagaattccagctccctcaatgggccatggcatttcacaagcacctgggttcctcctcccactccacatctaactggaaaactgccactttttctgcaagacacaccttgaccattgggaaattttccctgatccccttgaaattgctctttcgggccccctcagtaaccaggccatattcctactatttctcataatagaataattattcatttacatgctgtcccccctgtgagctccctcatggcagcagtcatatcttactcatatctctgggtccctg

SEQ ID NO: 53606 - DNA, 601 bp, Human
cttcatcacaaaaaacaaaaaacaaaaaacagcacaactctgaatgcttgctccttggcttcaaactactgaatggacctccattccttacaggatgaaatccaaggtcagctgcagtgacaggccccgggagctggcctggcctcccggttcctcttactattcatgctctgcgtatgctctgtactccagcctcaccaagagaattccagctccctgggggcccggtgcggtggctagcgcctgtaatcccggcactttgggaggccaaggcaggcggatcacctgaggttgggagttygagaccagtctgaccaacatggagaaaccccatctctactaaaaatacaaaattagctgggcataatggcacatgcctgtaatcccagctactcaggaggctgaggcaggagaatcgcttgaacacgggaggcggaggttgtggtgagccgagatcacgccattgtactccagcctgggcaacaagagcaaaactccatctcaaaaaagaaaaaaaagaattccagctccctcaatgggccatggcatttcacaagcacctgggttcctcctcccactccacatctaactggaaaactgc

SEQ ID NO: 53607 - DNA, 601 bp, Human
cagggggtgctgtcagacttggggagcaggagaccacctgtaagagccacatcattgggaacacagccagacaggggttaacagtggcttttgggaggtcaaggaatgggctgtgtgaggctttgtcacccaaagacgctgagcaagttgggcccgccagagaggcacgagcttcattccagccccacacagcctcagaggccaaggcaggaggaagaggccttgagccctggaggctgtccatgctgccacactgcagccgcctgcgctcctggttaatgatctcccctcttaccgcatygccttgccacagacctaaacccatcctaggctcctccttcacactccaggtcagcatttgcaggaccatgagagggaagaatcccttacactgcatcctcagcgactcacctgcctcgcctcatccctgccctgcctctcatccgttgcatctggccagtgagtcaaggccatcaaatctgctcctcagtgcggctcccaccaccccccatttttcattctcactgctacctgctggcttcattgcagcccccacaactctcctggaccactgctgtggtctccccactgcctcagtgtc

SEQ ID NO: 53608 - DNA, 601 bp, Human
caccaggtagcccagcctttagctaactggcttccaactcaggaagacagctctcaacacaggcagcaggaaagggtctaaatcttcagctgatgtggaaagcagaagaaaagccaaagggagcagactgcacagcaagaaggaacagcacgggcccagcacagcaggagctttggagagggccgggaagacttggttctacccacttacctcgaggctttgggcaaattaatcccttcaggtctgtcatctacaatattggaacaccgcctatgttccaggatggctggcaaacatttgyggagcgctaagtatctattagatgctgagctaagcctttaacaccatggtttccatccccccctaagagggactattctcctccgcatttaataaatgaagacattgagaatgaccagcctaaggccatgcagctattgagtagcaaagaggagagatttgaacctcgtacccccagtctcactctgtgaaagcccctagtcagtgctttggaatctgaagctgaaataatgtcagatttgtgtaaactgtgactacataaaatgtattttcaagagggtgctgtcggcagcctttcaaa

SEQ ID NO: 53609 - DNA, 601 bp, Human; identical to SEQ ID NO: 24624

SEQ ID NO: 53610 - DNA, 601 bp, Human; identical to SEQ ID NO: 24625

SEQ ID NO: 53611 - DNA, 601 bp, Human; identical to SEQ ID NO: 24626

SEQ ID NO: 53612 - DNA, 601 bp, Human; identical to SEQ ID NO: 24627

SEQ ID NO: 53613 - DNA, 601 bp, Human; identical to SEQ ID NO: 24628

SEQ ID NO: 53614 - DNA, 601 bp, Human; identical to SEQ ID NO: 24629

SEQ ID NO: 53615 - DNA, 601 bp, Human
cagcctccctagtagctaggattacaggcgcctgccaccacgcccagctaatttttttttgtatttttagtagagatggggtttcactatgttggtcaggctggtctcaaattcctgacctcaggccatccacctgcctcagcctcccaaagtgctgagattacagacttgagccaccacgcccagctagaaagaacttttctaagcataagataacccttcagagtgaagcctcgccagcatccaactccagcaaatgtcattggagcagtggttttctagcctggcttcaaatgcagartcacaaaacctaagacctgggaccctttaaatcagactctctgcaggtattctagctccagccagggtggaaaacctctatgacagctgatgtactattgagaatctctacctagattggaaaggtggattgtaggtgcaaagtaataccattgaaaagtcctctattcacgtgcttgccacttacaaacttatgtggtatcaccttaagtaaaatcagcctttaagaaagatcaaataggcatctaagctatagttgttaaaaaaaaaaaaaagaagaagaaaagaaaaggaagaaagg

SEQ ID NO: 53616 - DNA, 601 bp, Human
aggaagcggaggttgcagtgagccaagatcacaccactgcactccagcctgggcgaaagagcaagtttcactgcaacctctgcctcctgggttcaagtgattctcttgcctcagcttccccaggagctgagactgcaggtgcatgccaccacacccggctaattttttgtatttttagtagagacggggtttcaccacgttggccaggctggtctcaaactcctgacgccaagtgatccacccgcctcggcctcccaaaatgctgggattacaggattacaggcatgagccaccatgcccrgcagaaagaccttttcttttcttttcttttttttttttgagacggagtcttgctcttgttgcccaggctggagcgcaatggagtgatcttggctcactgcaacctccacctcccgagttcaagagattctcctgcctcagcctccctagtagctaggattacaggcgcctgccaccacgcccagctaatttttttttgtatttttagtagagatggggtttcactatgttggtcaggctggtctcaaattcctgacctcaggccatccacctgcctcagcctcccaaagtgctgagatta

SEQ ID NO: 53617 - DNA, 601 bp, Human
tatataataatattgtgacaatacaaaatttcctgagtttgatcattgcactgtggaacacgaatgttctcatttttcggaagtacaggtaaaaggtcaaaatgtctgcaacttaatctcaagtggttgggggaaagttaaagcaagatatggcaaaatgttaataatctggtgaagggtatacgagaattctttatactattcttgcaattcttgttttcaaaataaaaagctgacgtggccaggcgcagtggctcacgcctgtaatcctagaactttgagaggacaaggcaggcagatygcttcagcccaggagctcgagatcagcctgggtaacatggcaaaaccctgtctctacaaaaaataccaaaaaaaaagaaaaaaaaattagctgggaggaggaccacatgagcctggggaggctgaggttgcagtgagctgtgattacaccactgcactccagccagggtgacagagtgagaccctgtctcaaacaacaacaacaacaaaagttaatgcacaccttctcaaagcctctcccatcccacaactagttgagcacattggtggcactactacatccaatgtaaagaaattcctt

SEQ ID NO: 53618 - DNA, 601 bp, Human
taagccccggacctcacgaccagcctaggcaacaaagtgagaccctgtctctacaaaagataaaaaatttagctggtgtggtggtgcatgcctgtggccccagctactcagaaggctgaggcaggaggatcacttgagcccaggagcccgaagctgcagtgagttatatactccagcctgggtgacagagtgagactcaagaaaaaagaaagcaagaaagcaagcaaggaagtaaggaagaaaataaagaaagggagaaagagaaagaaagaaagagaaagagaaagagagaaagagagagagaaagagaaagagagaaagagaaagagagaaagagagagagaaagaaagaaaggaaggaaagaaggaaggaaggaagggaaagaaagaagaaagggaaggaatgaagggagggagggagggagggaaggaaattcataatcattatgcagaaagctcattcgaacttcaggtaaagcacctgccacactttgagtctggatcatgtgcttgaggcagtcaagtcaaaattgcagagtgttttgagaaatgaataaattcctctgaagcaagaaactgctaaactcaagtcaaaatccct

SEQ ID NO: 53619 - DNA, 601 bp, Human
cttaagccccggacctcacgaccagcctaggcaacaaagtgagaccctgtctctacaaaagataaaaaatttagctggtgtggtggtgcatgcctgtggccccagctactcagaaggctgaggcaggaggatcacttgagcccaggagcccgaagctgcagtgagttatatactccagcctgggtgacagagtgagactcaagaaaaaagaaagcaagaaagcaagcaaggaagtaaggaagaaaataaagaaagggagaaagagaaagaaagaaagagaaagagaaagagagaaagagagagagaaagagaaagagagaaagagaaagagagaaagagagagagaaagaaagaaaggaaggaaagaaggaaggaaggaagggaaagaaagaagaaagggaaggaatgaagggagggagggagggagggaaggaaattcataatcattatgcagaaagctcattcgaacttcaggtaaagcacctgccacactttgagtctggatcatgtgcttgaggcagtcaagtcaaaattgcagagtgttttgagaaatgaataaattcctctgaagcaagaaactgctaaactcaagtcaaaatcc

SEQ ID NO: 53620 - DNA, 601 bp, Human
tttctttttaaaaagttactacaggggcccgacgcagtggcttgtgcctgtaatcccagcactttgggaggccggggcgggcagatcacgaggtcaggagatcaagaccatcctggctaacatggtgaaaccctgtctttactaaaactacaaaaaattagccgggtgtggtggcaggcacctgtagtcccagctactcgggaggctgaggcaggagaatggcgtgaacccgggaggtggagcttgcagtgagctgagatagcgccactgcactccagcctgggtgacagagcgagactgyctcaaaaaaaaaaaaagttattataggtattactgtaaaaattaattaaagtatgctgttttaaggtagctattttaatttttaaaatctgtgaatggtttttttcagcatatacaaaccattttaaccctcaaaaggagaaaagtttatgtataaaaaaagaaaagatggtggaaagttcaaatccaattgttagtaaacactactactagctaggtggaattttcattctttctatgtttatttaaattttccataatgaaaacattgtttgcaattgaagtaagggttacttaaaag

SEQ ID NO: 53621 - DNA, 601 bp, Human
tagatatgtaatcttgctctgtggcccaggctggagtgcaatggcatgatctcggctcactgcaacttctgtctcccaggttcaagcaattcccctgcctcagcctcccaagtagctgggattacaggtgtgatccaccgtgcacagctacctgatatttcttaataactgttttaaagtaatttatttcttggaattctttattatattagagcattctgtaattactgttcatataatttgtatttaagtgtagtagagaacattggtaaatcataattgcctttttttttttttttttgagacagggtctcactctgttgaccaggccaggtggagtgaagtggtataatcacagctcagtgaagcctcaacctcctaggttcaagcaatcctcccacctcagcctcccaagtagctgggagtacaggcatgtgctaatgcctggctaactttttgtatttttttgtagagatggggcctcgctatgttgcccaggctggtttcaaatgcctaggctcaagccatctacctgcttcagtctcctaaagtgctgggattacaggcatgagccactgtacccagcctataattgcctttt

SEQ ID NO: 53622 - DNA, 601 bp, Human
tagttgcaaaaaaaaaattttttttttttgagatggagtttcactcttgttgcccaggctggagtgcaatagcacgatcttgcctcactgcaacctctgcctcctgggttcaagcgattctcctgcctcagcctcccaagtagctggaattacaggcatatgccaccacacctggctaattttgtatttttagtagagacggggtttctccatgttggtcaggctggtctcgaactcccgacctcaggtgatctgcccgccttggcctcccaaagtgctgggattacaggcgtgagccacygcgccagtgcaaaaatgttttttaaagtaactttaatattatacaagattatgactgtggaaggcacctcaccttatattattttatatcaaataatggctacatggagatggtagagaaaaaaaagaaagggctaaacttccaaaataagttgattaggaatatttctcaagagctgcctgacaactccttgtttgagagagaggcactggtcagagggtgggatggatgcttagagctggagtaggtggaggaagaatgttttttgaacagaagctttctaatgggacagcatgactt

SEQ ID NO: 53623 - DNA, 601 bp, Human
aaataaaaggttgtacttgtaaaatatttattgctagacctagttgcaaaaaaaaaattttttttttttgagatggagtttcactcttgttgcccaggctggagtgcaatagcacgatcttgcctcactgcaacctctgcctcctgggttcaagcgattctcctgcctcagcctcccaagtagctggaattacaggcatatgccaccacacctggctaattttgtatttttagtagagacggggtttctccatgttggtcaggctggtctcgaactcccgacctcaggtgatctgcccgcyttggcctcccaaagtgctgggattacaggcgtgagccaccgcgccagtgcaaaaatgttttttaaagtaactttaatattatacaagattatgactgtggaaggcacctcaccttatattattttatatcaaataatggctacatggagatggtagagaaaaaaaagaaagggctaaacttccaaaataagttgattaggaatatttctcaagagctgcctgacaactccttgtttgagagagaggcactggtcagagggtgggatggatgcttagagctggagtaggtggaggaagaat

SEQ ID NO: 53624 - DNA, 601 bp, Human
agtttaacaaaaaatcaacatctaaaacaaaaacataaagtcaaactgcccttgtagggcacttctaagggatagagcaggccggtttctccagagtccccataattagaatattggtttatcagtgtgagtgcaactcttcattgatcatctcctccgcaccaggcacaggcctggaaccttacattatttcatttcaaccttgacagtcctgcaaggtacatattgttatccccactttacagatgaaaaaatttgggttcagagaggttaaaaaaacttactcaaggccaggcgcatrgtggctcacgcctgtaatcctagcagtttgggaggctgaggcgggtggataacctgaggtcaggggtttgagaccagcctggccaacatgttgaaaccccatctctactaaaaatacaaaaattagccaggtgtggtggcgtatgcctgtaatcccagctactctggaggctgaggcggaagaatcgcttgaacccaggagtgggggttgcagtgagctgagatcacgccactgtactccagcctgggcgacagagtgagactccatctcaaaaaacaaaaaaacaacagaaaaaaactt

SEQ ID NO: 53625 - DNA, 601 bp, Human
ttattttgtggctgggcacagtggctcacacctgtaatcccaacactttaggaggacaagacaggtggatcacctgaggtcaggagttcaagaccagcctggccaatttggtaaaaccccctctctaccaaaaatacaaaaattagctgagcatggcacatacctgtaaccccagctactgaggaggttactcagagaattgcttgaacctgggagatggaggtttcagtgagctgagatcgtgccactgcatttcagcctgggcgacagagtgagtctgagtctcaaaaaaaaaaaaaaattattttgtgaaatttttgaatcgggcaacacctcattctatgccacagggtgggggttccccccaaggactctagtatcatctctcaggaggacactgggccagaacagatgggccagtgagtgcctttgaaagctcaggcgctgggaacaggacagagggacagggctgggtgagcagaggatcagcgcaaattggcagcctgacccaataaagatgccagggctattctgggtggcatgtgggagagaagggttgggggaagggagtctgtaattggggcaccgaccttcccatcgg

SEQ ID NO: 53626 - DNA, 601 bp, Human
gagactaggaatctgaatcttcccatatactccttttaaaattattattggccaggtgtggtggctcacggcacgcctgtaatcccacactttgggaggctgaggcaggtggattacctgaggtcaggagttcaagaccagcctggccaacatggtgaaacccggactctactaaaaatataaaaattagctgggtgtggtagcatgcacctgtagtcccagctattcaggatgctgaggtgagagaatcacttcaacctgggaggcggaggttgagtgaaccgagatcatgccactgcaytccagcctgggtgacagagcgagactctgtctcaaaaaaaaaaaattattattattttgtggctgggcacagtggctcacacctgtaatcccaacactttaggaggacaagacaggtggatcacctgaggtcaggagttcaagaccagcctggccaatttggtaaaaccccctctctaccaaaaatacaaaaattagctgagcatggcacatacctgtaaccccagctactgaggaggttactcagagaattgcttgaacctgggagatggaggtttcagtgagctgagatcgtgccact

SEQ ID NO: 53627 - DNA, 601 bp, Human
aggccgagtaactcaaagcttaggacattctgtccttgaacagcagaacaagctgtgcaggggcccacagaacaatggctgccttctgcagctggcagtgatgggaaataacattcttgtggtttagtttatgatgcatataaaaaggtgccgtaccccattagtggtccctgctgaccctctctatagatgaaaacaaggaaagataaggctccagaagccccagctgggtctgcagctgagcttacaggatgccgggaggcgtgcccgtgaggagaggcagcctcagtggcagtggcakcaaggagacagtcctgctgcagacgctgctggaaatgcagagccatcccctctaagaggggagtgggaaaattaggaaaatggcaacttatttacaacgtgcttctacacagttcatctgaacttaacaacctccggaggtgtggatagagcaaagaagactgaggctcagggaggtgcagcgccttttgtgtccaaggtcatgcaattagggagagactaggaatctgaatcttcccatatactccttttaaaattattattggccaggtgtggtggctcacggcacgcctgtaatccc

SEQ ID NO: 53628 - DNA, 601 bp, Human
ttgagtgctattcactttcagcaatttggtgagtgtgatggattattaaaatacttttactaccctgaacaaaaacaaacagaaaaaagaaaggaaagaaaacaagaaagctacttccatttaaaaaaataaaagaacacaggttttggagtaaggcagacctgggtttgaatgctggctctgccccttcaagctcttttacttggggaagtggcttactatctctgagcctcagatatatcatccctatcatacagaatttctgagattaaacaagacaagcacttagcacagtacaccygccacagggcttaacacatggcagctgtgattatgatttattttcaattccacttgctaatttcaagtggggatacaaatgaaatgagcaaggataaaagtcaaaaggcgacagttggaagaggagaagaaacaggccgagtaactcaaagcttaggacattctgtccttgaacagcagaacaagctgtgcaggggcccacagaacaatggctgccttctgcagctggcagtgatgggaaataacattcttgtggtttagtttatgatgcatataaaaaggtgccgtaccccattagtgg

SEQ ID NO: 53629 - DNA, 601 bp, Human
catagcaagaccctgtctctacaaaaaatacaaaaaaaaattagcagggtatggtagcacacacctgtaatcccagctactcgagaggctgaggtgggaggatcacctgagcctgggaggtcaaggctgcagtgagccgtgatcatgtcactgcactccagcctgggtgacagggttaagaccttgtctcaaaagaaaaaaaaaaaacccacaatggataccagttcagatccactaggatgactataatttaaagacagacagtaacacatgttggtgaggatgtagagaaaatgaaacyctcatacactattagtgagaatgtaaaaaaaaaagttaaacatagacttaccatataacccagcacttccactactaggcatatactcaagagaattgaaaacatgtattcatatgaaaacttgtacacaaatgatcatagcagcattatttataatagccaaaaagtggaaattaccgaaatgtccaccaactgatgtgttgataaaccaaatgtggtatattcatagagtggaatattactcaccaatacaaaggaatgaagtactgatgagtgttccaacatggacgaaccttgaaa

SEQ ID NO: 53630 - DNA, 601 bp, Human
agagtgagactctgcaagactccgtttcaaaaaaaaaaaagggcaaaggatctcaatagatatttctcagaagatatacaaatggttgataagcacatgaaaagatgttcaacattattagtcatatagggaaatctaaatcaaaaccacaatggtggctgggtgtggtggctcacacctgtaatcccaccactttgggaggctgaggcatgtggatcccttgagcccagaaatttgagtccagcctgggcaacatagcaagaccctgtctctacaaaaaatacaaaaaaaaattagcagrgtatggtagcacacacctgtaatcccagctactcgagaggctgaggtgggaggatcacctgagcctgggaggtcaaggctgcagtgagccgtgatcatgtcactgcactccagcctgggtgacagggttaagaccttgtctcaaaagaaaaaaaaaaaacccacaatggataccagttcagatccactaggatgactataatttaaagacagacagtaacacatgttggtgaggatgtagagaaaatgaaaccctcatacactattagtgagaatgtaaaaaaaaaagttaaacatagac

SEQ ID NO: 53631 - DNA, 601 bp, Human
tctcagttcactgcaacctccgcctcctgagttcaagtgattcttgtgcctcagcctcctgagcagctgagattacaggcaaacaccaccacacccggctaatttttgtattttcagtagaggacagggtttcaccatgttggctggtctcgaactcctgacctcaagtgatctccctgccttggcctcccaaagtactgggattacagacgtgaatcactgcacctggctgttttttttttttttgagtcagagtctcactgtcacccagccttcattgtgtgttgtttcttctgttttkttttttttttttttttttggaaacggagtctcgctgtcaccaggctggagtgctgtggcacaacctcggctcactgcaacttccgaccccctggttcaagcgattctcctgcctcagcctcccgaatagctggtattacaggcgcatgccaccacatccagctaatttttgtatttttagtagagacggggtttcaccatgttggccaggatggtcttgatctcctgacctcatgatccgcccacctcagcctcccaaagttctgggattacagacataggccactgcgcctggccggta

SEQ ID NO: 53632 - DNA, 601 bp, Human; identical to SEQ ID NO: 24630

SEQ ID NO: 53633 - DNA, 601 bp, Human; identical to SEQ ID NO: 24631

SEQ ID NO: 53634 - DNA, 601 bp, Human; identical to SEQ ID NO: 24632

SEQ ID NO: 53635 - DNA, 601 bp, Human; identical to SEQ ID NO: 24633

SEQ ID NO: 53636 - DNA, 601 bp, Human; identical to SEQ ID NO: 24634

SEQ ID NO: 53637 - DNA, 601 bp, Human; identical to SEQ ID NO: 24635

SEQ ID NO: 53638 - DNA, 601 bp, Human; identical to SEQ ID NO: 24636

SEQ ID NO: 53639 - DNA, 601 bp, Human
gaactttagattctgcctactacttttatcatacaaggaagagctctaaaatccttccttttattatagaatgtctgggttgaggggtttcttatcatcatggcaggggtttagggatagataagcagattccaaagagggagaaacaagaataaaatcatgtttgaaatacagactgctctgtaatatgtgatggagtcttcaatgactcagaaaaattgagagtgggtcaatggtactagcagtcactcctaaaaaatgttgttaagatggacacaaatacagaggcccttggtaatgkcgattgcctaatccaccctagacatgaaccactagagcaacctaatatctggctgactacagacctagatgactttctgtttctctgtgtgctgcatctgcatgtgaatatacacaaacaaataattaaacatcaagcaaatatcaacaggattagcttggcatgttagaacaaatcttgataaatctgcctcagtaacaatactcaaactacaagtctatgagaggaatacaaattcagcttattgaagtattgtcatgtaaggaaagatattttaataaaattgctcttccatcagtt

SEQ ID NO: 53640 - DNA, 601 bp, Human
ttgtaatcttatactttgaactttagattctgcctactacttttatcatacaaggaagagctctaaaatccttccttttattatagaatgtctgggttgaggggtttcttatcatcatggcaggggtttagggatagataagcagattccaaagagggagaaacaagaataaaatcatgtttgaaatacagactgctctgtaatatgtgatggagtcttcaatgactcagaaaaattgagagtgggtcaatggtactagcagtcactcctaaaaaatgttgttaagatggacacaaatacrgaggcccttggtaatgtcgattgcctaatccaccctagacatgaaccactagagcaacctaatatctggctgactacagacctagatgactttctgtttctctgtgtgctgcatctgcatgtgaatatacacaaacaaataattaaacatcaagcaaatatcaacaggattagcttggcatgttagaacaaatcttgataaatctgcctcagtaacaatactcaaactacaagtctatgagaggaatacaaattcagcttattgaagtattgtcatgtaaggaaagatattttaataaaa

SEQ ID NO: 53641 - DNA, 601 bp, Human
ggttcttgatcatatttcttttttttattttttctcgcagttcctttaatgttaagtttgggggctttaaataatgaatatacatgtctgtatttaccaaattctggcttccaatttatctctacctgtgtttatttgtctcaccttgttcacctgcttcaaagctatgtgactttactacatagcatgcacccttataggctgtcttaaatgcaacttgaaacaaacttggatatgtactacacattttaaaaaatggcttttgtaatcttatactttgaactttagattctgcctactrcttttatcatacaaggaagagctctaaaatccttccttttattatagaatgtctgggttgaggggtttcttatcatcatggcaggggtttagggatagataagcagattccaaagagggagaaacaagaataaaatcatgtttgaaatacagactgctctgtaatatgtgatggagtcttcaatgactcagaaaaattgagagtgggtcaatggtactagcagtcactcctaaaaaatgttgttaagatggacacaaatacagaggcccttggtaatgtcgattgcctaatccaccctag

SEQ ID NO: 53642 - DNA, 601 bp, Human
caactcccacttatgagtgagaacatacagtgttttgttttctgttcctgtgttagttcactgagaatgatggtttccagcttcagccatgtacatagtttgatttttaatgtgaaatttgagctgtctttgaaatatccagatgataatgttcataaagcaactgacaatgtggattaacagcttaagcagaccaatggggcaaggcatatgattttacggccagccacattaaacaagtggctgaagatacaggggtgaccatgaaagacaatggagggaaggagagagaaaaggaaayggcaaggggataaagagaagaagaaacaggaggagaaaatgaaggaggagaactaatggagaagggtgagaaagaggaagagggataggaaaaggtattatggggaagaaaaaagaactctgaggaacaaaatcaccttaaggagtacgcgacaaaataagagaaagtcattcaaacataaaacagatcaagtcaaggagaacaactaggatattctctttctcagaaatgcctgagaataacttacttgcaaattaagtcatttattctacaaaagatttttctttatttgaaatttaa

SEQ ID NO: 53643 - DNA, 601 bp, Human
tttggaaaattactgagatcatcaataatccagtgagggtcattaagatatgattttggagagtggtcgaaagaaagaaatgagatgatgcattaagattacacagcagtcagtagtgactggaattagggattaaatgagcagactactggtgaggcttaatgagtaaaaacagattcaacaatatcgcttccatgttgtacgtgggatttgagagtgcatcagagtcattgataaagtcatggaagtcagaaagcaggaaaaaaaaattcatgaaagtaattagtttgattttttttttctacccaaaagtgactgctatgccattttgggatattctgtctagtcattttttctatgcattttttaaaattatactttaagttctgggatacatgtgcagaatgtgcaggtttgttacataggtatgcacgtgccatggtgatttgctgcacccatcaaccaatcatctacattaggtatttatcctaacgctatccctcctctggctccccacaccctgacaggccccggtgtgtgatgtttccttccctgtgtccatgtgttcttattgttcaactcccacttatgagtgagaaca

SEQ ID NO: 53644 - DNA, 601 bp, Human
tggcatgaaacagggaggcggagtttgcagtgagcagagatggtgccattgcactccagcctgggaaacaaaataagactctgtctcaaaaaaaaaagaagtagtaattttgataagaaggaaaaaaaaatagagctcctttcacaagaggtagataaagtggagtcttggcagaagaaatatatggataacaaatcaagacctgaaatcacttgtgatttgctgccgaatgggtgtatctaccaaagtcatattgtaggtaggtaagaaaagaatcaaatgaagcagaccatgaaaagtmcccctgggtaagtagctgaacacctataaaatgtaagggatattttttcctctgggataaacacatatatcagctaagaaataacatggttagaatcaagcacactatttggaaaattactgagatcatcaataatccagtgagggtcattaagatatgattttggagagtggtcgaaagaaagaaatgagatgatgcattaagattacacagcagtcagtagtgactggaattagggattaaatgagcagactactggtgaggcttaatgagtaaaaacagattcaacaatatcgcttc

SEQ ID NO: 53645 - DNA, 601 bp, Human
caaaaccatcttactctaatctagatgaaaggatgaattagagagttctctggcctaaatgaaatgaccaaacaatatgaaaaaaagtgaaatatatatatagtgtttctcagttcctgtttgtaagtcagaagccaaacgaagtgaaaagatggaggtgtttttgcttgcttgtgtgttttttatgtgtgtgtgggggtggtgatggcagaaagataactttctgagagaaaaacacagacattttcctaggaaaagtgtcattccagccagccataaagaaacaattttgggccaggcrcggtggttcacaactgtaatcccagcactttggaaggctgaagggggcagatcacgaggtcaggagttcaaaagcagcctgaccaacgtggtaaaaccacgtctctacttaaaatacaaaaattagccgggcatggtgacatgtgcctgtaatcccagctacttaggaggctgaggcaggagaatggcatgaaacagggaggcggagtttgcagtgagcagagatggtgccattgcactccagcctgggaaacaaaataagactctgtctcaaaaaaaaaagaagtagtaattttgataa

SEQ ID NO: 53646 - DNA, 601 bp, Human
aacccatgtattcgtattacacaggcaatttattgaatcatactggtagaagtaagtcacaaaggaatggttgtaaagaaactaaaggccaagtaggtagcacgttaaatataattattgaattcctccaaacacacttttgggcagggattattgtatacactatagagatagagaaagtcaagcttagatggtttatgccacttacgcaagaagtcagatttggagccaaataacctgcaaatctaagtcaaagtaaaaaaaaaaaagttcattttactcaaacccaggtttagcgaayaatcaggattaaaatacacttgaccccaatacacaaaaacaatccaaatatatatttaaaatgtctagaacttactaaaggtagggacatttgcattgaaaaaccaacttcagcaacgctagtttgggatccacagttaaaatcagacaagctcacaagctcatcaagtcatgaaattcacagtagaataaaaaagaactgtgtctccagcttccaaataagatatttctaaaataatttggctgccatttgggcaaatatatatgtgcgttttgtcttgacagcctgtcaactggaaga

SEQ ID NO: 53647 - DNA, 601 bp, Human
aacccagagtccattcaagttactcttgttaggctttaatatatttagcagtaattatcacatagctcttcattaattttattgttatttgaatttctacgtgatgtatagttctgacatttttaaagtgctcatattcctatattgaaaattatataatacctcccttaaacttcctatccaattctcctctcagtacttcaatttaatttgcaaagtaggctgacctcaagagttcttccacctcggaaaaacattaactattataaacatgctgcagaatcataatgctcttataaamagaattatctagagatataatcaaagatcagtagagcatactggttaagcccatgggaggtagaaccaggtgtctggttttatatttcagctcagccacttaatatctgactttatattatgtagcattttccctaattttctgattaaaaataaagaatagaaaaactaatatcggtactaacataatagtattgttgtgtatattagaagcatttaacacagcctctggcatatagtaaattctcaatacgtattggtcatcattacagtagccctgaacctcagagaaaactaagaa

SEQ ID NO: 53648 - DNA, 601 bp, Human
tagtaatttttgaccttcttctgatatttcaattaatattttttggtggagcatgcattcctcttttgcatttgctaccaagaaacccagagtccattcaagttactcttgttaggctttaatatatttagcagtaattatcacatagctcttcattaattttattgttatttgaatttctacgtgatgtatagttctgacatttttaaagtgctcatattcctatattgaaaattatataatacctcccttaaacttcctatccaattctcctctcagtacttcaatttaatttgcaaartaggctgacctcaagagttcttccacctcggaaaaacattaactattataaacatgctgcagaatcataatgctcttataaacagaattatctagagatataatcaaagatcagtagagcatactggttaagcccatgggaggtagaaccaggtgtctggttttatatttcagctcagccacttaatatctgactttatattatgtagcattttccctaattttctgattaaaaataaagaatagaaaaactaatatcggtactaacataatagtattgttgtgtatattagaagcattt

SEQ ID NO: 53649 - DNA, 601 bp, Human
aagtgatcaaaattattgtcaccaattatggaataaatcaaaatcatgtaccacctgatacaaattagtaaggcattatctgtgatagtcttgtcaaaaatgcatattctgtatctaatcctaaggaaacatcagacaaatcttaagaaattctataaaacaattgttccacggtcaggtgtgaaagtcataagtgaagaagactgcagagcccttccagattgaataagtcttacgttagtgtggttctagatatgatacttttactaaaacccacgatattgggacagctgcagattawttgatgaggtctgtgtatttgatatcaatggtgtgtcaagattaatttcctaattttgatgattgtattttgttggcttagaataacattcatacaggaagacttacttaggagatgggtcaaaatgtcaacaatttactctcaaacagttcagaaacaatacatttgtacaacatttgcaatttttctctaagattaaatttattctaaatcaaagataacaaaatagcacaagagaaatagtatgtgttttctatgagcattcctccaaaagaggaaaacatagccatattttacaca

SEQ ID NO: 53650 - DNA, 601 bp, Human
tgaatggatatcaagttttggggaacgctatccaacccagtacaggtagatgtgtgtgtgtgtgagtgtgtgtgtgtgtgtgtgtgtgtgtgtacattctcccaaatgttccttagttctgccctgtccactgaaaaggcttgggaacactgacatcctaataacaatgaacacaactaatgcccagactttcatatgtaaatacaattctcctttaaacggaaccagatttttgtgtgtgtgtaaatggctaattctagggctgggctagaaaaagtacaaaatgagcctcaaacagcgygttgggccaaaaggtgagaatgcactcaaagaatgatggaggcatgtcagtaggacacaaaactcagccccaaggacacatcgtgaccaagtgtcagataatctgagcatcaggataaataactcaacctgttataattcattaaataaaacagaaatcgaaaagtcaaagctaatgtaaataaatacacaagcaaattaatgtgaagagaaaattttccttgcagaagaatgctaaccaatgactgtagatagaatgatggaattaagaaaatcaccacttggcagctctcatagtaat

SEQ ID NO: 53651 - DNA, 601 bp, Human
taaaatatatctctgagaacagaagagtagggtgcagtttttagagaggaaaaccaatgtatttagaaatagcaagagccaagatgtgagtgagtagaaaatgtatttctaaagaacataaagagacaatgttaggataatcaaatcgagtttaagataattccaattagcaagcacagagatataacaggaaaaaattaaaagggaaataaaacttaagcattagctactactgtgaataggcctgggagctattggttaatgggtatatagctaaattggcttaaagacactagtttacaagacacagatcaagatacatcatcagtgttgcctcttcacttagacattgttagtgctgagccaattctttaatcttaataaatctgaaacaccaattcaaattatcagatgcctatgactaagagatataggtttctaaatcaaattgaggcaacaaatcacagtccgccaggaatgacacattgtttacctatggcggtggggtaagaggaagagattgttaaattttgttccagtaggttcaaatttcaggcctttttgtaattccttcaaatatactttatgtaatattctatta

SEQ ID NO: 53652 - DNA, 601 bp, Human
agatgctggcagacttaacttcttctgagccttctctctctggcttgcagatggcttccctcttgctgccttctcatgtgcttgttcatctgcgcacttgtgcccctgatgtctctttgtgtgtccggatttcctcttcatgtaaggacaccattcagacagcattaggacccaccatgtgaccccatttaaccttcattacctccttaaaagtcccatctccaaatgcaatcacagtctgagatactaagagttatggattcaacatatgaatttgtggggaacacaattctgatcccawcacaaacccactgtatttacattttttactgtaaaaaatgtgttaatacttgactgatattataatctttatataatatataatgtacaacaatcatgcttgacatatataatgcccccttctaaaaatctacacagtgttttacatgtacctagcctagagcagaaactaagtaaactgtatctgctgtggcttcattctctatcaattaagctaaactgaaattctgtttctagaactcccttctctatattgccctagttacttctggcatgagacgttggaagcagaagtgaagaa

SEQ ID NO: 53653 - DNA, 601 bp, Human
cacatcctcctagttttcctggcaaatacctgcggttgagactaattcaactagatttggtggaatgtctgcctgtgtcccagaacagaagcaacctatataagctaactgctggtatttcacactgacaatagagtgatgcatagtaactagagaatacacacagcatgagttaggtagccactcagcggatgttggacattcactgcagacttgaaacaggttagagggttgatgactacacaatattcattcctgtgttcattccctttttcacacaaactttcaaacaataggaatragtaggtaacattggtaatgataatttagtaaacagattgtccatgaacaaattttaaaggataggagtaggaggaccaattttgagcagaagaaaggaattaggaataagtaggtaacattggtaatgataatttagtaaacagattgtccatgaacacattttaaaggataggagtaggaggaccaattttgagcagaagaaaggaaagataacacccagtctcaggtgttattctttatagcagtgtgaaaacacactaatacagctgccataacaaaattcccacagaccgggtgg

SEQ ID NO: 53654 - DNA, 601 bp, Human
tggaaggggacacagaatgagttttgtggggatggtgctattgtgaatttttatttgggtgctgggtatacaaacctgttcagcttatgctgttatagatatatgcattttactgtatggctattaaacttgaatgcagaatttaaaaatatgtacgcggaacaaaaagaaaatgtagaaaagcctgaacacaagaattactatctatgttcatgagaaatctaggttactaatgttcttagtgctagattcacatcacatggtctcacttgcttcgctgacagcctccccaaaaaaggcyttcacaaggcacttaaatagtgtttatcagaactgtgagttgctgtcagagcagctcttaagacggatactggtatttctcctttcatttaagtttgacattgtaacgtgttacatatacataaacgtgtgggaattgtttgatattatttcattatcacctaatggtaacagcagctctaataattacacaggaatagcaatccaaaaaaaaaaaaaaaaggaatcttagggtgattgtcattattccgattattctgtcaaggtgagaaaaaggacaataaagacatgctcgggaaag

SEQ ID NO: 53655 - DNA, 601 bp, Human
tttttaaagtcaccttccagaaccagaaggaaaaaaaaggagggatggtagagaggatcaacaagataaacgaatataagaatgaatatattcattgattcatttaaatgtcctgtaattttggtagacttaatttcaagcctgtctggggtgttgaaataaataaatcatgcattgtgtatgagccaattaatgactacaaagcagacaaaacatatctatgctgttagaagtcaggatatcagttaatcatgtgactggaaggggacacagaatgagttttgtggggatggtgctattstgaatttttatttgggtgctgggtatacaaacctgttcagcttatgctgttatagatatatgcattttactgtatggctattaaacttgaatgcagaatttaaaaatatgtacgcggaacaaaaagaaaatgtagaaaagcctgaacacaagaattactatctatgttcatgagaaatctaggttactaatgttcttagtgctagattcacatcacatggtctcacttgcttcgctgacagcctccccaaaaaaggctttcacaaggcacttaaatagtgtttatcagaactgtgagttg

SEQ ID NO: 53656 - DNA, 601 bp, Human
ttttagtagagacagggtttcaccatgttggccaggctggtcttgaactcctgacctcaggtgatccgcccgcctcagcatcccaaagtgctgggattacaggcgtgagccactgcacttggacccttatgattttcttgacaacattgccttctatttagcttactttattgtaagaatgtagtacagaatacacacaacataaaaaaccatgtgtcaattaactgcttatgttattgataagacttctggtcaacagtaggctattggtagttaagtttttaggaagtcaaaaactatrcatggaattcaactctgcaaggggttataaccctaacccctgcattgttcaagggccaactgtatgtaaggaaaggccacccaaaataacacatatatttttaaagtcaccttccagaaccagaaggaaaaaaaaggagggatggtagagaggatcaacaagataaacgaatataagaatgaatatattcattgattcatttaaatgtcctgtaattttggtagacttaatttcaagcctgtctggggtgttgaaataaataaatcatgcattgtgtatgagccaattaatgactacaaa

SEQ ID NO: 53657 - DNA, 601 bp, Human
gttcagcctctgccatccctgagacagcaagaccaactccttctcttcctcctccttctcagcctactcaacatgaagataatgaggatgaagcactttataatggtcaacttccacgtgatgaatagtaagtatattttacctttcttatgattttttttttttttttggagagggagtctcgctctattgcccaggctgaagagcagtggcgtgatctcggctcattgcaacctctgcctcctgggttcaagtgattctcctgcctcagcctcccaagtagctgggacgacagctctgygccaccacacccggctaatttttgtatttttagtagagacagggtttcaccatgttggccaggctggtcttgaactcctgacctcaggtgatccgcccgcctcagcatcccaaagtgctgggattacaggcgtgagccactgcacttggacccttatgattttcttgacaacattgccttctatttagcttactttattgtaagaatgtagtacagaatacacacaacataaaaaaccatgtgtcaattaactgcttatgttattgataagacttctggtcaacagtaggctattggtag

SEQ ID NO: 53658 - DNA, 601 bp, Human
gaaagtgtgattaaaatgggttagacacctctgaaatatcccactggtgtgggttttctgttggtttaactaagagataatgttggtcatacgcttgaaaaacagccttaacttgaaagttcccacttagctgccttgagctaggtacaactgacctttgagcaacacagatttgatttatatgcagggtccacttacgtgtggattctgttcagcctctgccatccctgagacagcaagaccaactccttctcttcctcctccttctcagcctactcaacatgaagataatgaggatgargcactttataatggtcaacttccacgtgatgaatagtaagtatattttacctttcttatgattttttttttttttttggagagggagtctcgctctattgcccaggctgaagagcagtggcgtgatctcggctcattgcaacctctgcctcctgggttcaagtgattctcctgcctcagcctcccaagtagctgggacgacagctctgtgccaccacacccggctaatttttgtatttttagtagagacagggtttcaccatgttggccaggctggtcttgaactcctgacctcaggtga

SEQ ID NO: 53659 - DNA, 601 bp, Human
gtaggttaatggcatacttgatagcagaccaaaatactagaggtgaatctcaaagaactaagaggtggattcaatgctctgaccaaggaaagtagcagggatttacaacaagacctcgagagagtgaactcttaagcacaaagtctttctatctgcaaagacagcttttatctatgagacttcactatctgttattgcaggtattcaataaattttattaaatgtatttgatgagaacaattagagaaaatatagaaatgagagttgaaaaaacatgaaacaagataagaagcagaacagwaaacagtagaaggtttttttttaaataaatgtagttttaaaaagtgaatttctgttagaaaaaaaaggaaagtgtgattaaaatgggttagacacctctgaaatatcccactggtgtgggttttctgttggtttaactaagagataatgttggtcatacgcttgaaaaacagccttaacttgaaagttcccacttagctgccttgagctaggtacaactgacctttgagcaacacagatttgatttatatgcagggtccacttacgtgtggattctgttcagcctctgccatccctgaga

SEQ ID NO: 53660 - DNA, 601 bp, Human
tgaaataatctgtacaaccaacccccatgccacacatttacctatgtaacaaacctgcacatcttgcacatgtacccctgaacttaaaataaaataagctgaaaaaaagaagtagttgcaggtgctctgagtcataagaaaacaagaaactttaattgatattctgccatgtaaatcttaagcaagcactgtcctaggtgatacctccagacatccctggggaattcagatcatcatcatttctgttatgatggtccttcacattctgggtaagcctcaaggttgcaagttatcctccctrccaggctttgtgctccttggaggcaggtatggttaagaaagaatatttagagtatgtatccttgactggtatataccaaaacgtaaacatgcattttgtatagcatgttgcccaccaaaacaagagaaacataccagcagggcactctaggtatgcaagcaatcaatattaatcagctttaaatttgtagtgagatttttatccatttcactccccttttaacttttctgattagactgaagataatatatcaattttattatagtactgtatgtgtttaacacctttctgatacatgct

SEQ ID NO: 53661 - DNA, 601 bp, Human
attatccttggcaaacaaatgtaagaacagtaaaccaaataccgcatattctcacttataagtgggagctagataatgagagcacatgaacacatagatgggaccaacacacactggggcctattggagggtgaagggtgggaagaaggagaggcttgggaataagaagtcatggatactaggcttaatacctgggtgatgaaataatctgtacaaccaacccccatgccacacatttacctatgtaacaaacctgcacatcttgcacatgtacccctgaacttaaaataaaataagctgraaaaaagaagtagttgcaggtgctctgagtcataagaaaacaagaaactttaattgatattctgccatgtaaatcttaagcaagcactgtcctaggtgatacctccagacatccctggggaattcagatcatcatcatttctgttatgatggtccttcacattctgggtaagcctcaaggttgcaagttatcctccctgccaggctttgtgctccttggaggcaggtatggttaagaaagaatatttagagtatgtatccttgactggtatataccaaaacgtaaacatgcattttgtat

SEQ ID NO: 53662 - DNA, 601 bp, Human
atgctgtctgctgccccacgtgagtttccatttaacgcaccatgttaagcaataaattctattttacaacaggctattttaagctattacttgaagatttgatcccttctatctgagtaagattcacttatttgcccccatgtcctgcctaaatttataatgccaggaaaaaataaaagatgtgaatcttatatttcattgtctaaatcccacacaaattagtttcctcgaaggtaggctgactgctaagttattattctcatgctttccattatgctcttacctctgatgacaacaattwaaaaaaaatttacttatattgaatcatcaagtaaaagaatgttcttgtttaaagtgacttcctcttaaatagcaaggagaaatttggatagctaaagaaaaacaaatgagaaaggccatgaacactttctcaattaaacagctagcactttcttcatttctgaatcaatttggttcatgtagaaagactgaagacacatatcatgtaaaataaattccctatttgtcacatttcaggaatcagcagccttgccactctggaaggcaatgcagatccggttgacattccaacaccaaaata

SEQ ID NO: 53663 - DNA, 601 bp, Human
tccaaggctttccatcattatggtatcttgccaccaaataggaagctattgtgaccaaaatagttaggttttcttttcttctccctgcccctccacccccaagatggagtctcgctctgtcacccaggctggagtgcagtggtgccatctcggctcactgcaacctctgcctcccatgttcaagcaattctcctgcctcagcctcctgagcagtggagactacaggcacccgccaccacacctggctaatttttgtatttttagtagagacagggtttcaccatgttggccaggatggtctcaatctcctgacctcgtgatccacccgcctcagcctcccaaagtactggaattacaggtgtgagccactgtgcccggccaggttttctttctttaggatggtaaattaagaaatgtagaatgcaatatagtcttcatgctaattgtacttttttatccaaaattaatgtatcataagcatagtcattataaatatgtactctgttaaatactgaacaagaatcaaataagcgtaaatttccagacggacaattttacaaatcccttaacagctgagagttgctgtttcctagtcctccat

SEQ ID NO: 53664 - DNA, 601 bp, Human
tccacgtatgcattttaaacttttaatatgtgttacattgtgaaattatcagtaagcgtataactcataaatctcccgttttcatccaaggctttccatcattatggtatcttgccaccaaataggaagctattgtgaccaaaatagttaggttttcttttcttctccctgcccctccacccccaagatggagtctcgctctgtcacccaggctggagtgcagtggtgccatctcggctcactgcaacctctgcctcccatgttcaagcaattctcctgcctcagcctcctgagcagtggrgactacaggcacccgccaccacacctggctaatttttgtatttttagtagagacagggtttcaccatgttggccaggatggtctcaatctcctgacctcgtgatccacccgcctcagcctcccaaagtactggaattacaggtgtgagccactgtgcccggccaggttttctttctttaggatggtaaattaagaaatgtagaatgcaatatagtcttcatgctaattgtacttttttatccaaaattaatgtatcataagcatagtcattataaatatgtactctgttaaatactgaac

SEQ ID NO: 53665 - DNA, 601 bp, Human
ctatacagacagtccctgacttatgacgggtcaacttatgaatttttgacctttatgatggtgggaaagcgatctgcagtcagtagaaactattttgtttttgaattttgattttttcctgagctagtgatatgtgatataactctgtttttcaatgctgggctgagggaatgaacagcagctcccagccagtcatgccattgtgaagctaaacaaccaggtgcggtggcttactccaggtgaggtggctcacgcctgtaatcccagcactttgcgaagccaaggcaggtggatcacctgwggtcaggagttcgagaccagcctgatcaacatggtgaaaccctgtctctacttaaaatacaaaaattagccaggggtggtggtgcacacctgtaatcccagctactcaggaggctgaggcagaagtattgcttgaacctgggaggcggaggtcgtagtgagccaagatcacaccattgctctccagcctggggcaacagagtgggactccatctcaaaacaaacagacagacaaaactctatgatgtcctgtggtgccagatgatttttgcccaactgctggctaatatgagagttctca

SEQ ID NO: 53666 - DNA, 601 bp, Human
cttgtaataattaacattactaattaactagtaattaaatagttatgtggaacagagtaagctctcaaatacgtttactatacagacagtccctgacttatgacgggtcaacttatgaatttttgacctttatgatggtgggaaagcgatctgcagtcagtagaaactattttgtttttgaattttgattttttcctgagctagtgatatgtgatataactctgtttttcaatgctgggctgagggaatgaacagcagctcccagccagtcatgccattgtgaagctaaacaaccaggtgyggtggcttactccaggtgaggtggctcacgcctgtaatcccagcactttgcgaagccaaggcaggtggatcacctgtggtcaggagttcgagaccagcctgatcaacatggtgaaaccctgtctctacttaaaatacaaaaattagccaggggtggtggtgcacacctgtaatcccagctactcaggaggctgaggcagaagtattgcttgaacctgggaggcggaggtcgtagtgagccaagatcacaccattgctctccagcctggggcaacagagtgggactccatctcaaaacaaa

SEQ ID NO: 53667 - DNA, 601 bp, Human
aatctctgggcctgactcaatggaaaccaacttggaatctcagaggttcaggacaggaatttacttcacatattaacccaaggaaaagagctaattgtgagttaggacagaggcaaagatgtttacatccttctaaaagcattatgttatctcaagtttttaattactgtaaatcaaaagtatccgagacaggtcacaatcaatttagaaagtttattttgccaaggttaaggtcccaaccatgacacagcctcaggaggtcctgataacatgtgcccaaggtggttgggatacagattgkttctatgcattttacggagacatgagacataaatcaatacatgtaaaatttacactggttcaatccagaaaggtgggacaactcaaaatgacggcttctaggtcataggtagatttaaaatttttctgattgacaattggttgaaggagttattatcaatacaaaggaatgcctggattactttaagtggttgtagggaccaaagttttatcatgcagatgaagcttccaggtagcaggcttcagagagaatacattgtgaatgcttctcataagactcaaagagtctgttctaacagta

SEQ ID NO: 53668 - DNA, 601 bp, Human
ttgaacccagtcccaacataagccagaattagcttcaaacggaggctagtatgatattaaactctcacttaagctcctgaaaacttcctatagaggaaataatgaactgaggacattatcacattatcacacgagatcaagtatggaacttgccactttttggggtcatgtcagcactcaaaaactgtcagattttgaagcacttcaaattctgaattttcagattaggggactcaatctgtagtgagaccttggtacatgcatgcttagagagagttgtttaaaaaatgtattgaaaackctacgtgacataattaaaatcttggcaaacacaaaataatatgtgaaaggctaagcaatgggtttacaaagaatgattaaggttgtgccaatatctggaggctttcaaattgggaggatgaaaagaggagggagagagagtgagataagagaaagaaaagaactgattatgttttcagccctgaagatgtgctgatgaatctgacgcagaccatattcttaagtaatctaatgaaatgatagcaagaaaattgaatagatgctgtatttattcaacatattccttcatttctctttattg

SEQ ID NO: 53669 - DNA, 601 bp, Human
tattttcttttggaagatattcagagattaatgtagcacattgatcatgttctgaattatgtgttatgtctactgttttgtcttcttttcattttgaatttattaaagaataacggtaagggttttctctactcttaaaagggtagtcatgaccttgtcttcttagagttgaacccagtcccaacataagccagaattagcttcaaacggaggctagtatgatattaaactctcacttaagctcctgaaaacttcctatagaggaaataatgaactgaggacattatcacattatcacacragatcaagtatggaacttgccactttttggggtcatgtcagcactcaaaaactgtcagattttgaagcacttcaaattctgaattttcagattaggggactcaatctgtagtgagaccttggtacatgcatgcttagagagagttgtttaaaaaatgtattgaaaactctacgtgacataattaaaatcttggcaaacacaaaataatatgtgaaaggctaagcaatgggtttacaaagaatgattaaggttgtgccaatatctggaggctttcaaattgggaggatgaaaagaggaggg

SEQ ID NO: 53670 - DNA, 601 bp, Human
cttagatgcaaagggtataagaatatgcaagagagctagactttctctcctaatagcatttgaagtttactttagcagtgttttcacctggtttctctttattgtaagaaactgcaaatcttcattaaatgtattttctcgaaggcagcatgatgtaattgaaagtacagatatatagtgtatacactatatacatactacatatacatataaaattgtagcatacatagaattatatagtgtgtgtgtgtatatatatatacacattatataattataatatcagatgtttctgttgacwttatttgattatactgagatcatattctacatcatgacttaacacccttacacaggaagagaatgtttttacatcaataagactccattgctttatttaaaaaatagaatagtaccacctacttcctattcttattctgaggctccataaaaataacatacaatcagtattctccaggtgagagaattttggttgagacacactctgtgctctccagagcaagctactttatttttatttaacaaagtataaatttaaggccaagatgcatgagaacagagatataagcattacagtggc

SEQ ID NO: 53671 - DNA, 601 bp, Human
tggctatttgcacagtatatactatatgccaagcaccaacttagatgcaaagggtataagaatatgcaagagagctagactttctctcctaatagcatttgaagtttactttagcagtgttttcacctggtttctctttattgtaagaaactgcaaatcttcattaaatgtattttctcgaaggcagcatgatgtaattgaaagtacagatatatagtgtatacactatatacatactacatatacatataaaattgtagcatacatagaattatatagtgtgtgtgtgtatatatatattcacattatataattataatatcagatgtttctgttgactttatttgattatactgagatcatattctacatcatgacttaacacccttacacaggaagagaatgtttttacatcaataagactccattgctttatttaaaaaatagaatagtaccacctacttcctattcttattctgaggctccataaaaataacatacaatcagtattctccaggtgagagaattttggttgagacacactctgtgctctccagagcaagctactttatttttatttaacaaagtataaatttaaggc

SEQ ID NO: 53672 - DNA, 601 bp, Human
cactttcattttttaaggagaaattatgttcccatattgtgaagtaacacattatcagaaaaaaaaaataagtcaagatgtaatattcagtatgatattaagttaatgaatctgagaatttagttccagtcactgcatatgtaatcgaaaaagaaaagtgaacaaattgtcaaaacttcctgtcattaccaaatttccttctagtgggtgactcttaaattaggaaatgccttcacagagaaaaaaacatatccaaatattttctgaaaaaccgtgttgttttatttatgcacaggcttcrtgcgtttggtcagagtagtatggggttaacagttttgaacataaaatagttctgacgtcttctgaaacgcttatctgtttctttgagcaaatactttaacctgtcttagcctcagatttaaatctacaaaatataatagggttattgtgagaattaaacaaaataatatatgtaggtacctatcacagaaataacaacatgctaagccagtgagtactaaatgtctctgtattaggttttaccctctgaaaaacagacccctaatgtcccttccagatctatggaataataaaatggaga

SEQ ID NO: 53673 - DNA, 601 bp, Human
cttaaggtgataactgaaacaatagaagaagctctctctgatatgttatggcaacagaaaataattccatgaagtgaaatgtaacaagcaaggggagagcagaacttatctgttccaaattccagagttctgtttttagcattcttgcgaggaaaaaacaagatacatacaagatttattgtctcatgccctggtttattttttgttattgaaaatatgataacagcaaagaagagctgacagtggtcaatggacaatcttctttataaagagtatgaatgtgactgccttatgtaacccrgtgagggactgttcactgtcacaatatcgatcattttagctacagatttgacccttgatagtatgccagaatcctggtgtaaaaaggaactgaaggttggtcccacatatgtggtgatgtgtaatggtattcagccaacattttcgaacccatctatgctgggtcacttcctgaagtaatgtgcagacctatcatgtaaagaaccatcttattaggtgctctcagaggtatgtgggtcttaggtaacgagtctctgctcatccatgacattttctttcttttactagaatttggattctt

SEQ ID NO: 53674 - DNA, 601 bp, Human
gtgttttgtcaaacctaaaagactgtatatacacaatgatttggctttctattgttgctgttattattagcagcactagtagtaccatcacagtgacctctggaataggaagatatattaataatcatttcttctttgtttagtggtcccagaacctttctatctccttgtatgatctagaagcaaatctgagcaagagtttattatggtctcaaggctatttttgcaaatactagaatagcattgtgttgcctagacacttaaaacatagtatgagatttggaaaaagcatgaatgctgstcctaaatgaatttcaaacaaaacaatcatatctgagattaatatggtgttctttccatcagagaaacagatagaagtatagactggataccaagctttattccctagatgtttcctcttacatcttctctatgaattgtggcaagcttttctctttctattaatttgcactttcttcctccttccctttatcctccctgcttcttttgcacatccctcccggccttcccttcctccagctctccctgactctgcccttccttccttccttccttccttccttccttccttccttccatt

SEQ ID NO: 53675 - DNA, 601 bp, Human
ctcctgtgctatgccaagaggcttacaagggactccacatgtaacagaattagccacccttgcacctctccactcctggcttcccacttcatgagaggacataatttggagggggtgtgtgattttgtaaagtgaatcagctgtgggattggtagagctacctcatcctttaatcagcacttggcatggaaagaggttctaggtctcctatgatgtaactttcccagcaatagtcaaaatcttacctccactgcatgtcactcctgcctttcaaactttcaactccaaatccagcagtttwaatgaaaacaggtggtttgtgtggaacacagctgaaggacttttctacctaccaacaatgcaagagcttttggttcttctaagtgaaaatgtcctatcacaaatatcacattttgtttcattaaatacaaacaaaaataacaaaagtaatgatattagtgatatccttaatttgtgaagatcaaaagcaaataatgggacatatattttttcaatatcatgaatgactagaagacagtgttagtgctcttaaaaattgcgtacttaatgaagaattatgtacaagtggacttatatacta

SEQ ID NO: 53676 - DNA, 601 bp, Human
ttctccttctctttagttgctgagaatgtgtgtatgtgtgtgtggtgtgtgtttgaaagacctgtctcccgcctgtcttcttactccaaaaatgtggaaatctatgcccattactgcattaaaagaaaaaaaaaaaggaaattggatgaagagtgcattaggaggaaaccccacaggtgacaaaaaccactctttggcttcctcccaagtcctcctgtctattggccttgtgcctaatatttacagggagaactcctgtgctatgccaagaggcttacaagggactccacatgtaacagamttagccacccttgcacctctccactcctggcttcccacttcatgagaggacataatttggagggggtgtgtgattttgtaaagtgaatcagctgtgggattggtagagctacctcatcctttaatcagcacttggcatggaaagaggttctaggtctcctatgatgtaactttcccagcaatagtcaaaatcttacctccactgcatgtcactcctgcctttcaaactttcaactccaaatccagcagtttaaatgaaaacaggtggtttgtgtggaacacagctgaaggacttttctac

SEQ ID NO: 53677 - DNA, 601 bp, Human
cacagcaaacagtcaccacaatgtattggctttctggttccagcctttccctttataaaacagagagagtgttacttgcagacaaaataagacaaatatgtgtgatctgcaggagccattcattactagtggtccttacgcacatagaccacattttaactacacttagcccaggctgtttgggaaacttgcaatctaggtgtgattatgccccaagataaagaggcaagcagaggggaatagatctctatgtccctccaggacagagatagttagatctgtataaacaagagtctgagtstgaccttccttggagggaagccggaggcaaaaaacacttagaacagaaagtgaggtggatgctctagttaatagagagttactaaacagagggttagtaacagcaggttgttacaggtctattgtacccttagtgacagttgtcaaaatacatcacagcagtgtttttccaaagattaagtggcttgtgctttttattctttatattaaaattaactctatatcaaataggtaatcttttttatccttctctagatttttaaagattacatgactctcctttggcttacacttcctgatt

SEQ ID NO: 53678 - DNA, 601 bp, Human
ttatttatttctcttggcaaatatatggttatgacatgcaaattctcctataagagttgataggaaaacaattcattttccacaggtgaaaatatattatcacatgaatattgggaattcagaatgtgacccagcaatgagaaaggtcttggacaaagtcccgcagcctgcagctgtggcgtccaaatcttggtctttagaaacttaattataaaatttttttttaatttgcctagaaactccatgtctgataaaaagaatgtagaaaataatatactctcctttgccaaaaaatatctcygcagaatgcttagtaagatatttgtccaacaatcaccttctatgctatcccagcatcttaatatgattctgtttgacaggcatggctctgtcatataggttttatatattaacctctatatgccctgccccatttatgcttggaaattgttgctatagaatagcgggcttgaaagctttaaatcagaccgctgaggatcattccactatctcaatgtgtaaaaattacttccttacatgtgagtttcctgttttataatgtagcatattcttagactaaaaaaactacagcttcttaatt

SEQ ID NO: 53679 - DNA, 601 bp, Human
tgaagaataaagtatatataaccagacatacttccacacacacccaccttaccactgaataacagaatcacaacaatatcaaacttgcacagatataccacaaaggaaaaaatgaaacacttagataaacacattagaaaataattcggcctccataaggctcaaagaaaacagcacttccctttctttgtgactaataatttatgatttagatagatggggagagattttagaggaagacagatagataatagatagatagatagatagatagatagatagatagatagatagatagatgcatagagaaatagagagggaaatagagagacagataaatagacttatagatagatgggtctgaatttggagaaactgtatctcctcttatacatttctggtgccttctaaaaatataacaacccatttggaaatacaactgatcaagtgaatcagcaatcaaaagcttgtttatacattttgaccagtactttttaaactaagaacttattctaagaaaatcataaattttattttctcctggttactcatatttttagttttagatgttcacttttctgtacaatattttttaaaagaa

SEQ ID NO: 53680 - DNA, 601 bp, Human
agtccactgcctctagtctcaaccccatgactagcagaaactcattaaaacatccaagacagaatttttggaatgctttttatgctattttgtagctggaaaggcaggataggggaaaccacaattgtcctggatcctcttatttttctttttgtgttgggcttatctacacatattacttaactttactattcctattcacaatgtatttcacttccatagatacttcaagatattgacaagctccaaaaatagaaaatgaaaatagccttactattctcttctacttcttttctcctgytttggctaacatatctcccaagcactagtagtttcaggctgtttcttttatgaaaagaaatgtgtttgatgagaaactctgcatccaataaaacaaattaatgaataaacaaaattatggacaagagataactcccctattttaaaaatcattgtttggtatgaaatgccacctaatacagagcacaaaatatagtaattagggaagactgttttcaaatttaagaaggatttaaattctcagatttgagaagtcaaaagtcaaaaattttgaactgtgaatgctaaaaagtgacttaaa

SEQ ID NO: 53681 - DNA, 601 bp, Human
attctatctagtgtccaataactgccaccttcctttgttccttaaggtctaggagtcttgatggtacttctatcgctagcatctggtgctgcattcttccatgacggtctctcttaaccaggccatacttttgtcaattgtccctttgttaaattctcctcaattgcctctttcctgacaagatcccaaaatacacgttacaaaactgggactctgtccaagtgccaaacattttgcctgcatgtcactcctacacagacatctatagttcaaaagtacttcagtgtaataatgtactgcsgtccaggcctgctccttaagaaggcagggcagactgttttcttacctgtaaaatgagagtaatacctattcatttaagtgggttgctcaagatgaccccactgggaagctgcacctctgagaatctttgcatctcctctttccttccacaacattgggagtaggttttctgatctctaaggcgagtaggaagtctctccaaggtttctttagaacacacagtgcagttaattggcttcaattcaaactgaataatgaacagctcttgctttcccgagtccactgcctctagtctcaaccc

SEQ ID NO: 53682 - DNA, 601 bp, Human
tcctctcaatcagagataataaccagcttctcactgtggacattccaagatgatgtgagataattcaggcaaagttcttggtacacagtagttacccaaacacactgttccccttccccaacgtgactttttaatgcttatgttgatggtggctagagtacagaatattctacaattgctcccacaagtccactgcccagccctacccacccagtgttggcatgtaagggtggccttaatagattgccccaattaactcctttactttctggctttttgttaggctccaccaatatacatyaacctaggaggctgtgcaactggctcccccaaagactcctgcaaagactttattcctgtatttggccactcaggttattatttagagatatcgttaaagtaaaattctatctagtgtccaataactgccaccttcctttgttccttaaggtctaggagtcttgatggtacttctatcgctagcatctggtgctgcattcttccatgacggtctctcttaaccaggccatacttttgtcaattgtccctttgttaaattctcctcaattgcctctttcctgacaagatcccaaaatacacg

SEQ ID NO: 53683 - DNA, 601 bp, Human
aggaaaaggtgtataaaatataaaattacataaaatacgataaaattatcactgctcaaatcttaatgttttttcttctgatatatattcagcgtttcatgtgggtttgtctgtttgtttcactggtaatttaatattcttgttaaagatccaaaattttcttagatcctcctgaagtttattttgaaaatcaaaaatccttatttagctctctacctccacatatttttttcatagataacgctgacattttgaggcgcaaaattataaggccatgatatgtacatacccagaaatgtgwgtataaacatttaaccacagacatgatcatgatgtaggcagcattctgagactttctttttctcacaggagatgtttttgaaaaacttccttgtcactgcatagaagttcacctcattacttcctacagttgcataatttttcattgtacaatatactatacatggctaaggcattctcatattgataaatattgcagttatttcatattttcccatgtcaaacaactgacagatatattagtatgataatattgtatttttttatttcctgcatttttacttaactctgtcataagatg

SEQ ID NO: 53684 - DNA, 601 bp, Human
ttcttttgttttattattgactatatttaaggtgtacactgtgatgttttgataaaagaaaccactgccttggaaagatgtctgcactttcatgttcattccaggattcttcagaatagcaaagaaatggacatcacccaagtatccactgacagatgaatggctaaagaagttgtggtgtatatttatacaatgaaatattattcagcctttaaaaaggagatcctgtcatttgcaacaacatgaatgaacctagaggatattatgttaagtgaaataagccagatcaaaggaaaaaaarccctgcctgatcttacttatatgtggcatcttaaaaataataataataataataagtatgtagacacagggcttttaaacatccttttaagctgcactattcatcctccctcccatggcttcaccttgttccaactaattgttttcactttttcatgtttcaattcaagagtccccatgtcagaaaggccttatcaaatcatgtctctgtcatattacttgaataaatgctcagaagaaagtgttcgatgagagtaaagaaagttgtcaaataattattgtctccctgattctttcatgt

SEQ ID NO: 53685 - DNA, 601 bp, Human
aggctcattatactcaacataacagtaaggtttcttctagcactaacacccctttatttaacaatgggataaaaacatctctcttagaatcacgaagttataggactggggattgaaatattttccaaatagttctgccacaaggtaggcactgaaaatcctcactgcaagcgaagtctcccagttttctcataattggtgtaatgattccattttccacaaactgtatattccaagtaaggtttgagatgatcccttttggtatgcttattaaataaataagacagcaaggggccgcgcygtgctgctagtcctacatggggagtcttgggaagccaagcaaatggaacattcttttaaccattcctattctgtgcctgctcctcatctctatcagtgtgatcacagttaatagttattatctctaagaaaaggcacacgtttgaaattgatctgccattatttaattgaataatcattttcttataatgaaatatggcatcttgcagtattcactgtaatggcaactgcaaaggcaaaaaaagtgagggaaagagtagaagaaatggtgttctccatttcaataattttgtttaaaaag

SEQ ID NO: 53686 - DNA, 601 bp, Human
tacctaattctcattcgagctcaaatccactgagtcccttggataaactaaggctcattatactcaacataacagtaaggtttcttctagcactaacacccctttatttaacaatgggataaaaacatctctcttagaatcacgaagttataggactggggattgaaatattttccaaatagttctgccacaaggtaggcactgaaaatcctcactgcaagcgaagtctcccagttttctcataattggtgtaatgattccattttccacaaactgtatattccaagtaaggtttgagatkatcccttttggtatgcttattaaataaataagacagcaaggggccgcgccgtgctgctagtcctacatggggagtcttgggaagccaagcaaatggaacattcttttaaccattcctattctgtgcctgctcctcatctctatcagtgtgatcacagttaatagttattatctctaagaaaaggcacacgtttgaaattgatctgccattatttaattgaataatcattttcttataatgaaatatggcatcttgcagtattcactgtaatggcaactgcaaaggcaaaaaaagtgaggg

SEQ ID NO: 53687 - DNA, 601 bp, Human
aatctggagaacattacctaattctcattcgagctcaaatccactgagtcccttggataaactaaggctcattatactcaacataacagtaaggtttcttctagcactaacacccctttatttaacaatgggataaaaacatctctcttagaatcacgaagttataggactggggattgaaatattttccaaatagttctgccacaaggtaggcactgaaaatcctcactgcaagcgaagtctcccagttttctcataattggtgtaatgattccattttccacaaactgtatattccaartaaggtttgagatgatcccttttggtatgcttattaaataaataagacagcaaggggccgcgccgtgctgctagtcctacatggggagtcttgggaagccaagcaaatggaacattcttttaaccattcctattctgtgcctgctcctcatctctatcagtgtgatcacagttaatagttattatctctaagaaaaggcacacgtttgaaattgatctgccattatttaattgaataatcattttcttataatgaaatatggcatcttgcagtattcactgtaatggcaactgcaaaggc

SEQ ID NO: 53688 - DNA, 601 bp, Human
caggataactttgagttttttcttttcttttccttctttacaatggtccagagtttctccaataagataaagttccagtaacccactgtagtaactggctcaaaaacgcaccttttttttttttttttttttttttttttttttttttttggctatttctctctctgtctctctctctcctttctccactggcatttattggtcccatctccgagttaaacttacaatcaaattcttgtctcagggtctgtttctggggaacccaaactcaaaaaaccaaaaagttttactctccttgcarccacaacaagggaaaattaaacattcaatgacctaaaaacccaaaaggaaaaatcaaatctggagaacattacctaattctcattcgagctcaaatccactgagtcccttggataaactaaggctcattatactcaacataacagtaaggtttcttctagcactaacacccctttatttaacaatgggataaaaacatctctcttagaatcacgaagttataggactggggattgaaatattttccaaatagttctgccacaaggtaggcactgaaaatcctcactgcaagcgaagtctc

SEQ ID NO: 53689 - DNA, 601 bp, Human
tattgcagaaagtagcaaggaactaattaatgttcctgcaagtgagagggtaagatgacggatttttctctatgtcacttttcattttcccccgtaaaggaatatacagacaaatacatacagatagagatatagtagtaggtataagaagtcaaaaatacatgatatttctagcttgacaatgtgctctaaaaagaaattgaaccgcgtgagaagccaaccaaccaacaaataactgtatgttttagcatggcagatgctgggataactgcctatttcttgctggatagcaaattaaacrttatcctaaaagatggatacattcttgtcagtgtataaaatacaacagtcctaaagagaaaataatgcatagctatgtgttacccaataattccctgaatatccatatcctctggttctgtctaaaaaggttaaatggctctaaatctgtctgctagactcataaggaactatgcattgctctggctagtcaggaaatttaattttcttctgaaattaaccaattgtgcatagagagagggaagctgctctccatgatccaactggggtggaggtgggggcagaggactgtagaactgca

SEQ ID NO: 53690 - DNA, 601 bp, Human
gctgagagcagtagctcacgcctgtaatccaagaactttgggaggccgaggggggcggatcagaaggttaggagttttgagaccagcctggccaacatagtgaaacctcatctctgttaaaaatacaaaaaattagccgggtatggtggtgcatgcctgtgttcccagctactcaggaggctgaggcagaagaattgcttgaacccaagaggctgaggttgcagtgagccgagattgtgccactgtactccagcctgggtgacagagtgagactctgtctcaaaaaaaaaaaaaaaaaaaagaagactagttagataactgtgaagggctttggtttttctggggatattcagccaacctctgtattataggctcacaaagacagatattgtgcctttctagaaatttcttgacaaaatgtaggttcagctgacaataattggacaaaatgtcagtcaaaatatatatgaatgaataaatgaattaatgtgaatgaatgaatgaatgagtttctgaatatgtgacttaatgaattaattaccattagttgaattcgcaggtatagtgagtttttcgaaacagtgttggacgatgtgctgtt

SEQ ID NO: 53691 - DNA, 601 bp, Human
tggcatccttggatatctatgaacttctattcaaaattcattaggaaaggttttcctccatgtgaccttaaagctctacagtttgattttgtttaccattttcagagagcatgtataaaagactagttagataaggctgagagcagtagctcacgcctgtaatccaagaactttgggaggccgaggggggcggatcagaaggttaggagttttgagaccagcctggccaacatagtgaaacctcatctctgttaaaaatacaaaaaattagccgggtatggtggtgcatgcctgtgttccsagctactcaggaggctgaggcagaagaattgcttgaacccaagaggctgaggttgcagtgagccgagattgtgccactgtactccagcctgggtgacagagtgagactctgtctcaaaaaaaaaaaaaaaaaaaagaagactagttagataactgtgaagggctttggtttttctggggatattcagccaacctctgtattataggctcacaaagacagatattgtgcctttctagaaatttcttgacaaaatgtaggttcagctgacaataattggacaaaatgtcagtcaaaatatat

SEQ ID NO: 53692 - DNA, 601 bp, Human
taaagaaaccattttaacattttctcgcatgcactttgagtatcaaaaattccatctacaagttttcagctttttgcctctaattgctccactggttgctctaactgctttaataaataatattatctgagttctgctagttccagaattctaaggtccctgcatcacatattatttattattcctctaaggaaaagaaggagcctttttctatccaaataatttctttatagtcagagaggagagagagagagagagagagaaagacaggaaatgaagggagaataaaaatgtgagaaamcaataaataaaatctaccttcaaattactacaaggttctctacagggtgagatattttcactataacattattggcatccttggatatctatgaacttctattcaaaattcattaggaaaggttttcctccatgtgaccttaaagctctacagtttgattttgtttaccattttcagagagcatgtataaaagactagttagataaggctgagagcagtagctcacgcctgtaatccaagaactttgggaggccgaggggggcggatcagaaggttaggagttttgagaccagcctggcc

SEQ ID NO: 53693 - DNA, 601 bp, Human
atgcatattcaagtttgatgtacaaactacaaatctattctaagtcagtttcttgttcttgcttcttcatccattttggtagagaaatgctactgtaatcaaagaatgtgtgaagagattacagtgaagggactagggtttggctaaggcagtcaacagcctcaattccaaacccctgtattatagccatcactgagatcagaagaagaaaatgagcaggtaaaaaaaaaatagaaatttataataaaaccatgaaggaaacaaattcctcactctaagcagggaaacatcacagtattcktcagggtacccactgcatcctgcattattggttatgaaaatttcctcaaaagctaggctgaggaagccagctttttctggcagattcaacatgggtgcatgctgtcatgggccccatgagtactaagattccaagggctctaaggcaatgatggcaataacaattctcattgcaggtagctggatcctaatacaaaaaagttatttgactactaacattctttaaattattttgagaaatttattttagggagctttgagacagagtaaaatcctggaatgatatgggagctgactgttc

SEQ ID NO: 53694 - DNA, 601 bp, Human
tgcatctcaaaatgtgtaacaaatatatatttatctaagggaagacactgtaggttgagaagtgtgccctgttctatccaatatggtaaccactgtggatttgggagctggacagctagcggtgtgaattcagtaaaattggaggagccaagatggccgaataggaacagctccggtctacagctcccagcgtgagcgacgcagaagacgggtgatttctgcatttccatctgaggtaccgggtttctctcactagggagtgccagacagtgggcgcaggccagtgggtgcgtgcaccgtscgcgagccaaagcagggcgaggcattgcctcacctgggaagcgcaaggggtcagggagttccctttccgagtcaaagaaaggggtgacggacgcacctggaaaatcgggtcactcccacccgaatattgcccttttcagaccggcttaaaaagcggcgaaccatgagattatatcccacacctggctcggagggtcctacgcccacggagtctcgctgatttctagcacagcagtctgagatcaaactgcaaggcggcagcgaggctgggggaggggcgcccgccattgcccaggcttgc

SEQ ID NO: 53695 - DNA, 601 bp, Human
aagcatctttgtttctctcagaatataagcattattattaagttttgttccctagagaatacagaagcttcaccaatcagaaaaaaaaaagctgattttaaaccctagatcagcactttctttttttgtttctctctcaagattcttgtgcaatctctaccaccttagatcactagttttaaaatattttacaaatacatgtaatttgattattatttataactaatagccaggtctagtataccacactgataatatttcaggcaacttaacttgccactatgaggtttgcatctcaaamtgtgtaacaaatatatatttatctaagggaagacactgtaggttgagaagtgtgccctgttctatccaatatggtaaccactgtggatttgggagctggacagctagcggtgtgaattcagtaaaattggaggagccaagatggccgaataggaacagctccggtctacagctcccagcgtgagcgacgcagaagacgggtgatttctgcatttccatctgaggtaccgggtttctctcactagggagtgccagacagtgggcgcaggccagtgggtgcgtgcaccgtgcgcgagccaaa

SEQ ID NO: 53696 - DNA, 601 bp, Human
tatattttccatgacttcgacccattaaggactttcataaattgtattctcatttactatgaaggtgtgaacctcggtagatcatcccaaacttgatttgtcccctattgcctgtttcaaaggcacttcagctagacccgtcccattccccagcaagcagacttcatactcatggggtagagctaataaacatttgacaaatgaatgaaaatagaagctctccatttccaccgtgctctcttcttaaaatatgcaatattatgttttcctctgcaacattaagtcaaatctgattgtccttatcaaaagcaaagctgtataatacatcatgtcaaaccagaatgtagaaatataaggaaaaataaaggtttagttaaaatgactcccataaatatttgaacatcagataaggatgtcaatctccctttgtcatgatgcaaaatagaggatttattttgccttatgagtataataatgttagatatcatggctcagcctacacaagcatctttgtttctctcagaatataagcattattattaagttttgttccctagagaatacagaagcttcaccaatcagaaaaaaaaaagctgatttt

SEQ ID NO: 53697 - DNA, 601 bp, Human
ttcctgtgctttgtaccactaaatatattttccatgacttcgacccattaaggactttcataaattgtattctcatttactatgaaggtgtgaacctcggtagatcatcccaaacttgatttgtcccctattgcctgtttcaaaggcacttcagctagacccgtcccattccccagcaagcagacttcatactcatggggtagagctaataaacatttgacaaatgaatgaaaatagaagctctccatttccaccgtgctctcttcttaaaatatgcaatattatgttttcctctgcaacrttaagtcaaatctgattgtccttatcaaaagcaaagctgtataatacatcatgtcaaaccagaatgtagaaatataaggaaaaataaaggtttagttaaaatgactcccataaatatttgaacatcagataaggatgtcaatctccctttgtcatgatgcaaaatagaggatttattttgccttatgagtataataatgttagatatcatggctcagcctacacaagcatctttgtttctctcagaatataagcattattattaagttttgttccctagagaatacagaagcttcaccaa

SEQ ID NO: 53698 - DNA, 601 bp, Human
agggcatttaggtcttttcctgtgctttgtaccactaaatatattttccatgacttcgacccattaaggactttcataaattgtattctcatttactatgaaggtgtgaacctcggtagatcatcccaaacttgatttgtcccctattgcctgtttcaaaggcacttcagctagacccgtcccattccccagcaagcagacttcatactcatggggtagagctaataaacatttgacaaatgaatgaaaatagaagctctccatttccaccgtgctctcttcttaaaatatgcaatattaygttttcctctgcaacattaagtcaaatctgattgtccttatcaaaagcaaagctgtataatacatcatgtcaaaccagaatgtagaaatataaggaaaaataaaggtttagttaaaatgactcccataaatatttgaacatcagataaggatgtcaatctccctttgtcatgatgcaaaatagaggatttattttgccttatgagtataataatgttagatatcatggctcagcctacacaagcatctttgtttctctcagaatataagcattattattaagttttgttccctagagaat

SEQ ID NO: 53699 - DNA, 601 bp, Human
agatgcatttatattcaaatgatgtgcttatttacacactataataataggataaacacaccattccagtgttctgccagatgtaattcattctggggacaaaaatattttttaccaaaaatgctcattcctaaacgcaatgtctacccacacggtctcacccggtcttgtacaattaaacaaatgcaaaatgcaagatcatgtatttgatgtccaataaatgttagccagaaatgtgtcctcttttgccattaaacagacaattctcttcactacagtctacaccctgttcctcttccayacttgttctgtccaatctcagacccttggctttggaagggcatttaggtcttttcctgtgctttgtaccactaaatatattttccatgacttcgacccattaaggactttcataaattgtattctcatttactatgaaggtgtgaacctcggtagatcatcccaaacttgatttgtcccctattgcctgtttcaaaggcacttcagctagacccgtcccattccccagcaagcagacttcatactcatggggtagagctaataaacatttgacaaatgaatgaaaatagaagctctccat

SEQ ID NO: 53700 - DNA, 601 bp, Human
tgtataactatgtcaaaataggttatgtaaaatgtcataaatgagtatataatttgaaattttaattggatattaaggttcatttaccaaataataaggagttttggtaaatactgggaatgaactgttaagcaagatatggtctattaactcttttcccccccccaaagacaaggtctcacgaggtctccctctgtcacctaggctggagttcagtggcacgatcccagctcactgtcaccttcacttcccagggtcaagtgatcctcttgcctcagcctcctgggtagctgagattacrggtatgcaccaccacgcccggctatttctttgtatgttttatagataggaggtttcaccatgttgcctaggctggtggtctctcaaccttaaaactagagatgcatttatattcaaatgatgtgcttatttacacactataataataggataaacacaccattccagtgttctgccagatgtaattcattctggggacaaaaatattttttaccaaaaatgctcattcctaaacgcaatgtctacccacacggtctcacccggtcttgtacaattaaacaaatgcaaaatgcaagatcat

SEQ ID NO: 53701 - DNA, 601 bp, Human
ttttggtaaaaattgtttaccatatagaaaaaaacatatttgaggaaagcatgcacaccaaaattaattttaaaagtagtgtataactatgtcaaaataggttatgtaaaatgtcataaatgagtatataatttgaaattttaattggatattaaggttcatttaccaaataataaggagttttggtaaatactgggaatgaactgttaagcaagatatggtctattaactcttttcccccccccaaagacaaggtctcacgaggtctccctctgtcacctaggctggagttcagtggcaygatcccagctcactgtcaccttcacttcccagggtcaagtgatcctcttgcctcagcctcctgggtagctgagattacgggtatgcaccaccacgcccggctatttctttgtatgttttatagataggaggtttcaccatgttgcctaggctggtggtctctcaaccttaaaactagagatgcatttatattcaaatgatgtgcttatttacacactataataataggataaacacaccattccagtgttctgccagatgtaattcattctggggacaaaaatattttttaccaaaaatg

SEQ ID NO: 53702 - DNA, 601 bp, Human
tattaaatgttggaaagttatgaggatggtgatatttgattatgtaagtggtttccattttggtaaaaattgtttaccatatagaaaaaaacatatttgaggaaagcatgcacaccaaaattaattttaaaagtagtgtataactatgtcaaaataggttatgtaaaatgtcataaatgagtatataatttgaaattttaattggatattaaggttcatttaccaaataataaggagttttggtaaatactgggaatgaactgttaagcaagatatggtctattaactcttttcccccccmcaaagacaaggtctcacgaggtctccctctgtcacctaggctggagttcagtggcacgatcccagctcactgtcaccttcacttcccagggtcaagtgatcctcttgcctcagcctcctgggtagctgagattacgggtatgcaccaccacgcccggctatttctttgtatgttttatagataggaggtttcaccatgttgcctaggctggtggtctctcaaccttaaaactagagatgcatttatattcaaatgatgtgcttatttacacactataataataggataaacacaccattc

SEQ ID NO: 53703 - DNA, 601 bp, Human
aaactcttattaaatgttggaaagttatgaggatggtgatatttgattatgtaagtggtttccattttggtaaaaattgtttaccatatagaaaaaaacatatttgaggaaagcatgcacaccaaaattaattttaaaagtagtgtataactatgtcaaaataggttatgtaaaatgtcataaatgagtatataatttgaaattttaattggatattaaggttcatttaccaaataataaggagttttggtaaatactgggaatgaactgttaagcaagatatggtctattaactcttttyccccccccaaagacaaggtctcacgaggtctccctctgtcacctaggctggagttcagtggcacgatcccagctcactgtcaccttcacttcccagggtcaagtgatcctcttgcctcagcctcctgggtagctgagattacgggtatgcaccaccacgcccggctatttctttgtatgttttatagataggaggtttcaccatgttgcctaggctggtggtctctcaaccttaaaactagagatgcatttatattcaaatgatgtgcttatttacacactataataataggataaacac

SEQ ID NO: 53704 - DNA, 601 bp, Human
ttatagttgtaaaatggggataacatgcatttcctccgtcataaagttagtaagagaaatatgtataatatcttgaccatagtatctgtcacatagtaaactcttattaaatgttggaaagttatgaggatggtgatatttgattatgtaagtggtttccattttggtaaaaattgtttaccatatagaaaaaaacatatttgaggaaagcatgcacaccaaaattaattttaaaagtagtgtataactatgtcaaaataggttatgtaaaatgtcataaatgagtatataatttgaaatyttaattggatattaaggttcatttaccaaataataaggagttttggtaaatactgggaatgaactgttaagcaagatatggtctattaactcttttcccccccccaaagacaaggtctcacgaggtctccctctgtcacctaggctggagttcagtggcacgatcccagctcactgtcaccttcacttcccagggtcaagtgatcctcttgcctcagcctcctgggtagctgagattacgggtatgcaccaccacgcccggctatttctttgtatgttttatagataggaggtttcacca

SEQ ID NO: 53705 - DNA, 601 bp, Human
aacgctaataggtaacagaagagacaacagaatgatgaagtataaaaaaagcatcttacaatgtaacagttcagaccataggaccagatccagtactcatatttaataatatatttaatgcatttattgaatctttcctaatttttgacctttctgctaagccctatatattaatttttcatttaatctttcctataatctagtggagtagcccattatagactttcttgtctctcaatgtttatagttgtaaaatggggataacatgcatttcctccgtcataaagttagtaagagaaayatgtataatatcttgaccatagtatctgtcacatagtaaactcttattaaatgttggaaagttatgaggatggtgatatttgattatgtaagtggtttccattttggtaaaaattgtttaccatatagaaaaaaacatatttgaggaaagcatgcacaccaaaattaattttaaaagtagtgtataactatgtcaaaataggttatgtaaaatgtcataaatgagtatataatttgaaattttaattggatattaaggttcatttaccaaataataaggagttttggtaaatactgggaa

SEQ ID NO: 53706 - DNA, 601 bp, Human
tttatggctgcatagtattccatggtatatgtgtgccacattttccttatccagtctattgttgatgggcatttcagttggttccatgtctttggtattgtgaatagtgctgcaattaacctatgcatgcctgtgtctttataacggaatgatttatattcctttgggtatatgcccagtaatggaattgctgggtcaaatgatatttctgtctctaggtaactgaggaatcaccacactgccttccacgatggttgaactaattcatattcccactaacagaagaaattaatttctatayggtttataagccatccagtctattttgtagtttgcattttgtatagaagcccaaatggactacaaaacagaatataacaagtgattatttttctcattttggaatatactgatttgaacatatcttagacacctaaatattaaaatgcaatatctaagtaaacatgatttattgaataagatggtaagaatttagaccttccctgaaagccagagaataaaagcttccatctcccaagttctttacaggcctatgaataaactttaaatccaccttccttttctcacaaactctgctctg

SEQ ID NO: 53707 - DNA, 601 bp, Human
tattaatatcttttttatacaccaagattcatttcctggctatggaatgctggacccaataatctttaagttttaaagactacaaggtggactattggcccgtaagtaagcagtgatgcactaaaacaggataggatggatgcccaaagaaggatatatgcaattgcatttcaggaagaaagactgaagaaggccttcatgattgaggtgatggcttaggaagtgcacatgaaatctctctattcattgatactcattaaactcaaagctgaagcatggtccatgccagttagtactgagygcatttcttatacatgttcttgatagatacttattatatgacaaagaataagactatgccattataaaaaaataaattctccataatcctcccactataattttgcactgttaatattttagtagagttcattgaaaacattatgtatgtatgtatatgaatatgcatctaccaatttgtacctatacctacctatgaagatagctagataaataactatacagcaagttactagttagatagctagataggtatagatagatatattaatggatttttccttctcattttagctatttc

SEQ ID NO: 53708 - DNA, 601 bp, Human
tataataaaagttgataaagtagatgtaagctcttaaagacagtttggcaccaaatttcaccatatagctattgtttagagactccattatagttttatcaagtgcaaagaagaaaaaaaagtcaataaaaagattaacaagttattttaacaaccctagactctcctcccccataataaaatagctcaaatgttttcacaaaatgtatgaaaaaaattacattgaattgatattgatataattttaaacagcctatgattactgtgtaaaatacattagactctaaaaaaaacaaaaaawtatctataatctctcctacccaaaataatacatattgataaagcttccatctatattttccacatgtatgtatgcatgtgtatgatttaaatatgtgtttctatattgtatgtaccatactatatgtatatgtgtgtccaattatttaaattatagtgtacagttcttgaatttttttaacctactgttttatactaaatcttttcctcttactttaaaatgcaaagcattgtttttaatggctgaataatggatataagaatgtttccttctcacatatcctgaaacatttcagtaatt

SEQ ID NO: 53709 - DNA, 601 bp, Human
aaataacgccgcctacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcactaccattcaggacataggcatgggcaaggacttcatgtccaaaacaccaaaagcaatggcaacaaaagmcaaaattgacaaatgggatctaattaaactaaagagcttctgcacagcaaaagaaactaccatcagagtgaacaggcagcctacaaactgggagaaaattttcgcaacctactcatctgacaaagggctaatatccggaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactagccatcagagaaatgcaaat

SEQ ID NO: 53710 - DNA, 601 bp, Human
aaccaaaaacaaaaacaaaaaaaactacaattagccaggcatgatggcttgtgcctgtaggcccagatgctagggagtctaaagcaggaggatcacttgagcccagggtggagtgagctatgatatagtgcctgggcaaaagagagagatctatctcaaaggtaacatgaattaagtttaactctactagattgttttcagtatatgtgaaaattctttataattattgactatccacattaaagaagactggatttttttgagctttttataaagccttaagtcatctaaatagatacarcttttctgagaggcttaaggtgataatcaggcttcaacatggtaaattactaaaaaaattatgtttacatctttctaaatgaggttaacacttctaacaaaccaaaatcaccaaatggcatgctttatttgcttcttctcttcatgttacaaggagaaactgccgtgatggtaagacactagggaagaaaatagtactcctaaggcaggggaaacagcaaagtttccaaagctctgtttctatccagagccagagtttggcagtgttgaaactacatatcaacttgactgcatgttctct

SEQ ID NO: 53711 - DNA, 601 bp, Human
ttggtagccttgtcaccctgcagctaacagctcaatgccctggagcatctatttttgtatctgtttttcttacttgtgtgggatttctcaaaaatgagtcttttgtttctggattgtcctgaaatgtttcttaagccaagctctgtgtattcattgctttgagtacattttgctgataactcataaaccttgatggatatttaagtaaaggagtctatcttattttaaaaaggtggcatgggccttggttgtggatcctgtttgtaatcccagcaggaggatcagtggaggtgaggagttmaagactagcctgggcaacatggtgagaccctgtttctaaaaaaaaaaccaaaaccaaaaacaaaaacaaaaaaaactacaattagccaggcatgatggcttgtgcctgtaggcccagatgctagggagtctaaagcaggaggatcacttgagcccagggtggagtgagctatgatatagtgcctgggcaaaagagagagatctatctcaaaggtaacatgaattaagtttaactctactagattgttttcagtatatgtgaaaattctttataattattgactatccacattaaagaaga

SEQ ID NO: 53712 - DNA, 601 bp, Human
tttaccttaaatcttcatcatcatggtaaatagcagccatgcactgtagtttcagggaatggggttgctactagcagagatatactatacaagcctaatctcttgttagcacatggacatctgcctgccagctcatgtgataagatgtgccagttgatcaggataacatgttagatccactaccactgaaatacttgggtaataaacacagtgaagcatctcagcctcggttaagtgaatctgacacaagaggataaagaatgacatctccattctcattaagagataacagatggacttygctaaaatccactttttagcctaatttcatttgtttaaatcttttatctgatgagatagcattctgagagtcattttaaattgttctccctggaatgactatttctttatcattattagaacctccccctatggggttctgctattctgaatggttttaaatattcatctcagacaaattctataaatctccttttaatttttttccccaagacatggtctgtggctttggaaaataaacatcatgtgatgggctaaataatcaaatcaagtcaaaacaagtttctaagctatgttcata

SEQ ID NO: 53713 - DNA, 601 bp, Human
aagccagagtccttagggaaacagacaggggacgcgaggctcctctctgccagcacctttctcatggtctctaactcccaagattggttaatattctgtggggatccttccctgtgaacacagtcagtgccccacaatttttctacaaggagagcacagttctttctgccctttctgtctcagcttcaatcactcagggaaaaaaaaaaaaaaaaaagacataaagatccagaaagccataatggatgtgtacctatctgcatgggatttttaacaaacagctgtctagggtatatttaaraaaagatcctccctgccaatcaattaatagtgtctgtttggagttagaaatcatcagggtactccctcattatactaattcattatttcctttcttcattcattcagtcatttaaccaatatttattaggagccccaaagcactatggtaggcccacaggataaagcaataatgaaatgttacatgagaacagggaacttaactatttctgcccttaggaatttattttcaaaagctcaaccaaatacgtatgtgttataagccttgaacagttatttaaaagaaaataaacacgtacaa

SEQ ID NO: 53714 - DNA, 601 bp, Human
ctctctctctctctctctctccctttctctctctctctctctctctctctctctccctctccctctctctctcgcagtgcctggatgaatttccccagtttctatctgtgtgaccctattaattgttctgaaagggtaatacaaaggagttatcaatgggcgagtcttgatctgccctgggaacaattttgtctcttgagaaggcaaccttatttggtgagaccctgaaagtgtaaattataatgccaatgtatttcctttggggttaccttcattttcactctgctcttaacaatgatcygcattttttgagtgcttactaattactccataccaagaatcctaataaagaaattataagcattacttctttgaatagccaaccaacgttttacaggtaataagctgtttccatcaatgttatattcaagatatattaacagtaacaatccttattgttactatatctcaaactaattacctcaagctaattgagaaaataaataactttctaaggcatcagttctcaaacaatttggtctcagggtcacttcacacacttaaaaattaatgaagaaccccaaaaccctttatgcattaa

SEQ ID NO: 53715 - DNA, 601 bp, Human
tattgttgcaactgtttctaaaattgaataaaataatcaccaagtgatttgaaaaacatggagttaaagccatgaggttaagatgtgtaatttaaattttagtggccttataattgataatctcctctagttccagagggttggttcccggaagagcacttcaggctctctctctgtgtctctccctttctctctctctctctctctctctctctctctctctctctctctctctctctctctctctctctctctctctctctctctccctttctctctctctctctctctctctctctccccctctccctctctctctcgcagtgcctggatgaatttccccagtttctatctgtgtgaccctattaattgttctgaaagggtaatacaaaggagttatcaatgggcgagtcttgatctgccctgggaacaattttgtctcttgagaaggcaaccttatttggtgagaccctgaaagtgtaaattataatgccaatgtatttcctttggggttaccttcattttcactctgctcttaacaatgatctgcattttttgagtgcttactaattactccataccaagaatcctaataaagaaa

SEQ ID NO: 53716 - DNA, 601 bp, Human
ttgttattattgttatttaagtaagcatatattgttgcaactgtttctaaaattgaataaaataatcaccaagtgatttgaaaaacatggagttaaagccatgaggttaagatgtgtaatttaaattttagtggccttataattgataatctcctctagttccagagggttggttcccggaagagcacttcaggctctctctctgtgtctctccctttctctctctctctctctctctctctctctctctctctctctctctctctctctctctctctctctctctctctctctctccctytctctctctctctctctctctctctctctccctctccctctctctctcgcagtgcctggatgaatttccccagtttctatctgtgtgaccctattaattgttctgaaagggtaatacaaaggagttatcaatgggcgagtcttgatctgccctgggaacaattttgtctcttgagaaggcaaccttatttggtgagaccctgaaagtgtaaattataatgccaatgtatttcctttggggttaccttcattttcactctgctcttaacaatgatctgcattttttgagtgcttactaatt

SEQ ID NO: 53717 - DNA, 601 bp, Human
tggttgttattattgttatttaagtaagcatatattgttgcaactgtttctaaaattgaataaaataatcaccaagtgatttgaaaaacatggagttaaagccatgaggttaagatgtgtaatttaaattttagtggccttataattgataatctcctctagttccagagggttggttcccggaagagcacttcaggctctctctctgtgtctctccctttctctctctctctctctctctctctctctctctctctctctctctctctctctctctctctctctctctctctctctctcyctttctctctctctctctctctctctctctctccctctccctctctctctcgcagtgcctggatgaatttccccagtttctatctgtgtgaccctattaattgttctgaaagggtaatacaaaggagttatcaatgggcgagtcttgatctgccctgggaacaattttgtctcttgagaaggcaaccttatttggtgagaccctgaaagtgtaaattataatgccaatgtatttcctttggggttaccttcattttcactctgctcttaacaatgatctgcattttttgagtgcttacta

SEQ ID NO: 53718 - DNA, 601 bp, Human
tggaatggtagctgttattattatggttgttattattgttatttaagtaagcatatattgttgcaactgtttctaaaattgaataaaataatcaccaagtgatttgaaaaacatggagttaaagccatgaggttaagatgtgtaatttaaattttagtggccttataattgataatctcctctagttccagagggttggttcccggaagagcacttcaggctctctctctgtgtctctccctttctctctctctctctctctctctctctctctctctctctctctctctctctctctctytctctctctctctctctctctccctttctctctctctctctctctctctctctctccctctccctctctctctcgcagtgcctggatgaatttccccagtttctatctgtgtgaccctattaattgttctgaaagggtaatacaaaggagttatcaatgggcgagtcttgatctgccctgggaacaattttgtctcttgagaaggcaaccttatttggtgagaccctgaaagtgtaaattataatgccaatgtatttcctttggggttaccttcattttcactctgctcttaacaatgat

SEQ ID NO: 53719 - DNA, 601 bp, Human
tggtggaatggtagctgttattattatggttgttattattgttatttaagtaagcatatattgttgcaactgtttctaaaattgaataaaataatcaccaagtgatttgaaaaacatggagttaaagccatgaggttaagatgtgtaatttaaattttagtggccttataattgataatctcctctagttccagagggttggttcccggaagagcacttcaggctctctctctgtgtctctccctttctctctctctctctctctctctctctctctctctctctctctctctctctctcyctctctctctctctctctctctctccctttctctctctctctctctctctctctctctccctctccctctctctctcgcagtgcctggatgaatttccccagtttctatctgtgtgaccctattaattgttctgaaagggtaatacaaaggagttatcaatgggcgagtcttgatctgccctgggaacaattttgtctcttgagaaggcaaccttatttggtgagaccctgaaagtgtaaattataatgccaatgtatttcctttggggttaccttcattttcactctgctcttaacaat

SEQ ID NO: 53720 - DNA, 601 bp, Human
aatggtggaatggtagctgttattattatggttgttattattgttatttaagtaagcatatattgttgcaactgtttctaaaattgaataaaataatcaccaagtgatttgaaaaacatggagttaaagccatgaggttaagatgtgtaatttaaattttagtggccttataattgataatctcctctagttccagagggttggttcccggaagagcacttcaggctctctctctgtgtctctccctttctctctctctctctctctctctctctctctctctctctctctctctctctctctctctctctctctctctctctctctccctttctctctctctctctctctctctctctctccctctccctctctctctcgcagtgcctggatgaatttccccagtttctatctgtgtgaccctattaattgttctgaaagggtaatacaaaggagttatcaatgggcgagtcttgatctgccctgggaacaattttgtctcttgagaaggcaaccttatttggtgagaccctgaaagtgtaaattataatgccaatgtatttcctttggggttaccttcattttcactctgctcttaaca

SEQ ID NO: 53721 - DNA, 601 bp, Human
gctgagtagtattccatggtatacatacatatgctacattttctttatccattcattgtttgatggacacttatgttgattctatatcctagcaactgtgaatcgcactgtgataaacatacacatgcaggtgcctttttgatatagtgacttcttttcccttgggtagatacccagcatgggattgctggatcaaatggtagatctactttaattctttgagaaatctccatactgttttccatagacgttatactagtttacattcccaccagcagtgtataagcattccttttcatcrcctccacactgtctatttctgtttgtttgtttgtttgtttgtttgtttttaactttttaataatgaccattctggctgaagtaaggtagtatctcatttctggttttactttgatctcaattttataaaatggagataacataacctacctacttcagtatctattcatcgtaatattatgtgttaggaaattatgctaaaaaagttaatactcgtttgttctgtgcaagttacttatgttgtgaagaggagcttcaggccaagtttatactggctttttaaaatgcaggactaaccttt

SEQ ID NO: 53722 - DNA, 601 bp, Human
gagtcagcatcacctagaggctttttagaaatgtagaatctgcaccccaaactcagggaatcccaatctgtgttttaacaagatcaccaggtaattcataggcatataaaggcttgagaagcagtgccttagagtatttgctgaacaactattatatgcagtccatcaaaatgcagctgtgcttctggtgaaaataagagcatttggacaccaacttcctgctggggcagggatgttaaacaaattgccctcaatcacacatctcataaggaggccacccaggatttcagcttgcataggmtgtaaaagaacaacaggaaagagtcttctagcctggattcctccagagcctatgttcatagcactgtgcaaaactgcccaggctttctttgtctattcggccagctccagtgggccagttctggtttccaagcatttacagcagggaatgtcatgaattgcatacacacgtgccagggtcagaatagataccagtattcactcagaccgttctgaccatattactgtctgaacactaagctcataacaggaacttcaaatctaccaccctaggattttctggcttcaggatagcagaaag

SEQ ID NO: 53723 - DNA, 601 bp, Human
aacattgaaaatagagagtctaagtaaaaaacaaaacttcctgatgactattacctccctaagattggaaaaccaaataccattttcaaaactgttaacagaagtttccagatagggaaggaactggtccaggtcaatggtttgcaactagtggactacactgcagtatgagtgttgcttagatattcgtgaaaaattcaaattctcaggccccaaacaagacctactgaattaggaactctgaagatggcaccaagtaatctgtaatagtccttcccaggtgagcgtgctacatgctaawctttcagagacattagcttagggttttgttttgtgataactatttcatatgaataaatagtattaaatgtgtattatatatgaatagagcattgttacttatagccaatgactactggagtcagcatcacctagaggctttttagaaatgtagaatctgcaccccaaactcagggaatcccaatctgtgttttaacaagatcaccaggtaattcataggcatataaaggcttgagaagcagtgccttagagtatttgctgaacaactattatatgcagtccatcaaaatgcagctgtgct

SEQ ID NO: 53724 - DNA, 601 bp, Human
tctcttctaaacttgaaatgtctagaaatatttaagtagaatctctaaaatagaggctaaaactaaaatacttttagcagataatattgactatttgtcatattagttatgtatagtgtaaacataattacatgaggcagtataagaaacatctagcaagtcacctgatatattaacattaaacaaataaaaataactcaaaatgtgggttaaaattaattataaatatcaaacaaagacgagtcatcattgtatttgtaaggtttgttttcaagaagatgcaaaaacagagggaagacayaaacaatgaatttgaagtaattgtgttttccaaaagagtatcaatttgcagatctataatttactgaaaattattttcctcaaagtcacatgacacacaaatacacccatatcatcacatgacattgattttcttataacatttcacatgatacatatataaatatgtgtgtataatttaaaattaattatgatacttttaaaattaagaagaataccaatatttctgatctggcttagacaatatttgatcagaaaaacaaaagcatgagtgtccacagaagaaataactgccaatttc

SEQ ID NO: 53725 - DNA, 437 bp, Human
aaattttatttatttatttatttatttatttatttatttatttatttatctactgagacagagtctcactcagtcgcccaagctggagtgcagtggcgcaatctcgggtcactgcaacctctgtctcctgggttcargtgattctcctgcctcagcctcccagtagctgggattacaggtgcccaccaccatgcccagctaatttttttgaatttttagtagagacagggcttcaccatgttgaccaggctggtctcgagcccgtgaccttaaatgattctcccgcctcagcctcttaaagtgctgggattacaggcatgagccaccgcatctggcaaggaacagaattttaacagcctctcttctaaacttgaaatgtctagaaatatttaagtagaatctctaaaatagaggctaaaactaaaatacttttagca

SEQ ID NO: 53726 - DNA, 601 bp, Human
cccaaacatttacaggcagcatgcagattgagaagacatctcagttacagacacagataatttattttttaaaaagaagaaagaaggaggaagaaggaggaagaggaggaggaggaagaagaggaagaggaagagaaggaaaaggagaaggaaagtaatagtagtagtatagcagtagtaggaggaggaagaggggatggagaaggggaggatgggaacagaaccaagagccatgtgtctagagtcaaaagtctaggagaatcagttctctgaaacagtactggatactcatcaaggaacyagtaacatgtgccaaaatgattccaagaatcactatttaccagtaactgccatatgacttccactttctctgttcttgagtaatgctgtctacagaaattatccttattctattcccccattgtatactgggtcagctcgaggatgatgctctaatgatttaaaatctcagagtgtttttagtaggaatgcaaatattttgtggccaaaggtcaactgtgtttgttttaaatcatgacattaattatttaatactcctctcattgagtttcttcccctggatatgggctctcttactgaa

SEQ ID NO: 53727 - DNA, 601 bp, Human
ttaatccatttatgctgggggttgcaatttcctgggtgtgaaaaatctgactttggtgacgccattgagcagtaggatataacgaactcccacatgcttagcattccaaaaatggaacatgaggcataaatgggctaaggatagggtatgtctcatagaccctctactaagaatcgtaacagcattgaccacagcagattcacgaggtgtccaaagtcaagaagagctcaccctgaagagatttgtgagtgtgattgctgtctaatgaaatgaattacaaattgatttgtaagaaacttayaaaatatttaaagaaagcatattggcttttacaaaaaagacagtaaacaatgaaaaaatgctgccagactcccaaacatttacaggcagcatgcagattgagaagacatctcagttacagacacagataatttattttttaaaaagaagaaagaaggaggaagaaggaggaagaggaggaggaggaagaagaggaagaggaagagaaggaaaaggagaaggaaagtaatagtagtagtatagcagtagtaggaggaggaagaggggatggagaaggggaggatgggaacagaaccaagag

SEQ ID NO: 53728 - DNA, 601 bp, Human
tatcatttgatttttaaagtctttgagaactctaattatattttgtaacttaatgcttttgtgtgattcacaatcacatacttttaaaacatggctccaaattctatgaaatacctttcactgaaagatagggtagctgttctcttgaatataggctctgtgatagatcaatagtatatgaacgaagtggcactgtgctaatttctaagctcaagtcttaagaagttagcagcttctatctctcttggggtacttcatcttggaatgcaaataccaggccatggagaagcccaaactctcscttggaaaggcagtgatggccaccaccaatttgccagccatatgattgagccatgttggaactgggtagtcagtctcttcaaagctgccccagtttatatcacattctgcagagacaaactgaccctggcaagccctgcccaaatttcaaatttgcgagcaaaataaatggtgatgtttttttctgccgctaagttctgggatttgttgttatgccgcagtagataatcaaaacagatttgagttccttgaagtaaggtactgctgtaatgacaacgttaagcatgtggcactggttctg

SEQ ID NO: 53729 - DNA, 601 bp, Human
agccactgcaaccaaccttaatagagattttgtaaccaagttgttacttccagtctcccaaaacactgatattttgtacatttttgtgtctttaaaatatataatacaagcaagattttcttgtacattttctgtcacagttgcctcttctctgtttttccaataaccagcaatattttctattactaaatatttaaggtaaatttgaattcatgtgtcattctctccacttacaaatttactttatgaaaccattgaaaaccatttcaagaaattccccagatgaaaatattatatagcrgattactagtaaagtaagggaagtcatgaagtattactaaaagattcctttttagattttgggaggcaacagaaatacacacacacacatacacacacacatttgtaatttacaattattctgaataactggaaattgtaattacatacataataccaagatcaaaatccttgtctaaagagagcaattatgtggtactatcatatttaacatagtgtgctatcccagcaaattaaatagagaacatatttttttgtctaaatctctagttactcttcattcttttcacttcagcaggtt

SEQ ID NO: 53730 - DNA, 601 bp, Human
gttgtacatattttggggggtacatgtgatattttgacgcatgtatagaatgtatggtgattagattatgctaatcaggatatccattatctcaaatatttatcttttctttgtgttgaaaacattacaattcttccagccattttgaaatatacaataaattattgttaactatattttccctactttaataatgaatactaaaacctatttctatctaactgcatatttttttaatttcaacttatattttattttatgttcagagggggacatatgcaggttacctgggtatattgtrtgatgtgatgctgagatttggggtatgaatggccccatcaaccaggtaatgagcatagtacccaacagttagtttttcagcactggccccctactttcctccctcctctagcaggcatcagtctactgttgccagttttatgtccatgtgtacccaatgtttagctcccacttacaagtcagaacatgcagtatttagttttccaagagcagtatattttgcttaatgtaaaatataattcagaacttcaagtcaatataggagatacaaggcaaacaacgactcttgtgaaaagaagtt

SEQ ID NO: 53731 - DNA, 601 bp, Human
ttaaatcactagatgaatgaatgaaaatataattaatagctaggttgattgttggatggataaacaagtgattgcatgaactgatgagtcaaaggaagaatactaccagaagccattttttgttttttttattttgtttatatttatattatatataatagttgtacatattttggggggtacatgtgatattttgacgcatgtatagaatgtatggtgattagattatgctaatcaggatatccattatctcaaatatttatcttttctttgtgttgaaaacattacaattcttccagcyattttgaaatatacaataaattattgttaactatattttccctactttaataatgaatactaaaacctatttctatctaactgcatatttttttaatttcaacttatattttattttatgttcagagggggacatatgcaggttacctgggtatattgtatgatgtgatgctgagatttggggtatgaatggccccatcaaccaggtaatgagcatagtacccaacagttagtttttcagcactggccccctactttcctccctcctctagcaggcatcagtctactgttgccagtttta

SEQ ID NO: 53732 - DNA, 601 bp, Human
ggttaaaatcaaagccatacattattactgatccttgatatttctaataggtgttaagcattccagagaaataatgattcatgtgtttcatttataatgattattaaatcactagatgaatgaatgaaaatataattaatagctaggttgattgttggatggataaacaagtgattgcatgaactgatgagtcaaaggaagaatactaccagaagccattttttgttttttttattttgtttatatttatattatatataatagttgtacatattttggggggtacatgtgatattttgaygcatgtatagaatgtatggtgattagattatgctaatcaggatatccattatctcaaatatttatcttttctttgtgttgaaaacattacaattcttccagccattttgaaatatacaataaattattgttaactatattttccctactttaataatgaatactaaaacctatttctatctaactgcatatttttttaatttcaacttatattttattttatgttcagagggggacatatgcaggttacctgggtatattgtatgatgtgatgctgagatttggggtatgaatggcccca

SEQ ID NO: 53733 - DNA, 601 bp, Human
ttttccatgagaaaaaaactcttagcattttgttccaaaatattttcctgaaggttaaaatcaaagccatacattattactgatccttgatatttctaataggtgttaagcattccagagaaataatgattcatgtgtttcatttataatgattattaaatcactagatgaatgaatgaaaatataattaatagctaggttgattgttggatggataaacaagtgattgcatgaactgatgagtcaaaggaagaatactaccagaagccattttttgttttttttattttgtttatatttrtattatatataatagttgtacatattttggggggtacatgtgatattttgacgcatgtatagaatgtatggtgattagattatgctaatcaggatatccattatctcaaatatttatcttttctttgtgttgaaaacattacaattcttccagccattttgaaatatacaataaattattgttaactatattttccctactttaataatgaatactaaaacctatttctatctaactgcatatttttttaatttcaacttatattttattttatgttcagagggggacatatgcaggtta

SEQ ID NO: 53734 - DNA, 601 bp, Human
actcttggccttaagtgatttgcccacctcagcttcccaaagtgctcggattataggcatgagccaccacacacagctgatacttgacatttctaatagatgttaagtattccaaagaaataatgattcccacttaaacaatttttattcataaagaggcccttagaggatatgttcatataggctataaagatggtaacagagacactgcaagtttagatttcataagatagtttggattttttaattatagtcggtaaaaaagtactacactttataatccaaatccagttattggggycaaaattgagccaaagaattaatatgtaccatgtcagaaacaaaaagtatctaagctcttacttatttgagtggaggtagaaaaagtaataataataagtaataaggaaaaaacaataataaaaacagtaggagctttcatctgccaggtcacattggatattattatatattacttttttatttgtgaaaattaaatcagtacaaccactcaaaatgaagaaactacatatgctacccgtaagaaatgaatgcaggactcccaacatttctggatttaattgtaaggtctcaaacttaa

SEQ ID NO: 53735 - DNA, 601 bp, Human
acatagacagctttctaagggaggtaatgatctggaccttgaaggaaaagtagtatgtggaagtgcagagatacgacaagatatttaaggcaacaaccacaaaaacatatgatggacaaaattccagagtaagggcactgcacaaaatgtttgagacacgtgtgatgagcaagaagatttttttataaactactgtagatactaacatcttgtgtagttttggatgagaaaaacattcatagtattttattccaaaacattttcctcaagtttaaaatgaaagccatgcattattattgaygcttgatatttctttcttttttttttttttaattgagatatggtctcgctctgtcacccagactggagtgcagtggtgcaatctcggctcactgcaacctccacctccttggctcaagcaatcctctcacctcagcctctggtgtaggtgggactacaggcatgtgccaccacgcccatctaatttttgtatttgtagtagagacagcttttcaccatgctgcccaggcgggtctcagactcttggccttaagtgatttgcccacctcagcttcccaaagtgctcggattataggcatga

SEQ ID NO: 53736 - DNA, 601 bp, Human
tcagaagctttgattctagaaagaaagaatctgtcccaggatttcctctagcagtagaaaattggacttttatctgactggtaagcaaatattacagtttagaaaaccccagttaacattaatagaaggtaaattccatctggagaaaaattttgagtctttttttgttcaaggttgtattccacatattgttcactgatgtattcaaaacagcacctgttatcctaaagtcaagataatacctatctcaggggtgactgaaaggcttgaatgaaattatatataaaagcaccaagcaaaytgcagtgctgaaagagttagcccttgtttatttgtccccgttttattttgctctgaacttccaagttacctctttactggttcaccttcctctgagatcctgatacctctgtgtctaattccataaacacacctttctccttagccatgattccagaaaacttaaatagtgacatgtaaactatttttaaaggaactttgtactttactggcaccttttaaaatatatatatttttaatttcaaattttattttagattcaagagggacatgtgcaggcttgttacctgggtatattttg

SEQ ID NO: 53737 - DNA, 601 bp, Human
gacttcttcctcagcactgttctaggtgttagagagattaatatggttggtgtccaagctctgtgtattctttatataagtctcagtcagtacaaccaaactaacattgaaatcctacttgcaaaccactaccctactccattaataatctatgtctgccatttgagaatgtcatcatcatcatcatcatcactttttaagattacatgctgtttattgaacacttattttcaggcaccatgattttaattttcctaacaatcctatggagaaagtggcatgattattctctcataaacayttaacatatgataattctattttccaaggtaactttccaacatccattcattaaacaaatactgactttacacctactgagtgccagctacacttataggcgctacagataccaaacagaaaaacaaataaacagagtaaacacacattcacttatattcatagatacttagaaataagggggatgtctgagatattattgaaacttacgaataaaaataaaactaggtaaagaaaaaaaaagggaaatgttggaaggggttagtccttctaaatgtcgtttctccacccaaattcctgt

SEQ ID NO: 53738 - DNA, 601 bp, Human
agttatttggctaaaaaataatttattttcatatattgtcacacgcctcttagaacatcaaccagtttgatgtagattttttccatcaaggcattggaaccagtcagtggagaataaaccactttggttgacttcttcctcagcactgttctaggtgttagagagattaatatggttggtgtccaagctctgtgtattctttatataagtctcagtcagtacaaccaaactaacattgaaatcctacttgcaaaccactaccctactccattaataatctatgtctgccatttgagaatgacatcatcatcatcatcatcactttttaagattacatgctgtttattgaacacttattttcaggcaccatgattttaattttcctaacaatcctatggagaaagtggcatgattattctctcataaacacttaacatatgataattctattttccaaggtaactttccaacatccattcattaaacaaatactgactttacacctactgagtgccagctacacttataggcgctacagataccaaacagaaaaacaaataaacagagtaaacacacattcacttatattcatagatactta

SEQ ID NO: 53739 - DNA, 601 bp, Human
gttaaactctgaaaggaatacgcagtgctgaattgaggagtcacctcaatttgttttctttctctctggtatctgagttccttagttgctggctgcctttaaatcatgttgttctccctaactttatggttgttctccatgggagagtttgtctgatgtaagttaccatcatagacgtaaagaaaacacttgattcccccccaacacacacacacacacacacacacacacacacacacacattatgatgtaatatgttcattatttcccccaagaaaaataaactgcaaatcaccctgcrcttgtttagcaacagacaaaatttactctagaaggactctaatcctccgtgagttcaaaggacactgtggtcagtgccagacagagttcatggatggtgattaagattgtgctatctttagttgatgctctggctacaaagccagaccaatttcttgagaccgcttttcctcagtctatgcttttgccacagtaaattctgcatttattgtgacagtggaccaagatgcatgcaccatattgagttaaataaacaaatacataattcaagatgaacgattagcagaattcaagatgaatg

SEQ ID NO: 53740 - DNA, 601 bp, Human
atagtattttaagaaatatcacattatagtggtttatctatatattcatttatcctacaagttactcattttcactgtattgtggaagaatacagaaagaagaaacacttttctacagtcacaggaagatttaaaatagggaattatctttcgcctttaaaaattaggaaaagtactttactttaggtatagaaaggtggaggccaggagcagtggctcacacctgtaatcccagcactttgagaggccaaggcggggagatcgctaggtcaagagatcgagaccatcctggccaacatartaaaaccccgtctctactaaaaatacaaaaattagctgggcatgttggcacgcacctgtagtcccagctattctggaggctgaggcaagagaatagcttgaacccgggaggtagaggttgtagtgagccgagatcatgccactgcactccagcctgatgacagagcaagactccatctcaaaaacaaatgaaaaacaagaaagaaggaaagaaagaaagaaagaaaggaaggaaggaaggaaggaaggaaggaaggaaggaaggaaggaaggaaggaagaaggaaggaaagaaagaaagg

SEQ ID NO: 53741 - DNA, 601 bp, Human
cttgatagctttatctactctctgccctcattttgattattgaatatgtgtagtgatgtataagtactcttctatgtgccttcaatataagaaaaagcaaacagagataaagactctgttctctcagaacttatagtacagtagcagagaataatcaaacagtgttgaattatacactagactgagagatatgaagaaaagcagacagttttagtgcagcacatcacagagagagcttaactaggttggagggtttaaagaggatggactttgaacattcgcagttggagttgaggtaggygaactaggaagcattccatttagagaacatattgggaccttgttgacgttgacttatcaaccttgctggggggaaaatgatttccttcagtatttgcaaggatgctacaatgagcatgggtctctagctccagtgatagatctgcttttgccttttatgttcacctcctactccctttctagggccattttccagagtttgtattttcgtggcacttctgtccatactggccatgcctgtgcctactttgtgagaggcaagtccttccagttttcttagaccatccttctttcaaagtcc

SEQ ID NO: 53742 - DNA, 601 bp, Human
aaattgtaactcgttgattcttgagccctctatatctcctccatagttatctacgaccacagtgatccagtaaatgatcaatgaatacctcaaaacattcaaactaattaatgtaatctaacccataatcttaaataatatattatttttattaattcattcattttcttgatagctttatctactctctgccctcattttgattattgaatatgtgtagtgatgtataagtactcttctatgtgccttcaatataagaaaaagcaaacagagataaagactctgttctctcagaacttayagtacagtagcagagaataatcaaacagtgttgaattatacactagactgagagatatgaagaaaagcagacagttttagtgcagcacatcacagagagagcttaactaggttggagggtttaaagaggatggactttgaacattcgcagttggagttgaggtaggtgaactaggaagcattccatttagagaacatattgggaccttgttgacgttgacttatcaaccttgctggggggaaaatgatttccttcagtatttgcaaggatgctacaatgagcatgggtctctagctccag

SEQ ID NO: 53743 - DNA, 601 bp, Human
aaagaaatcatatgtgagagtgaccatatgtcagatttaacagagttcaaagtagccattaacatatatttaaaaaggcataattaaatatgtaaatgaagatgccataacaacataacatcaagtagagaatatcaataaaaagacagaaattattaaaaaggaagcaaatggaaattgtgcagtaggaaattaccataaccaaaattttaaattcactagagagactcaaaagtagatttaaattggcagaagaaagaattactgaaagtgaagatcagtagagaatcaaagaacagcrgttaaaaaaaaataaagaaaaatgagcagagcctcagtgaaatatgggacaccattaagtgtcatatatgcataatagtaatgagagaagaaaaggagacagagaatggagaaaaaaatgaacaaataattcctgtaaacttcccaaatttattgagaaacactagcctgtatatcctaaaacttccccaacaaactctaagtaggataaacacaaagagactcacagacatatcatatctaaaatgctaaaagccaaaaacaagaacattttgagaccagcgggaggtgaacaaacaaa

SEQ ID NO: 53744 - DNA, 601 bp, Human
actgcatgtacagattagacagtgaataataggggcacagtcttagaaaactgaaagtataagaaaaagctaccatattccttaaacattattttgctccttctgaagtgaaaaaattgctaattttacagattcagatacactgacaatggttgattaggccaagtcaactatgtatgatattattctttgttttccttatctttaatattacatgcacgtgtgcatgcacacacacacacacactcatatctacacactgcaggcaaacatgcatatacacattttcttcccactcttytggttaaaaaattgtcaaagtccattcttatttttctcttttctttttaatttggcctcatggttgcaataaattgcaattatctcttcaacctagatgaccaacaggtggcaaaactcaggcataaagaatgaacaaactccatcagcttcttattggaggcaattttcaacattaaagtaggttttctcatatgtcatatatgggacaaagtgttatttatctatccctggggcccagtgcaaaataccaactaatatctttttaggaacaatgtgggattagggagctattacttaa

SEQ ID NO: 53745 - DNA, 601 bp, Human
ctttaatctcgctaaatattcaattaataaatagtgattagcacaggcttaataaactgcatgtacagattagacagtgaataataggggcacagtcttagaaaactgaaagtataagaaaaagctaccatattccttaaacattattttgctccttctgaagtgaaaaaattgctaattttacagattcagatacactgacaatggttgattaggccaagtcaactatgtatgatattattctttgttttccttatctttaatattacatgcacgtgtgcatgcacacacacacacacactcatatctacacactgcaggcaaacatgcatatacacattttcttcccactcttttggttaaaaaattgtcaaagtccattcttatttttctcttttctttttaatttggcctcatggttgcaataaattgcaattatctcttcaacctagatgaccaacaggtggcaaaactcaggcataaagaatgaacaaactccatcagcttcttattggaggcaattttcaacattaaagtaggttttctcatatgtcatatatgggacaaagtgttatttatctatccctggggcccagtgcaa

SEQ ID NO: 53746 - DNA, 601 bp, Human
ccctatgggaaggaaaaaataacatcagcattgagggtatttcattttaacgtgcaactcaactttctcttgaaagcatgtgtgtctgtttccaacttcccttaattaggatgttttcaacatggtgattatagagtctgaccaaataagaaaaatagcaagtgcttgactgctttaaaaaaaagcataaattgttatttcaaacaccatttgctgagtttagcttgataaagaccatttctgaataaattaaaagaggtttctttgataaagcaagctttattttatagataagggatcmattctttaaaagaaaaatgttgtatacaacaaaaatgtatctctttttttcttgagtagaacacaacccattttaagctcttacttgcttgactggctgtataatagagatgaacacttaaaacctagcaaaaggccagaactaaatcacttgttgagaagtggtccttaacaatgataaaagaggtaagattaaagatgaaatatcatatattttatgaatcacatttttcattaaaattgaccctggaatatttttgaataagatgatcccaagtgattttaatattgtcattttcat

SEQ ID NO: 53747 - DNA, 601 bp, Human
aagctttatttcttttcatttaaggtttcatgaaatgcttttgagtaagaatgtcattggtcacaggaatgtattgttttcttttgaaaaaaaatgttcactcttgatcagactcatattctcatgattattttataagagatgtgtcacacagacataggatttcaaagttctgcttccttggagagcattgcgacatcctagaaatttcagggactttagcacttttaagagcagactttaaaattcatttttgccacttttcatggtaaatcttaagtaagactcatagtctttttcrgtctcagcttttatatctataacatgtggttgctaataccaagctcctagagcaggaacgttagatgtgtgtgtacatttttcacttatgtaagcaatcagatttctcaattacttccatctccatagccaccaccttagacctggctaccattatcttttgcagttacagcttcctaaatgtgcttcctgcttaatcatgtgtgtgcatgtgtgtattttattcaagcataaaactctttatgttcaatctcatttttgcttattacatgctagtcacaggtatcttccattcttctaa

SEQ ID NO: 53748 - DNA, 601 bp, Human
aaacaaaatacattaaaagccttaaagaagggtgcttaaaaatagataggcatacaagacaaatcaagttataacaattatgattaattgaaaggggggaatataggtaaataagaaattttatcaaaatctacacaataacccaattatttcaaaactgtaaaatgtagtacaaacatattcacagttcatatctaatcaaaatatattgtctggatatttttgataatttgcatggcattccagttgctaccaagatttttattccatacccattcaacatgtttaatgagctcaccattttttttttttttggcctgaaacatccttgccttaaagtttattaggtggctattcagagcatgtagcttgcagttctgacatacaggaaatacagcaggaggaagtagatgaggttctaatcttattgacacactaaatgaagtcttcagtcctctgggtagaatttgggactctgccttcataaatgcattgtagaacttccaacatttttttcagcgttgggtttttcattcactttacctttcttgaaactaaattgaagtaaaccaatacaacgctaggattccagaagaatgcg

SEQ ID NO: 53749 - DNA, 601 bp, Human
tattttccaaggcttctagaatatatgtctatctctaggaagatccagcaataatgaacagcatggtatcttcaattgaaccacactgtcactttctcaggtaaaacttagtttctcttttctctaaatccttctataatgatatgaattgtaaggtgatagaaagggggtgaaggaaaggaagggaagttacggtcgatgaagaaggaacagcataatgtttggctttctattaattctattattatctccactttatttctgatgatcatattaactttcctgaaatattaacatctakctcttggagtagttttcaacttgggaaagaaaggaatgatccatgaatgagctttatatggctgtcattcctcaccttgaaaatgaaatagtatgaaattatttacatatgcgcatttatgaggggaaaggtcgtagcttttatcaaattatcaatgatgtccataactgaataaaacaaaacaaaatacattaaaagccttaaagaagggtgcttaaaaatagataggcatacaagacaaatcaagttataacaattatgattaattgaaaggggggaatataggtaaataagaaattt

SEQ ID NO: 53750 - DNA, 601 bp, Human
aactggtgaattattacattttcttccaaatatcccataaactggttatgattaagatttttggttaaaccacatttgacacttcaaaacagatatcccctgctttggcattttatctaaaagtagatgccaagtaggtcacttgaaggacttcataccattaaaatgcattaagatatccatactaatgaggctaaagttttcattgatgaaataacttttgaatgcacttagctttaaacagtaaaagaaaaagaacagatttgttcaaagaaatgtaccttcacagaggcaggttgtrttgacataccgagtagagggcaactggagaccacgtagggtccactgtgagctacgatgacctcagctggttttttcaagtaatttcatttcatggcaataatataaaaatttctggagcagtcataaattctgagaaatatgcatctaaagttaagcttaaatattttcccttctgctaataaagttagtatgcaactgaaaaatctaatgtttcataatttattgttgaaatattttcaattttaaggaaagctgaaagcaaaatatatgtctttattagagaaaacaaagcatatct

SEQ ID NO: 53751 - DNA, 601 bp, Human
cagtgcattatatgctggggagaaggtggctgaactggtgaattattacattttcttccaaatatcccataaactggttatgattaagatttttggttaaaccacatttgacacttcaaaacagatatcccctgctttggcattttatctaaaagtagatgccaagtaggtcacttgaaggacttcataccattaaaatgcattaagatatccatactaatgaggctaaagttttcattgatgaaataacttttgaatgcacttagctttaaacagtaaaagaaaaagaacagatttgttyaaagaaatgtaccttcacagaggcaggttgtattgacataccgagtagagggcaactggagaccacgtagggtccactgtgagctacgatgacctcagctggttttttcaagtaatttcatttcatggcaataatataaaaatttctggagcagtcataaattctgagaaatatgcatctaaagttaagcttaaatattttcccttctgctaataaagttagtatgcaactgaaaaatctaatgtttcataatttattgttgaaatattttcaattttaaggaaagctgaaagcaaaata

SEQ ID NO: 53752 - DNA, 601 bp, Human
gataagcaatttattgagccactggaactactgactaaaaagtctcagattataactcagcaatctgtatttcaaacagccttctgggtaattctggtgtacacacaagtatgagaaccactgttttgagccaatggaaaagattcatattcatagttctctcctcataattcattaagaggctttatattgtcaagctcatgtcaagctcagtgcattatatgctggggagaaggtggctgaactggtgaattattacattttcttccaaatatcccataaactggttatgattaagatktttggttaaaccacatttgacacttcaaaacagatatcccctgctttggcattttatctaaaagtagatgccaagtaggtcacttgaaggacttcataccattaaaatgcattaagatatccatactaatgaggctaaagttttcattgatgaaataacttttgaatgcacttagctttaaacagtaaaagaaaaagaacagatttgttcaaagaaatgtaccttcacagaggcaggttgtattgacataccgagtagagggcaactggagaccacgtagggtccactgtgagctacgat

SEQ ID NO: 53753 - DNA, 601 bp, Human
gtatactcctatagtgataatagatttaccataaaaagtagttaacagtgaaatgttctcaggtttatgatatttcgaggatataataatgatgtcaatgctattgtgtctgtgtgaacaattatgtcccattgaactttgaaatgttattaaagagaaaaaaaaattccttttgagaaggggtcatctttgctttctaacttaccactcaagtgtaagaagcacaatttcagaacttttagcagctatggggctttgcattgtatcaagcacatgttatatgataggcaattcattcaayttacttgaggcaaaaataaaatacttttttttaatttctaggtctccctttttaaaatggaacataatcttactttgtaagtgtttgatttttgttaaggacctttttgtctagttataatgtcttataaataattataattattcttagcttgagtgacaaaataacataaaataatttaaagtataactcatggttaagacagtgagatagtcatcaagagaaaggactctggagttaagcttcccagataagataaaagtcacagctctgtttgtggctcattgtgtgacattgaag

SEQ ID NO: 53754 - DNA, 601 bp, Human
cacaaacatcactgcaacaaacctctctgatgagttgcttctgttccctcccaataattaatactgttttttaaagctagtgggtaacacatgcaaacaatgctttggagtgtatcctgagatgaataaattatagggattagaattaccacggtgcagagaaatgtttggatagatagaggtacttggaatcggtgcttattaaatgtgcttgtttcatttgtaaagctgcattaacttaatgctaaagttgtttcttgggatgtcagataattatcttaataatttgtatttatgattmtgtgatattgctagttcaatgtgacaagcgggacaagagctaatgtaggaaaagtttgaatgtatactcctatagtgataatagatttaccataaaaagtagttaacagtgaaatgttctcaggtttatgatatttcgaggatataataatgatgtcaatgctattgtgtctgtgtgaacaattatgtcccattgaactttgaaatgttattaaagagaaaaaaaaattccttttgagaaggggtcatctttgctttctaacttaccactcaagtgtaagaagcacaatttcagaacttt

SEQ ID NO: 53755 - DNA, 601 bp, Human
ataggaagtaaggtaattaccatgccattatactgataagctgaatttcaagtgctcatagttgaacaaaaattatcttaatgataattttcagttatgttatgaaattgcatcctattttccaatttatattgtactctgtttcacaaagctaatatatttaccttcatttttcttgatggtgaaattcggattgttgaccatttctggaaggagactgtataagaaataatgtccgtttttgggatcatctttgtccatggcgctaacagtttgaatgacctgaaacataaaacttgaygtcagcatttctgatgatttcagaggctcctgccatcggtaaaagcttagtgacattctttttgtggtctgatactttggctcagagactctttttcagctttctaaattgtcatggatggtttgtgccaagaataaggagaaaaatccattactttaaaacctcagctttgataagttgatgaaaattaagagcattacctttgtgtccatttggtgtctgtggcttgaaatagcaaagttaagtgtatttgaaatatccactgggcaattacaggtttctttccaatttgagtattta

SEQ ID NO: 53756 - DNA, 601 bp, Human
cgtggtaaacattcaattaaaacttaacaactacaaagtgtaggccaattctccctcttagggatatctcagaatctcaaaatacctggaagctttcacaggggttaaattttactcttcattttttaaagtaaggtgattgaagtatttcctggggaaaaaattaactttttacattaacaaagttcttatctattgcttaaatattgaaaataggaagtaaggtaattaccatgccattatactgataagctgaatttcaagtgctcatagttgaacaaaaattatcttaatgataatkttcagttatgttatgaaattgcatcctattttccaatttatattgtactctgtttcacaaagctaatatatttaccttcatttttcttgatggtgaaattcggattgttgaccatttctggaaggagactgtataagaaataatgtccgtttttgggatcatctttgtccatggcgctaacagtttgaatgacctgaaacataaaacttgacgtcagcatttctgatgatttcagaggctcctgccatcggtaaaagcttagtgacattctttttgtggtctgatactttggctcagaga

SEQ ID NO: 53757 - DNA, 601 bp, Human
cctgcagtgagccgagatcgcgccaccgcactccagcctgggcaccagagcaagactctgtctcaaaaaaaaaaaaaaaaaaaaaaaagtgtaactggcttggcatgttcaaaccaaagcatgtataagggcacagaagacggaagagaataacggaaaataaagttaggaagatagacattcaatctcattgcctggtgtttttctgctttttaagtacatatgaagttctatatttagcatacaagactttcataagctatgtatttgctaagatactcctggcttaaaaattgggtcrttctgtcactcttaaatattccacttgccactatgtaaataactttatgctctctccagccaaatgaaaaagaacaatttttaggtactctccatttttattctttgattaggttactgtaatgatgcttatgttcaaataactacttaagttacccaaatacttctctttctctttcctcctttccctgtgctttactcatggacaatgtttgcagacatgttcaatcattggcccatcgagtaagggaaaatggaaaagcatattattaatcatctcccaaataccttatttaggttc

SEQ ID NO: 53758 - DNA, 601 bp, Human
aaaagataccatccattattaataacctcagaagacagtggggaaaacattccttgagtcatgtgtttgccttagcagttaccaccctgtcctacagagaaaagaaaagaggaaaaactttacagcaactgttaaccacccacttgctctgcccatagataagggaagccaatacctgagttattgtgaatgatttaaaatgggctaaatagaagagggataaagcagaggatgggaatttcaaaggggaagcgagaggggatttaaaaagtgtaactggcggccggacgcggtggctcaygcctgtaatcccagcactttgggaggccgaggcgggcggatcacgaggtcaggagatcgagaccatcctggctaacacggtgaaacctcgtctctactaaaaatgcaaaaaaaaaattagccgggcgtggtggcgggcgcctgtagtcccggctactcaggaggctgaggcaggagaatggcgtgaacgccggaagcggagcctgcagtgagccgagatcgcgccaccgcactccagcctgggcaccagagcaagactctgtctcaaaaaaaaaaaaaaaaaaaaaaaagtgtaactggc

SEQ ID NO: 53759 - DNA, 601 bp, Human
taaattatagtttcctctctaagatttcaaattgttataagacagagtcctgaggaaaacaaaaatatactgtatagaagggcaaaacctgtgtctatttaattcactgctttatttccaattccaattcttaagggtgtgcctggcacatgatggacaccaaataaatatgtattgaatgaatgaataagggaaaaaaagataccatccattattaataacctcagaagacagtggggaaaacattccttgagtcatgtgtttgccttagcagttaccaccctgtcctacagagaaaagmaaagaggaaaaactttacagcaactgttaaccacccacttgctctgcccatagataagggaagccaatacctgagttattgtgaatgatttaaaatgggctaaatagaagagggataaagcagaggatgggaatttcaaaggggaagcgagaggggatttaaaaagtgtaactggcggccggacgcggtggctcacgcctgtaatcccagcactttgggaggccgaggcgggcggatcacgaggtcaggagatcgagaccatcctggctaacacggtgaaacctcgtctctactaaaaat

SEQ ID NO: 53760 - DNA, 601 bp, Human
ctatcacaacatttcattgtaaattatagtttcctctctaagatttcaaattgttataagacagagtcctgaggaaaacaaaaatatactgtatagaagggcaaaacctgtgtctatttaattcactgctttatttccaattccaattcttaagggtgtgcctggcacatgatggacaccaaataaatatgtattgaatgaatgaataagggaaaaaaagataccatccattattaataacctcagaagacagtggggaaaacattccttgagtcatgtgtttgccttagcagttaccacmctgtcctacagagaaaagaaaagaggaaaaactttacagcaactgttaaccacccacttgctctgcccatagataagggaagccaatacctgagttattgtgaatgatttaaaatgggctaaatagaagagggataaagcagaggatgggaatttcaaaggggaagcgagaggggatttaaaaagtgtaactggcggccggacgcggtggctcacgcctgtaatcccagcactttgggaggccgaggcgggcggatcacgaggtcaggagatcgagaccatcctggctaacacggtgaaa

SEQ ID NO: 53761 - DNA, 601 bp, Human
tgtaaggccaggttcacaaaattgggttaaggaggaaactttgtttgtgaaagtatagaagttagactatgtgataattcccacaaaatcataatattgttcagacttgcctgcaaatttccccactctatcacaacatttcattgtaaattatagtttcctctctaagatttcaaattgttataagacagagtcctgaggaaaacaaaaatatactgtatagaagggcaaaacctgtgtctatttaattcactgctttatttccaattccaattcttaagggtgtgcctggcacatgatrgacaccaaataaatatgtattgaatgaatgaataagggaaaaaaagataccatccattattaataacctcagaagacagtggggaaaacattccttgagtcatgtgtttgccttagcagttaccaccctgtcctacagagaaaagaaaagaggaaaaactttacagcaactgttaaccacccacttgctctgcccatagataagggaagccaatacctgagttattgtgaatgatttaaaatgggctaaatagaagagggataaagcagaggatgggaatttcaaaggggaagcgagagg

SEQ ID NO: 53762 - DNA, 601 bp, Human
taaaatgttttcatgcaggccaggtgcggtggctcacgcctgtaatctcagcactttgggaggccgaggcgcatggatcacgaggtcaggagatcgagaccatcctggcgaacacagtgaaacgccgtctctaccaaaaatacaaaaaaattagccgggcgtggtggcagcgcctgtagtcccagctactcgggaggctgaggcaggagaatggcgtgaacccgggaggcggagcttgcagtgagccgagatcgtgccactgcactccaggcctgggccacagactccatataaaaaaaaraagttttcatgcgtattactgatatatattatatgtattgatatcaatatactttccagtcccattattaaacagtgtttgtgtgtgtctgtgtgtgtaaaagcctcaaataaacaccaacaaaggatgtaagcacatcaagataccaaaaaccatctcattaatttccttttggagaatcaagcaaggtcttatgatcatacggcctatgtatttacagaaaatacttcatgaaacttttgtctttaaaaaacttttttggacaatccctatttctcctttaagtaaactacattctag

SEQ ID NO: 53763 - DNA, 601 bp, Human
tgcactgataaaatgttttcatgcaggccaggtgcggtggctcacgcctgtaatctcagcactttgggaggccgaggcgcatggatcacgaggtcaggagatcgagaccatcctggcgaacacagtgaaacgccgtctctaccaaaaatacaaaaaaattagccgggcgtggtggcagcgcctgtagtcccagctactcgggaggctgaggcaggagaatggcgtgaacccgggaggcggagcttgcagtgagccgagatcgtgccactgcactccaggcctgggccacagactccatataaaaaaaaaaagttttcatgcgtattactgatatatattatatgtattgatatcaatatactttccagtcccattattaaacagtgtttgtgtgtgtctgtgtgtgtaaaagcctcaaataaacaccaacaaaggatgtaagcacatcaagataccaaaaaccatctcattaatttccttttggagaatcaagcaaggtcttatgatcatacggcctatgtatttacagaaaatacttcatgaaacttttgtctttaaaaaacttttttggacaatccctatttctcctttaagtaaacta

SEQ ID NO: 53764 - DNA, 601 bp, Human
acattgactcacaatatatgtttcaaaacatggccaaagttactttttatttctttatcttttaaactatgcactgataaaatgttttcatgcaggccaggtgcggtggctcacgcctgtaatctcagcactttgggaggccgaggcgcatggatcacgaggtcaggagatcgagaccatcctggcgaacacagtgaaacgccgtctctaccaaaaatacaaaaaaattagccgggcgtggtggcagcgcctgtagtcccagctactcgggaggctgaggcaggagaatggcgtgaacccrggaggcggagcttgcagtgagccgagatcgtgccactgcactccaggcctgggccacagactccatataaaaaaaaaaagttttcatgcgtattactgatatatattatatgtattgatatcaatatactttccagtcccattattaaacagtgtttgtgtgtgtctgtgtgtgtaaaagcctcaaataaacaccaacaaaggatgtaagcacatcaagataccaaaaaccatctcattaatttccttttggagaatcaagcaaggtcttatgatcatacggcctatgtatttacagaaa

SEQ ID NO: 53765 - DNA, 601 bp, Human
tgtaaacatgcttcctaatttataacataattcatatttctgaaaaaactatttcacaagaaattatgtttctatggaatgtaacgttagctagattattctttggggaaattatatactacattgtagaatacgtatttattttaggaagacagaaaacttataatactgttaatatagggagatagttttttcttctcctttcttccctacctactcaacatgtgaacttcttctcattacctgaacatatttccattttcttcctttgagaaaaaagatagagaattttagataattrtctcttacccattctaaaactttctttgtacaactttagcttaccaacatttaaaacaaaggcaagtttcacattgactcacaatatatgtttcaaaacatggccaaagttactttttatttctttatcttttaaactatgcactgataaaatgttttcatgcaggccaggtgcggtggctcacgcctgtaatctcagcactttgggaggccgaggcgcatggatcacgaggtcaggagatcgagaccatcctggcgaacacagtgaaacgccgtctctaccaaaaatacaaaaaaatta

SEQ ID NO: 53766 - DNA, 601 bp, Human
gaacataaaatccccagagatattcagggacatatacactggtctaggtgagggctcttgtatttctgtgtacctaactttaaatcatttaagtttcatatcatattattaaaaagtttataaacattgcttatgtggaatcacagtgctacacaattctcatttccagaaaacagtaaatatttctaaatgtttccttttcatttaatgcatttgagatactttttattttaaaagtttaataatgaatcatctgtgttctttttgtcttaatatattgtgtacatttgagtgattatgmatgatcattaaaataggataatgtagaataaatgtgaataatgagaattaaatggtagttttgcaaatttccagtattattcactagatacctttgtccaatttatttcagtgagtttcaatcattagcaagatacgggaagagcaaaaggacatccatatagaattagttacttaacttttatggttgatgtgcaatttttttcaccaaagggccactccaggccttctgactaactttccagcaagcagatttcctccatgtccacgaaaggttactttgggcgcaccattgttgttg

SEQ ID NO: 53767 - DNA, 601 bp, Human
ttgaagtccctactttgttctctatgaacataaaatccccagagatattcagggacatatacactggtctaggtgagggctcttgtatttctgtgtacctaactttaaatcatttaagtttcatatcatattattaaaaagtttataaacattgcttatgtggaatcacagtgctacacaattctcatttccagaaaacagtaaatatttctaaatgtttccttttcatttaatgcatttgagatactttttattttaaaagtttaataatgaatcatctgtgttctttttgtcttaatayattgtgtacatttgagtgattatgaatgatcattaaaataggataatgtagaataaatgtgaataatgagaattaaatggtagttttgcaaatttccagtattattcactagatacctttgtccaatttatttcagtgagtttcaatcattagcaagatacgggaagagcaaaaggacatccatatagaattagttacttaacttttatggttgatgtgcaatttttttcaccaaagggccactccaggccttctgactaactttccagcaagcagatttcctccatgtccacgaaaggt

SEQ ID NO: 53768 - DNA, 601 bp, Human
atttgttgtatattttcaaatagctagaagagcagtttttgaatgtcctcaacacaaataaataataaacctttgaagtgatatatgtgctaattaccctgatttgatcattacatggtgtacacacatatcaaaaatattagattgtaccccacaaatatgtacagttaatatgacagtttaaaatactaataaaagaataaataaaataagaaagaatgagattagagtttgggctttgggtcagaaaaggcaaagacaatgcgttgacctgttgtgatttcaggccactgggagtgayctatcccagtcgcaaatgggtcactagactaccgtgatgtatagttctaatgtcccaattgaagtccctactttgttctctatgaacataaaatccccagagatattcagggacatatacactggtctaggtgagggctcttgtatttctgtgtacctaactttaaatcatttaagtttcatatcatattattaaaaagtttataaacattgcttatgtggaatcacagtgctacacaattctcatttccagaaaacagtaaatatttctaaatgtttccttttcatttaatgcatttga

SEQ ID NO: 53769 - DNA, 601 bp, Human
gaatgtgcagagcagataagccagcatagagaaaattagagaaataggaaaaacgaaaaacaaccaaacaaaaaacaggctcatgcaacgtgcttgaggcagctggatctggttattagacaagccatttaaacactagacttttttattatttggatcaatttccctttacagtgcagatagcttgagtgggattttctgacacttctaacatataagttttataaatgtatttactctctccatttagttttctccatctgagaaaaaagctcttttgtgtgaagctacatgaaatgcrttcactcatttaacagtctctcacattctttaatcacagactccatatattgattttccctttgagcccacgtataattatttgtgtttttttatcctcataatgctgtaaattatccctggatgtatccattttaagagaagcgtaaggttgagagtggcaatagcttataaaagatgagctagctagtgatggagcacacagacagaacccaatctgtgggaaatggtttcttcgtcttgtatgcttgtctctgtccctactcactttcatcatgttgcctccgagagtcttttatgt

SEQ ID NO: 53770 - DNA, 601 bp, Human
ctaaagcttatccacagaacgttcctttgagcaatactgtgcacgagttgaatgctgacaatagctggcatctgaggagagtcctgtatggtaatctggatgatgctaacggtattcataatgctttgcaaaggctctaaaaaccttcattgaatctctgggaaaataatctctctaagtacagaaggataagcccctgagatatttcacattttaagaaatagacattcccacaactcaataagtagatcctgctgttcaacttactcttctataacaaaaaaagataatattcaatctytttttctctccttgtgaaaagtgaaatctaagccaatgtttcaagtagagttatagcattttccttttataataagtcattgaagattgaaaacaatttatctaggcatttaatagctcattaatttttagtaatcagatgcaatgggagttcatgtattaggaaaaaatagtaattttattgtattttagaatttgaaatgaaaaatatagaaatctaagaagatgtgaaactggtttcaaaagaatcccaagagatgtcacatgtggattttctgctaattactctgcattcttactt

SEQ ID NO: 53771 - DNA, 601 bp, Human
acaattttttaaacttaagcatgtgaggtttctaataatagtccatcaaccatatccctgcgtcattcttgccaacccaaatctgttctcctcactacatcctgagatctgttttaaacttgggcaaacatacatcttcaaaacacttcggtgattgtccattactctaataaacaaagtgcttaccatatttggcaggtcacatttcctctctggcttcatgcaaaccgtatcaatctagtccattaaataaagccacatttgaagatgattacacatatttgtgattgatggtagtagktggtaacttaggaaaatcacctatgataacatggaacatcctaccaatgccgattctaatacacgccgttctctttccctctctatttcctttgaaaatacaaccatttctgtgtaatacagttttccctacttaccttctgtaggtaaattccttctcatactttacatcttagctcaatcattatttactcagggggacttgaacttgtggatgagaacaaggatttttttaatacttataaatctgcataacatcacttgctccctccccttcgttttacacacacatacatacaca

SEQ ID NO: 53772 - DNA, 601 bp, Human
taagagagaggacagattttatctcaaatgatcaatgtttatttaaaaaataagatgtaattcaatagtttatcttcaaatcatatgtttgtcattggcatccaaattcctttgaaactgtactaatgcggggatcaaaatattaaatcaatcacaaatcattgggcatctgaaggaatgtttggctagatgatggctctagtttgttccattcctgaagtactctaattctacccaaatgactcttcagtgttttcttgaatatgtctcaagataaaaggatcactgcttcattgtagtmtatgccatggttaaacaaccgaaaagaattagaaagttcctcattgtattgtatggatatccttctccaaatatcattcattcaatttttgaattttgtgttctgtgaatataagtcttcagataaggtaaaagctgtcaagtgaatgaaaacaattctggtgatcttttcacaattttttaaacttaagcatgtgaggtttctaataatagtccatcaaccatatccctgcgtcattcttgccaacccaaatctgttctcctcactacatcctgagatctgttttaaacttgggcaaac

SEQ ID NO: 53773 - DNA, 601 bp, Human
tgtgtcagatatcaattcctttgtccctgacgccctaaagcacatgttaataccttctcttttttttatactttaagttctggggtacatgtgcagaacatgcaggtttgttacataggtatacacatgccatggtggtttgctgcacccatcaaccaaaagaacaaagctggaggtatcatgctacccgacttcaaactatactacaaggctacagtaacaaaaatagcatgatactggcacatgttaatgccttctaatgaccctctttgagttctcttactggtaaaataattgtagraagccatattctcataccctcccctgctaatcttaagcacctttaaagcagtccttattactggcttctttatcttcgaccacttttcataaggagctgtgacttacaaactgatgttcattgacttagttctgaacttttgaaatacttacatagacaatgtcatgacctggaacttggagtctgatggtcatcaacagtgctgttcagcaagtgtatctgactcaccttctaaggaaacagttggactgtacccttagccccttctaagttagaattgtgtggttatcttatttgctt

SEQ ID NO: 53774 - DNA, 601 bp, Human
aggctgtgccctgatcaacttgagcacatgttctcagaatctcctgagggctgtgtcacgggtcattggtcatgaccaatgtttggctcagaataagtctcttcaaatattttacagagtttgactcttcatcaacactactgatgaaactgcaacttcctctcaacactattaactgtttgctctaccacagaatagagaccaggttagccacttgcttttcgttttccttttgtgtcagatatcaattcctttgtccctgacgccctaaagcacatgttaataccttctcttttttttctactttaagttctggggtacatgtgcagaacatgcaggtttgttacataggtatacacatgccatggtggtttgctgcacccatcaaccaaaagaacaaagctggaggtatcatgctacccgacttcaaactatactacaaggctacagtaacaaaaatagcatgatactggcacatgttaatgccttctaatgaccctctttgagttctcttactggtaaaataattgtaggaagccatattctcataccctcccctgctaatcttaagcacctttaaagcagtccttattactggctt

SEQ ID NO: 53775 - DNA, 601 bp, Human
gattgaagtctcatgtctctctaaaatgtataaaactaggctgtgccctgatcaacttgagcacatgttctcagaatctcctgagggctgtgtcacgggtcattggtcatgaccaatgtttggctcagaataagtctcttcaaatattttacagagtttgactcttcatcaacactactgatgaaactgcaacttcctctcaacactattaactgtttgctctaccacagaatagagaccaggttagccacttgcttttcgttttccttttgtgtcagatatcaattcctttgtccctgamgccctaaagcacatgttaataccttctcttttttttatactttaagttctggggtacatgtgcagaacatgcaggtttgttacataggtatacacatgccatggtggtttgctgcacccatcaaccaaaagaacaaagctggaggtatcatgctacccgacttcaaactatactacaaggctacagtaacaaaaatagcatgatactggcacatgttaatgccttctaatgaccctctttgagttctcttactggtaaaataattgtaggaagccatattctcataccctcccctgctaa

SEQ ID NO: 53776 - DNA, 601 bp, Human
ttactctaaatcaactaaataagaatttctggggatgggccctgggtatctgcatttcaaacaaatgttgttggcgtaaagatcttctgggatgcctgatagccctttcaccgtattccatttcttcccttaggtgttagcagtggttaatggcttggatcaagccgtcagaggctccactggggaagctattatgctctggattgtgtggtccagccagggtaccagctgatagcaattttcctgcataattcctactttcctggtttagtggtaaaatagctgctaaaaaaaaaaaaaaggaaatgatgcaaggaaatgtggtatcctacagtgagctaaagtccagtgtttgtccttgaatcattttaaagtttaatatgtgatattaaaacagcctgtctaaacatatatctttgggcagaagtcttaatacacagtgaaggcaagagaatggaaggcagttatgtagataaaattatcattcaagcagtggacacattatcattcctcccaggttgctgagaacggcatgtgcttttgaatcttaaaatccacattcttcctaatattggaaatagtactgttttgatcacacaag

SEQ ID NO: 53777 - DNA, 601 bp, Human
tcttactcaaaatgctccacgcaccttttgcagatcccttaatgctcagaggaaaggcaggtttattccacctcaggcattggggaatgagggatgaagactaatattactttcattttatctgaggaatgcttgcattaactaacccactaaagtgaaaactattccaataaacaatttctattgtgtttgaatgaaaattttaaagcttttataaatatcaacagatctagaaagaatattttatctatttggatttatgaagaagggtaaaaaatgcattttgtcagcacataaaccwcttaggaaaaaaaaaaaacaaacacacaccaaggcctttagtggaatttcttgtgacaatttgagaaaacaacctaatagcaggtaaatatccagacattagaaagcttgcattatcagaagagcaaattccctaccatgtctctatgaattgaataggtgcctctaaatatttaagaaactggaaaaagacagattaattcattttgtacttgagcttataaatgtgtgctcattaacacatttgatataaagagtagttgagccaaagagtaaaattgttttaaagcactagtttaag

SEQ ID NO: 53778 - DNA, 601 bp, Human
ctggaggctaaaaattacaacctagttcagtgtattttctacactctgcctttgtcaccttaacaaaaattacctcaaaaaacaagggaacatagactctaagacatttttattaaagctcaaggataagagaaaaacatatatggagggaagtttttccatgttatgacacctttattagagacaacaaaaagcgaagtggacaaggcaactggtggacaagagtatagtatttgattaaaaatatatccaacactatactctatagatctaaattccatactttgagcctcaacgtaayggagcatagcataccataacacagcagagcagagcataaccatgaattaattatgaaaaagttatcatttttggtatgagagaggaatgcaagtatcacagaatccaagttgcatgctagattcaatcacagtgcccaaggtctggtgtgtttgatgatttttttctctgctcttaattagtatgcttgctcttactcaaaatgctccacgcaccttttgcagatcccttaatgctcagaggaaaggcaggtttattccacctcaggcattggggaatgagggatgaagactaatattac

SEQ ID NO: 53779 - DNA, 601 bp, Human
atacaagagagaaatttttctagaagtaaaaaatatatgaaaaaagagaggaaatgatcactgaatccatagttacatactacattattttaaaaaaagaaatctcttgaagttgagggtaaaacaacagtttccaaaagatagaaggatatgctgacaagatcaatttaagaaatgggccgatcagtatcaattgcaattctctagtggatagaaaatacttaaaaaaataaagaataacaatataataattaaaacaatgcaaattaaaaatacaatcaactatatctatatatagtarctatattgcattaggtattataagtaatctagaggtggttagacgtatatggtaggatgtacatagagtatgtgtaaatactatgccattttatgtaagagactttgtgcacccatggattttgatatccacaggaaccaatccccagtctataccaataagcaaatgtattcatattccccatcatttctcccagttagggattttcctgtttcctcattcttttgtaatgctttacagataaataatataccaagaaaaaagaaaaactcaattttcaggagcttgctttattcttca

SEQ ID NO: 53780 - DNA, 601 bp, Human
actaatgagaacttctaatacaattttgagtacaagaagttatagtaggcacctttactttgtttctgatttttttaaaaaagaaaaagccttttgactttcaacaattgggaagaggatcaatggtgtttcttggaagattttttaattgtctgtttacatgcactcttttttttttttactttagttttactttagtttttttttttttttttggttaatttgtttgtttgttttatttgctgtcaatagtgtaaaaggaaagaacagtcatataagtgatagtatcttggctgttcaytacctctaaacttggcttcaattttactcatacgttattcaacaatcttcttttcagtctttcatgttttcattgtgtatcatcttcttgtctctgaatcttagcctgccctctccccttatagcttccgcttattgtttttattgcatttgttttatctttttgagcagagtaaacagagagtgtgtcctaataatgagatgttagatacaagagagaaatttttctagaagtaaaaaatatatgaaaaaagagaggaaatgatcactgaatccatagttacatactacattattttaa

SEQ ID NO: 53781 - DNA, 601 bp, Human
acagctagacatggtcaggggaaaaggcaatcaaggagagccctgcccaaacaattgtaattctaaagtgactgtggacatacccatgcttgagattccctgaagtgaaacatcatgggtttaataccacagagggggaaatagacttcactaaaacaacccagccagtcattaaacaaataagcaaataaaataagccttcagaggacagttcccagttttgctatattatctaaaatgcctagtttccaacagaagattatgagacatgcaaagaatgaagaaaatatgacccacagcrgaaaaacagctggcaaaaagaaaaagcccatgagagggacaataaaaaattaactagagtgactaaacagtagacttgaattggcaaaagaaatgattagtgaactcaaagatagaacaataaagagtacacaaactaaagaatagagagaaaaaaagaataaagagaaataagcagagcctcaaaaaaatgtataacaccattaagtgcaccaacaaatgtgcagtgagtgtactaggggaagagaaggagaaagaaacagaaaaaatatcattgaaaacctgaattaaaaaaaatagt

SEQ ID NO: 53782 - DNA, 601 bp, Human
tgacctaggaaactattctttcaaaggagatcaaatttgaatggactggtctgtagagtaatttaggttccaaggcagccttacaaacaatacagaaatcctgttggaaattagtggaattcaacagctagacatggtcaggggaaaaggcaatcaaggagagccctgcccaaacaattgtaattctaaagtgactgtggacatacccatgcttgagattccctgaagtgaaacatcatgggtttaataccacagagggggaaatagacttcactaaaacaacccagccagtcattaaacwaataagcaaataaaataagccttcagaggacagttcccagttttgctatattatctaaaatgcctagtttccaacagaagattatgagacatgcaaagaatgaagaaaatatgacccacagcagaaaaacagctggcaaaaagaaaaagcccatgagagggacaataaaaaattaactagagtgactaaacagtagacttgaattggcaaaagaaatgattagtgaactcaaagatagaacaataaagagtacacaaactaaagaatagagagaaaaaaagaataaagagaaataagcag

SEQ ID NO: 53783 - DNA, 601 bp, Human
ctgacctaggaaactattctttcaaaggagatcaaatttgaatggactggtctgtagagtaatttaggttccaaggcagccttacaaacaatacagaaatcctgttggaaattagtggaattcaacagctagacatggtcaggggaaaaggcaatcaaggagagccctgcccaaacaattgtaattctaaagtgactgtggacatacccatgcttgagattccctgaagtgaaacatcatgggtttaataccacagagggggaaatagacttcactaaaacaacccagccagtcattaaamaaataagcaaataaaataagccttcagaggacagttcccagttttgctatattatctaaaatgcctagtttccaacagaagattatgagacatgcaaagaatgaagaaaatatgacccacagcagaaaaacagctggcaaaaagaaaaagcccatgagagggacaataaaaaattaactagagtgactaaacagtagacttgaattggcaaaagaaatgattagtgaactcaaagatagaacaataaagagtacacaaactaaagaatagagagaaaaaaagaataaagagaaataagca

SEQ ID NO: 53784 - DNA, 601 bp, Human
attgtctttttgtggttgacatttctatgagaaacaatctttccatattctccttttgtaacagactattataataatttagaaactgcagcaggaatattgcttgctgcagaacaaagctatcttctttactactgagaaaagcattggtgggtctaacactaaattcatacttctataaatatttttttactaatcctggaatttgcctatcttgctctcctttctacacgcagaagactgttgactgagtaaagaaaatctatgagttattcttgctaaattttacctgccagttccrggcaacatcaattccttttttacctactcatctatttttgtttttgtttttgtttctatttttggattggtaattgtatttgttttcaatttacttgagttctttcattaggctgaatgaaattgccattattttacacatcaaaaaccatagaatattagcagtttcacaaagctctaattactgttcttggaataattttttatatcttaaatgttgtaaatatcttctacaaagttgtggtttctgctgtaacactcatgatgccttttcatttcatttaaatttttgaatttaata

SEQ ID NO: 53785 - DNA, 601 bp, Human
ttcttctggttgtacatcattatatagtaatttgaatatactgagaaaaagagatttctaatggagttaagcagttatataccaaatgatccagtaatctttattgtcatgacctagatggaaataccagtaagctaaaagcaaggaacattatctcaaaacagatatagaatatatagttgtgttatattttcagaaagtatgtgacaagtttgagtacagctaattagtacaaagaacatttctggatggttttatacatgatagttcaaaacaaaagatagaatttgttcttcaaggracaattaataaaactgaaatgaggctattgtctttttgtggttgacatttctatgagaaacaatctttccatattctccttttgtaacagactattataataatttagaaactgcagcaggaatattgcttgctgcagaacaaagctatcttctttactactgagaaaagcattggtgggtctaacactaaattcatacttctataaatatttttttactaatcctggaatttgcctatcttgctctcctttctacacgcagaagactgttgactgagtaaagaaaatctatgagttatt

SEQ ID NO: 53786 - DNA, 601 bp, Human
caaagtaaaactggtcagtgagaagtgattggtcccacattagatacacagttctcaaactttcacccccaagttgaaatattttgttgtcattcatcctcatctcatgaattgcagtcacattgtatataataattgctaacctgctttctcatgttgattactgaaagatatacatttactcaaaatggaaatgctgattaactctcactgatattacagccaaaagcaaataaacacaattttggttactaagtgcctagtgttatttgggcaaaataattatttgttttttttttttcaaatattggccaattatagacccccgaacacagggctacctaatcattgcatgtaatagtaatgattccaaaccattgccatccaatttctgatcatcagtatcctattggtttccaaaatacttaactaagtgagatatcccattcagatgacttcaaataagttttggaaaactactgtaccatatagcactatactaggatttccaaaaattgatagccattctccaaaatggatatatagttatatttaattttgctttgtttaagatataaacaggcctataatgcttttctaa

SEQ ID NO: 53787 - DNA, 601 bp, Human
gtcacccaggctggagtgcagtggcgctatctcggctcactgcaagcttcgcctcccgggttcacgccattctcctgcctcagcctcccgagcagctgggactacaggtgccagccaccacaccgggctaattttttgtatttttagtagagacggagtttcaccgtgttagccaggatggtctccatctgctgacctcgtgatccacccgcctaggcctcccaaagtgctgggggtacaggcgtgagccactgcgcccggcctgcgctttttcaatcagcatggaccaggacaaccatawcaggttgaatgaatgggaccccctgacggaccaacggagttttaccgtcatcaccttaaaaatgcaaaatatttcttttacaaaaataatctttaagtgtcccttccgaagacatatattatctcatctccatataccatatataagctttattttctttatttagcctgataataggttaagcaaatttgattgaataaaatgtcatcatatttgaaacacatgtttgagaagctctgtattaaaagatagactgtatgacaacacagttgcaaaacaatgcactttgttgattcccac

SEQ ID NO: 53788 - DNA, 601 bp, Human
gtctcgctgtgtcacccaggctggagtgcagtggcgctatctcggctcactgcaagcttcgcctcccgggttcacgccattctcctgcctcagcctcccgagcagctgggactacaggtgccagccaccacaccgggctaattttttgtatttttagtagagacggagtttcaccgtgttagccaggatggtctccatctgctgacctcgtgatccacccgcctaggcctcccaaagtgctgggggtacaggcgtgagccactgcgcccggcctgcgctttttcaatcagcatggaccagsacaaccataacaggttgaatgaatgggaccccctgacggaccaacggagttttaccgtcatcaccttaaaaatgcaaaatatttcttttacaaaaataatctttaagtgtcccttccgaagacatatattatctcatctccatataccatatataagctttattttctttatttagcctgataataggttaagcaaatttgattgaataaaatgtcatcatatttgaaacacatgtttgagaagctctgtattaaaagatagactgtatgacaacacagttgcaaaacaatgcactttgt

SEQ ID NO: 53789 - DNA, 601 bp, Human
tttttttttttttttttgagacggagtctcgctgtgtcacccaggctggagtgcagtggcgctatctcggctcactgcaagcttcgcctcccgggttcacgccattctcctgcctcagcctcccgagcagctgggactacaggtgccagccaccacaccgggctaattttttgtatttttagtagagacggagtttcaccgtgttagccaggatggtctccatctgctgacctcgtgatccacccgcctaggcctcccaaagtgctgggggtacaggcgtgagccactgcgcccggcctgygctttttcaatcagcatggaccaggacaaccataacaggttgaatgaatgggaccccctgacggaccaacggagttttaccgtcatcaccttaaaaatgcaaaatatttcttttacaaaaataatctttaagtgtcccttccgaagacatatattatctcatctccatataccatatataagctttattttctttatttagcctgataataggttaagcaaatttgattgaataaaatgtcatcatatttgaaacacatgtttgagaagctctgtattaaaagatagactgtatgacaac

SEQ ID NO: 53790 - DNA, 601 bp, Human
ccctgattgtcaaggtgctagtgctgctcagtggaggatttccactatcactgattatgattggtaaaagatagacttcttgcttctggcggttgaatccattatgctttgccaaaatactgagggaattatctgaaaaaagtaaaaattacaataatttgcatcatttcaaaatgactctccaaataacacttgtttttctagttcatgaaccctttgcaaacctcaagacaatcccgacttcaaaggactgctcaggctttttccctgactcgtctccgcactttttttttttttttttgagacggagtctcgctgtgtcacccaggctggagtgcagtggcgctatctcggctcactgcaagcttcgcctcccgggttcacgccattctcctgcctcagcctcccgagcagctgggactacaggtgccagccaccacaccgggctaattttttgtatttttagtagagacggagtttcaccgtgttagccaggatggtctccatctgctgacctcgtgatccacccgcctaggcctcccaaagtgctgggggtacaggcgtgagccactgcgcccggcctgcgctttttcaatcagca

SEQ ID NO: 53791 - DNA, 601 bp, Human
tcttgtgggagggctggaatgcctctagctgggaagagaaacctgaatgtgagaaaagggcaaggaaaacatacccaactagtcagatgggccaaatcaaatgtgggctaatggagcaaaatatgtcatcaaagtgatgcttaaatccaagacactgggtgagaaagacagatggaacaagaaagacagtaactgataccgtctttatggtgttttgttcctcaagggtagtataagatacgactctcatgtttttctattttcctactgtataatcgcattgttataattggactttttwaattaaaaggttatagaatcttaatttgcaatcatcattttaaattgatgtttatatgaaggaaaatatcagagaaatgcaatggtattttgaagaaaacttatttttagtttgctcatttgctttctttttatatcaccaaatttgggatccgatggactcagcaacccaaactacaatgaaacactattgtggacatagtagagcctgctgttgcagtgaactggtgtgcctcacacccagagttcttcttatgcactagatggtgttgtaacgacgtaaaagcccttctccactgcc

SEQ ID NO: 53792 - DNA, 601 bp, Human
catttgaatcctgagaaagacgcgctcaaagaacccagcgaacaaaggagagggttggagcccacgcaaaacatgggtgtgataaagccacacgcgacctgagcccccaccctcagtaactactctccagcgcccaccgggaggaggggtccggggaaagggtaagccgaggaaggagaagacgctccggccagaccgaacgcagggtaggggaggcgagcaggcgaggaggagggaaggggacgggaggggcggagctctcgcggccgcggggctttgtgtagagtcaaggccgggatasaaattttgcctcgcgggggacgggtcgagggggtaggaggccgacgcggggcaccccaaacctgcgttgccacgaatggtgggcgggagaagggagagaatgggccgcccccttcgccgccgccaccaccaaggcggggtaggccggcgccgtccccagcggcggccaccttcgaggctgcggactgcacggccgaagggggagaggcaggagacaagacgggcgggccccctgattcccgcccgcaggaaccgcgggggctgcgccaggaagagggtctcgttctaactgtgccgggcc

SEQ ID NO: 53793 - DNA, 601 bp, Human
cagggacttaggtaataggagaaagcatctctgatgaggtaaaatttgaaagaaaagagaggcaaaagatttctggggaaagagaagtataggaaaatttcagtcttatttagtcatgttttattgtgcaattagtattactggtatttatgaactgctgctataattaatttagcacttatttgcctccaaagaaattattacctatttcacggataataaagatttataccacagctaagaacccatgtagttgtattaaaggttattcagcaaaagactttggtactactcataaatrcaagtctaagaaaatctgacaatcgttggctgccaagtagaatttctataatttgctgaagaaggagtacgttgggaggtatcatcttggtaacttttttttttgagacggagtttcgctcttgttgcccatggcactatcttggctcactgcaacctgcacctcctgggttcaagccattctcctgcctcagcctcccgagtaactgggactactggtgcctgccaccacgcctggctaatttttgtatttttagtagagacggggtttcgccatgttggccaggctcttctcaaactc

SEQ ID NO: 53794 - DNA, 601 bp, Human
ccaggctggagtgcggtgatgtgatcttggctcactgcaacctccacctctggggttcaagcaattctcctgcctcagcctcccaagtagctgggattacaagcgcccaccaccatacccggctaatttttgtatttttagtagtgacggggtatctccatatttgccaggcttgtctcaaactcctgacctcagatgatctgcccgcctcagcctcccaaagtgctgggattacagatgtgagccactgtgcccagcccactttttcataaagtataaaaaggctaagaagttttaagascctacaatttttattcatcatttaaatggtcagtaatgtattaataatttgggcattttaaatgttactgatttgcatcaaaatacagattatccctaatccaaaaatttgatatccaaaatgttccaaaatctgaactgttttgagcaccaacttaatagtcaaggaaatgctaactggagcatgtcaaatttttgattttcgaattagggatgctaactggtaaataattacaaatattgcaaaacctccccaaatctgaaatacttctggtcccaagaattcagataaaggatattc

SEQ ID NO: 53795 - DNA, 601 bp, Human
acataggttatatgcaaatactataccagtttattgaaggaacttaaacacccatgaattttgctatctgtggaagtcttggaactaattccccacagggtcaggacagtcaagctattttaatggtttgaagtctatcatttcaacacgggtttatatattacaataaaagctagaataaaaaatgcgatttatccactaaatctttcaaagtcctccctaaatacaccttttgtttgtttaatggaaacaaccccaaaaacttttttgtcctctctcctacatatttgataacagtacrggataaacaatcagcttttacaaaatccatgcttctaataacataaatacttgattttgttggtatcacacctctaattttagttaacttcattttcagcacagctctcttctgaaaacaattcatatacaaagtcttttaaagggaaagccacctttttaatgcaggtgccaacaaggctaagaaacaatatagagtttagcaaagcagggccatggccctttgcaacattcctctgcaattataattaagaggctatgattgcagaaaataaactacctattaagaaagaatctacca

SEQ ID NO: 53796 - DNA, 601 bp, Human
aaataattcacatattcacatatattgcctagcattaattgttttaaatatttcttttctccccaaatagctaattgtcgtgtctgtatttgtttatacatatcctcatctttatctacaaaaacattaaggcagctgttgcacttgtgttatctgtactatgcttggccacactaacacagtattccatatgtattatatgccctgcaaatatttgtgggattaattttatgtgttattattttgtaacagtcccaggtcaactcttttcagcagcacaggcagattaacaattattgtaaaaaaaaaaaaaaaaaaaaaaatacttaatatgctacactgagttgttgctatactgagttgttctccagaaccatgaaagcctagggtagggggaacttttttaaatggttaaaggaaaaggaaaaagagggtatagctctcattcttattcatctcctaagaataaacgaaaaaagaagtttgttttcttccagatcttttcatctgctaaatgccctcaaaaggggaataatagacaaagtttcacagtagctaaaaaaaaataaaaaagatcagtgctgaatatgtattaaaagga

SEQ ID NO: 53797 - DNA, 601 bp, Human
aatcaaagtgtaatcttgtttttgtttttttgaagcgagggagtaagggagtgaggtctccctaccaatatgtattaacccaaagttatcaggggagcaaactaggagtagaagaatacccaaacagcagttttgcaaaccaataagcttcagataggtttacttttttcttaagtagctttagtagtgttaaaatgacttttcaaatcagtaaataactgtaacatattagaccaacaggaaaaatattcagatttagatcattctaagctcctaaaaatactaatttacatttatcaawgcaaaactactttttacttagaaacgtacatctctgcatctgcttactatactcagacatgttatctggtcttattgaccgtagaaatttgatatactcatcactgtgatattttgtcatttcttcggcagtggctttatggggcctctgtgaagagaaataaatgtcagaactgtggaattacaaccggttatatcagtattatcaaacaaatatacaaattcccctatcggtcccctcaaaagaaccaagtctaccagaacaaaatatataaattccaaaactaacccaaacttatat

SEQ ID NO: 53798 - DNA, 601 bp, Human
agaaacaagatagaccttttaaacatttatcataaaaaagtagtagaatgagacaaaaacactacaagtgtatgccatgcataagcaagagcttaaaatcatgaaagttaacagaaatcatctataacacaaataggagttactccttagaaaaatattctcctagagctgcaacctgagattaaataatggtttatgtggaaagtggtagtaacaatgatacctagaagacaaagggaatgaatgaagtctccaagtgaaaataagtttaaaaagcgtttaagtcataatcataaaacayagaggtttgaaagtaaattgtactttactataaacatactgatttccttttgttatcaaaattcacaatcattaaaacttctgttttacacaaataacccgaaagataacacaccaagttcagatcaacttttaaatctgattgcattagcacttaccaactgaaccgccagttgagagctgacaaaactcaaagagtccatcaaacactggacaatcttctccaacattaactgtggaagatggatttcattaatttcaacacattctgcaaattaatgaaagccttttcttacaaaaa

SEQ ID NO: 53799 - DNA, 601 bp, Human
gggtttcaccatgttggtcaggctggtctcaaacccctgacctcataatccacccacctcgtcctcccaaagtgctgggattacaggcatgagccacggcactggccttttatacacttctaattctttttttaaggcagggtctcacactgttgcccaggctagagtgtagtggcaggaacatggcttcctgcagactcaacttcctgggctcaggtactcccacctcagcctcctgggtagttgggactacagatgcatgccaccacatctggctaattttttttctgtagagatgggrttttgccatgttgcctagcctggtctcaaactcctgggctcaagagatccgcccacctcagcctcccaaagtggagggattacaggcctgggccatagtgcctggccacacttctaagtcttaataattgaagaattgggcaaatttcctgcatttcttcattgttttgtaatgaattcatagaaaattcaccattaactatttcaacctatggtttacctaatattttttaaagccatagactttatttattgtgttttaatgaaaacactttatcactgaaaagagtatcaatataaa

SEQ ID NO: 53800 - DNA, 601 bp, Human
tgggattacaggcgcacgccaccacgcccggctaatttttctatttttagtaggatggggtttcaccatgttggtcaggctggtctcaaacccctgacctcataatccacccacctcgtcctcccaaagtgctgggattacaggcatgagccacggcactggccttttatacacttctaattctttttttaaggcagggtctcacactgttgcccaggctagagtgtagtggcaggaacatggcttcctgcagactcaacttcctgggctcaggtactcccacctcagcctcctgggtagytgggactacagatgcatgccaccacatctggctaattttttttctgtagagatggggttttgccatgttgcctagcctggtctcaaactcctgggctcaagagatccgcccacctcagcctcccaaagtggagggattacaggcctgggccatagtgcctggccacacttctaagtcttaataattgaagaattgggcaaatttcctgcatttcttcattgttttgtaatgaattcatagaaaattcaccattaactatttcaacctatggtttacctaatattttttaaagccatagac

SEQ ID NO: 53801 - DNA, 601 bp, Human
caacagtcaattaaaaaacaaggcaaatgattgcaaatgattttcctttgctcctgatgagcaggcaagatgttacactgatactgctcaatcactgtttatttgaggagtcagtatcaattttaagttgactgaaaagtcagcctctatggatagcatgcatggaataactacaagcaaaaaacactagctcagtataatacaaagtagaatctgctaagatgtgtcataactgatggcaaaaaataactaacattgcgaacatccaaattcctaagtacctctatagatctctctctcmaactgcagccacagataaggaaaaataactccttcaacaactcagagataattttatatccatcagtagagaacaaagcctcattcagatatggaagttaggcagttagactaactcaataggtaaaaaaatttcctttaacactggcttcaaatttttgtcttcagtttaaaacatccaaaatactagaatataaacttccaaggtcattgtcattttttactagttgaaactaactaaaatgaaaattgccaaactacttttaaaaaagggtatttaatgggagttttgacatttata

SEQ ID NO: 53802 - DNA, 601 bp, Human
tgggcaagaacttgctcaaagagttgaagacactggaaccaacatcaacagtcaattaaaaaacaaggcaaatgattgcaaatgattttcctttgctcctgatgagcaggcaagatgttacactgatactgctcaatcactgtttatttgaggagtcagtatcaattttaagttgactgaaaagtcagcctctatggatagcatgcatggaataactacaagcaaaaaacactagctcagtataatacaaagtagaatctgctaagatgtgtcataactgatggcaaaaaataactaacaytgcgaacatccaaattcctaagtacctctatagatctctctctcaaactgcagccacagataaggaaaaataactccttcaacaactcagagataattttatatccatcagtagagaacaaagcctcattcagatatggaagttaggcagttagactaactcaataggtaaaaaaatttcctttaacactggcttcaaatttttgtcttcagtttaaaacatccaaaatactagaatataaacttccaaggtcattgtcattttttactagttgaaactaactaaaatgaaaattgccaa

SEQ ID NO: 53803 - DNA, 601 bp, Human
gtcactgtgttagccaggatggtctcgatctcctgacctcgtgatcctcccacctcggcctcccaaagtgctgggattacaggcgtgagacaccgcgcccggcccagcgattgtaaaatcttaagtgagaaaaagagatgttgaaagccattctcaaatccttctaaaacagcattctctaatattttcaaaaacttcaaactgtaagaattttgaataataactgagatgagaccatagtgacatccacctgtcagaaattaaatgaagcttccattttccacttctgagataaactagsatcacactgcaaagatactgtcttattctttaagcttaaaacagagaagacttttgcttgacttccactaggatgtaatggttgttgacaaatgtattctatcagtttacagcagtggttctcaaactttaaggtgaagaatcacccagagtttctgggccctaagaatgtgtatttctaacaagttcccaggtgatgctgatctgctttcctcagtttaggcgccactgtttgagaagcactggtctgtaagataagaccaggtggggaaagggagaaattgaaggagtttactggcaa

SEQ ID NO: 53804 - DNA, 601 bp, Human
tttcaacaatgagctaaactcagagtagccttcttttcagcatgagaatgaattagcaggcagaaaaaggagtgtttattaaattaacatccaaagatacacgtgaattacacagaaagtccaaaaacagctgtacatataatgtaatgactgattttaattctcttacgaagttatggggacatgcttaaaatattcaaatgttatcctgaaaacatcagcaactgtaaaatctttttttttttttttttggctgagtcttgctgtgtcgcccaggctggagtgcagtggagcgatctcrgctcacagcaagctccgcctcccgggttcacgccattctcctgcctcagcctccccagtagctgggactacaagcgcccaccaccacgcccggctaattttttgtatttttagtggagacggggtgtcactgtgttagccaggatggtctcgatctcctgacctcgtgatcctcccacctcggcctcccaaagtgctgggattacaggcgtgagacaccgcgcccggcccagcgattgtaaaatcttaagtgagaaaaagagatgttgaaagccattctcaaatccttctaaaacagcat

SEQ ID NO: 53805 - DNA, 601 bp, Human
tggaaaataaattaagccaaaaagccctgccggacaatcatctgcagaatccttcttgtggttcacaatctgttggtatgagtttacttatgatgaaagaacgacccacactttctcgaagatttaacagctaccgactaaagcaccagatttgttctttttttttttttgagacagagttttgctcgttgcccaggctggaggcgcaatggcgtgatctcagctcactgcaacctccgcctcccaggttcaagcaattctcctgcctcagcctaccgagtggctgggattacaggcatgygccaccatgccaggctaattttgtatctttagtagagacagggtttcctccatgttcaacaggctggtctcaaactcccaacctaggtgatccacccacctcggccccccaaggtgctgggattacaggcgtgagctatggtgcccagcctcagatttgttcttaattggacttggacttcaaacaaattttgttcctacttgttgaatgagtaccactccaggcattaatctctctcaaaagacgcaaaggttccagctacatatactcttaaatgatatatacatatattatatatac

SEQ ID NO: 53806 - DNA, 601 bp, Human
ttgtggtacagaggtgactcaaacccatgctatgtactataatgtctctactttgcttgtggagacaaagccttaacaaaatgttccagacaatgaaaataacttatagtgcaccttgcaattttaaaatacatttcaactaataaaaaaaattatttccattaactgaagaaattaaatggctgaatacggtggctcatgcctgtaagctcagcacttctgagaggcagaggtgacaggatcacttgaagccaggagttcgagaccagcctgggcaaccaagcaatatcccatcctgacaaaaaaattaaaaattaaaaaaaaaaaaaagaataatcagtaacttaatgtttcaaatcctttagaaaaaaacaaaatatctaataaagttaaaaagacccatcatacttggccctttaaagcatactaaatctttgtcaagataaaatgtttatcaaaacaattcaatgatttcttactttatcttttccatatattctggagtgttctggtttgtcatgtttgaaggactaatatgcagtttgaagtctggtccaaaatactcaaagtaatcattatatggcaactctaatgaaaacaa

SEQ ID NO: 53807 - DNA, 601 bp, Human
cttgtctggatcttctccatcttcatctccactgtcttcatgaacagcatcttctggaatagcttgcatctggacaccaggtgcatgaggtaacatgcgcaaattttcaaacaaacgctgtctaaattacacatgcaaagtttattagacaaaattaaatttctttgcagttcttacatgcaagagaaaatatttagcaaaaaatttcatctttggtctagctaaacctatatattaaaaggtctctctttgttgcccagactagagtgcagtggcaagatcatagctcactgcagcctcraactcctggcaatcctcctgcctcagcctctgcgcgttaggactacaagtgtatgccaccatgcccggctaatttttaaattttttgcagacaaggtctcactatatggcccaggctggtcacaaactactggtctaaagctatcctcccacctcggacttccaaagcattaggattacaagcataagccaccttgactggccaaggaggcattattttagcctgccatttcaatgatgagaaaacataagcacaaaggcaagtgaacttatcaaacatcatacagcttgtttgtggtac

SEQ ID NO: 53808 - DNA, 601 bp, Human
taccacatgctgtgctaaacatgagggccatttaaatacatcctgtcctctctaagctgacataattagaaatggatgcactctgttaaaaaaaaatcctgtgattaacaacctgtagtaatactctttgagtctttattcactaaagaagtttgggcctctttcaatgttcggatttctctacagtatgaaatgtcagaaatgggcaggtcttgtgaagatatggcctaactctggataacttgagacccaatatgtagtgagctataaagaaaaccatctagcagaataaaatcaggcrctgacatgatatgactaacagacatttctagggtaccataaatatgtatgatcatacatacatgccttattctcccttaaaaaggaattgatgaaggtctgattggatttcacaaatatccactgaggctagtgtgagaagtggccatgtatttcagaatcagtaagctaaaacatagaggtacaagaaagaactccttggaacagatgatcaagtatagctgaggtatctcttgccatgagtaaccctatttaaatcaagattgggaggcggtgctgtggagccctttttttctagagg

SEQ ID NO: 53809 - DNA, 601 bp, Human
aggcaggagaatggcgtgaacccgggaggcggagcttgcagtgagccgagatcgtgccactgcactccagcctgggtgacagagggagactctgtctcaaaaaaaaaaaaaaaaatttactagtacgggcttgtaactttagttaaacagacgtacaacagatggaaataatggaggattattgttatttagagcctaaatacacctgaaaactgcttaatactgacagactggagtggaggcctgcctctgcacagtgtcagtggttattgctaatgatatttatgaggtgtttgaaatyatgtccttcacgtagtttcttttgctcacacacacctgttttcctttgccctagatgtgtccatatgactgtgtcagtgtgatcttgtagaaaagaactctgggctttagttcccgtctcccctgaatggtgttcttcccttaggctggcagtttgacatttctggggctcagtttcctgtctgtcgaaggagggtgatagatggtacctgccttgtatatttcatggagttaagatgctcaaataagaaagcatcttaaaataacagtgcttaaaataacatagactgctactatttgt

SEQ ID NO: 53810 - DNA, 601 bp, Human
tgggtgggaactgcagaaccaccatcgtcatttgctgttctccttctgtcttcaatgaggctgagaccaagtccacactgatgttcggacagaggtacgtgtggtctctcaggacccatcctctgtgctaggtcttgggtcttaagagtgaatggcaaggctgggtgcaatggctcacacctgtaatcccagcactttgggaggccaaggcgggtggattgcctgaggtcaggagtttgagaccagcctggcccacatggtgaaaccctgtctctactaaaaatacaaaaattagccggcygtggtggcatgcgcctgtggtcccagctacttgggaggctgagtcaggagaattgcttgaactcaggaggtggaggttgcagtgagccaagatcataccactgcactccagcctgggcgacagagcgagactgtctcaaaaaaaaaaaaaaagaatagtgagtggcaaggggctattgtcagagaatcacaaagtaagggacaaacagccttttactaaattacatctagcaggtgatatgtaaacttgaggcatcacttattgaagccaaagcaataattatattttaaaataatgggc

SEQ ID NO: 53811 - DNA, 601 bp, Human
atattaacaaaggaggaaactgatttttttttctttttttcctctgaaatcagttaaagctaattaagggaaagtgaattttgaatgtccaaatagaaagaagctagtgatcattaggctccttcattctctaaatttgccaaagttgatggtaaaaagaaaaagaaattgtagatattctatatccttttactcttagtctcttgggagaatgagagactgagaccctctttatttcactttgcaagattgtttttaacatcctagataggagaatgtttgttctagtaaaaaaaaaaacaaaaaaaaaaaaaacaataaacctcagggcacaaaaattcagtatctctcttagtaaccctagtttattctgcatctggaaattcttgtatctgacttgatttctttctccatcagtttgtttttcttaactcaatttttattgaatataatatagtaaaatacataaacttaagtgcataactaatttttttttataaatatatatacacatgtgaccaccacccaggatcttggaagcctctctctttgaccctctcagtcaacaccgaactctcaagggtaattgtcaccctaactt

SEQ ID NO: 53812 - DNA, 601 bp, Human
tggaagttgggttgcgcatctttagctactcctctggatcttttctgcaccatctctgtcctgctttgtgacttaggagggtgactggtttgggctcatgcaatgggctccttttcctctggcttccagttatgttacacccgtggggaaggaacacaggcaggcgatcagaaggagagaagagcgtgaggtccgggtatttatttcctggcttcttccctgccagatcattttgggttggctgtgtccctaccaatggctgtgacaattcatacctaccaggcaatcttttccttctagmcttctctctctggctccccttcagcttaagggtagtaatggctccccagtccctaatgtgggtaccacattaacccttgttatttcccaacacctttccaaacctttgttaagcactcttcaaatcatgcaatttgagcaggtggtctgtttccttccaggaccccgattactacagaagtggggatttcctaggcaattgttaaaagtattttgagaatgaggaccagttacaccaatggtgataaccttgctgagtctgctcacaaaatatgcctctggctaaacctgcctgagtata

SEQ ID NO: 53813 - DNA, 601 bp, Human
acagaagtggggatttcctaggcaattgttaaaagtattttgagaatgaggaccagttacaccaatggtgataaccttgctgagtctgctcacaaaatatgcctctggctaaacctgcctgagtatagcatagaggctttagctttctctttctggtatcatgtgaagttatcaagggactctttatgatttaaaaagtaagattagtagccttgaagtgtgcccttaagtgtccataagcattttagccatgagttatttttcactttttgccttactaagttgataatggatgcttgtratgtttgtgcttgcatctgagaagcatccacagtactgcctgaggatgtcaggaggagaggtgagagtgtcaaacaggaccagactttaaagtagtaataaaattgctgttatttgaaaaattagactcaaagcacttctagggattgcagcctcaagctacagtgaacaagagagagttatcctaattcttaaatggagtcttacattgaagttgttaaactcctcttttgacagttgggttatttagttgtctgctttagcaatgaatttttggaatgacatctgtagtgctggtgag

SEQ ID NO: 53814 - DNA, 601 bp, Human
ttgcatctgagaagcatccacagtactgcctgaggatgtcaggaggagaggtgagagtgtcaaacaggaccagactttaaagtagtaataaaattgctgttatttgaaaaattagactcaaagcacttctagggattgcagcctcaagctacagtgaacaagagagagttatcctaattcttaaatggagtcttacattgaagttgttaaactcctcttttgacagttgggttatttagttgtctgctttagcaatgaatttttggaatgacatctgtagtgctggtgaggactgctgaakttcttgcactgaaatagaaatcaggatgtcatttgctgacaacggtaattaacccgaatcacaaatcagattgtgctggcaaatatgacggtgtaagaactgttggaagttcaaaatgaaaaagtcaatagcaaataaaacaggatatcacatattttttaatgaagctttaccttcttgaaagtaagcctaagtggagtttcctttttaattggacaaggccacttaggtgttcgtttctgtgcatgctgagctgagtcatggcttttgtttttggtatcacttggtgcagctactgat

SEQ ID NO: 53815 - DNA, 601 bp, Human
ctgacagcagaagaatggaagaagaaatatgaaaaagagaaagagaaaaacaagactttgaagaatgttatccagcatctggagatggagctaaacaggtggaggaatggtaaggaaaagtaaggaggaagagtgaggcatgagtgtgtgctttttttatttttattttttttgagacagagtctctctctgtcactcaggctggagtgcagtggcgtgatcttggctcaccgcaacctctgcctccagggttcaagccattctcctggctcagcctcccgagtagctgggattacaggcktgcaccaccacacctggctaatttttgtaatttttttttttttttttagtagagatgaggttttaccatgttggccaggctggtcttgaactcctgacctcaagtgatccacccaccttggcctcccaaagtgctgggattataaacgtgagccaccgtgcctggccgtgtgtgtgctttctttttcttgtgactgttggcatcctgggagacacttgggaaagttggggcaatggtgcagcttgattcctcctggcaacaacctgtatgaacaagcagatgttttcttagtccctaaca

SEQ ID NO: 53816 - DNA, 601 bp, Human
aaaaagagaaagagaaaaacaagactttgaagaatgttatccagcatctggagatggagctaaacaggtggaggaatggtaaggaaaagtaaggaggaagagtgaggcatgagtgtgtgctttttttatttttattttttttgagacagagtctctctctgtcactcaggctggagtgcagtggcgtgatcttggctcaccgcaacctctgcctccagggttcaagccattctcctggctcagcctcccgagtagctgggattacaggcgtgcaccaccacacctggctaatttttgtaatttttttttttttttttagtagagatgaggttttaccatgttggccaggctggtcttgaactcctgacctcaagtgatccacccaccttggcctcccaaagtgctgggattataaacgtgagccaccgtgcctggccgtgtgtgtgctttctttttcttgtgactgttggcatcctgggagacacttgggaaagttggggcaatggtgcagcttgattcctcctggcaacaacctgtatgaacaagcagatgttttcttagtccctaacacaggcaccatccccatcccatcacttggcta

SEQ ID NO: 53817 - DNA, 601 bp, Human
aggaaaagtaaggaggaagagtgaggcatgagtgtgtgctttttttatttttattttttttgagacagagtctctctctgtcactcaggctggagtgcagtggcgtgatcttggctcaccgcaacctctgcctccagggttcaagccattctcctggctcagcctcccgagtagctgggattacaggcgtgcaccaccacacctggctaatttttgtaatttttttttttttttttagtagagatgaggttttaccatgttggccaggctggtcttgaactcctgacctcaagtgatccayccaccttggcctcccaaagtgctgggattataaacgtgagccaccgtgcctggccgtgtgtgtgctttctttttcttgtgactgttggcatcctgggagacacttgggaaagttggggcaatggtgcagcttgattcctcctggcaacaacctgtatgaacaagcagatgttttcttagtccctaacacaggcaccatccccatcccatcacttggctagcatgcattgttagtgtggaccagtgattatctgcaaggctgccttaatctgcttccaatgagatgcactctatctaatat

SEQ ID NO: 53818 - DNA, 601 bp, Human
tcaggacggtctgagcggggaggaaggtaaatgccagtcctcaccaataaatgtatgatggtagtccacgctgcataccaagaagtgaaagcacaggtgccaagagttatacaacagggggccctgaccttgactgagaagccagtgaagggttccttgaatatgcaatgtagagattagtatctgtgagaagcgcagttagccaggcaaaatagggggcatgaggtgaggtgggggctccgagaatggaggacataggccagcagggagcactggcctgagatgggctcgagggataggyggggctctcctgtcttcaggattttggtcaagggtgttaagctgcaagtcataccttcgcatttttgaagatccattggctgtattggagagtggactgcaggtcggagaggagggctgggagctggggtggtcttccagggatgagatgatggtattgaagtgacagggtagtaggaagggagagaaatggatgaacctgagagatatttaggaggagaaattagccgggtgtggtgaggggttggctatgggagagggaggtttcaatgacaactgtgttttctggcttgccgagttg

SEQ ID NO: 53819 - DNA, 601 bp, Human
tatgtttcaaattttatttgaagtcgtgaaaataatgcagtgaagactgtgttttttatgtagttaggcatcatctgcctgctgctttgcctgcactgggggtggactgagtctaaggggaggtggggagaggtgggcagcgaatacccttgcttttgtggcagcaacacctagtggcagaaaaagagtgagaagagcgaatttgcctttcccacttcagtgacagcccagaaagtaagcatgaatgcttctgtccctcagctgccctgaggtttttttttttttttttttttttttttttaactgttaagaaaattaacttccaatcgagagggaggtcttccaatgccaaatctccagttcatttttctctggtctgagaggtttgaagtggaaacattggctctccctgccgatctggtggcagcactcctgcttactgatgcatttgacaagatttgggataataacatatgacagtgcagctaggtagaaattcactcctttattttttgaattaggaatttcactgttagcatctttgaattgggagggatatctctaacgtccctttcagttcccaaaccgtagatctctgatt

SEQ ID NO: 53820 - DNA, 601 bp, Human
tttgtgaactcttgacctcaggtaatccacctgcctcggcctctcaaagtgctgagattacaggcatgagccactgcgcctggccccatcctttgcttaaaatatggaatagctataaaatgcagtgattttttgatgtgtaattctttctttgagttaagggtatacagctttaaactaacaacaacaacaacaaaacatacaaaacaaaacacatgcacacaaaacagatttttgcaataagaacatatctgtctttttcttttatttttttatcgtctggaccatacagtggggtttyccatcatcctgaactttttcaacttgttttcttatatctggtttttaaattacttacttttggatacagcatagaacataaacatttgaacattagattcacaagttccatgccatctcatttccccagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggcc

SEQ ID NO: 53821 - DNA, 601 bp, Human
ttagattcacaagttccatgccatctcatttccccagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacggttggagcatttgtgtctagggggtgggacttccttggctgccgttcctgtactcakattgatattcattgacagacatggtataaggaggcagtggctgaatagttattcagtgttagatgcattctctgaggtccctccaacaattgaaatacttcgtgcaagtgacttttgttcactcttcctggaactgcatatcatgactgttttatatccagagaattaataacattagtggggatgctttgtgggaatagtcaaaagagtgcagactttggagccagaaaagtcttagttacaagtctgacttcataactcttagaccttagctgagacagttaagctttgtgagtattc

SEQ ID NO: 53822 - DNA, 535 bp, Human
aggagttgtgttttctggagaggttatttcattagattaaagctcagtctccagggtcttcctgcctaaagctgagctccccagatctggagaggggagtgttctgtatatattttccatctgcctagaagttaccactgtccctgttcagccaacaagctctcattcatccattcatttcacgaatatttattaagcacttaccctcatggagctagcaagtaaaaaagacaagacaaatgatgtagacattaggtgctgtaagaaagtgttggggcctgagtgataaggagctagccarggtagtgtgtgtgtgtggcatgtggtggggtggtgatggtggggagggaaagcttccagggagaggaaaatgcaaaggccctgagatgggaattggtgtgtctgaaggacagaaaaagggaagacctaataattgaatggtgaagatggaatccagaggtgcatgttcaatgaatgaggccttcagccctgcacttttcccagcccctttctctcatgcatgcttttctctgag

SEQ ID NO: 53823 - DNA, 601 bp, Human
cactgcatgggctcttttgtcggagttaacttctaaggatttcttcctccaacctttacgcagaacacaccaaatttgagtttctatctcaaacatagagatttttcttttggtcacattttaaactgtaaaggaaaattgattgtggagtaagacttttaggtgaataaaatgagacaggagaagatgtaggattttgattagttgtaggcaaactatgagcctcattgagtcaaggtccacagttaaagacgtccacggcatgcccttgctccagccagcagaataaaatcatgcgtcktgggagtccctttcctgttttcagagtgctgttgccaaaaggtctcctttggacatcatcataaatctgtgcagtgggcagggcaggggcttttatctcagttttacatgtgagggagtgcagctcacacaggttacaggcttatctggaggttacgtggatagggagaggttggtgccctctgactgacctggctggagaagctcaggctgggctgtaaaaggtcaagggaacactttttatttagttggtgggctaattggcttctagggccaacttggtttgataacagatcttggg

SEQ ID NO: 53824 - DNA, 601 bp, Human
cccctgtggtggtctatggttcctttttgtttttcagattgctcaacgataaaagggaacaagccagagaagacctcaaagggctggaggagacagtggtatgtcaagatatttcccgatttatgtttgtctccaagaccggattcatttgtgatttgtcggattatttcaaaattttatccatgcacacctttctgtgtaatgttttagataagacattctatggaaaagtaggatttgtagaatttagtcctcaacttttcacagaatcagtcaaccaatccatctatccttagagcartaacctggagcccctgagtgaggattaagctgaattgcaacttagcaattttacagccctgcactttgtgacatacttccactcaacattcaacagatatttattgagcatctcctaacggctggcattcttcaaggtgcttgaatatatccataaacaacagagataagatccctgtcctcatgaagcttacctttagctgtgggagacgataaacagtaaggaaacaaatcttgcactctatcagattgctatagaatgtgcataggttggtgcctgggggaggctccatgaggatgt

SEQ ID NO: 53825 - DNA, 601 bp, Human
atgtcaagatatttcccgatttatgtttgtctccaagaccggattcatttgtgatttgtcggattatttcaaaattttatccatgcacacctttctgtgtaatgttttagataagacattctatggaaaagtaggatttgtagaatttagtcctcaacttttcacagaatcagtcaaccaatccatctatccttagagcagtaacctggagcccctgagtgaggattaagctgaattgcaacttagcaattttacagccctgcactttgtgacatacttccactcaacattcaacagatayttattgagcatctcctaacggctggcattcttcaaggtgcttgaatatatccataaacaacagagataagatccctgtcctcatgaagcttacctttagctgtgggagacgataaacagtaaggaaacaaatcttgcactctatcagattgctatagaatgtgcataggttggtgcctgggggaggctccatgaggatgtgacctttgagcagggactcgaagaaggagaagaactgagcacagagatgtgttggggagagcattccaggcagaggcaacagctcatgccaaggccctga

SEQ ID NO: 53826 - DNA, 601 bp, Human
cagctccaggagtttggtcgccaccagtcagtgcctgtgattttctcagagcggcagaattggtgcgggaagccagatctggccttgtcagccttcttctctgctgtcccagcaaaacagtcacctcacaggaataaccccagttctttccaagccagggcagatcaccatgtaggaggccacacgtacacccagactgtcagacaacacaggcataggcacacatgcacacagatacacacaggcactcacagggtacacacagggcgggcacacacacacacacagagagagagagagmcagagagagagagagagaacaaacgttgcccaggaaaggaatctctagccaggcccttggtggtgctattcaaaactgtccagacgggaataacaccttacctgtccccaataccctatgatttcagcccagctccatcactaccgtgatatatgaccttgggcaagtcccttcccctgtctgggtctcaggctcacctccagacaaggaggggtggccaaaatgatctcaagagctcctccccagccccgacgtgcttggattctgagatgaaacccaccttcccccaaagcccattga

SEQ ID NO: 53827 - DNA, 601 bp, Human
caaaacagtcacctcacaggaataaccccagttctttccaagccagggcagatcaccatgtaggaggccacacgtacacccagactgtcagacaacacaggcataggcacacatgcacacagatacacacaggcactcacagggtacacacagggcgggcacacacacacacacagagagagagagagacagagagagagagagagaacaaacgttgcccaggaaaggaatctctagccaggcccttggtggtgctattcaaaactgtccagacgggaataacaccttacctgtccccaayaccctatgatttcagcccagctccatcactaccgtgatatatgaccttgggcaagtcccttcccctgtctgggtctcaggctcacctccagacaaggaggggtggccaaaatgatctcaagagctcctccccagccccgacgtgcttggattctgagatgaaacccaccttcccccaaagcccattgagatgcctccagaagcagtttcctctgtctttactgttccctctcctctccctagtccccttccctgccttgatcagactcccaggggttcgttgccacttagcgcagcccat

SEQ ID NO: 53828 - DNA, 601 bp, Human
gctgcatggatgaaggcgtgaaggctcagggaagggaagcggctcccccagtcacccagctggtaagcagcagagtcagagtgggaagctgggtcttctgactccaagcccagtgctctttccctgctggtcttttggctgcttcctttgactccatatgctatgaagctcagacccagccaggcctgacacagccaagccgtgcttagtgatgccagctcacagggtgctcatgggcagccctgattggttggaggtcagcaggttctttcttagtcattcacctggttagtcaccgtcyccactggctggaaggattcctccagctccctatccctggtctcccagccaggaaacccttcctttgctggtgccctaagttcacccaacagtaatagaaagtcatttcttaggaagtcttaaccactttagctgttgagtcattaaactcctccagggcccaagcctcatctattcatagctcagaggctgtcagagcaggaaggggcttcggagatcagctggtaccaccccctgctctgacagataaggagtcagagaggtgacagaaatcacacagtcagagggtagcaaaaaccta

SEQ ID NO: 53829 - DNA, 601 bp, Human
acctaacccccagtcccctactccttctacttgttcaggatacttatttattatttttattaacaacagcagcagcaacaacaataacaatggcaaccaccatttattatttactttgtggcaggctctatactagacgcttcatttgtacccccttatttaattctctcaccaacctctctagataggcattattacccccatttttcagctgaggaacctgaggctctgagggtagatgactcccccatggcctcaggcctcggaagcatggcacttgcccagattcaattggacctcwctgactctcctgccctgaatttttcacgaattctttctccatttcaagagcccattccatgctgggtgcagtggctgacaccggtaatcccagcactttgggaggcggaggcagaagtagacagatcgcttgaggccaggaggtccagaccagcccggacaacatggcaaaacccagtctctactaaaaatacaaaaattagccaggcatggtggttcatgcctgtagtcccagctactcaggaggctgaggcatgagaatcacttgaacgcagaaggcagaggctgcagtgagccgaga

SEQ ID NO: 53830 - DNA, 601 bp, Human
ctcaagcaggtgattcatgaggaaacctatactttttacatcttttcaagaaggagagtacagatgtgacctgccacccccaaaatcccagaggtcctaaaataagagaaggagacattagcaatcttccaaacacccagagaggtgagcggcttgtccacactcacacagggagttgagagtatgaccctgactagaagccaggccttccagtgcctgcactggtgttctctgcatcctccagcctgtcccccacatcccaccatctctcttagcactcaggcctctggcagctcatcactccattgttcgaggcctctttcgactttccaaggtgaaggaagggtagcccagcctaggaaagtcccggcacccacctcagttggcatttccttcctgcccacaggctagcccgtgggcgtgcttcgaccccacaatttctgcagggcagcggaggaacataggcactgacttggaagctggagtgcctgggttcatctcaatccaccctatccccattcccctactgccactagctgtatgtccttggacacattatctaatctctctgagcttgttttgtcatttacaaagtggggat

SEQ ID NO: 53831 - DNA, 601 bp, Human
ctccctcctccactccctctccaccttggacacagggaacggacaagtgtctgtaacaggtcgggtgctgtccacaacatttcctgtcaccagaatctccacactgctccaggacggcaggcggcatcatcctgcacagtcaaggaaaaggacgctcagagaagttcagaaatctgggcaggaccctacaaatataaaatgacagcaccaggacttgcacccaggtctgtagggagtatttcttcatggagtcatgcaacccccactccccatggagcctctgcgactccttccatgtgarcacagctagcggtggcagatgggtaccagggtctatgcagggtgctcagttgtgggctcagcttcagggtctcttgccctcagaactatggatagagcatttagcccaaagagagaacagaattttagctccaatcctctcagttcacagtttggagactaaaatccaggctggagaagggtcatgcttacagctatcatcagagctgggcatagagccctgtttcctgacccctccgccagcctctggtcctcagagagccacatgacaaatgtctttcgtggcagcacaaagagcagt

SEQ ID NO: 53832 - DNA, 601 bp, Human
tcttcatggagtcatgcaacccccactccccatggagcctctgcgactccttccatgtgagcacagctagcggtggcagatgggtaccagggtctatgcagggtgctcagttgtgggctcagcttcagggtctcttgccctcagaactatggatagagcatttagcccaaagagagaacagaattttagctccaatcctctcagttcacagtttggagactaaaatccaggctggagaagggtcatgcttacagctatcatcagagctgggcatagagccctgtttcctgacccctccgcyagcctctggtcctcagagagccacatgacaaatgtctttcgtggcagcacaaagagcagtcaaccgcccagctgatgccaccgcctccctgtctgtccacattctctcattgtgcagaaactgcccatgctacagcagctcccaggtggctcccagagaccttccccttagctggagccagcatccccaagctactgccacaagtcacaccttcactttcccatttgctagagccagcctcaactgtggcctggagccacagctccagttctcctgggctggtggcctctctggctgggc

SEQ ID NO: 53833 - DNA, 601 bp, Human
tggagccagcatccccaagctactgccacaagtcacaccttcactttcccatttgctagagccagcctcaactgtggcctggagccacagctccagttctcctgggctggtggcctctctggctgggcctgacatcccatcctcacccttcacaaaagcaagttccttactacccctgcttcctccagtgacacagcaaagatcccttagtgaaggggccatgtggctgccaggaatgtggggcaggaggctggccttcatgctagagaggtcttagacaaattgtttgctgttgctgctyctgcttctccctcttcatcatcatcatcacccatcatcatcatcatcaccatcatcatcatcatcaccatcatcatcatcatatctctctctctgtctctctctctctcactctgtctgtctctttgctggctctgtgatcatggaaggagcagacacttccctggtgtacctcagtcctcccatctgtatagaggaagcagtccacagagggaactgaggaggccagctcagcaatgcagagttctctaagtcaatacttctcaaactgtaatgtgcagggaataacctggttgatctg

SEQ ID NO: 53834 - DNA, 601 bp, Human
tattttgcctggcgcagtggctcatgcctgtgatcccaacactttggaggccaaggcaggggatcacttgaggtcaaaagtctgagaccagcctggccaacatggtgaaaccctgtctctactaaaaatacaaaaattagtgaggcgtggtggcgcatgcctgtagtcctagctattcagggagctggggtgggagaatcacttgaacccaggaggcggagattgcagtgagccaagaaagcgccactgtactccagcctgggcaacagagacagaccctgtctcaatcaatcaatcaatmaataaaaacttttattttaagttcagggatacacattcaggtttgttatataggtaaacctgtgacatgggggggtttttgtacagattatttcatcaccgaggtactaagcctaggacctattagttatttttcctgatcctctctctccttctaccctccaccctcgagtaggccccagtgtgtgtggatccagtggctgtgagagctggcttcctggcttacagatagccatcttctcactgtgtcctcacatcctcacatgacagagagagagagaaaatgagagagagtgctacc

SEQ ID NO: 53835 - DNA, 601 bp, Human
atcctcatggctgccctaggagggaggcactattttctttctttcttttttttttggaggcagggtctcactgtgtctcccaggctggagggtagccatgatcatggctcactgcagcctcgacttccctggctcaaatgaccctcccacctcagcctcccaagtagctggaatcacaggcatgtgccactacacccagctaatttttaaattttaagtagagacagggtctttctatgttgcccaagctggtctcaaactcctgggtgatcctcccatctcggcctcccaaagttctggrattacaggtgtgagccactgcatgtggcctggagacagtattattatccccattttacagatgagaacactgaggctcaggggggtcaggggatgtgtccaaagtcatgcagctggcaaatggcagaacacggatatgttaagcactcggtcatcgagtgtctctgagcctcatatcaaccccaaggtgtaggcatcattattcctactttgccaacaaagaaattggacttgagagataaggtcacttcctgcaattgagggtcagtgaacgtgggagccagagtccagtccagacttc

SEQ ID NO: 53836 - DNA, 601 bp, Human
caaccccaaggtgtaggcatcattattcctactttgccaacaaagaaattggacttgagagataaggtcacttcctgcaattgagggtcagtgaacgtgggagccagagtccagtccagacttcccaaccttaacacctagcttctccccgacccaccccaaccacaagtgcccttgcccccttgacagtggcagaaaataggtcattcccgtagtagggatattagagatgtcacagagggttgtgttggcctatgaggggcaaaaaggcagcattgggggcaggggcagttgtcacagtatggccttggttcccggcctttgtccacaccatcccactgaacaggatgggaatctgagaccagaatggggacagagtgacggttcttaagagtggccactgagtggagaggaggccttgctgagggtgacttgggcaactcacctgctccctggtatggaggtaggggggtggggggcaggtcagacggcccttgtgtgctgagtagggaggttacccccgtagcagcagttgctggaaccagagtcatgggtgtgaggaccctgcccacgggagttaattcattagggctgaggtaag

SEQ ID NO: 53837 - DNA, 601 bp, Human
gagggttgtgttggcctatgaggggcaaaaaggcagcattgggggcaggggcagttgtcacagaatggccttggttcccggcctttgtccacaccatcccactgaacaggatgggaatctgagaccagaatggggacagagtgacggttcttaagagtggccactgagtggagaggaggccttgctgagggtgacttgggcaactcacctgctccctggtatggaggtaggggggtggggggcaggtcagacggcccttgtgtgctgagtagggaggttacccccgtagcagcagttgctrgaaccagagtcatgggtgtgaggaccctgcccacgggagttaattcattagggctgaggtaagcccaggaggcttcaagtctgaaggaccccccaggcgattggaatctgcagcctggatctgggatgatggagaagagagcttgttgggatctgtattccatacttgggaggctgggccactcaccagctgctagaattttctttctggctgtccttggtgtctcagaaacatgcaaaggtggctgaggaagatctttgctcatcctcgagccaaagctcctggggtgagccaggtggc

SEQ ID NO: 53838 - DNA, 601 bp, Human
gtctgtgagggactgggctggtggcacctaaagcccttccagttggggccgtctctgttgcacctgccctggcctcccctccagccctcccgagaagcatgctacccaggattacgcttttgtccccgcttcaccccatgctgtccgagccctgaagagacttcctctgtgtctagtcccaagaatagagttctgtcaaggacctccaagtcaccccttgctggaaagagagcattcttgagtgtggccgaggtcctgcttatcagcacagcgagtccactgccccagcccctggggctgytggaatgcaggagcctcccacccggacagggtcagctgctcacggctcccacagtagtccctggaatggagtgcgggagggagcactggtgctgagggcaggctgatcccagccactgccttccgacagggagtggccaggagcgaggctgcagacacagttttgttgcaccccagctggcccaggatgtgtgtactggcagccagtcctgccatccaggccctgggcttgctccaaggctgccagggtaccgggagctgtgttctgctcatgcaccagccttcaacatttcaccttgac

SEQ ID NO: 53839 - DNA, 601 bp, Human
cagctgctcacggctcccacagtagtccctggaatggagtgcgggagggagcactggtgctgagggcaggctgatcccagccactgccttccgacagggagtggccaggagcgaggctgcagacacagttttgttgcaccccagctggcccaggatgtgtgtactggcagccagtcctgccatccaggccctgggcttgctccaaggctgccagggtaccgggagctgtgttctgctcatgcaccagccttcaacatttcaccttgaccagtgacccactggatcttctcagggtcagggyttagccctgggggtctccactgtggtttgatcactcagaatgttttggggcctggtgtgattccctgctacagagcctacacagtcatgtactcaacctttggccaggatggggtgagttcagggtgctgctgatggtccgcacctgcagagtagaggctcaggcagacagcagatagcattctggcaattcccagagtcctgcagatgcttcagattctttgagaaccactgatgcagcccaacccttctctcttccagatgaggggatgagacccaaggcagggtgcaggggagatgg

SEQ ID NO: 53840 - DNA, 601 bp, Human
ccaggccacccgcaggtcaacccctccaaagagaggatggtggcggactggaccagcgtggtggtggtggagacagagcttgtgggtggattgagctatgtttgagaggcagaggagacagcactggctgatgggtacgatacatatgttggaggagagggctgtaggagttgggggaagagaacaatcgagaatggtcctcagtttttgacctgagcaaccaggtggaggatgtgcatttactagatggaaaagaacatccagagagtagcaggtttggtagactcaagacttctgtttyggatacccagcctaattttgagatgctcatttcaaatccatgaaggcagttagacagataagtctgcagctcgagggagaagtcaaagctgagatatcaactcaggagttatcagatagaaataatattgaaagtcatgcgccagatgagatcagctgggaagggggtagagctggcaagaagagcagagcgcccagcccttcctccagtgctgggaggtcaagcaaggaagggagcctgccaggagatgggaaggaggcctgggcactgtggtggcccagaggccagggggagtgtttc

SEQ ID NO: 53841 - DNA, 601 bp, Human
taaatgcttcacaccctccccctgcagagacccatgagggagttagccttatatccctcaagcaaatgaggcctgaggcccagcaaggcgatgggcgcagggctactgccaggaagccgagtccgggcctgtctgactccaaagcccccgctcttcctcagcagtccctcaccccagccccaccagctccgcctgccttaccctgccgccgccttccacattccctcccacctcatccatccttgtcctttgatcatttctgtcagcttccagccgtcttggcctctgcctccctcctccrggaaagctctgctttttctctttgatcctgcacgtctgtcctctgctgtgtcctcagctgggccccacgtccctcccaccctgtccttgcgagatgttcccgcaccctctgccaagggtggggggctgaagagtaaccaagagctttgcagggaacctgggcctgcgagacagaagtgtggcccctgtcccccgactgctctttgggaaagagcttggggatctttgggcctagctgggctcagcacaggggcccagagatgagatgcaagcgcacagtccatcgatgcctccagaggca

SEQ ID NO: 53842 - DNA, 601 bp, Human
aacctagctctgcatttacttgctgtgtgatcttgagcaactgcttgacctctctgtggctccgttactgcatcttcaaatggggataataataatatataccaatagggtcgtttgaagattacacaacgtacatatattagctcgcttagagcagtgcctggcacgtagtaagcgctctataaatgttagctaatattgttttgaattggagaggaggatcagtgacagaggcatttaatcattcgaataaagtcaagtgcagagaaagccagcttgcccagattccatatcggggctrgggggagggagcagggtagcactgtaagctgcagctggggggagctgggtcctggggagattgcctgggtcctcgggaggctgcccagcttggagctcttggcaccataaaaagcaagctcaggacaccagtgcataaacaggcagcctctatagatcacaggagccaggaagtcactctcctcttataccctggcctggctgatctcttgccaatgttgcactgtgaacagtgggtgcagagaagctggagggcttcaggatggccgaggccactggaaaggctggaaaatcagaggtc

SEQ ID NO: 53843 - DNA, 601 bp, Human
ctctgtctggctcagggccacactgacacatccctaggacagaaaggacaggctacccaacttcagggtgcatctacctggcagaaagcagggtggggcgaggctcaggagagaggagctttggctaggaaggcctcttccatcctcacagtttgagcacctgctgtatgcacggcaccaagactgcaaggccagattctgcctagagtggagtacaatggtcttgggatgttggcctgttggacatgctttctatgcgctttgacaaagggagtggtcctggggacatctgagggggtcaacaaggttgaatcctacctttgccaatttttatctgtgtgaccttgggccagcagtgtctaaccttcctgaaccttagtttccccatcaaaaaggagcaaatcatggccaccttcaggtcatggggaacattagggataacaagtgtgagggcatccaggttccctgccaccattgccactgttcacggaggataccatagcacaggctccgctcaggcgtgtgaatgcctccctttctcgcccttacttcctatgctccatcctctgcattcccacctgcagcccagactcagctgcac

SEQ ID NO: 53844 - DNA, 601 bp, Human
agaggagggatgcaggcaggatgcagtggctcaggcctgtaatcccagtactttgggaggccaaggtgggcggatcacttgaggtcaggagttcgagaccagcctggccaacatggcgaaaccctgtctctactaaaaatacaaaaattagccaggagtggtggcacacacctgtaattccagctactcaggaggatgaggcaggagaatcattgaacccaggaggcggaggttgcagtgagccgagatcatgccactgcactccagcctgggtgacagagtgagactccatctcaaaataaataaataaataaataaataaataaataaggagggatgcatcaaggtccccttagatgggccatggatcctgatccctgggccccagcccagagaccctggaggccacatacctgtgtggccttgtccaaatcaccaaccactcactcagcccagtctccttagctgaaaagccagggcacctgccttctggcatgcagcatccattcaactaacattagttagactggacaaggtgaccggcctgagcttgtcccctggctcagacattcactagctgtgtgggcttgaatgagtcatg

SEQ ID NO: 53845 - DNA, 601 bp, Human
ccaaatcaccaaccactcactcagcccagtctccttagctgaaaagccagggcacctgccttctggcatgcagcatccattcaactaacattagttagactggacaaggtgaccggcctgagcttgtcccctggctcagacattcactagctgtgtgggcttgaatgagtcatggaaactttctgtgtctcagtttccttatctgcaaagtggacataatactcatctaaaatgtttgtgaagactaaataaacgaatgcgcagaaagcacttactacagtgtacagcgtctggaatacargtgcttaataaatgtgagttttattattactacggctgcttttgttgttactaccaccattagctgctgtgtgccaggcactgagccactaagaagtacaaggcagtacccctgccctcgatagcctctgcgtacagacttacaggacaaaatgacagccaaaataaaaagcagcagcagctaaataaatgaaagaaagcaaaggcccaagtccccaagatcctggtctcctgcatgagatgagtggcagggagtagaggagaagctgggtaccaacacgattcccaaatgttctggctt

SEQ ID NO: 53846 - DNA, 601 bp, Human
ttagctgaaaagccagggcacctgccttctggcatgcagcatccattcaactaacattagttagactggacaaggtgaccggcctgagcttgtcccctggctcagacattcactagctgtgtgggcttgaatgagtcatggaaactttctgtgtctcagtttccttatctgcaaagtggacataatactcatctaaaatgtttgtgaagactaaataaacgaatgcgcagaaagcacttactacagtgtacagcgtctggaatacaagtgcttaataaatgtgagttttattattactackgctgcttttgttgttactaccaccattagctgctgtgtgccaggcactgagccactaagaagtacaaggcagtacccctgccctcgatagcctctgcgtacagacttacaggacaaaatgacagccaaaataaaaagcagcagcagctaaataaatgaaagaaagcaaaggcccaagtccccaagatcctggtctcctgcatgagatgagtggcagggagtagaggagaagctgggtaccaacacgattcccaaatgttctggcttgtcttggcatgggagactcaggcagggacacgtg

SEQ ID NO: 53847 - DNA, 601 bp, Human
gtaatagtagagctaggatggtagccaggcctcctgactcctagtactttgtaattcctatgcaccatcaccctctgggccccgccctgcccccataacactgcccactgggtgagatttcaggcagccagactctgggcctacacctaggctggcctctgctgctcctcagacccaacagggcttccagttgggagaagttcattccctttaggagattgtggcaaggagataccaacacacccctgtttctcctcaatgggctcaacaggaaaggcctgggagtgtaaatgtgtaagaytcgggccagccagatgccagcgtcatggacagggccttgaaaaaagcatgtgggggaaaactggcacctcagccatccgcgaagagggccaagtccactttaaattgtgctgtggaattcctttctcaatgccaggctgttcctggtggattcatttaattaaaaccccaccagatccaatctgttagaagctctgagctcacagatgccctgtccagctggtcatgaggatgcagacaggccacaggcctgggccatggcacctggctcaatggctagcttagaacaggccccaccggc

SEQ ID NO: 53848 - DNA, 601 bp, Human
gaacgagtgtgcccagccacatttttcatattttcatattagcgtgggatcccacaatatagaaagcgttgtctcctactcttttaatttaacatgatgtggtagttttctatgtaatcaagagactgttcaagaactgcactttaatggtcacacaatattccaccacataaatataccttaatatgtttaaccaaactctattggtggatatttggactgtttacaatttttcacaatgaaaatgctgctataaacatccttgttcataaatctttgttctgatctctggttattttcygagcagagattcctagaagtgccactgcagggccactgggtagacacatttctaagcttcttgattcgtatcatgcagctgcctttctgagagagtccgctggcccccacaccaaccccatttgtgagcacacccaccagtcccacgcaggtctattttctctgaccttaacacatcatgtgtcatcctaacattgtatccttgcctcagtagctcccctcatcagaaccctgcatttcctatccacccttcagagctcagagcaaatgtcacctcctccatgaagccctccctgataac

SEQ ID NO: 53849 - DNA, 601 bp, Human
cactgggtagacacatttctaagcttcttgattcgtatcatgcagctgcctttctgagagagtccgctggcccccacaccaaccccatttgtgagcacacccaccagtcccacgcaggtctattttctctgaccttaacacatcatgtgtcatcctaacattgtatccttgcctcagtagctcccctcatcagaaccctgcatttcctatccacccttcagagctcagagcaaatgtcacctcctccatgaagccctccctgataacccaaccaaagttctctatgtccagccctccttcrgcttctgtcttaaatccctcctaaaacatttcccacctttgccatgcattttaataatttgtgtaataataacctctgctttatacagggcactgaagttttcaaagtgcttccactgagaggtttcatttgattcaatcccagatggaaagtgttttgaggtcagggacctcatcaatagatcatctaggtctatttctcctggctacatcaccaactcaagtccagcacaacctcaagctagcccttgtgtaacagaagtgtttcaccagcccttgttactccttggcctatcagaac

SEQ ID NO: 53850 - DNA, 601 bp, Human
ggcctctgggatgggccagaaggagctggccagggaggcaggcctggctctaggccaggctgtgtctgcaaacactgaccttggctgccgcagggattttccatgacaccagcaccctccctctgagctccctgcatcacacatgggcctgaggagggtgggggatgggggctttgggggtttgtcctacatcagaggccccaagatcagtactagggccacctgtggatgggaggcagctcaaggcaagagaggagacagcagtgggcccaagagtggggagtccaggaggaagcatggrgcagggagagaagctgctgggggtagtggggggaagagctgggagaggagatgggacaatgggaagagaggcctcgggaaggggcagggcagaagaagcggataggtgctgtgcttcagagctgtccttcccaggagctctggcctgaagagggacaaactccagatcccattctgtacattggtcccacccctaccccagctccatgagacccggtggttcccaggcctagctaggggcttgcccaggcccagtgcaggggggattccttctgaaccttgaagctgacctcattttgaa

SEQ ID NO: 53851 - DNA, 601 bp, Human
ctagggccacctgtggatgggaggcagctcaaggcaagagaggagacagcagtgggcccaagagtggggagtccaggaggaagcatggggcagggagagaagctgctgggggtagtggggggaagagctgggagaggagatgggacaatgggaagagaggcctcgggaaggggcagggcagaagaagcggataggtgctgtgcttcagagctgtccttcccaggagctctggcctgaagagggacaaactccagatcccattctgtacattggtcccacccctaccccagctccatgagasccggtggttcccaggcctagctaggggcttgcccaggcccagtgcaggggggattccttctgaaccttgaagctgacctcattttgaaggggccagaggccacagtgaaggcaggagctatgagtcacccgaggccctcctgccaagggccacctcccgtccccatcctggatgtctaaggggtggtttctcatcaccatcccagacctcagagtccttcagaactggagcctctgggttctgcagccctcccaccccaggcctgtgctggacactgaggggacaagccagccctgcagg

SEQ ID NO: 53852 - DNA, 601 bp, Human
ggggagtccaggaggaagcatggggcagggagagaagctgctgggggtagtggggggaagagctgggagaggagatgggacaatgggaagagaggcctcgggaaggggcagggcagaagaagcggataggtgctgtgcttcagagctgtccttcccaggagctctggcctgaagagggacaaactccagatcccattctgtacattggtcccacccctaccccagctccatgagacccggtggttcccaggcctagctaggggcttgcccaggcccagtgcaggggggattccttctgaaycttgaagctgacctcattttgaaggggccagaggccacagtgaaggcaggagctatgagtcacccgaggccctcctgccaagggccacctcccgtccccatcctggatgtctaaggggtggtttctcatcaccatcccagacctcagagtccttcagaactggagcctctgggttctgcagccctcccaccccaggcctgtgctggacactgaggggacaagccagccctgcaggactcctctgtggacatgagtgcccaaatacagggtgggggcctgagaggggcagagggaggagag

SEQ ID NO: 53853 - DNA, 601 bp, Human
ggagcctctgggttctgcagccctcccaccccaggcctgtgctggacactgaggggacaagccagccctgcaggactcctctgtggacatgagtgcccaaatacagggtgggggcctgagaggggcagagggaggagaggcctcttcagtgcccagagaaggttcccagaaggttctcgggaaaggcagtgtctgagctgcatctcacaggaggagggagagcacctgcgccctcctcccgtctccaccaagctgcagcccctccctcctctcctcccccaagacctgggcacagaagctrggctccttccgcctcatctcctttaacatgccaattaggctccctcagagcctgcagtcccacttcctggttccacactgctgccatccccacaactgaggggcggctccatgtctgtgcctcaggcgcctgagctggttcctcgtgggccctcccctgggtgccctctgagcccagctgccctctgccatccagcaggggagcccagccttcctctgagggccctccctgtgtcttgcagcccccagagctgcctctgtctcccccaagcccgcactcctctctggctgccacaccagg

SEQ ID NO: 53854 - DNA, 601 bp, Human
tgatcgaccttgcacatgaacacatacatagccctgagaaagcctaggctcaaatcaaatgatggtgaatcctgttaaattcagcatttccccaatttaattgagccaagcaactcttttctcatccaacagttgttaacattccatggaactggtatttcagaaaaataacttgagtaaacactgatcatagaatgttggcactgaaaggaactttaaagatcatcaaatcttggtgctccccaaaatattcatattaataattcatatttattgatctcaatgtcctaagcatgttaartctatgaactcaatcaagtccccacaccaagtctatgaagtgagtacttcattattcccattttacagacgagaaaactgaggcacagtggattaagcagtgtggccaaagataaagttgtttggcttcagagcctgtgatcttctctactccactaaactgcagagatcctctccctgtgttcagtatttcaaacatacaacaataacttaactccatctcaaagagtcaattatctcaggctaatcagactttctgactggcagatgtgtgcttaattaattttgatggggaaagaaa

SEQ ID NO: 53855 - DNA, 601 bp, Human
ttgatctcaatgtcctaagcatgttaagtctatgaactcaatcaagtccccacaccaagtctatgaagtgagtacttcattattcccattttacagacgagaaaactgaggcacagtggattaagcagtgtggccaaagataaagttgtttggcttcagagcctgtgatcttctctactccactaaactgcagagatcctctccctgtgttcagtatttcaaacatacaacaataacttaactccatctcaaagagtcaattatctcaggctaatcagactttctgactggcagatgtgtscttaattaattttgatggggaaagaaattaattatggttctaacaatgatttattcagtgcctgctctaaagagtatccacactgcactgatcaccacatcgaacttcataaataaaatcttccaaaattttgcctctgtgaatgggtgagtgaacagagaaaataataaaaggcagtgggaaaagctgggaacctcatctcttgccctatcttccatgtcacagatgaggaaacctgaggcccagaaggaacttgccaagacacaaagctgtctttgatcagggtcaggtcagacccca

SEQ ID NO: 53856 - DNA, 601 bp, Human
atcctggttctggcattcacaagctgtgtgaccttgaacagattgctttccctctctgggcctccatttcctcatctgtacgatgtaaagactgaaccaaatgatggctaagggtatttctggatctgagaaccttaaaacctatgttggattcagggaaaggaggctgggagaggaggcggtatggatagtcctggtagttttctgagaggcagtggccagagtctcccggtcagaacatctgctctggttgatcagcccagcaggtactgcgagagagggtcctcagagagtcagccamacagaaggacagatgcagcccctcacccagagactcgaaggcctggacagaggagagaagatagagaacaccttttgccccctgcctcataaagccaagcgcgacatgggcaaggaccaggcaggcagcgggcctgctggcaggcagacgggtcttgccaaactcccacttacttcccagaagctccagggccccctgggagtggctccacccagctggcacccctccaagttgggcgcccacgtcagcaggtcctcacactcccttgccctttcacccagtgacaatgggacaggcaat

SEQ ID NO: 53857 - DNA, 601 bp, Human
aagctgtgtgaccttgaacagattgctttccctctctgggcctccatttcctcatctgtacgatgtaaagactgaaccaaatgatggctaagggtatttctggatctgagaaccttaaaacctatgttggattcagggaaaggaggctgggagaggaggcggtatggatagtcctggtagttttctgagaggcagtggccagagtctcccggtcagaacatctgctctggttgatcagcccagcaggtactgcgagagagggtcctcagagagtcagccacacagaaggacagatgcagcycctcacccagagactcgaaggcctggacagaggagagaagatagagaacaccttttgccccctgcctcataaagccaagcgcgacatgggcaaggaccaggcaggcagcgggcctgctggcaggcagacgggtcttgccaaactcccacttacttcccagaagctccagggccccctgggagtggctccacccagctggcacccctccaagttgggcgcccacgtcagcaggtcctcacactcccttgccctttcacccagtgacaatgggacaggcaatggggtggggggcaccctaag

SEQ ID NO: 53858 - DNA, 601 bp, Human
aaggacagatgcagcccctcacccagagactcgaaggcctggacagaggagagaagatagagaacaccttttgccccctgcctcataaagccaagcgcgacatgggcaaggaccaggcaggcagcgggcctgctggcaggcagacgggtcttgccaaactcccacttacttcccagaagctccagggccccctgggagtggctccacccagctggcacccctccaagttgggcgcccacgtcagcaggtcctcacactcccttgccctttcacccagtgacaatgggacaggcaatggggyggggggcaccctaagccggatacttggagaagcgtctgactgcctgagcatggccctcctgttaccacctctgctgcaactggctcagagcaacgcctgaggctgatgcccaagtgaaatgctctcctcccaaggcctcccggcctggtcgcccttcctgggtgatgcattggctcccacgtaccggaatgaatgctgagtcagaaaggcccagtggccttggccaacacccaaggcctctctggacttcatgacaccaactgtaatatgaagatagtcataatagtgaccttgtaagaa

SEQ ID NO: 53859 - DNA, 601 bp, Human
tgtgaccccaaagaggaggcacatctaggccagggctgcctggacagggcagtggctgtggtggagcatgaggtgctgcctgggataagagcctctggttaagcctggatgtgtcatttgctttgaaagtcactaagttcaacaggatgaagggcagaggaaggggttgtcacttgcagctgaagctgggtcctgaggagctaggtctttgtgggctggggtaggagaggcgaaggagggccacgaggcagtgtgggaagcactgtggagaggaggggccggcttggctgggtgtgggatraggacgggtctctggggtggccgcagggtatagcaaaagaagggcaaggaagggatgtgtggctccttgaagctgggcgctttgtgagcacagtcacagtgggcagtgaggctgccagacagggggcactggcttttcctaagagacggtgggcccagggaagtcacggcctatgacaaacacaggacaagggagcagtggtggcagagagggggtgagggcccctgatggtggtatgtgtctgcctgaccccacagagatggccctgcccccaggcccatgctctcaggtcacccttcc

SEQ ID NO: 53860 - DNA, 601 bp, Human
ctgggataagagcctctggttaagcctggatgtgtcatttgctttgaaagtcactaagttcaacaggatgaagggcagaggaaggggttgtcacttgcagctgaagctgggtcctgaggagctaggtctttgtgggctggggtaggagaggcgaaggagggccacgaggcagtgtgggaagcactgtggagaggaggggccggcttggctgggtgtgggatgaggacgggtctctggggtggccgcagggtatagcaaaagaagggcaaggaagggatgtgtggctccttgaagctgggcrctttgtgagcacagtcacagtgggcagtgaggctgccagacagggggcactggcttttcctaagagacggtgggcccagggaagtcacggcctatgacaaacacaggacaagggagcagtggtggcagagagggggtgagggcccctgatggtggtatgtgtctgcctgaccccacagagatggccctgcccccaggcccatgctctcaggtcacccttcccctgtgagatcccacgaccactgcttccatctcgcaagctacagcttccaaagagctctaacgcccagtctctcctgtg

SEQ ID NO: 53861 - DNA, 601 bp, Human
agacagggggcactggcttttcctaagagacggtgggcccagggaagtcacggcctatgacaaacacaggacaagggagcagtggtggcagagagggggtgagggcccctgatggtggtatgtgtctgcctgaccccacagagatggccctgcccccaggcccatgctctcaggtcacccttcccctgtgagatcccacgaccactgcttccatctcgcaagctacagcttccaaagagctctaacgcccagtctctcctgtgctcctgcagagggctctggcgggcagcgagggtggggrttaatagctctagctcaatcttccagagtgtaggaaagacaagtgagcccagagaggggtagggatttgtccaaggtcacacagctatcacgtggccaagctggggctatgtccatgctccctacttcctgttgagccccatccatggtgccatgccctcccctctccaccaagtagtgccggcctggaggacagggaaggacgggatgagaagcagctctggctcagggcctgcccagttgtcgaggtgagttgtggtctggctgccatggcccagctggcgggcacaatctgttctca

SEQ ID NO: 53862 - DNA, 601 bp, Human
ctgcttccatctcgcaagctacagcttccaaagagctctaacgcccagtctctcctgtgctcctgcagagggctctggcgggcagcgagggtgggggttaatagctctagctcaatcttccagagtgtaggaaagacaagtgagcccagagaggggtagggatttgtccaaggtcacacagctatcacgtggccaagctggggctatgtccatgctccctacttcctgttgagccccatccatggtgccatgccctcccctctccaccaagtagtgccggcctggaggacagggaaggacrggatgagaagcagctctggctcagggcctgcccagttgtcgaggtgagttgtggtctggctgccatggcccagctggcgggcacaatctgttctcaccctactggagcacagacgtcctaagcacagtggctctacagctcagctgtccaggtccctagcaaatggtgacacagttactggcccgacgctgtggagggggtcaggggagctggttctaagggcagccccaagcagctgtccccagagctccttgagctttaagatccaaatggccctgggttgacagaggtgccagcttt

SEQ ID NO: 53863 - DNA, 601 bp, Human
gtccccagagctccttgagctttaagatccaaatggccctgggttgacagaggtgccagctttactggaactgagctgccctcaagcctggctgctctcttggaaacatgacagtaatctggcacttcactcattattaatcacagtgagccattattgagcacttgataggtaccaggctctgggctaagtgcattacacacatgatcttacttattcctccccaaagtcctgtgaggcaagtgtattattaaccccattttatagatgtggaaactaaggctcagagaaatcatgcatacacacacacacacacacacagagagagagagagagagagagagagagagagagagacagtaagtccaggacagagtcacacagtatcctgccttgcaatttagttatcaaacatattctgggcctccataggtatggctggcaatgtggaggtagaagctagagaggaaagtgacaagacccatcagtgccaccccttccccccaaagctagtgtttagctctatgtagttggggatcctagaggacagggggtggtggtaatattggccctggaattacaagctgaacattttcagtgc

SEQ ID NO: 53864 - DNA, 601 bp, Human
caaagtcctgtgaggcaagtgtattattaaccccattttatagatgtggaaactaaggctcagagaaatcatgcatacacacacacacacacacacagagagagagagagagagagagagagagagagagagacagtaagtccaggacagagtcacacagtatcctgccttgcaatttagttatcaaacatattctgggcctccataggtatggctggcaatgtggaggtagaagctagagaggaaagtgacaagacccatcagtgccaccccttccccccaaagctagtgtttagctctrtgtagttggggatcctagaggacagggggtggtggtaatattggccctggaattacaagctgaacattttcagtgccactcaaataaggcagagatcataagctgtgaggaatccaggaggactgcatggaagaagaaacatttggttaagatttgataaggcttagaatggaagaaaatgccagcgtcattttattatcataattatgttaataaaagtagtaaatatatcaacaataaaagaagcaggccagcaccagtaaacacactttacaaatgaagaaacatgttcagagagtg

SEQ ID NO: 53865 - DNA, 601 bp, Human
acatattctgggcctccataggtatggctggcaatgtggaggtagaagctagagaggaaagtgacaagacccatcagtgccaccccttccccccaaagctagtgtttagctctatgtagttggggatcctagaggacagggggtggtggtaatattggccctggaattacaagctgaacattttcagtgccactcaaataaggcagagatcataagctgtgaggaatccaggaggactgcatggaagaagaaacatttggttaagatttgataaggcttagaatggaagaaaatgccagcrtcattttattatcataattatgttaataaaagtagtaaatatatcaacaataaaagaagcaggccagcaccagtaaacacactttacaaatgaagaaacatgttcagagagtgggagtaatttgcccaaggtcacacagccactagggccctgtcactagggatgagttcccatccagggtcattttccctccagttagccggaagaattctcaacttaggctttggaatggctggtgcagagggaacatttgcctctgccctgatcttggctcagggtgggccagggtgggggcggggt

SEQ ID NO: 53866 - DNA, 601 bp, Human
aaaaggcaaaggggtgggggctgggtgcagtggctcacacctgtattcccaacacttttggaggctgaggttggaggattgcttgagcccaggaattcgagaccagcctaggtgacatagtgagaccccatctctacaaaaaataaaaaattaaccaggtgtggtggcacgtgcctgggagtcccagcgacttgggaggctgaggtgggaggattgtttgagcctgggaggtcgaggctgtagtgagccctgattgcaccactgtactccagcctgggtgacagggcaagaccctgtctcaaaaaaaaaaaaaaaaaatggcaaagggagacaagagcccagcctgcttgttgctagccaaagtgttctttccttccagcttggcctgctcttaaaagcaaagctcctgcagtgtacatcctggcattgtgtggctacctgggttttaaaccagaatcagaagtcccggatcagagggcactgctgaggttcagcctcttctcttcttggccaggaggcagcagctctgaatgggcccctgaggctgcacaggggcctttgtcactggggcgcatgcttacaaacagtgcagttcttggga

SEQ ID NO: 53867 - DNA, 601 bp, Human
actcttaagcccatctccagtttttaaaatttcctttgttggcagaatgaaatattttccctataatatctacttgtttagatccagaaagaactggtcaatctgtctctccatatcttaaccctagcgaattttatagacataccttggaatcaagtctttggagaaagaagactacttacatttgtttgtctctctattcagtttggagataagaaaatcgaggcccagagatggtaagtaaagccacctaagtgacatccaccattgagatgtgattccagagcccatctcccatccrtctctctagactcggtagcttttttatgctggcctctctcacctgaaacctgaagagcagagcttttatcccatgcaaaggaaatagatatgtcctggtcttctggcccacgctgctcctggcctggagcctcatcacctcttgcctggagtgggcctgcccggacctggagggctaccaagagaatagcagcgaggagggcgataatcctcatggctggggtgacctggaggagggagagcaggagcagctgtgtggggagggagaagccagcttggatttatagctttgctgggagaa

SEQ ID NO: 53868 - DNA, 601 bp, Human
taaggggttaggcaaagcctgtctcaaatgccgcagtctcctgacatcctccatgtatgatcattatatgatcattaatgattagtgagtcattacagaggacacatattatgtattacccaatgtatttctttgaaggaaaatttgtattattttaattatttttatgtacagaaaactcaacagtgcacatttaacccagtttagtggcaagttctttagcctttgccttttcgagcttggcaatgcgagccacagacttaggacccaggatgttgccaccccagtgacggcagatctyatcgtatctgtcattgtaattggtcctgatagcttccaccagcttagccaaagcgcctttgtcttccgagttcacctgtgtgaaggcgacagtggtgcaggtcttcctgtggacgagacgtcccagtcttgccttcctcttgataatgcactaagggaccaccattttacgacatagggcaggcaagaagacagccagctcgatgggatccacgtcgggtgcaatcaccaccagctgagctttcttgttctccaccaaggtggtgacggtgttaactcctgctcaaaggacaggtggtct

SEQ ID NO: 53869 - DNA, 601 bp, Human
accatagagtgttctccatgaatttacacatgttctgaacttagctgaaatcttaaggggttaggcaaagcctgtctcaaatgccgcagtctcctgacatcctccatgtatgatcattatatgatcattaatgattagtgagtcattacagaggacacatattatgtattacccaatgtatttctttgaaggaaaatttgtattattttaattatttttatgtacagaaaactcaacagtgcacatttaacccagtttagtggcaagttctttagcctttgccttttcgagcttggcaatrcgagccacagacttaggacccaggatgttgccaccccagtgacggcagatctcatcgtatctgtcattgtaattggtcctgatagcttccaccagcttagccaaagcgcctttgtcttccgagttcacctgtgtgaaggcgacagtggtgcaggtcttcctgtggacgagacgtcccagtcttgccttcctcttgataatgcactaagggaccaccattttacgacatagggcaggcaagaagacagccagctcgatgggatccacgtcgggtgcaatcaccaccagctgagctttcttg

SEQ ID NO: 53870 - DNA, 601 bp, Human
agctgaatttagaagaaacgtaaagataacttatttcatcaagtttgtatttcaaagtctctagtgacttccaccttgccaaatccaatggtcactttctagtccatttcttttttgatctcttaagcattcctctttgatatacagtattttattcatgggatttcaggacaccaaactttttctcattttctacttagctccttttaaatttttttgcttcccctttttgcaacttctaaaagttgagtgccctgcggctcagttccggagcctcttctctccttccacttttttttttcccttagagtattaggaagcaatttagcttagtgttaagaattcagactggggccacactgcttggattcagtcccaggtttgctgcttaccggtagtgtgatttttggcctagttgcttagataatctgtgtctcagtttccttatctttaatatggaatataagagtaataatagttcttacctcagagagttgttaagagggttgagttaatatttgtaaagcacttagaaaaatttctgtactttttattaagtaagattttaaaaagaacctcatctaatttcttagctttaaat

SEQ ID NO: 53871 - DNA, 601 bp, Human
tgaaactagctggacttcctgggtcaagtggggacttggagaacttttcggtcttacaaggggattgtaaaatgcaccgatcagtgctctgtaaaaacgcaccaatcagtgctctgtagctagctggaggtttgtaaaatgcaccaatcagtgctctgtagctagctagaggtttgtaaaatggaccaattagcactctgtaaaatgaaccaatcagcaggacatgggcggggacaaataagagaataaaagctgggcaccctagccagcagcagcaaccggctcgggtccccttccatgytgtggaagctttgttctttcactctgcacaataaatcttggtgctgctcactctttgggtccgtgctacctttaagagctgtaacactcaccacaaaggtccgtggcttcattcttgacgtcagcgagaccacaaacccaccagagggaacaaactccggacacatcatcacctttttctgtctcaccattcttaccttacttcagtcattgttatctctcatagtcagtggcaagagccttctggtaggtttctttgttaccactcttgcctctacaatcagttctcatttacaaaggt

SEQ ID NO: 53872 - DNA, 601 bp, Human
acatgggcggggacaaataagagaataaaagctgggcaccctagccagcagcagcaaccggctcgggtccccttccatgctgtggaagctttgttctttcactctgcacaataaatcttggtgctgctcactctttgggtccgtgctacctttaagagctgtaacactcaccacaaaggtccgtggcttcattcttgacgtcagcgagaccacaaacccaccagagggaacaaactccggacacatcatcacctttttctgtctcaccattcttaccttacttcagtcattgttatctctyatagtcagtggcaagagccttctggtaggtttctttgttaccactcttgcctctacaatcagttctcatttacaaaggtcagtgatcttttaaaaatgttagataatgtcagttacctgctcagagttctctggtagcttcctatcctacttaaagggaaatgcaagtttttttattgtggctcacaatatggcttcttcctgtgtgtctgatatgattatgatctccagactcactctcttgaattccaggcttcttaaatctgaacgctccaagctcattcctgcctctgtagctata

SEQ ID NO: 53873 - DNA, 601 bp, Human
ggctgcagtgagctatgactgcactcttgcctgggcaagagagtgagaccctgtctttaaaaaaaaaaaaaaaagaattaaaaaaaatgcatctttaccctctcactctgtttctttgttccatttctttttctttatagtacttagtgacctgacattaattgattgattatcttttgtgtggaatataaactccattaagatgagaacttttcattttttttcccctaatactttagggatagtgtctggtacatagaaagcactcaagaattatttatcaaataatgaattattggtrtttttctagaacattagtcttgtatttctatttgctgttcttttttccctccaaaacaaattcatctgtcagaaaactgaagttatctttctaagtctggctcttcattcattatttggtaacatttttgtttgtttttaaatctttttttacattaatatagatggggttttgccatattggccaggctggtcttgaactcctagcctcaagtgatctgcctgcctcagcctcccaaagtgctgggattaccgatgtgaggcacccgggcccagccaatttggtaatattttagtgttg

SEQ ID NO: 53874 - DNA, 601 bp, Human
ttttgtctgttttgatagttggtacctaagtttacttagtcatacaagtcgtgaacttgggagtaattcttgacttctgtagttgtaattttctacattctaaacaacaaatgtatcctgtctaccctgtgccagataccctggtaccgaatatgccctcaaggattccaggtttagatcaccactctctcagattagtacagtagcttccagctgttcttccctgcttccagtttttccctagttattttccagatggctgatggtgatatttttaaaatgtgaatgtacgcgtggcccytccgtttaaaatatttctagagagggctgggcgcggtggctcacgcctataatcccagcactttgggaggccgaggtgggcggattatgaggtcagcagatcgagaccatcctggctaacatggtgaaaccccatctctactaaaaatacaaaaaattagccgggcgtagtggcgggcgcctgtagtcccagctactcaggaggctgaggcaggagaatagcgtgaacctgggaggcggagcttgcggtgagccaagatcacaccactgcattccagccttggtgacagagcgagagtcc

SEQ ID NO: 53875 - DNA, 601 bp, Human
acagtagcttccagctgttcttccctgcttccagtttttccctagttattttccagatggctgatggtgatatttttaaaatgtgaatgtacgcgtggcccctccgtttaaaatatttctagagagggctgggcgcggtggctcacgcctataatcccagcactttgggaggccgaggtgggcggattatgaggtcagcagatcgagaccatcctggctaacatggtgaaaccccatctctactaaaaatacaaaaaattagccgggcgtagtggcgggcgcctgtagtcccagctactcrggaggctgaggcaggagaatagcgtgaacctgggaggcggagcttgcggtgagccaagatcacaccactgcattccagccttggtgacagagcgagagtccgtctcaaaaaaaaaaaaaaaaaaaaaaaaaaagttctgaagaatctaccgctttcacagtactttgaacttttcagcagggcatgtaaggcctcttatatttggcttctttgtgactcttgagcctcaccttccacttttttcttgcaggtgtatttcactccttattggttttatgccactgtgctcttcaggtgtgg

SEQ ID NO: 53876 - DNA, 601 bp, Human
aaaatgtgaatgtacgcgtggcccctccgtttaaaatatttctagagagggctgggcgcggtggctcacgcctataatcccagcactttgggaggccgaggtgggcggattatgaggtcagcagatcgagaccatcctggctaacatggtgaaaccccatctctactaaaaatacaaaaaattagccgggcgtagtggcgggcgcctgtagtcccagctactcaggaggctgaggcaggagaatagcgtgaacctgggaggcggagcttgcggtgagccaagatcacaccactgcattccrgccttggtgacagagcgagagtccgtctcaaaaaaaaaaaaaaaaaaaaaaaaaaagttctgaagaatctaccgctttcacagtactttgaacttttcagcagggcatgtaaggcctcttatatttggcttctttgtgactcttgagcctcaccttccacttttttcttgcaggtgtatttcactccttattggttttatgccactgtgctcttcaggtgtggatcctctggcttgacatacctatttgttcattaatcctcagtaggtttgttttgaggagatgatgcatgtaaagcac

SEQ ID NO: 53877 - DNA, 601 bp, Human
cctctctgaaatgcttccatgctgttcttttgatacctacttctttttctggttagcagagcttcagattacatttctttgcagatacagtttccaggaggatcagggatattagatgaaagatttttgaagaattgatttgcaaagaggataatttctttcagacttacttttccattggccatttttaatgaactgttacatcttcgggctgactgaatgacagtcctttcctcaccacctaaatgtgatgcgaagtcctcctgtcagcatttcttacctccccagatctttgacagtsataaattttgagaaaaatcaaaagttgctgcttatcagaaaaagttctctaatcttttgaaaagactattgaaattcaaatgaggctctgtgtatgttttttctgggtactgctgggcagatttctcaatctcctctttttgagtattagtgtaaggatattctcaggataaaatgagatcattatgaagctttgaattctttagaagcaagtctgttatttttgtcacttttccttttcccacaaaccctgtttttgtcttagaaaataaatagttttgacttcatttgctattcacag

SEQ ID NO: 53878 - DNA, 601 bp, Human
tttctgggtactgctgggcagatttctcaatctcctctttttgagtattagtgtaaggatattctcaggataaaatgagatcattatgaagctttgaattctttagaagcaagtctgttatttttgtcacttttccttttcccacaaaccctgtttttgtcttagaaaataaatagttttgacttcatttgctattcacagaaccatgttgtaggtagtttatatccttctgattaaaaaaaaaatacttgttcttttataactgagaagaattgtgccactgattttgatgattttgagrcagcctcaataaatgatgtgaacaattttagatttctgaagtgggttgtgtttctgatccatccatacaaatatgaatcagatgctgattctatttatgtgtaggaaagtaataaagtagttcatgagttttcaacataatatctgctgataactgtatcatatgttcctggatgtatcattaatcaagaactgtaagatagcactcaactatgatagtaggcaatttatatttgatcagataaactgttaactttttaataagttttaatatgcttagctattatgtttttaaataagg

SEQ ID NO: 53879 - DNA, 601 bp, Human
tcacagaaccatgttgtaggtagtttatatccttctgattaaaaaaaaaatacttgttcttttataactgagaagaattgtgccactgattttgatgattttgagacagcctcaataaatgatgtgaacaattttagatttctgaagtgggttgtgtttctgatccatccatacaaatatgaatcagatgctgattctatttatgtgtaggaaagtaataaagtagttcatgagttttcaacataatatctgctgataactgtatcatatgttcctggatgtatcattaatcaagaactgyaagatagcactcaactatgatagtaggcaatttatatttgatcagataaactgttaactttttaataagttttaatatgcttagctattatgtttttaaataaggtggcaggttttagaatttaagtgtgttcttttaaaaaatgcacttaaaaaaaaaacaacctgcttggctaccagtcagtgagaatgatgaattaattattaaaatgcactaccagaccaaagtaataacatgctttccttttctaagatgaagtaagtgatattgttcagaatgactcactcaatattcttgggc

SEQ ID NO: 53880 - DNA, 601 bp, Human
aagctatttgtgaaaatgctttgtgatgtgtggattcatctcacagagttaaatgtttgttttggtaaaacaggttgttttgataaaacaggataaaaactctgaacactgaagctcagttaagcattctggtaggtgatacacattgtggtgatacacactgatgtatttggagggtgatgaagcttcctagcacagaagctttatgtttggaaccctcccagatctagctccatacaggtggttgtttgtatctgggggtctgcattcatggattcaaacaacagtggatcaaaacttrtagaggaaaaaatatcatgtctgtaccgaacacatagagacatttttcttgtcattatgccctatacagtatagttatttacataacatttacattgaattaggcatgataagtgatctagagaaattaaagtatataggaggatgtgcaaaggctttatgcaaattcaatgccattttatattagggacttgagcatccatacattttggtatctgtggaagatcctggaaccaatctcccatgtataccaagagacaactgcgtatctctattggctggtcctggtttgtgttttttg

SEQ ID NO: 53881 - DNA, 601 bp, Human
tacattttggtatctgtggaagatcctggaaccaatctcccatgtataccaagagacaactgcgtatctctattggctggtcctggtttgtgttttttgtgataaaactctaattgtaagtatagtactttctatgtgagttgctatggtgaattatcaatcctgaagggtagtgggaacttccagtttgtatccagttggtcagaagtgcctggggaccccagagcttgtgtctgaggtttgaagtgaagggagtcttatggagagctgtgtcttcaacctgtgaagtctttgctgactrggtagttagcatcagaagtatgctagccctctgggtagttagcagtgcattgtagagggtttctgcatttgaaagttaagtttgaaaaccattaaaccaggtattattgttattattattattattattatttttgagacggaggcttgctctgtcacccaggctggagtgcagtggcatgatctcagctcactgcaagctccacctcccaggttcacgccattctcctgcctcagcctcccaggtagctgggactacatgcgcccaccaccaagcctggctaattttttgtatttttag

SEQ ID NO: 53882 - DNA, 601 bp, Human
atagtactttctatgtgagttgctatggtgaattatcaatcctgaagggtagtgggaacttccagtttgtatccagttggtcagaagtgcctggggaccccagagcttgtgtctgaggtttgaagtgaagggagtcttatggagagctgtgtcttcaacctgtgaagtctttgctgactgggtagttagcatcagaagtatgctagccctctgggtagttagcagtgcattgtagagggtttctgcatttgaaagttaagtttgaaaaccattaaaccaggtattattgttattattattrttattattatttttgagacggaggcttgctctgtcacccaggctggagtgcagtggcatgatctcagctcactgcaagctccacctcccaggttcacgccattctcctgcctcagcctcccaggtagctgggactacatgcgcccaccaccaagcctggctaattttttgtatttttagtagagatggggtttcactgtgttagccaggatggtctctatctcctgacctcgtgatccgcccacctcggcctcccaaagtgctgggattacaggcgtgggtcaccgcgcccggctaaacc

SEQ ID NO: 53883 - DNA, 601 bp, Human
atttaaggtcaatgtgttactatgactttttgtggcttcatattgcagatacatgagtagtcttatcatttttttgagcacttagactgagagcatggttattgaaataattccccaaagtaaaccttattattttcaagggatttacaatatattaccaaaacttgagcaatgataggtaaatttgagctagttctcctcttttccctcttccaaactgcttttacatattggtgatagattaatatttttcaaaaaagtctaggtcttgttgttttatttccttatttggaactcttgrcattctgatgtttcttgaagcagtgcaaacacctgagatagtattttaggtcttaatgttgttctcttattattccaaattttcacaaagtagtctgtatttcagccagcctagattcttcattatacttcttttctgttttgatgactttactttttactttattcacttaattagaaacagattaattcattattctgtcctcttcttattttctaaatacatcgggaagcccttcctgattctcctcttctctctctccaggatctttacctgtctttcaatttgctttgggctttg

SEQ ID NO: 53884 - DNA, 601 bp, Human
tcctttcttagattgtaagctacttctggtagggtatggcgtggactagaaggctattccattttgctgaatatgtgttcaaattttataattgcctgcaagtaaatcgctttattgagatcatgaattgtttggatctttgtattaattcttatgcaaggaattaatctgtgtgaataacctgcttttgctatcttctatgttagaagattttagggtagctaggtaggtaccctacctaaccaatacctattggttattatccacttggtctttactagatgcttattttagttgtccrgtggtagtgactaactagcaggtgatgctgtgatatatagcaggtattatacacctgtaaaatatttggtcagagttgactgctttttattttctgcgattaaactcacttgacgtacttctgctctcagtagtaggtcaaaatgaggaaataagtgtactctgttgatctaggcaacagggcatggaggagagtatggaaacaagaatttcattatcacttggtcaagaccaaccattacagataagaatcttggtatgagtcatttccactgtccccccaacccatctgtgtttaaaa

SEQ ID NO: 53885 - DNA, 601 bp, Human
ttctttttttggtctttttctttatcttccacattagaaggtagtttcctcacgcctgcaatcccagcactttgggaggccaaggtgggtgagtcaccaggtcaggagattgagaccatcctggctaacacggtgaaacccgtctctactaaaaatacaaaaaaattagctggacgttgtggcatgtgcctgtagtcccagctactcaggaggctgaggcaggagaattgcttggacctgggaggtggaggttgcagtgagccgagatcgcaccactgcactccagcctgggtgacagagygagactccgtcttaaaaaaaaaaaaaaaaaaaaagatagtttcagatagcttgcttgtttgcccatggctaatactggagaaatcaaaagcacattggaagttctgatcatgtggttaggtctcattgacttttaacttcactgtaggttggtctggtgggccattgactatggaattctgcctctccactcctccccctgcaatattactgtctttaggtctttcctcttgggctgacatagagcccccagaaaagagtcttctgatttcttggagggtaacggtacaaatgttgaatc

SEQ ID NO: 53886 - DNA, 601 bp, Human
tcagccttgcatacctgggatgaatcttaattggtcatggcatatgtaattctttttatacattgttggattcagtttgctgatgtttttgtaatcggtggaaggtatctgagttactggcagtgagtctgtatgggtctgcaccaatctcagttcttgcctcctcagaagaaagaattcatctaaggggcgtaaggcagaaaaagagatgaagcaagtttcagagcaggagtggaagtttattaaaaagctttacagcaggaaagaaaggaaagtgcccttggaagaaatccaagtgggygacttgaagagtaagtgcggtttttaactttgatcccaggactctataggttggcccctttcctgtgattcttcccttagagtgggcggcccacatgcgcagtgccctccttatacttgggaggtgagcatgcacagtgtgtttagaaagttgtatgcatgcccatcggaggcttttttcccttttctggtggagtgccccaggaaggtcgtatactgccattttgtctcttaatgcccctgcctgggctcactcactcagtgcctgagattttattggagcccccttttttgcttctcc

SEQ ID NO: 53887 - DNA, 601 bp, Human
ttcatctaaggggcgtaaggcagaaaaagagatgaagcaagtttcagagcaggagtggaagtttattaaaaagctttacagcaggaaagaaaggaaagtgcccttggaagaaatccaagtgggtgacttgaagagtaagtgcggtttttaactttgatcccaggactctataggttggcccctttcctgtgattcttcccttagagtgggcggcccacatgcgcagtgccctccttatacttgggaggtgagcatgcacagtgtgtttagaaagttgtatgcatgcccatcggaggctttyttcccttttctggtggagtgccccaggaaggtcgtatactgccattttgtctcttaatgcccctgcctgggctcactcactcagtgcctgagattttattggagcccccttttttgcttctccctggtgcctgcattcatttaacactttaatgtttaacacttgtggactgttaggagcttctctctccttggtgcaagctgccaatttatcacttttagagaggcaatgtgataattgctgaatcacccaacattcctagtgggtgtgggagaaccctctcctgccctgctcgtacct

SEQ ID NO: 53888 - DNA, 601 bp, Human
gaaagtgcccttggaagaaatccaagtgggtgacttgaagagtaagtgcggtttttaactttgatcccaggactctataggttggcccctttcctgtgattcttcccttagagtgggcggcccacatgcgcagtgccctccttatacttgggaggtgagcatgcacagtgtgtttagaaagttgtatgcatgcccatcggaggcttttttcccttttctggtggagtgccccaggaaggtcgtatactgccattttgtctcttaatgcccctgcctgggctcactcactcagtgcctgagattttattggagcccccttttttgcttctccctggtgcctgcattcatttaacactttaatgtttaacacttgtggactgttaggagcttctctctccttggtgcaagctgccaatttatcacttttagagaggcaatgtgataattgctgaatcacccaacattcctagtgggtgtgggagaaccctctcctgccctgctcgtacctgtcttactacctgtaacattttgttgaggatttttgcatttatgttcatgagagatattggcctatagttttcttgtaatgtttttgtctggt

SEQ ID NO: 53889 - DNA, 601 bp, Human
gcggtttttaactttgatcccaggactctataggttggcccctttcctgtgattcttcccttagagtgggcggcccacatgcgcagtgccctccttatacttgggaggtgagcatgcacagtgtgtttagaaagttgtatgcatgcccatcggaggcttttttcccttttctggtggagtgccccaggaaggtcgtatactgccattttgtctcttaatgcccctgcctgggctcactcactcagtgcctgagattttattggagcccccttttttgcttctccctggtgcctgcattcawttaacactttaatgtttaacacttgtggactgttaggagcttctctctccttggtgcaagctgccaatttatcacttttagagaggcaatgtgataattgctgaatcacccaacattcctagtgggtgtgggagaaccctctcctgccctgctcgtacctgtcttactacctgtaacattttgttgaggatttttgcatttatgttcatgagagatattggcctatagttttcttgtaatgtttttgtctggttttggtatcagagtaatgctggcctcacagaatgagttaggaagtat

SEQ ID NO: 53890 - DNA, 601 bp, Human
tggcaactattctgatttgttgttaagacttgattatactatagttttgtgatttaaatgtgattatgtatcttttaaagatttgaaaaataatgtttctgcaatcccctttacaatctacagagaaagcaaccagcgagatgaatactgctgaggactggggcctcattttggatatctgtgataaagttggtcagtctcgcactgggtaagtatttagcgtttcaaaggatttttattctttctttttaaaaaacacgaaaggccaggtgcagtggcttgcacctgtaggcccagcccytcggtaggatgaggtgggaggatcgcttgagcccaggagttagaggctgcagtgtgtgatgattacacccatgaacagccaatgtacacgagtcagggcaacatagtgagaccccgtctcttaaaaaagaaggatcaggaggtaaagtatattagcattaaatttagtttaaaaagagaatatttttattaaaaagatttgaagaatcatctcatttagtttatataccttttaaccagttagggtaacatggctggtaaaaagttgatgctttaatcaccctccttcatattttcttct

SEQ ID NO: 53891 - DNA, 601 bp, Human
tgttttaaacctactttctttcagtttttccatttctattaatgacaagatgattctttcattgcactaaaacttgagtcaccttcacatttattactcaattctgtccatctgccttcataatctctcaaaatgttgacgttttaaagtctccttaatcaagtttttgagcatagccaaatggtgcagaggcagttttcttcaggggctgtataccctccactctagctttttttggcccataatgtcctcccactatgacgttcccaaagaatctcccaaatgtggtcccatccatccctttgttgtatttacattttagtatattctgacctggttcattaatttaattgaaaatttttaactactgtgtgttacatatcgcgttcccttttctccatttttatttgtcctactttactttggacgttccttaccttgcctaggctagcgaattaacccactggcattttttttctgtttccatctcttttctaattcttatatccagttgccgtataacagctgtgttcatgttactcccctaccttccatactgagttcagtttaagctccttagtcttctgaatcatgcattttc

SEQ ID NO: 53892 - DNA, 601 bp, Human
taatttcccatctctgtgtctcatatcctttcagacccaatgtagataccacttcttccacaaagcctttccttatcccctttactgacaatggtatgatcctctgaatcctcaaagcactctatcaaaactattcttatttgtgttttttcctgcattttagtaacttatatctaatgaactgaagtttcttagatataaacctagtagatttgtagaatgaatggtccatgaacttctgttgcacatgggaaagaagcaaatagcttagtggtggagatcatgtactctagagggagawtgcctgggttcaaatcttggctctagccatttagctatgtcatactgggtaagtaacttatctttctgggccttacttttccagtttaccacctaagaataataatagtatcatcttcataggggagttgttgtgactttgagattagctttatcaagtgtttataacagtacctggcacatggctgaatgagtgcaactctgcctgcttttgattgaagtcatattttgtgacagtttctgttgaagactgggcaccaagctagaccacttcatgtgcattttggagataaaagtttta

SEQ ID NO: 53893 - DNA, 601 bp, Human
aattagtaatttttagtaattatctcaatttcagaaagcctactagatgtaatccctgtttacttcatttaagttgtagtttctttttaaatcttgaaatacttgattataccaaacctaaaactttaacaaacattctgaaatttttttctaacgtctcaagatattcacatgatttctactgcgcaatttccagtgtgtgagtaactagtgaagaatgcccagccaattaggtcatatgatgggctgaacagccttcatttgtttagaaatcaagagaactttcacaatgataatagcmgttttctttaacatgtcttcacataaataatttttctatgttagtgttgattgatttgtttatatttatgtaaacatagacgtgaggataaatactgattatcttcaataacaagttaaaattaaagttctgtaattgacctctagattaagttttgctgttattttatatgttaactgtctttgcttagctttagccaaagatatagttgactaaaggtggaaaacatcatgtaactttttctttacccgactaatggatatgttttggtactaaatttattctaacagaatgagaaag

SEQ ID NO: 53894 - DNA, 601 bp, Human
tactgattatcttcaataacaagttaaaattaaagttctgtaattgacctctagattaagttttgctgttattttatatgttaactgtctttgcttagctttagccaaagatatagttgactaaaggtggaaaacatcatgtaactttttctttacccgactaatggatatgttttggtactaaatttattctaacagaatgagaaagatcatatgatagtcattattggtgttttgtgaaaaatacaaatgtaagcctttgggaaggagtttgttaaaaatgtttttccttggctttgtttttttttttttttttttttttttttgagacagagtcttgctttgttgctcaggctggagtgcagtggcacgatcttggctcactgcaagctccgcctgccgggttcaccccattctcccgcctcagcctcctgagtagctgggactacaggcacccgccaccatgcccagctaatttttttttgtatttttagtagagacggggtttcaccgtgttagccaggatggtctcgatatcctgaccttgtgatctgcccgccttggcctcccaaagcgctgggattacaggcatgagccaccc

SEQ ID NO: 53895 - DNA, 601 bp, Human
caagttgttgactaggcaatagggaatgggatccgatgcgagctgatttttctatctttacttgcctagacaatgattttacttttttattttactaagtcttaaaaacatcgtatattttatagaatgagacttatagaattctgatgactgttgtgcttgttttgcagatgagaaaactaaagccctgagatttttaatgtgacttgtctaaaacgagtgagcagaggcaaaattagaagtcagatttctttacttcccattttatgtttttttctaccttcactgtgctgtgtgcttmggtgcttgtatgagcagttatatttgaaggttaaaattatgaatcaagacataccaatcttacattaaagtttttggtgattcctctctccccatacgttatgttacattgtgttttgtttgactgaaatataccttagtgttacatggtctagaaaactcaaaatatcatcgtactgaatttaatcctcaatattttagttcagcatgtagaagtttagtttatctgcttttctaatgaagtcctttgggacttacatgaacatgtttgttaaataatagtcaaataacatcactgtat

SEQ ID NO: 53896 - DNA, 601 bp, Human
aatcttcctgtcactgctcggcatatggtttttatgatactaaaaagtacttttcaactgagatatagagctatttgaaataggagaattttcaaaagttttatacagcataggatgtcacaaatcttgactcctttttccaacaatagctttaaatattcttggcttcctcctatatagcaatggaaataccttttcagataatctcactaactggtgaccgcgcctaacattgagctatagatctctcataactgtacaacagtatacctataagtagatagacatttgtaaataatayagtgacattgttgaaaacttactgtgggccattcaaagacatttgaaatttcacttttcttggaaaagagaattgcaagaatgcaaaattgcttttagttttccttgatcctctgactgtagaattgagctgtatcatatacatgtttaacctactgaatttaactgtattcttttccagcctcctcagattttttcccaaaaaacttgtgcctgccaattcatttagtgagcttgtatgtgctgtctcacaattacaattcccacttttctcatagcatcaataccttgctgtgctgag

SEQ ID NO: 53897 - DNA, 601 bp, Human
aataggagaattttcaaaagttttatacagcataggatgtcacaaatcttgactcctttttccaacaatagctttaaatattcttggcttcctcctatatagcaatggaaataccttttcagataatctcactaactggtgaccgcgcctaacattgagctatagatctctcataactgtacaacagtatacctataagtagatagacatttgtaaataatatagtgacattgttgaaaacttactgtgggccattcaaagacatttgaaatttcacttttcttggaaaagagaattgcargaatgcaaaattgcttttagttttccttgatcctctgactgtagaattgagctgtatcatatacatgtttaacctactgaatttaactgtattcttttccagcctcctcagattttttcccaaaaaacttgtgcctgccaattcatttagtgagcttgtatgtgctgtctcacaattacaattcccacttttctcatagcatcaataccttgctgtgctgagggccattcttgctcggagcatgcatattttatctaacatagtcctgtatgcaagccagcttcttcagctgttgctcaa

SEQ ID NO: 53898 - DNA, 601 bp, Human
gtgtcttacaaaaagttttaaaataccaaaatggggttttaagaagctttttgagagagatgaggatttgcccaccctttaaacaggtaggtgatggaaacctttggtagactcttctaagtgcacgtgcagattttctcttaccatgtatttttacaaaatattttgtgtttattgccacccgtctcttctcacatcctctgttcctcccagcactacttattgtgcgttttccccctcatggctttattatagttctattaactacattttatgaaaggatgtatgttttccacttagygaactcagtggaagatacacagaacttggtaataaatagaactttataaggaagatgacttattctaaatattagttgtacaatagtgaaaagcagtatttttcgtgttttgctcagtgacttttttttgagcatcagccacgttgaaggcacaattctaggccccattcgcaatgacagtgttttaacttcagtcacgggagagcaacagcagttgctaaataattcttattttcattttctcaaatttcagttgacagtttattatgtgccagagggcatggttaaggagtggcatgc

SEQ ID NO: 53899 - DNA, 601 bp, Human
gagcatcctaagagctagtgctccaggagacccaaatgtactccacatggcttcttgtaagttatgtgtctcagaatgtcacttccactatattttattggtcaagcaagtcactgaagtcagtccaggttcaaggggagggttgttagatgtcacctcttgaagggaaatggtaagttcatgtcaaaggaattattatcatagttatctttggaatacataatttgcctgaggcctgttagttccataagtgttgaatcagaactttgaacttaacaaaacaatgaaaaataccattagraaaaaataattctaataaacaaaattataaattccacttttgatacttgagacactcaatccttaagaatggaatgacaaaatgtgatacaagggtttcttcatttttaaatctaacatttaattatgacttttgacatggaaaaaattgttctgtgttgaaagatgtacccatttgtgtgtatttataaatatgaacagctgacagatagggaatcttaactgattaggtagtcatgaagattttctttcatggtgccttttcatcgcttggttttagacacatggcctgatacagctt

SEQ ID NO: 53900 - DNA, 601 bp, Human
ccaaacctttttaaaaagtagtgttttaaccatacttttaattacttggtaagatttaataattatacatatatatatatataaaagttcagtattacctatctggtggaaatactaaaaactgaattaaaaatgcataggacagaatgaaacagttcataatagtggttaagttctgttttgtagacagttctgaagggatttttaagctagtatgtaaaaagatactgctgtgtttgcacaaacaaggtgttcatcagcgcttcattcttactggctttgcagctctgtccttttaatkgttcagtagccaattttattttggtgccagagatatctttgctttggtttttacaattggctgtggtaaaacaacataggaatgtctaaaataaaaaggaatagtttcatttcaacacccctttccccaccatcctttccaaaagtcacagtttaggtttcctaccttaaaaaaaagtggtttataaacaaaatacataatcaattttatttaacatttggtaaagaaagtatacaggattattttctaaaatattgagctgaatcatctttagattattttttactgattttaatttta

SEQ ID NO: 53901 - DNA, 601 bp, Human
aaactgaattaaaaatgcataggacagaatgaaacagttcataatagtggttaagttctgttttgtagacagttctgaagggatttttaagctagtatgtaaaaagatactgctgtgtttgcacaaacaaggtgttcatcagcgcttcattcttactggctttgcagctctgtccttttaatggttcagtagccaattttattttggtgccagagatatctttgctttggtttttacaattggctgtggtaaaacaacataggaatgtctaaaataaaaaggaatagtttcatttcaacamccctttccccaccatcctttccaaaagtcacagtttaggtttcctaccttaaaaaaaagtggtttataaacaaaatacataatcaattttatttaacatttggtaaagaaagtatacaggattattttctaaaatattgagctgaatcatctttagattattttttactgattttaattttagtattcaaataattctttatatctggcctttaccatgcattgaaatgattgttttgtgtttttatgtcggcatggtattcacaactgcaagtcagtatggggtcacggaccctggctc

SEQ ID NO: 53902 - DNA, 601 bp, Human
tatctgtgtccagaacatagcatgtttaagtgacaggtatgaatcttgttagtgcctattactgcctggtaactggcatcatgggcaaggaactgaacttcagtaaatggaggacttggtttgctgtgaatgttttgaacactgaatgagtcctttgcttattatataatttttgagagcctaagcacatgatgtttcgtaggttatatgaatgattactctgctttactattatcattaattaccataaagcatccccatgaaatgcatgtttgctacattcttggcctgtcatttaaayagatctgtttttactgacctgtgatttatctacaacaaagagcatcccttgtatgtgtatggtttgatagtttgatgagttttgacaaatatatatacctatataagtatcaccccaaccaagatagcatttaatcactcccaaaagttccttccaccttatgcaagtactaatatgcattgtcactatagattaaatttccttttctagaatttcataaaatgaaatagtattgtcagtactcctgtgtctagcactaaatgtgtttctaagatgaattcaaatttttgtatgtatcaa

SEQ ID NO: 53903 - DNA, 601 bp, Human
tctctttctgtcttttgtgtatcaatcaaatggtttttatggttttatttttttgatttaaaactttgttttgagacagggtctcactctgtctctcaggatggagtacggtggtgccatcacagctcactgcatcctcgacctctggggctcaagtgaacctcccacctcaggccattcactgcgcccataggagctgggaccatttctggctaatttttgtattattttttgtagagatagggtttcacagtgttgcccaggctggtcccaaacttccggactcaagccatctgcccayctcggcctcccaaaatgctggaattataggtgtgagctgctgcacccaagctattttattttcatttttctcttaaaaatatttgtagtggtggctctgtgttaaattttttcattttttttctctctgtacttcagtttgggtactttcagcatattttcaaatttactgatctttcattcttacctgattaattccatccactttttaattttacatatttttttgtctctagacttttatctgggccctttttaatatatttcttcatcattatgtggatgatttccagcatgctta

SEQ ID NO: 53904 - DNA, 601 bp, Human
ctttcagcatattttcaaatttactgatctttcattcttacctgattaattccatccactttttaattttacatatttttttgtctctagacttttatctgggccctttttaatatatttcttcatcattatgtggatgatttccagcatgcttataatagcttatataaagtccttgactgctaatttcatcatctttgttatttctgcattctcagttgactgaattttctgctagttgtgtatggtagttttcttcttcatatcatgtcttcatatcattttattgaatgcttagtaytttgaattttatatttttgagcatcaggtgttgtattcctgttaaggagtattggactttattttttcagaagtggttacattcgtctgtggcttatgttgttaggcagtatgtaggtatgattgagctgcattgctagggtctaaactcccctgtatatccactgaatcctctggattttcaatagatgcttcactgtggcctcatctctgacaactgtgtgagcgttggatctctttagcatatcgccctcggtcactttttgaccagtttcatggagtttttcacctgtgcatgcgt

SEQ ID NO: 53905 - DNA, 601 bp, Human
cagttgactgaattttctgctagttgtgtatggtagttttcttcttcatatcatgtcttcatatcattttattgaatgcttagtactttgaattttatatttttgagcatcaggtgttgtattcctgttaaggagtattggactttattttttcagaagtggttacattcgtctgtggcttatgttgttaggcagtatgtaggtatgattgagctgcattgctagggtctaaactcccctgtatatccactgaatcctctggattttcaatagatgcttcactgtggcctcatctctgacractgtgtgagcgttggatctctttagcatatcgccctcggtcactttttgaccagtttcatggagtttttcacctgtgcatgcgtgggtttttcagaaggtcttcactgatacttggaaagtgcctctaggcagaaagttgaggcaaacttctggcttatctaattcattttccttcttggatattatcattcagtactgcctgtggcctcatgtctttaaaaagttaacctcagtgtggaaaatctgtttttccagttttctaattgtttacaacgggagtgtaagtctggtctgtttt

SEQ ID NO: 53906 - DNA, 601 bp, Human
tgtggcctcatgtctttaaaaagttaacctcagtgtggaaaatctgtttttccagttttctaattgtttacaacgggagtgtaagtctggtctgtttttccaccctggctggaagtggaagtcatggcctaccattttattttcaaacctttttttttttcctacccagaattagcctgaaatgcctcatctacgattactaataagagagcctgttaattttgtttgaaaaatttaaaggaactagtttacagtttttcaaccgtgttattaataaaaattaaatttccctactttatcrtagtctccctttttatcgtagtcttttgtctataacagttaaggggcagggggaagctagatgtattattaagtaatttttacttttctcatttttttagacctaaggattgtcttcggtctattatgagaagagtgaaccacaaagatcctcacgttgctatgcaggctttgactgtgagtggtttcattttaatctgtaccacgaaattacctgccacaattgagcccctttaacttctgattttgtgcttttagcttctaggagcatgtgtatcaaactgtggcaaaatttttcatt

SEQ ID NO: 53907 - DNA, 601 bp, Human
cccagtaaaaatttgtgcattctaaaagtaattatttttggcctttttagggggagtactgtaaatcaagaaaaagtttttgtatgttaaaagggaaaatgcctcatgtttttgggaaaaatgaatagttccaggttacagtagaaaaatagcagtatagaaatatagtaagaatgtaaaattctgtacttttcgaacatcatggttaaatgataattctttccctttcctgctttatgcagttaatatttattttctactaattaataaacattgtcttttaatgtcctgaatgtccatygagattacaactgtttatgaagagattctaataccatgttttttgtaatgtaggtgaaaaatgtggtatacttacctatgtataatagtgcaagcagccatttccaaaaacgacttcctataggcaagaggacttctctttattttctgaatgttttacagtgaacatattggttttgtacttaataacatcccgccttttttttttttttttgagacagtgtctctctttgtcacccaggctggagtacagtggcgtgatctcagctgactatagcctctgcctcccgggttcaagtga

SEQ ID NO: 53908 - DNA, 601 bp, Human
gttatgttattttgaagaaattaaattttcaaaatgattaacatgcagtgtacctcaaactaggccccagataattaagcatcatggaaaaaatgcatagtcatgaacattaagaagtcaggaatttggaataaaggaactgtatcatttattctctccttcccacttttttattgctttgcaaaaagcagacacttttccttgtcttactgatgtacaaaccttgcttcgttgcaaaatattctgaaaagtcctttcagatctccaaaatcttattacctatttaatgctttaatttgamgtgagatatatatgatgggttttttcatagtgtgaacattagttttatttcgaataactatattttcttgtctatagctatgcataacttgtgattcaaaaaacatcacttaataactttactatttaaaatgtctgtattaaatcattggctaggaaattggtgctcttttatttctttttctattttacagggtcatcctaaagtatgtgaaaaattaaaggctcttatggttgaatggacagatgaatttaagaatgatccacagcttagtctaatatcagcaatgattaagaacct

SEQ ID NO: 53909 - DNA, 601 bp, Human
gcaaaggacatttttcttcttaaaaaaattttggtttaaaattttcttaaaaaaattatgtctttgaaaattcattcattcataactgatagctggtttttactactcagtatagtttctagaatctgtataattaaggaaaaatcttaaacagaataatccaagacattatacattccttgacaacagaaacaatgtttatttatcaaagagtagactcactgcagagaacccacctagaataggtagagaaaatgcaagcccactaaatatctagagtctttggttcttgttaactcaraacttggtttgaccagcatcactggcattacctggaggcttgttagaaatgcagcatggttgaacccactccagacctatgggttcattatctccattttaacaagatcttcagaggatttatatgcacgttgaggtctgagaagcactgctgctctagaggacagccttcagtgcaagtgaaaactgcgtttcagtccacaaagggacttactcttgtaagaaaaggaagaattaatgattgtgccatatgtacccttgtttggttaatctagaatcttagccacggaaacagttttag

SEQ ID NO: 53910 - DNA, 601 bp, Human
tagaacacaggcatgctgattctcagtccagtgttcttttcgctgcccgagtctgccttctttgttagagaggttagtgaatatgtgtctgtctagaccaggcttccagtggagtgaatgctggcaagagcattatgtcttgattggtagagaaactagcttattctcttgttcaagaaattcaggacatagaagagcaatagtaaagataggacttaattttcatcctttgatctagatgttataaagtatgtaacagctaatcttgtcatagtggctatatttcacctacaagaaatayatataaagtaaaatatgatgaggtagaatgatttttttagtggtttctgaaaagcttattagaaaccctacatgtaaagagcttcacattaaatgaaaaaaataaatcatctaagttcaactgcagaactccctgtagattttaaagccacttagttacttaagttattactgtgttttcatcagactagatttttgttagggcatacttaacaaaaacctctgaagatatatttttctaagtatatttttttcatctgagtacagaagaaaataatgtaaaaatattaagaaaagtgat

SEQ ID NO: 53911 - DNA, 601 bp, Human
ttcatctgagtacagaagaaaataatgtaaaaatattaagaaaagtgataaagtcacctgactcatactgatgcagttctgttagcactaacttttgatgtaaagatagaagtaggctagcagcaccgctaccgtagttggctgcttaataagacaagtgttattgttacatttagaacctgatgatagaaaggaactttgaataaaaagtgcagttcagaaacatgcggcttcacatagcttatttctgcgcttctctactggtagagatttcttcacacaccataaaagttcaaatctrtctaattgtgaagtttgccaaattgtgaacaaaaatttatgtaaaccgtaaaacttatttctgaccaggcatacctgtagttttcagaagtgtctgataattaaaacattatctaaagaaaattgcaactagagataggtcagaattgagagtgtttaaagttgtattctgtgaacaccaaaaagtttttttcttctcagctcttctaaaaataaatgcctggccgggcgcggtggctcacgcctgtaatcctagcactttgggaggccgaggcgggtgggtcacgaggtcaggagatcg

SEQ ID NO: 53912 - DNA, 601 bp, Human
atttagaacctgatgatagaaaggaactttgaataaaaagtgcagttcagaaacatgcggcttcacatagcttatttctgcgcttctctactggtagagatttcttcacacaccataaaagttcaaatctgtctaattgtgaagtttgccaaattgtgaacaaaaatttatgtaaaccgtaaaacttatttctgaccaggcatacctgtagttttcagaagtgtctgataattaaaacattatctaaagaaaattgcaactagagataggtcagaattgagagtgtttaaagttgtattcygtgaacaccaaaaagtttttttcttctcagctcttctaaaaataaatgcctggccgggcgcggtggctcacgcctgtaatcctagcactttgggaggccgaggcgggtgggtcacgaggtcaggagatcgagaccatcctggctaacatggtgaaaacctgtctctactaaaaatacaaaaaattagccaggcgtagtggcaggtgcctgtagtcccagctactcaggaggctgaggcaggagaatggtgtgaacccgggaggcggagcttgcagtgagccaagatctcgccactgtact

SEQ ID NO: 53913 - DNA, 601 bp, Human
gaattgagagtgtttaaagttgtattctgtgaacaccaaaaagtttttttcttctcagctcttctaaaaataaatgcctggccgggcgcggtggctcacgcctgtaatcctagcactttgggaggccgaggcgggtgggtcacgaggtcaggagatcgagaccatcctggctaacatggtgaaaacctgtctctactaaaaatacaaaaaattagccaggcgtagtggcaggtgcctgtagtcccagctactcaggaggctgaggcaggagaatggtgtgaacccgggaggcggagcttgsagtgagccaagatctcgccactgtactccagcctgggcgacagagcgagactcaaataaataaataaataaataaatgcctgtgcatttgtttgacaacacgaaatccagttaagtgaggaatgtagaactgtattttattataatgttgaatatttttcctttcataccctcaacaaacattgattgattgcttgtaatatttaggcacattccctcagggaacatacagtctggttgtggagacagacatgtaatcagacaattataacagaagctgagattattgcctgttacaatg

SEQ ID NO: 53914 - DNA, 601 bp, Human
actttgcatctgtagaggtctgtttacactgtagttgtcatgtgtattacctctacatacgttataagccccggaggtaatgttacatactttttgttttaaaccctgaatgagcccatctcatctgattttggaatcacatgtgttaatttaatactttaaataggctgtgaggtgcccatgaggtgtaggtgctattatcgtagtcattttattgatgaggaatttgaggcaccaagaggctaatttgcccagtgtcatccagctagaaagtggtagatctgggatttgaactcatgtytgtctgactccacaacttacattcttaaccactcatatcgcagtaccttgtttaaaggtgttatcataataacaaacaagagaatgtgtaattaacaggttgagggatgcttcattgacagtgatattttagctgattactgactgatgtgttcaaactcaaaagggaaaaagtgaacggagcaaaggagccatagggggagaacgttgtaagtagaagtaaatgagtgtgagacctgtaaagtaccggtatagagactgctcaggaactgctagcagtttctggtaactggcagaatgg

SEQ ID NO: 53915 - DNA, 601 bp, Human
actttgtaatggcttttgaaaaatattgttccctacctcaaggtcctaaaagatagttttctgtattgacttttagtagctttaaagttttgttttcgtattgtttcttttattactctaaaacaagagcggaagagcagaaagggttctgtgttgaattgaaagcaggataatcaatgcactgatattacatttcagagcctgagtgacatatggtgatggtctgcacttgggaagtagtggtggagatagagacacgtttgagatctattttggaggatttgttaggttgagtctttasactggtaagaattacccttggagcaataaaatctcgattctccaagattgcctttaaggctttgatttattaagtctgcagtgaagcttgatattcttgactttccaggcagttttgatgattattttgaaaaaaaggtcaaggaaaatatctgcagctaaaaaagaaaagtagatttaagagtttgtattttttattacccagaataatttacattgtatttgttcagtaaaaataggagttttcatgctgttccaattttgttaatttatttttaaactttcagttgtgaatgaatga

SEQ ID NO: 53916 - DNA, 601 bp, Human
ttgagtctttagactggtaagaattacccttggagcaataaaatctcgattctccaagattgcctttaaggctttgatttattaagtctgcagtgaagcttgatattcttgactttccaggcagttttgatgattattttgaaaaaaaggtcaaggaaaatatctgcagctaaaaaagaaaagtagatttaagagtttgtattttttattacccagaataatttacattgtatttgttcagtaaaaataggagttttcatgctgttccaattttgttaatttatttttaaactttcagttrtgaatgaatgaataaactgacaaaatgatttttgttcaatgtatcaggatatgttctagtttctaactatactattgaaggaagaataccttttatcttgatgtctttttctacttcttcagactgttggatataataacattttgggtctttaaaaactcattgttttctagccattgagttgtctctcaaggaacaaaggcagcagtcaaccaccctttccactttgtatccaagcacatccagtctcttaactaaccaccaacatgaaggccgaaaagttcgtgctatatatgactt

SEQ ID NO: 53917 - DNA, 601 bp, Human
attgatttaaagttcttcctgtagtgtctctcttacttactgccttagtccatttgggctgccgtaacaaactaccgtagactaactggtttataaacaacaggaatttatttctcacagacagattgactgtgtgttgaaggcccactttctggtttgtagaaggctgtcattttgctgtgtcctcccatggcagcaggggcaaatgagccctctggggtctcttttataaggtcgctaatctcattcatgacttaatcgctttccaaagtccccaccttctgataccattgctttgggkgttaggatttcaacctgtgaattttgggaagacacaaacattcagacatattttaacatttttttttttttgagtggaagaaaataaagtttgagctggttagctggaaattgcccaaaaccttacgtctgttctttcaaaaacatgtattgagtgcttgctagctttccatatactagagtttacacctaggagtgtactctttgcgaatgttttgcactgtgaacagtgtcatctttgacattcgttctgttgggagaaaaaaaaaaccttgctgctgtgtaccagaaagagcaatga

SEQ ID NO: 53918 - DNA, 601 bp, Human
tagcttcttaccttttctgaggcttcttcttcttttgtaataaaggaagattcattggctttttcagtgggttattgtgagattcaaattttgtaatagtgtaagttgaatactacaaaagataaagatgtacagaaataaatacatttgttatggtaaagcattgttttttgtttgtcatagtgatcctaactggtggaaaggtgaaacccatcaaggcatagggttatttccttctaattttgtgactgcagatctcactgctgaaccagaaatgagtaagtattttccagcctgccartaaatgatgttttctaatccttttcttaatggaagttgagtaaactgaactttttagagcagtgttgcccaggctggagtgcagtggtgcgagctcggatcattgcaacctccgcctcctgggttcaggtgattctcctgcctcagcctcctgagtagctgggattacaggcacccgccgccatgtccagctgtttttgtgtgtgtatgtatttttagtagagacagggtttcaccatgttggccaggctggtcttgaactcctgacctcaggtgatccacccgcctcagtctcccaaag

SEQ ID NO: 53919 - DNA, 601 bp, Human
atgatgttttctatgtctgtgagaattcaaaaacatgtcaaccttgtttaaatggcattgcgtagtgtgctgactttttaataacctgggctggtaatgatgttttgtttgtttttggactatttttttgtcctgaatcagttcctggagaggatagaattgcttggagttctgttcaagataaggtcaaggatctcatgtagatcctggagccatttcatctttttttttttttaagtcatatagcaatgcagcttcaatatgagttttctagtttttctcatgtttttcactctggacratctaaaagagaaactgaagcatcagagcctatgtagtggggttgtagttctcaagcgtggagaacaggtgcaggtgctagcatgatccccagagcatcattcttttgaggaaatagaagtctatttcacttagcctgtcaaagagaaatagctgccctatttagcttgcttttggtttggagatacagtaaaatattgtgaaatccctttgttatatattgtatataaataatatatttttttacacacacatagtattagttcctgtgagaaaaggggttgcaaacttgcgcgtcaag

SEQ ID NO: 53920 - DNA, 601 bp, Human
gtatgggctagtagagcaagatagattggcattcaaatccaggctttgtcatttattagctttctcttttacaaaagtttttaatctttccaaactaccttatttataaaaagggcatatctcataagattgggagattcattggaggaaatgtaatattccatcaagcatattcaatagtttaataaacattatttcccttccttaaattgccccctcctgtcttcctttccatcatgattcttaatatttttatgaattgattgaccacattgatgcaaggattaaaaatatagaaagraagtttgtttagtagagttgtatatgcctttcagtagtatttggaggttgttatatagctactgttatgttaaattgtttttaaagattgctttggtgagtaggagaaatctgtgcttctggccaatgaattgttgatccctcaatgaccactttttaatgtcaaatgataatattatataactagaaaatacaggctgatttgttggaagactgagacccctgtcaaggccacctgcaaagttctccactggcatggacggcgctctctaaacgcctacgtggcacgccagataataca

SEQ ID NO: 53921 - DNA, 601 bp, Human
gtttttaatctttccaaactaccttatttataaaaagggcatatctcataagattgggagattcattggaggaaatgtaatattccatcaagcatattcaatagtttaataaacattatttcccttccttaaattgccccctcctgtcttcctttccatcatgattcttaatatttttatgaattgattgaccacattgatgcaaggattaaaaatatagaaaggaagtttgtttagtagagttgtatatgcctttcagtagtatttggaggttgttatatagctactgttatgttaaatygtttttaaagattgctttggtgagtaggagaaatctgtgcttctggccaatgaattgttgatccctcaatgaccactttttaatgtcaaatgataatattatataactagaaaatacaggctgatttgttggaagactgagacccctgtcaaggccacctgcaaagttctccactggcatggacggcgctctctaaacgcctacgtggcacgccagataatacatagctgattttcccattcattacattggagtagtgtggattttctgtcaaaccagattttttttttctaccaaatg

SEQ ID NO: 53922 - DNA, 601 bp, Human
tgattgaccacattgatgcaaggattaaaaatatagaaaggaagtttgtttagtagagttgtatatgcctttcagtagtatttggaggttgttatatagctactgttatgttaaattgtttttaaagattgctttggtgagtaggagaaatctgtgcttctggccaatgaattgttgatccctcaatgaccactttttaatgtcaaatgataatattatataactagaaaatacaggctgatttgttggaagactgagacccctgtcaaggccacctgcaaagttctccactggcatggayggcgctctctaaacgcctacgtggcacgccagataatacatagctgattttcccattcattacattggagtagtgtggattttctgtcaaaccagattttttttttctaccaaatgagattttttcttgaaggattagtaatttaaaaagagggtttattttaaattgcagaattcacttaggccattgtaaaactttgcttttgtcctccagcttactaaactctgatgtgtagtaggtgattaaccttttttcagaaatacaactcttattattagtgaaatctctttttatggaaac

SEQ ID NO: 53923 - DNA, 601 bp, Human
aaggattaaaaatatagaaaggaagtttgtttagtagagttgtatatgcctttcagtagtatttggaggttgttatatagctactgttatgttaaattgtttttaaagattgctttggtgagtaggagaaatctgtgcttctggccaatgaattgttgatccctcaatgaccactttttaatgtcaaatgataatattatataactagaaaatacaggctgatttgttggaagactgagacccctgtcaaggccacctgcaaagttctccactggcatggacggcgctctctaaacgcctrcgtggcacgccagataatacatagctgattttcccattcattacattggagtagtgtggattttctgtcaaaccagattttttttttctaccaaatgagattttttcttgaaggattagtaatttaaaaagagggtttattttaaattgcagaattcacttaggccattgtaaaactttgcttttgtcctccagcttactaaactctgatgtgtagtaggtgattaaccttttttcagaaatacaactcttattattagtgaaatctctttttatggaaactgtaaaatgtttacaagag

SEQ ID NO: 53924 - DNA, 601 bp, Human
aggagttggtactttgtattgaaatttaaatggttttgctttaagaaaaaattgattacttgagtttttttgttgtaaaaatttttgtatttttttataaaaattcaagcaatatagacgatgcagactgttttttgaaacttcctctccagtcctttgtttgccgtgccagagcctcattattttaaattcctgctgaatattctgtagagtggccttaccatgatttatttaatctattgttgaatgcctaggttgtttacagtttttacagtgtagtagtgagattttttttttttttgaacatctatctttgtgtttctttagggtagatattcaggagtgaaactattgagttgaaggatttgtgtattttccatgttaatagataatgtcaaattgttgagcaaaacaagtttttacactcgtattcatatcatgcgagaactcctgtttcccagcatactcaacaaggatattaagattgtttgcacatgactgaggaagggacactcattgactatctattgaaacaaataaattactgttgtaaaaataaaattgtcattaaattacttctacataaatcattgcataaaag

SEQ ID NO: 53925 - DNA, 601 bp, Human
cagagcctcattattttaaattcctgctgaatattctgtagagtggccttaccatgatttatttaatctattgttgaatgcctaggttgtttacagtttttacagtgtagtagtgagattttttttttttttgaacatctatctttgtgtttctttagggtagatattcaggagtgaaactattgagttgaaggatttgtgtattttccatgttaatagataatgtcaaattgttgagcaaaacaagtttttacactcgtattcatatcatgcgagaactcctgtttcccagcatactcamcaaggatattaagattgtttgcacatgactgaggaagggacactcattgactatctattgaaacaaataaattactgttgtaaaaataaaattgtcattaaattacttctacataaatcattgcataaaagcagtgctaatatattgaatatcattggagatgattcatgattcctccttgtgttgaacactttctagtatttgaggaaaagcttacgctaattttatattaaatgtcttcatatgtcattgtcacacctgaaacaatgtatatttttagtaattatgctcaaaaatata

SEQ ID NO: 53926 - DNA, 601 bp, Human
gagatgattcatgattcctccttgtgttgaacactttctagtatttgaggaaaagcttacgctaattttatattaaatgtcttcatatgtcattgtcacacctgaaacaatgtatatttttagtaattatgctcaaaaatataatatcaacttggtgacacaccatactttttggagccacataatggtacccaaattggtattattgggatttaaatttgagatttcttgaattaagttaatcactcctatttagttaagttttatagaaatatctgctgttactgcatataaagaaaakattaaaactggctacctttttcatctttaagcgtgtttatgaaaaaataaaaagtatgtttgtggttgtctttttctactcaaacttattaccatgttttaaaaataacattaacaactgttgagttaataatacattaaattatgcaactagcaaaccattaaggatttttgaagtgtcacattgtatagatcaggagttggcaaactcttaggccaaatttagcctgttgcctgtttattggaacacagataaatttgtttatatattgtttggctgcttttgtgctgcagtggaaga

SEQ ID NO: 53927 - DNA, 601 bp, Human
ggaaaagcttacgctaattttatattaaatgtcttcatatgtcattgtcacacctgaaacaatgtatatttttagtaattatgctcaaaaatataatatcaacttggtgacacaccatactttttggagccacataatggtacccaaattggtattattgggatttaaatttgagatttcttgaattaagttaatcactcctatttagttaagttttatagaaatatctgctgttactgcatataaagaaaagattaaaactggctacctttttcatctttaagcgtgtttatgaaaaaataaaaagtatgtttgtggttgtctttttctactcaaacttattaccatgttttaaaaataacattaacaactgttgagttaataatacattaaattatgcaactagcaaaccattaaggatttttgaagtgtcacattgtatagatcaggagttggcaaactcttaggccaaatttagcctgttgcctgtttattggaacacagataaatttgtttatatattgtttggctgcttttgtgctgcagtggaagaattgagtagtagcaacagagatcatatggcctgcaaagcctgaaatat

SEQ ID NO: 53928 - DNA, 601 bp, Human
gcaaagcctgaaatatttactggcgggccattacagaaaaagtttgcttggcccttggtatggataatttaaagagaatcttttccgatcctcagttaccatagcattctttcctaaaattgatctgcccgagaacattctctcctaccattttcgtttttacccccctcctctcccttttcaattcttctctccaactttacggaagaaaggcttaccgcttgcccgtagtgaagattactgtggtacattgcctcagagtataagaattaccagggatgatttcatatactggttttgstattaagaaagtcatggctctaatgactagttaacacagctgagatggttccatattttttgtttttaaaaaataggaccaaaatgaattttcagctagtagatcattaaaaataatttttaatgacagaccactgtcattccattccatctttcagaagataccgaaagaacttaatgaaattgctataatagcttgattatatgaacaaaatttctcctcactttcaactataaaaacaaaaaataggaatagaactggtgctgaatcctggctcattttacttttcaaaacttgaaa

SEQ ID NO: 53929 - DNA, 601 bp, Human
ggaagactgtgctaagggcaaggaatccacctgggctaggagaagtgatgtttggctgattgcattatataagaaaatgctggccaggcgcagtggctctcgcctgtaatcccagcacttcgggaggccgaggcgggcagatcacgaggtcaggacattgagaccatcctggccaacatggtgaaaccccgtctctactaaaaatacaaagattcgctggacgtggtggtgtgcgcttgtaatcctagctacttgggaggctgaggcaggagaatcgcttgaatctgggaggcggaaggtcgtagtgagccaagatcatgccactgcactccagcctgggagacagagtaagactccatctcaaaaaaaaaaaaaaaaaaagaaaagaaaagaaaagaaaagaaaatacttgcagaagcagactaatcatctatgtagaaaccctacttctttgacactaaataattttaaatattgtatagtattctgtaagcaaacaaaacggaaaccatctgtgtgttaatggactctcactttcatttgacctttttttgtgtgtggtaggcaaactttcttgacatgtgcttttgttttttaagac

SEQ ID NO: 53930 - DNA, 601 bp, Human
ggccaggcgcagtggctctcgcctgtaatcccagcacttcgggaggccgaggcgggcagatcacgaggtcaggacattgagaccatcctggccaacatggtgaaaccccgtctctactaaaaatacaaagattcgctggacgtggtggtgtgcgcttgtaatcctagctacttgggaggctgaggcaggagaatcgcttgaatctgggaggcggaaggtcgtagtgagccaagatcatgccactgcactccagcctgggagacagagtaagactccatctcaaaaaaaaaaaaaaaaaaagaaaagaaaagaaaagaaaagaaaatacttgcagaagcagactaatcatctatgtagaaaccctacttctttgacactaaataattttaaatattgtatagtattctgtaagcaaacaaaacggaaaccatctgtgtgttaatggactctcactttcatttgacctttttttgtgtgtggtaggcaaactttcttgacatgtgcttttgttttttaagactgcttaaaatgaaaattgtgaataatttacattgaaaattggtatccatttcaaaaaaacagaattattttgacttgggaa

SEQ ID NO: 53931 - DNA, 601 bp, Human
tggtgaaaccccgtctctactaaaaatacaaagattcgctggacgtggtggtgtgcgcttgtaatcctagctacttgggaggctgaggcaggagaatcgcttgaatctgggaggcggaaggtcgtagtgagccaagatcatgccactgcactccagcctgggagacagagtaagactccatctcaaaaaaaaaaaaaaaaaaagaaaagaaaagaaaagaaaagaaaatacttgcagaagcagactaatcatctatgtagaaaccctacttctttgacactaaataattttaaatattgtrtagtattctgtaagcaaacaaaacggaaaccatctgtgtgttaatggactctcactttcatttgacctttttttgtgtgtggtaggcaaactttcttgacatgtgcttttgttttttaagactgcttaaaatgaaaattgtgaataatttacattgaaaattggtatccatttcaaaaaaacagaattattttgacttgggaagagttttttttttttttagcatacttatgtcactttcactctctgatgattaattcgtttctcaagctattttccttttacacagaacatagttttt

SEQ ID NO: 53932 - DNA, 601 bp, Human
aaagaaaatacttgcagaagcagactaatcatctatgtagaaaccctacttctttgacactaaataattttaaatattgtatagtattctgtaagcaaacaaaacggaaaccatctgtgtgttaatggactctcactttcatttgacctttttttgtgtgtggtaggcaaactttcttgacatgtgcttttgttttttaagactgcttaaaatgaaaattgtgaataatttacattgaaaattggtatccatttcaaaaaaacagaattattttgacttgggaagagttttttttttttttagcatacttatgtcactttcactctctgatgattaattcgtttctcaagctattttccttttacacagaacatagtttttaaattttaaataattactttgcttaggattagtagtctttatttgccctgcgtacctatatatagtagcataaccatgtaaaaaccatgcatggagaaaggtttgtaattattttagtagtggtcatggtaaagtagatctgtttggattttttaaaaaacataaatacatatatacttatatatcgtatagatgtgtgtatgtaataatggtttcattc

SEQ ID NO: 53933 - DNA, 601 bp, Human
gcctgggtaacatagtgagactctgtctctaccaaaaaaaaaaaaaaaaattagccaggctggggcatgttccttggtccctgctctcgaaaagctgaggtgggaggatagcttgagcccagaaggtcgaggctgcagtgagccgtgttcacaccactgcagtctagcctgggcaacagcgacaccctgtctctaaaataaataaataaataaataaattctcaaatgcatttgagattatttggaatagctgtttgaaactttctaaaactaatgtttaaaattaaaataaagtttaacrgaatttttttacttggcagttacagcatataatatactaattatgctaatagttttttgttgttgttgttgtttaaaggaaatagcttttatacagggttatgcagcagaatcagccatcacacttttgaaaaaaattacagatatatccatcccactccagacctattgaatcagaatcctcagggttgaggccctttttttttttttttttttttttttttgaggcggagtctcactccgtggcccaggctggagtgcagtgctgcaatctcagctcactgcaagctccgccttccgg

SEQ ID NO: 53934 - DNA, 601 bp, Human
aaatgcatttgagattatttggaatagctgtttgaaactttctaaaactaatgtttaaaattaaaataaagtttaacggaatttttttacttggcagttacagcatataatatactaattatgctaatagttttttgttgttgttgttgtttaaaggaaatagcttttatacagggttatgcagcagaatcagccatcacacttttgaaaaaaattacagatatatccatcccactccagacctattgaatcagaatcctcagggttgaggccctttttttttttttttttttttttttttgaggcggagtctcactccgtggcccaggctggagtgcagtgctgcaatctcagctcactgcaagctccgccttccgggttctcgccattctcctgcctcagcctcctgagtagctgggactacaggcgcccgtcaccacgccaggctaatttttttgtatttttagtagagacggggtttcgccgtgttagccaggttggccttgatctcctgacctcgtgatccacccgcctcggcctcccaaagtgctgggattccaggtgtgagccatcgcgcccggccgaggcccatatttttaaa

SEQ ID NO: 53935 - DNA, 601 bp, Human
gcagtagcgtagatggattcataggggcaagattagaagctgggagaccatggatattaggcaagaaattatgagtatttgttggcaagatacagtgctattaattggaaagagttatttaggagattagcaaataattacacattgggtgacatggttgggagacagctcagtgcagagataagagaaagaagtattggtgaattgcatggttttgccccaggcaactgggtggacggtggaactgtaaattgagaatgattacaataatgctaacatttaaggggtatttagtatgttmcaagcactgtgctgtatgctttacacaaagtaacttattcctcataataacctgtgaagtcggtaaactattacccccattttatagatggggaagctgagacctggagacaaaacggaagtcccacttagctaagattctaaaccagacattctgactccagaacccagcgcatagactctatattacggcaatattatagcccataccattgtcaataatagtatgaaatttgacatctcctaatcaactttatatctcacacatatggagtgatgacaaataatgccttaggtcacc

SEQ ID NO: 53936 - DNA, 601 bp, Human
tgaatttgtgccaagtacaagagcactgaatttcccaacaatagatttataaataacaattggaggaaagtttagaagtaggcagtattttgaaaatttggcagttgctttttatattgcttgttttacatttttaatacaaatgtagggggaattctcagcatcttagtacttctcttcacatagctaacctagtgtcttacagtggaaacgcatgtattccgttggaaacaggaagacaggaagtagaggcagtggataaagacaaccctttgaagaatttttttctttctttttttartgggagcagtgcacaagtgcagggacttgagatgggagtactggcagcggagcggtgggagcggtagggaagctcagtacgtgaggggtgcagctgcagagagttgatcagtgtggtgttggagcgtgtgcttccgtattttcaaggaaataaaagaaatgaggttatgaggccttcccttccactagtcctttgggaccgttcttgtcaagaaccctggtgatgcccatactgctagactcccggtcagttcaccattctcctcctcctccatttgacagttcgtgattccctcctctt

SEQ ID NO: 53937 - DNA, 601 bp, Human; identical to SEQ ID NO: 18601

SEQ ID NO: 53938 - DNA, 601 bp, Human; identical to SEQ ID NO: 18602

SEQ ID NO: 53939 - DNA, 601 bp, Human; identical to SEQ ID NO: 18603

SEQ ID NO: 53940 - DNA, 601 bp, Human
aatacggtttgtttttttgaccggggtcccaaatcgcccccctccatcccatattacatttgtattcttacactttaatccggaaagagggggttaggggccgagggctgtggggggggggggctttatctgctcacattatcaaaggtcaatagcctcctaaggctaggcacttatttactacggagccaggaaaatagaggaacagtaaatctgaggggtttttttccatgtatttgaaaagaaaggcatcttccctcctccatcccttacacccccccctccgccccatagaacaagyttcaattcaggaaaggcctgtggcgtaggttggagactttttaactttttacataagcctgtagacctcctctggcaatgtccctcgattcctccagagtgaaaccagccaatcaagcaacgacatcgccaaaacccaaggcctggcaaccagtacttcaggcaggttcgcgtcgacaggggcaaacctccattctaccctgggctgctaagcacagtggctgccctccagctcttcagggatgttgtcggccccccgcccctcccccaaccagccaaagcaaaccttcgccaactcaag

SEQ ID NO: 53941 - DNA, 601 bp, Human
ctcgctggtgtccatgttaggattaaaatcccttcatgacggcgaggaaaactgtattatttgctttcagggggtacattaggagtccacgtagtatatgctccgcaaacattcgctgattgaatgagaggcgcgggggcggggcggcggagaggggtctgcggccgccaaggccgccagggttaacccaggtccttcgaagaaggttgggaccgagctgctgccgcgtgtgaaggtgtgtgtcgcggctgggggtgccacaacgggccatggagcccacctcccagagggaggaagtctktgcacaccagcgacttgggtcgaacactttcagcccatccactgggccaaagctatttaacaattaatgcgttcctgggggaggccgggggaagtacccgccccttgtcgggacgcaaagccaggcgtcaggtccaaaggggctgcagtgcagtccgatttcagcacggaacccagagccgccgccctgaaactttttaagccagtgacagaggagggtcagtccgtcctcctcctgagggtgaagaccattttatgagttcctttcaggacccccaaagcaagaaaagccaaagaaagg

SEQ ID NO: 53942 - DNA, 601 bp, Human
gcgttttcaaaatgctgaaagcttatccattctacttaacgttgattaagacacatatcctagatctttcaaattccttgtacactgtattaagctcgtcctaacccgagagagccacgctttaaattcgactctcttgtttactttattatcaatcagatttaaatccataaagcctgtagaatcaacaaccttgagctaattatatatgaaatatgccttaatgaatttccatacaattaagaatgttgccaaataaccaatttcaaggataatttttaacagtcattttcttttcccrgtgagctcaaggctgtcttgagccattaaagtccaagcaggcagaaggggtgtgtgtgagctaagggcgaaaagcctagaactgcgctcaactagcaaaagcaaaaccttatttatataaaacaaaaaaaatcacctttggagacatcaactctttatagcactgtttccaagcaaatttaatttccaaagaaattaaagaaagaaatccaaacatattcaaaataatttttgaaagtccttttgtcccccagcataggtcagctggagaggacaaactaatctcctctgggtttctgca

SEQ ID NO: 53943 - DNA, 601 bp, Human; identical to SEQ ID NO: 18604

SEQ ID NO: 53944 - DNA, 601 bp, Human
cccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacgagtcaagtaaatattaatttttgctttacctcccttaagctcamatatctgctttccatttcttttcctttccttttcactttccgcttttaattattttgttggtctgatattgatcggctcttggtttcaattctggctgtccatctgggaagccaaaattgttgccctattgtatttccaaaccctgtcataaaacttgaaagtagtgaatgagcttcgtagagtcaaaagtcagtgtaagtcttttattccatcaggagaaatcataatatactgcaccctatcttgaagatttccataaattatctcaggtttgagaactgcctttggtaaatttcact

SEQ ID NO: 53945 - DNA, 601 bp, Human
taggctttcaggaaatattcattgagtccacacatcagtggcataggtaaatttggaggcttgttgctcatgatacaatgtgcaaacataatgctaagccttttacaacataaaagatatattaagtagttaaatacatacaaatatttgtatacaaatatctatctagatagataggtatttattccactttcccacctatttgtctagcctttgtattgatcagtggctactaccagagctatgttaaaggcataaactctctcattgaactccaaaaacttccttcacactgtggatrtagcccttgcatcagggaggaaggctacactacaccttgtgttgtgtctggactgctttgacctttgctggcttagattctgaagaggtaaatgattaagaaagcttcttgtcacagtttagagatgtgagtcttgggccagtccacccacaaatatccctttttttctgttgttttaagcatcttacagagcaagcaaattttttggtcaaaattctttctattgtttgtcagacagacccacggactaaaacaaaacatttaaatattcctatattcctgtgtggtaaactgataaat

SEQ ID NO: 53946 - DNA, 601 bp, Human
taggtaactttcagggagtttttgaaaccttgcaaatatcccttcctcaccaaactttcaccccctggatttggcatccactgatgattttttaaaataattttttccttcaaatattattagtaggcaatctactggaaggaataactttcccttctcacccatttatttattcattttaaaaaatcagagtaaggactcagagattgttaatttgttcaatgagttattatcccgttgtttattgtgatgttccaatactcccataatttgccaaaggcagtcaaatccttggctgtartaagtccttgaatcaaaataaaatgcacgctcttctcatgatctctgatattttcctgatctggcctctgctgacctcatgtcaaacttatctctggctccagtccgtctggttcagtgttctttagccacactggacacctttcaattcttcaaccacagcaggttctttttcatcttagggactttgcacttacggttccttctacttgaacatgtttccctgaacctccacttgcctggctttttctcattattcagatctcggcaaaccaagagattgtgaccactctacctaatg

SEQ ID NO: 53947 - DNA, 601 bp, Human
cttgcaaatatcccttcctcaccaaactttcaccccctggatttggcatccactgatgattttttaaaataattttttccttcaaatattattagtaggcaatctactggaaggaataactttcccttctcacccatttatttattcattttaaaaaatcagagtaaggactcagagattgttaatttgttcaatgagttattatcccgttgtttattgtgatgttccaatactcccataatttgccaaaggcagtcaaatccttggctgtagtaagtccttgaatcaaaataaaatgcaygctcttctcatgatctctgatattttcctgatctggcctctgctgacctcatgtcaaacttatctctggctccagtccgtctggttcagtgttctttagccacactggacacctttcaattcttcaaccacagcaggttctttttcatcttagggactttgcacttacggttccttctacttgaacatgtttccctgaacctccacttgcctggctttttctcattattcagatctcggcaaaccaagagattgtgaccactctacctaatgttgtttaccacttttcctagtcattctc

SEQ ID NO: 53948 - DNA, 601 bp, Human
gtcaaacttatctctggctccagtccgtctggttcagtgttctttagccacactggacacctttcaattcttcaaccacagcaggttctttttcatcttagggactttgcacttacggttccttctacttgaacatgtttccctgaacctccacttgcctggctttttctcattattcagatctcggcaaaccaagagattgtgaccactctacctaatgttgtttaccacttttcctagtcattctctgtctcttccagtgttttattttctatgtagctgtcatcactctcctaagttwtttatttatttgtgtgtctcttgtctaacactctgtaagcagtctggaatcttatctatacatgtaactgcccagtgggttcaccttgcccgctgcctagacagagccgatttatcaagatggggggaattgaaatggagaaagagtaattcacacagatccggctgtgcaggagactggaattttattattactcaactttgtctccccgaacatttggggatcagagtttttaagataatttggcgggtaggggcttgggaagtggggagtgctgattggtcaagttggagatggagt

SEQ ID NO: 53949 - DNA, 601 bp, Human; identical to SEQ ID NO: 23776

SEQ ID NO: 53950 - DNA, 601 bp, Human
gccttaaattatttcaagggaaacatgtgctgtaagtcaaaagctagctcctaagtataccagcacaaatatattaaaatgtttgggtatgcccaatgtaataaaatgtttgggtatatgtgtacctctcccagatatagactagagagagaggaggaaacctgaggtaaaggaacatccttcgaatgacaaggcactgaaaagtttatggctccattcctatatgtaatcaaaataggtagcaacaaagtatccaaaagcattttttaaaagtatgataaaatataaataagcttttttwaaaaatatcaagacgactagttcaatagttttctttctttcttttttttttttttttttttgagacggagtctggctctgtcacccaggctagggtgcagtgacacgatctcagctcactgcaacctccacctcccgggttcaagtgattctcttgcctcagcctcctgagtagctgggactacaggcacccgccaccacgcctggctaatttttgtatttttagtagagacggggtttcaccatattggccagccttgtctctaactcctgacctcaggtgacccactggccttggccc

SEQ ID NO: 53951 - DNA, 601 bp, Human
aaatatattaaaatgtttgggtatgcccaatgtaataaaatgtttgggtatatgtgtacctctcccagatatagactagagagagaggaggaaacctgaggtaaaggaacatccttcgaatgacaaggcactgaaaagtttatggctccattcctatatgtaatcaaaataggtagcaacaaagtatccaaaagcattttttaaaagtatgataaaatataaataagctttttttaaaaatatcaagacgactagttcaatagttttctttctttcttttttttttttttttttttgagayggagtctggctctgtcacccaggctagggtgcagtgacacgatctcagctcactgcaacctccacctcccgggttcaagtgattctcttgcctcagcctcctgagtagctgggactacaggcacccgccaccacgcctggctaatttttgtatttttagtagagacggggtttcaccatattggccagccttgtctctaactcctgacctcaggtgacccactggccttggccccctgaagtgctgggattacaggcatgagccaccgagcctggcccaatcgttttcttttgaagaacc

SEQ ID NO: 53952 - DNA, 601 bp, Human
aatttttctatttgaggtagaaataccaagaggaaacagaaaggctaagcaattgtactaaagatgacaaagtctcataggtaagaacaatgcatttaaccaatcagcagaggacatagtacttggagttattttctaatagtgacagtgagcttgaatttccaatatgactctatcaccaggtcctctgaccaaggacatttacttgtaatattatactaactaggtaaatcactagagcctgtaccagttagttagctgggttcttaggatggattttatataaaggatttgaagtgayataatgaaaaaatacagttttgcaaaagatcccaaaatgtcctgtaggtggtaattatttcttaaatggttcttctatgaaaactaagagcataacattttgttttaaataagtgatgcattccatcatttgggagggaaacaaacataatattgttttaatacattactgtccaatcatctattttataagagatcaacagaagccaaattcccttttgaaacttctcagaggctctgagccagaaaaattacaagaaaatgagatatgccactttccccttcctccaacccttccata

SEQ ID NO: 53953 - DNA, 601 bp, Human
tgtcctgtaggtggtaattatttcttaaatggttcttctatgaaaactaagagcataacattttgttttaaataagtgatgcattccatcatttgggagggaaacaaacataatattgttttaatacattactgtccaatcatctattttataagagatcaacagaagccaaattcccttttgaaacttctcagaggctctgagccagaaaaattacaagaaaatgagatatgccactttccccttcctccaacccttccatagaagacaggcagccagagtttcccctcctgaaaaaacwgtggggccgtttcctttaaaagttgaacagaacctaatgggagaaatttaaggcatctagtgtgaatgcaaatgctccacagtgagttcctcctctttggcatttgggaggttcccctcctggctccctacccacttactgtaagttgaaatctaatagttgacacccacccaagtacaaactgctcctggtatgatttcccactccagagagttacagaaaaaccaacctacttaaatctattgaaatgtaacatcagaggaaactcacaccagcctcagagtcctacattcttagaac

SEQ ID NO: 53954 - DNA, 601 bp, Human
ttaaaggctatgtgaatatcctgttagttcttcaggttttgaccacttattgtagcattccccagtggatgtccacaacaactgttattgtggtgttctaaaggtgatttttctgttttcctcagaattatttttgacatatggtcatttcattattttaaaaacttattttggctgtggctttgctaagttttcagaatgaatttgatttctagaacattttaattagttttttttaattaatttctttactggaagggttatctttaaatggaaggttattaatctcccttgaaggaawctgtttaatttagtaagccacggaggattgctaatgattcttattttttatttaaatttacaaaaatataaacaaaataataaaaataatgtaagattttatggggtaatttagattttttaatgttcattttttaatttcttaaaaattatactgcagtaataatcactaagcatcagacaacttaaattttaacttaaatggaaagtaagtggccaataaatgctttgtgtaacctaatggccgtgctgagtttcttcttaaacagcaattcatagcaggtgagttccgactcagagt

SEQ ID NO: 53955 - DNA, 601 bp, Human
cccttcaaccttccctcaccttccctggcccaggtaaattttgtctagttttttgagacagagtagcctggacatctctttattctcttttcaattattattagagttaaaaaccctgtggtttgcttttttcctggccttctgtttttattgctaaaagtcttttgaaaccaggcccttacaatccaaaaagtttgggcttttaaatgtgttgtgtgggcatcaagagcctattttgaaagtcaaaaccataacatttatttttttcccctgcatttttcaatgttcttactggcaatgwggacaccatagtgtaagtatcaatcacatataaggaagtacgcacacagaaaattacagaggttaataattcagtgtattatctctaatgatactaacacttttgatgggacacatagaactattacatgtcaaacattgcttatgtgttatttaatactcgaaataaccctatgacataagtgctgttgttatatctattttacagctggggaggtcaagattcagtcttataagtagagaaaataggcagcatgatatgtgaaaacaaactttgtcctgaactctagcgtcagtcctg

SEQ ID NO: 53956 - DNA, 601 bp, Human
ggttaataattcagtgtattatctctaatgatactaacacttttgatgggacacatagaactattacatgtcaaacattgcttatgtgttatttaatactcgaaataaccctatgacataagtgctgttgttatatctattttacagctggggaggtcaagattcagtcttataagtagagaaaataggcagcatgatatgtgaaaacaaactttgtcctgaactctagcgtcagtcctgtcttagacttcatttttctcatgtatacaatgaggaagtttattttcaaatcaccttcaarctctaaaattataaatagaggtctacaatccttgtcccaaaccctcatggccagttgtatgttggaattcagaaattttcagatttgtgaaaggtaatgtagtttgaatactatatgttaatgattaactacagtgggatttggggcaatgtcttataatcagtgatacttctgcagcaattttttatagtgagaaaaataaagatttttgaaaaactcttaacagttcaggtcatatgatattgccaaattagtttgcttaaacatataaaaagttttagaactcattggatttattag

SEQ ID NO: 53957 - DNA, 601 bp, Human
caagcatcacagatgttctgttgttacacggattacagaaaccatgttggagctttaaatgacagaaaatgttggcatgttggtagagtctttaatataaaaatgtttgtgatatatggtagttaagacacagttatgctttggcttaatatgttacaaaattaatgggctgtagctatatattctctgattgtttggctctgttgatcaaagtagcagttatagaataaaatctatgacctgatttttttatggtaacttctgtaaaatatttcttttttaagcttttattttaggttcrggggtatatgtacgggtttgctatatagtaaattgcatgtcataggggtttggtgtacagattgtttcacttctcaggtaataagcatagtgcccgataggtggttttctcattctcaccctcctccctctctactttcaagtaggccttgatgtctattgcttccttcttggggtccatgagtactcaatgtttaggtcccacttataagtgagaagatgtggtatttggttctctgctgctatgctagttctcttaggataaaagactccagctttatccatgatgctgcaaaggaca

SEQ ID NO: 53958 - DNA, 601 bp, Human
gccaaactgctttccacaatggataaactaatttgcattcccaccaacagtgtataagtgttcctttttctctacaagtttgccagcatgttattttttgaccttttaataatagccattctgactgggtgagatagtatctcattgtggttttgatttgcagttctctaatgattagtcatgttgagcattttttcatatgcttgtgggccatatgtgaaaagtgtcttttgaaaagtgtctgttcacatcctttgcccattgtttaatagggttgtttgtttttgcttgctgatttaarttctttacagattctggatattttaccttagttggatgcatagtttgcaaatattttctctcattctgtatgttgtctgtttactctattgatagttccttttgctgtgcagaagctctttagtttaagtccatttgcctacttatggttttgttgcagtttcttttggcatctttgtcatgaaatctttgccaggtcctatgtctggaatggtatttcctaggttatcttccagggtttttatagttttaggttttacactttttaacctgtcttgagttgacttttgtatatggtgta

SEQ ID NO: 53959 - DNA, 601 bp, Human
ttttgtcttagtaccatgctgttttggttactataggcttgtagtatagtttaaagtcaggtaatgtgattcctccagctttttctttttgcttaaaattaccttggcaattatatttttggtgccatataaattttaaaatagtttttttctaattctgtcaaaactatcactggttgtttgataggaacaccactgaatctgtgaattgctttgggcagtatggccattttaacaatattgattcttcttattcgatgttttctttttttttaattattatactttaagttctagggtrcatgtacacaacgtgcaggtttgttacatatgtatacatgtgccatgttggtgtgctgcacccattaactcgtcatttacattaggtatatctcctaatgccatccctccccgctccccccaccccacgacaggccctggtgtgtgatgttctccttcctgtgtccaagtgttctcattgttcaattcccacctatgagtgagaatatgcggtgtttggttttttgtccttgtgacagtttgctgagaatgatggtttccagcttcatccatgtccctacaaaggacatgaactcgatgt

SEQ ID NO: 53960 - DNA, 601 bp, Human
cttggcaattatatttttggtgccatataaattttaaaatagtttttttctaattctgtcaaaactatcactggttgtttgataggaacaccactgaatctgtgaattgctttgggcagtatggccattttaacaatattgattcttcttattcgatgttttctttttttttaattattatactttaagttctagggtgcatgtacacaacgtgcaggtttgttacatatgtatacatgtgccatgttggtgtgctgcacccattaactcgtcatttacattaggtatatctcctaatgcyatccctccccgctccccccaccccacgacaggccctggtgtgtgatgttctccttcctgtgtccaagtgttctcattgttcaattcccacctatgagtgagaatatgcggtgtttggttttttgtccttgtgacagtttgctgagaatgatggtttccagcttcatccatgtccctacaaaggacatgaactcgatgttttctttatttttgtcggactgagttagtttgggaagccagtttttgagctctgagattctttcttcagcttggcctattctgctgttaataattgtgattt

SEQ ID NO: 53961 - DNA, 601 bp, Human
ctttgggcagtatggccattttaacaatattgattcttcttattcgatgttttctttttttttaattattatactttaagttctagggtgcatgtacacaacgtgcaggtttgttacatatgtatacatgtgccatgttggtgtgctgcacccattaactcgtcatttacattaggtatatctcctaatgccatccctccccgctccccccaccccacgacaggccctggtgtgtgatgttctccttcctgtgtccaagtgttctcattgttcaattcccacctatgagtgagaatatgcrgtgtttggttttttgtccttgtgacagtttgctgagaatgatggtttccagcttcatccatgtccctacaaaggacatgaactcgatgttttctttatttttgtcggactgagttagtttgggaagccagtttttgagctctgagattctttcttcagcttggcctattctgctgttaataattgtgatttcattatgaaattcctgtagtgtgttttttttagctctgtcaggtcattttggttctttcttataacggttattttgtctttcagttcctgtactgttatattgtaatcc

SEQ ID NO: 53962 - DNA, 601 bp, Human
agggtgcatgtacacaacgtgcaggtttgttacatatgtatacatgtgccatgttggtgtgctgcacccattaactcgtcatttacattaggtatatctcctaatgccatccctccccgctccccccaccccacgacaggccctggtgtgtgatgttctccttcctgtgtccaagtgttctcattgttcaattcccacctatgagtgagaatatgcggtgtttggttttttgtccttgtgacagtttgctgagaatgatggtttccagcttcatccatgtccctacaaaggacatgaactsgatgttttctttatttttgtcggactgagttagtttgggaagccagtttttgagctctgagattctttcttcagcttggcctattctgctgttaataattgtgatttcattatgaaattcctgtagtgtgttttttttagctctgtcaggtcattttggttctttcttataacggttattttgtctttcagttcctgtactgttatattgtaatccttagtttccttggattggtttcaactttctcaatggttctcaatggaatctcaatgatcttccttcctatccatattctgaatt

SEQ ID NO: 53963 - DNA, 601 bp, Human
tacatgtgccatgttggtgtgctgcacccattaactcgtcatttacattaggtatatctcctaatgccatccctccccgctccccccaccccacgacaggccctggtgtgtgatgttctccttcctgtgtccaagtgttctcattgttcaattcccacctatgagtgagaatatgcggtgtttggttttttgtccttgtgacagtttgctgagaatgatggtttccagcttcatccatgtccctacaaaggacatgaactcgatgttttctttatttttgtcggactgagttagtttgggragccagtttttgagctctgagattctttcttcagcttggcctattctgctgttaataattgtgatttcattatgaaattcctgtagtgtgttttttttagctctgtcaggtcattttggttctttcttataacggttattttgtctttcagttcctgtactgttatattgtaatccttagtttccttggattggtttcaactttctcaatggttctcaatggaatctcaatgatcttccttcctatccatattctgaattctattgctatcatttcagtcgtttcagtctggttaagaac

SEQ ID NO: 53964 - DNA, 601 bp, Human
agaatatgcggtgtttggttttttgtccttgtgacagtttgctgagaatgatggtttccagcttcatccatgtccctacaaaggacatgaactcgatgttttctttatttttgtcggactgagttagtttgggaagccagtttttgagctctgagattctttcttcagcttggcctattctgctgttaataattgtgatttcattatgaaattcctgtagtgtgttttttttagctctgtcaggtcattttggttctttcttataacggttattttgtctttcagttcctgtactgttatrttgtaatccttagtttccttggattggtttcaactttctcaatggttctcaatggaatctcaatgatcttccttcctatccatattctgaattctattgctatcatttcagtcgtttcagtctggttaagaacccttgctgtggaactagtgtggttctttggaggaaacaaggcagtctggctttttgagctgccagagatcctgcactagttctttctcatctgtgtgggctgactttccctcaactgtggtggctgatgttccctcaactgtgctgtaatttgagtacagtcagttg

SEQ ID NO: 53965 - DNA, 601 bp, Human
ggttttttgtccttgtgacagtttgctgagaatgatggtttccagcttcatccatgtccctacaaaggacatgaactcgatgttttctttatttttgtcggactgagttagtttgggaagccagtttttgagctctgagattctttcttcagcttggcctattctgctgttaataattgtgatttcattatgaaattcctgtagtgtgttttttttagctctgtcaggtcattttggttctttcttataacggttattttgtctttcagttcctgtactgttatattgtaatccttagttgccttggattggtttcaactttctcaatggttctcaatggaatctcaatgatcttccttcctatccatattctgaattctattgctatcatttcagtcgtttcagtctggttaagaacccttgctgtggaactagtgtggttctttggaggaaacaaggcagtctggctttttgagctgccagagatcctgcactagttctttctcatctgtgtgggctgactttccctcaactgtggtggctgatgttccctcaactgtgctgtaatttgagtacagtcagttgatttctttcctggatg

SEQ ID NO: 53966 - DNA, 601 bp, Human
ttggcctattctgctgttaataattgtgatttcattatgaaattcctgtagtgtgttttttttagctctgtcaggtcattttggttctttcttataacggttattttgtctttcagttcctgtactgttatattgtaatccttagtttccttggattggtttcaactttctcaatggttctcaatggaatctcaatgatcttccttcctatccatattctgaattctattgctatcatttcagtcgtttcagtctggttaagaacccttgctgtggaactagtgtggttctttggaggaamcaaggcagtctggctttttgagctgccagagatcctgcactagttctttctcatctgtgtgggctgactttccctcaactgtggtggctgatgttccctcaactgtgctgtaatttgagtacagtcagttgatttctttcctggatgttttcagaggacgaagtgtttgtgctgggtcattatttgcgctgaattcatgtcctttgtttctcaggggcgttatgttagcaaagtatttttggtgctgaagtttgggctatgatccagtagatggtgcttaagcataatggccagtagtta

SEQ ID NO: 53967 - DNA, 601 bp, Human
ggagatccaccttagagaaatgcagagctgctgctactgggaatgttcagccaggggatggggccactgcactgctggcctgagctgaggtccctgcttggtgaagagctgaccctgattatgaagggtcatagatcacagatgatctgcagactgaccaggctgcaaagacagagcatatttctatggacttgagtttctcagaaacaaaagaggaagggactgcttttattttgattgaatttacattaacatcaatcttctttaaacactgccttccactgtcaccaacagaaatacraaaaaagaaaaatgaattacattgtctcagaagcatactgcttaaagggagttcatttactgacatgggaaatgagaaaatattagtggaaagaacacattgagtctgtctccttcccattgctccacctacggtgggagacctcaccatgatctttcaacttcttttacaattctctttcgctcaccaaatgttgtgtgcagcaccaaagcactgaatatgtagacaacagtggagcgggtcaagaggactgcccttcctgaagtttttaatgcagagaacagatgtgatagaaaatct

SEQ ID NO: 53968 - DNA, 601 bp, Human
accatgatctttcaacttcttttacaattctctttcgctcaccaaatgttgtgtgcagcaccaaagcactgaatatgtagacaacagtggagcgggtcaagaggactgcccttcctgaagtttttaatgcagagaacagatgtgatagaaaatctgagagttttgacacaccaattagttcacagaagaaaaattctgagactcttggtttatgacatggcaatcctgtacgaacgtgatgacttttattttagacggttaattccctttactctgttcaatggccaaaaactggagcctyagtttcactcaacttcttggaaaaatacctgtcattgttcacaaagaggacaggagggtaatccaaacagtttcactttttgattgcttaacaactattagagaaaatgtatcatcacttctgtaagaaaaaaaaaaaacttctaagagtattgagatgattgagtgagttgtgccgtcttcggaggtgaagacgaacacatctttatttatgcaaataaagcaagaatgccagttacctagtggatgtgagaatagtgagccagcactggtaatttaagggatgctctttcagaatgtg

SEQ ID NO: 53969 - DNA, 601 bp, Human; identical to SEQ ID NO: 23777

SEQ ID NO: 53970 - DNA, 601 bp, Human; identical to SEQ ID NO: 23778

SEQ ID NO: 53971 - DNA, 601 bp, Human; identical to SEQ ID NO: 23779

SEQ ID NO: 53972 - DNA, 601 bp, Human; identical to SEQ ID NO: 23780

SEQ ID NO: 53973 - DNA, 601 bp, Human; identical to SEQ ID NO: 23781

SEQ ID NO: 53974 - DNA, 601 bp, Human; identical to SEQ ID NO: 23782

SEQ ID NO: 53975 - DNA, 601 bp, Human; identical to SEQ ID NO: 23783

SEQ ID NO: 53976 - DNA, 601 bp, Human; identical to SEQ ID NO: 23784

SEQ ID NO: 53977 - DNA, 601 bp, Human; identical to SEQ ID NO: 23785

SEQ ID NO: 53978 - DNA, 601 bp, Human; identical to SEQ ID NO: 23786

SEQ ID NO: 53979 - DNA, 601 bp, Human; identical to SEQ ID NO: 23787

SEQ ID NO: 53980 - DNA, 601 bp, Human; identical to SEQ ID NO: 23788

SEQ ID NO: 53981 - DNA, 601 bp, Human; identical to SEQ ID NO: 23789

SEQ ID NO: 53982 - DNA, 601 bp, Human; identical to SEQ ID NO: 23790

SEQ ID NO: 53983 - DNA, 601 bp, Human
agctcaatcaccctcttttaatgggtaagttaataaatattgtctaaataaaacaacagaggcatttaaagtccaattagactacaaaagcactaaaaccagatcacttaataggggatgcttccgagcagggctggcctgtgggaagggtgagtaaggagatggtggtttttcaacactaactttttaagtttttgagtagtgatgaatttatctacaaattgcacacattaaattctcctgagcatttaaacagcacttacaaacttaatcaagtcctcttaaggatatatcacttacragaaacttataaatgtaaccaaattcttctaaacaacactagctaaaattttaccgaattcatttacaatttcaaaatacaaacaccaccaaagaagcagatttataagtctaattaaaattttttctatatattttatgaatccaacaaattaaaactcaaatatagtgtatcaaatttcttgcacattttcattatgttaaaaatcaaacccttaacaggatttttctagacatttaaatatggctactgagttaagattttctaagtatttcaattaaaacaattccagtatgtcat

SEQ ID NO: 53984 - DNA, 601 bp, Human
cacagtaattattctctcttactatatgagtccactgatttgctgagcctcaattaattgggagagggaagcaggaggtggagtagggcagggagggtcacagaaggctttcttttccagggatgtgatatttaaggtgagcaaattggtgtggggaagtgactgctctggatgttcaaaatagaaactatggccgggcgtggtggttcatgcctgtaagcccagcactttgggaggcctaggtgggtggatcacttgaggtcaggagtttgagaccagcctggccaacatgatgaaaccscatctctactgaaaatacaaaaattagccgggcatggtagcacacacctgtaatcccagctactcgggaggctgaggcaggagactcgcttgaacctgggaggcagaggctgcagtgagccaagatcatgctactgcactccagcctgggtgatagagtgagactctgtctgaaaaaaacagaacaaaccccccgccccaaaacagaaattacagcgtatatgaaagcccaaagtcttatacacatgatttacaacacttattgaacattgaccaagtggttggcactattttaagcact

SEQ ID NO: 53985 - DNA, 601 bp, Human
aaaattagccgggcatggtagcacacacctgtaatcccagctactcgggaggctgaggcaggagactcgcttgaacctgggaggcagaggctgcagtgagccaagatcatgctactgcactccagcctgggtgatagagtgagactctgtctgaaaaaaacagaacaaaccccccgccccaaaacagaaattacagcgtatatgaaagcccaaagtcttatacacatgatttacaacacttattgaacattgaccaagtggttggcactattttaagcacttcagatgcattttattttayagtaaatgaggaatttgtggtaaaagtgattaagtaatttcaaggtcacacagtgtaaataatggaggcttgatgtaaacccaggcagtctggttccaagaaacgggatagcagagagtgactgggaaaagtggtgtgaggtgaagacgaagaggaaggcaggaaccaggtatgcagaccatgttaaagattttgaaaatagtatgcaaatttaaggattttaaggagagaattggcagggtcacatttacatttttcaaagctctcctcttgctgcactgtggagaactgatcacagat

SEQ ID NO: 53986 - DNA, 601 bp, Human
tactcctgaatgttagccaatatgtagaaaactcaatcgtttcatttatgtaatttccatttcttcacactttatactctcaagtctgtgattttactcagcttagattacattagatcatgtgattctaaaactataaaattgtatagcctcaactttctatcatttttatcttatgatactcttaaagacctcagagcagtatttttgtacatgagattaggagaacagcttctgcccttttgaggcctggtgtagtcccagaggccatgttttagagaggatagtcaaaataggaaaycttaactgtgggcctaggtcatccagacgctgcctgctctgttgtttcagtcagattggcattggggaaagaagaggaagcataaaatgtgagtttacatggcagcaccaattcagcagaccagtgcaagtgaggtatataggtaagatgtggcatcttaggaatgttctttgtcggtcttctgagaagctgcaagggctcttagtttggtgttcctagaagcagaccccgaaatgatcatgtgtgtgaaagtgacttgttagaaagtgtttccaggaaagatcagtgggggagcaggca

SEQ ID NO: 53987 - DNA, 601 bp, Human
agatcatacttcagagtgctcctgatggatggggcaggaagcattctcacacctgtcactcactgttaagggccacatccagaaggacgtaaattcccaggaacttctggctttccttgctcaggtagctggaaggcagtcctctgtcagagagacccaggtattgattgtaggcagggaaagcacactggtatccaaggtgtacaaaaatgacaaagggggccgggcacagtggcttatgcctgtaatcccagcactttgggaggccgaggcaggtggatcacctgaggtcaggagttcragaccaacctggccaacatagtgaaaccccgtctctactaaaaatacaaaaaaaattggttgggtgtggtggcaggtgcctgtaatcccagctacttgggaggcttaggcaggagaatcacttgaacctggtaggcggaggttgcagtgagccgagtccgtgccattgcactccagcctgggcaacaagaatgaaactccgtctaaaaagaaaaaaaaagagagaaaggggtctaaggagataaggaggaagcactgacagtgtccactataaggcccaagaagcaatttatgtgttggt

SEQ ID NO: 53988 - DNA, 601 bp, Human
ttctttttaaaaaaattttagttatacatggaatatcccagttaaatggactgaagataatataacaagcagtgtgttatttaataggtcagaaaaagaaggtaaatattattaattgatttatttcttctttgaattgatgtaccacattaaactaatataagtataaagatgcaacagtaaagctggaacttatgtaaacttcagctaagtgatctcttaaataatttattgatgattccaaatcttcatctacaatcagaactgttataccttgagatattcttttcaatgatttatyttgactgactgatttatcataaatacccatatccaaaggagaagggtcgcatgcccaacaattggaagatcaatgtgtaagtttccttccttccttccttcctttttgttttttcttttatcagataagccattgaatttctttaactgttatatgacaagcctgaggatttttttaatgctcccattaaattagaccattttttggaaatatatttgtgttctatctgcactgatttattttttccttacttgaaaaatgttagggttgtataaaaacaagtaaaccttctcacgaaat

SEQ ID NO: 53989 - DNA, 601 bp, Human
cactaatgtattccctacctctatagatttgtctcttctggtcatttcacataaataaaagtgtatatgcagtattttgtgacttttcaattagcataacgatttcaaggctcatccatgatatagcatgtaactctacttcattcctttttattgccaaatcatatcccattatatggatataccaccatttgtttatccatttatcagttgatagatatttggatcatttccaccttttgtctgttatgaataatgctgctataaacatttgtgtataagtttttctgtggatccagcrtgttttttccacctttgggccttttaaaaaaaaacgtttattgttaacagtttttgtgatttttttttactattactacaaactaccagctttgtcattatagaggtgaaatccttctgaagcccttctgcacagggattgctattacaacaaaactctctcttgcttatttatgttaataattattgtaatatcgtgatcaaaaaaaattctaaatttttgcagaattcccagatcaatgccactttgttttagtattttatgctgtgtttcaatgcgaggctctatcttttgtggtct

SEQ ID NO: 53990 - DNA, 601 bp, Human
ttgtgacttttcaattagcataacgatttcaaggctcatccatgatatagcatgtaactctacttcattcctttttattgccaaatcatatcccattatatggatataccaccatttgtttatccatttatcagttgatagatatttggatcatttccaccttttgtctgttatgaataatgctgctataaacatttgtgtataagtttttctgtggatccagcatgttttttccacctttgggccttttaaaaaaaaacgtttattgttaacagtttttgtgatttttttttactattamtacaaactaccagctttgtcattatagaggtgaaatccttctgaagcccttctgcacagggattgctattacaacaaaactctctcttgcttatttatgttaataattattgtaatatcgtgatcaaaaaaaattctaaatttttgcagaattcccagatcaatgccactttgttttagtattttatgctgtgtttcaatgcgaggctctatcttttgtggtcttctgaccattttcttattcataagtacacttgccagaggaaaagggagaagacagaaaaaaaaaagacattttcaa

SEQ ID NO: 53991 - DNA, 601 bp, Human
attcacccagcactttcatggaatgaagtttccatacaagtgaattttccagataactaaagcttactcaagtgctttgtaaaatgcatttcaagagttcacaatagacattgttctaatatgtgttatgtactccttagaatatttggaataataaatttaatccttaattactagattaattctttcaagcacgtattgcttatgtgcaaaacacagagataagaatgggggcagtgctggagcaaaaaaaaaaaaaaaaagcaatcctaacccttgtgtagatggttgtctagggatrggtttgcaggcagacataatgctgtgtcctaagtgcctctgtggcaatgcagatcaccaaaagcactcatagaagcatcagcccaggtttgggggttcaggaagcattcctaaaaaatatctaggctgagagttcagaggctaaagatagagtataaatgggtgataaaaattgaatgtagaggagacgtgtgctctggacagaagcatgactgtgaaagtgaaagagcagggagttctcacactccttcgtatccctttgtcaatacatttcacacatttttttgttctaactattgac

SEQ ID NO: 53992 - DNA, 601 bp, Human
actttcatcagcccttattcctagtattattactttatattttaaacaaaatcattgttattaagcttcatatgttctctcttttcgttctttcttttttttttttttttttttttgggacagagttttgttcttgttgcccaggccggagtgcagtggagcgatctcagctcattgcaacgtccgccccctgggttcaagtgattctcctgcctcagcctcccatgtagctgggattacaggtgcctgccacctcagctggatatttttttgtatttttagtaaggatggggtttcacamtgttggccaggctggtcttgaactccagacctcaggtgatctacctgcctcagcctcccaaagtgctgggattataggcgtgagccaccgcgcctggcctctcttttttttttctcaactaaattataagcttcttgatgacacaaactacacatatttcttgtctcctgtccaccctattatcaacaaggtgctacgtacattctgagttcagaaagtcctagtttaatgaagggttgtttgccccagaatgctgtacttttagaggttaactgcatatattttagttatgtctccatc

SEQ ID NO: 53993 - DNA, 601 bp, Human
atctcaattctattgcaggtcttcttgatacagtaacattttaaaagtgttgctgattatcaatgtattatcctgcttagtgatagccatttccatcaacttcaatgttgattttaataaacaaagtattattttgagtatttacatttgtatcccctccccaggctgccctggtgaatattgtttgtgtaatcaatccattatgattagggatctatggactacccctgaaggcatggacttctctgtctcgaggcactgttttcttttattgatggattgaccagcacgaaattatttygcccatttgacaagcttctgccagtaaaaactatccatcataaattacagtataattatttatattacttatttcttttttagctcactcattatagtggtattctaaagttagacaactaagtaaaaattaggctttgggttttggatccaaatcaaacctgcctccttgagctaatatttcttttcttttattttctttttgccctctgggtctaatttctctgtgttgacagtgcatgcaaacatgttgctcattagtgtttatttactactacaggaatcactttgaactcctcta

SEQ ID NO: 53994 - DNA, 601 bp, Human
gatagccatttccatcaacttcaatgttgattttaataaacaaagtattattttgagtatttacatttgtatcccctccccaggctgccctggtgaatattgtttgtgtaatcaatccattatgattagggatctatggactacccctgaaggcatggacttctctgtctcgaggcactgttttcttttattgatggattgaccagcacgaaattatttcgcccatttgacaagcttctgccagtaaaaactatccatcataaattacagtataattatttatattacttatttctttttwagctcactcattatagtggtattctaaagttagacaactaagtaaaaattaggctttgggttttggatccaaatcaaacctgcctccttgagctaatatttcttttcttttattttctttttgccctctgggtctaatttctctgtgttgacagtgcatgcaaacatgttgctcattagtgtttatttactactacaggaatcactttgaactcctctaatcctagtggaaatgcttttctcaaaataaacccagatcatattgggttttatcgtgtaaattatgaagtagcaacttggg

SEQ ID NO: 53995 - DNA, 601 bp, Human; identical to SEQ ID NO: 23791

SEQ ID NO: 53996 - DNA, 601 bp, Human; identical to SEQ ID NO: 23792

SEQ ID NO: 53997 - DNA, 601 bp, Human; identical to SEQ ID NO: 23793

SEQ ID NO: 53998 - DNA, 601 bp, Human; identical to SEQ ID NO: 23794

SEQ ID NO: 53999 - DNA, 601 bp, Human; identical to SEQ ID NO: 23795

SEQ ID NO: 54000 - DNA, 601 bp, Human; identical to SEQ ID NO: 23796

SEQ ID NO: 54001 - DNA, 601 bp, Human; identical to SEQ ID NO: 23797

SEQ ID NO: 54002 - DNA, 601 bp, Human
tgaacttctgacctcaggtgatccacgtgcctcggcctcccaaagtgctgggattatagacctgagccaccatgcccagcctaaaatatatttttaaggttaaagtgagcagttccggaaagttaataatatgtagttataggttggatggacctacaagccagtcagaatgattgcactgtgcctttgataatcattatcctaaaatgagaacttctaaggaaggctcttggttttctatgtacacctccttttcacatggtagctctctgtccccctccaaaagcttattactcatgtragagtactcagtagtgagtaactccacatagtagatttttcatggaggagttgacttagatatcggctctcaaaaggacaaataagaacacaagataattttaggatgtaaacattataatatatgctgtaataaagtcataatagttgagctagaatgcctggctggtatcttgaagtgataaaactagttgatgtagtaacactgaaatgattttgccctcccagttaataagggctccataaaaacctgtgttgagtaaaaactttcatagctctagcagagggccaggtgtgggca

SEQ ID NO: 54003 - DNA, 601 bp, Human
gtgatgttttattttgagtgacctctgagctgttttgcctttgcttttgttttccatagtgtctcgcactaggttactgagccatgtttgttaaaaccaatcacatagttgtagaaatctttccctcttttacatattaattaacacattctctgtagggtacaagattaacagcaataggaatagtttgccattttccttaattgtggagagaaagagctactgaaatgtctgtgactgtaagctttccttggcctagtgctgttagcagagcactgttggctcatgagtgaacatacttttaaatgagtctaaaatgaatacatcagtagttggtgcctttaaggcacactgactaaatgttgtggcatttttatttgatagtctcaatctgcagtatccagtatggtccccactactcacatgtggcttttaaaattcgcattagttaaaaataaaacttccatttctcagtcacaccagtcacattttaagcgcttggtagtcacatgtggctgatgggtactgtattggacattgtagatacaggacatttacatcgttgcagaaagttattggatattgctgttctggaagtcaa

SEQ ID NO: 54004 - DNA, 601 bp, Human
ggagcccaaaaagaagaggccagaggcagctgaaaaaacagtaagtctttcatgggggaaattattcaatctagtagtttcaaacttgtcagcatttctaggactgccttcgttgtgtctttagtctactccaggtcccttagtctgcttctgtctctcttactagctcgggtgactgtctaccttgacctgttgcaatagcagcagcagcattggaaactcaagattctcagtttaacacatggaaggggtccacgtatactcgagcttttgcttgggataaatctcagcttcttccatygggttaacccaattagcccattgatttttttcagaaaaatatgtataaataacaagtacacaggtatttggtattgtagtaagcaaggaacaaatgtagatttgctatttttatggcaaaattatattggctgaacatccattttggtaagaaattacatattgttgtttctgtataattttaatgttgcagttcataagccagaaaaatttaatttgtggacttaatgtggagtttctttataacatagatttatatgttgattttttaatttaaaaagttcgatttatatgatatgaa

SEQ ID NO: 54005 - DNA, 601 bp, Human
tgaattctatagcttctctcaaaaatgtagatattcaaaactttgtataccagttcaggggttctcatgttaaacagttgtccatggcttctattaagagctctaggtacatatgctctgttgtaaaatattattactctttagtaagtggcctaaggcaagtcatttgagattttaaaacccatttcctcatctccaaaaaaaaaaataataccatctacccaacaggattattagaaactatgctaagattttgtgacattaaataaatgtagggtattacagagccttacagaaaagaacttaattttgccctgctagagcgcattcagttttcatttgtgttttggagaaatagtaactgtaagcaaacctgcacttggcatcttagaaggcttttgttctgccccagtctcctggtctgcttgggagactattatctgcttactggtctaatggccttttgagtatctttcctgaaatgtccaccttgattacaccctgggaaatccatgcatgtaatcattacttcaccatctggctacattcctttggtctcttgactgcaagttaaatggtgctatgcttgaattcttgactt

SEQ ID NO: 54006 - DNA, 601 bp, Human
aaacctgcacttggcatcttagaaggcttttgttctgccccagtctcctggtctgcttgggagactattatctgcttactggtctaatggccttttgagtatctttcctgaaatgtccaccttgattacaccctgggaaatccatgcatgtaatcattacttcaccatctggctacattcctttggtctcttgactgcaagttaaatggtgctatgcttgaattcttgacttcctattttaatggccttatttgtgtgtgcagaagccagcgtttttttcagtcactgtataatacattgygcttactctggttactggctcatagtcttgtcagcctttttgttttgttttgttttgagacagggtctcactctgttgctcaggctggagtgcagtggcttgatctcagctcactgcagccttggcttgctggacttaattgacccacctaagccactcgagtagctgggactacaggcatgtgctatcatgcccagctaagtttttaaaaatttattgtatagatggggtctcactatgtttctcaggctggtttcaacctcctgagctcaagcagtcctccagcctcggtctcctagg

SEQ ID NO: 54007 - DNA, 601 bp, Human
caccctgggaaatccatgcatgtaatcattacttcaccatctggctacattcctttggtctcttgactgcaagttaaatggtgctatgcttgaattcttgacttcctattttaatggccttatttgtgtgtgcagaagccagcgtttttttcagtcactgtataatacattgcgcttactctggttactggctcatagtcttgtcagcctttttgttttgttttgttttgagacagggtctcactctgttgctcaggctggagtgcagtggcttgatctcagctcactgcagccttggctygctggacttaattgacccacctaagccactcgagtagctgggactacaggcatgtgctatcatgcccagctaagtttttaaaaatttattgtatagatggggtctcactatgtttctcaggctggtttcaacctcctgagctcaagcagtcctccagcctcggtctcctaggattacaggtgtgagccactgtgccccgccacttatcagtcttaagaattccccaaagttggcaaccttcagtagcatatatggacctttcttttcctgagtagaacctcttagttccttgcagagtgg

SEQ ID NO: 54008 - DNA, 601 bp, Human
gtttcaacctcctgagctcaagcagtcctccagcctcggtctcctaggattacaggtgtgagccactgtgccccgccacttatcagtcttaagaattccccaaagttggcaaccttcagtagcatatatggacctttcttttcctgagtagaacctcttagttccttgcagagtgggatctgtcttctttttcatattgcttccctaccctagggctgttcataggaactgccttgggctgagatagttcccctcatgttcctgtgtttgggcactgggctagccttcgtttctgctattmtctggccagctggtgagtattgtggatttacagagagctcttctcctgagtcaccagttgagattcctgaaagattaattaggggaggtcttgtagctgctgacactcaagttgcaaggcactttaggagccttctgtgatccaagctgagcaagtgtaacataacctaatgtgtggtcacatgcatttcagaattcagactcactcagagagtgaaaggtttgaaatattggcacaaagaaatgcttttctgaaaccctgcagattttattcacacattttagagtttttaaaaaggga

SEQ ID NO: 54009 - DNA, 601 bp, Human
ccctggctgttctcaaactcctggcctcaagttatcctctcaccttgctctccaaaagtgttgggattagcatacgtgagccactgcacccagcctgtgtatatttatatatatacaaacataatgttttttatgaactatttgagactaaaattcataaaattttaccttttatccctttaccttaaatatgtaaggtgtatttcttaaaaataaggattttctcttttataagcacagtacagtacagattcaacttagatttaaaacattgctgacgtacttttttttttttttttttgagacgcagtctggctttgtcgccaggctggggtacagtggcgcaatctcggctcactgcagcctccgcctccggggttcaagcaattctcctgccttagcctcccgagtagctgggactacaggcgtgcgccaccacgtccagctaattttttctatttttaatagagacggggtttcaccatgttggccaggatggtctcagtctcttgacctcgttatcagcctgtcttggcctcccagagtgctgggattgcaggcttgagccaccgcacctggctgctgatgtacttttgtctga

SEQ ID NO: 54010 - DNA, 601 bp, Human
tgcaacctccgcctcctggactcaagtgattctcctgcctcatcctcctgagtagctgggattacaggcatgcgccactgtgcccagctgatttttgtatttttaatagacatggggtttcaccatgttgcccaggctggtcttgaactcctgacctcaggtgatccacccgcctcagcctccctaagtgctgggcttataagatgagccaccgcgcccggccctttttttttttttttttaagttaaagagacagggtcttcctctattggtgcacatgtgtggccatagctcactgcamccttgaactcctgagctcaagtgatcctcttgcttcagtctccccagtagctgggactgtaggcacgtacaaccacatccagctgtattcatacttttaaagcttagaagaagttatacagcacaatggacctgcacaatatttaaaatatttttaaattagttagcatcatttaattgagagtgcataacaatctgtgtttttagcttcttttgagaaaatttggtaatgctggcttatgtaacagtgatggaccaggagttctccattttgccttgtttgcagttctcatctggcccc

SEQ ID NO: 54011 - DNA, 601 bp, Human
attgtactatgctccggggaagcagaattagaccagtgtccagagtgtatatacgaaggtctttgttttaaagagactgaaggatattaggcaatactaacaggcctttctgtcttaccagaagcacccctacccgtctgactgatagactaattgcgcattctttcattgatttttttttttttaacctaacaaagaaacatctccatttgcctgactttggctaaactctggtacaaagacgaacaaaaagtcttggtgtacaaggacccatctactggggaaatgcatatggaaacaygcagtgctagtagaagttgaataatattcataaaattgctccactgaccgtccgtggaaggcctgaattgttgttttttccccctaaggtctccaccaattcaggtttagggtgaccgttgtagcttttaggaaggttctcaatctgcacatcagccacctcctttcaataagctttcaccattacttgacctgttctcccatgaagaatattgatttgacatttgtcttgttgtagctgttgtctttagtatgacctcattccctataaagtgacccataggcaaattggtaattgttt

SEQ ID NO: 54012 - DNA, 601 bp, Human
taattgcgcattctttcattgatttttttttttttaacctaacaaagaaacatctccatttgcctgactttggctaaactctggtacaaagacgaacaaaaagtcttggtgtacaaggacccatctactggggaaatgcatatggaaacacgcagtgctagtagaagttgaataatattcataaaattgctccactgaccgtccgtggaaggcctgaattgttgttttttccccctaaggtctccaccaattcaggtttagggtgaccgttgtagcttttaggaaggttctcaatctgcasatcagccacctcctttcaataagctttcaccattacttgacctgttctcccatgaagaatattgatttgacatttgtcttgttgtagctgttgtctttagtatgacctcattccctataaagtgacccataggcaaattggtaattgtttgatttacagagaagccccaggcacttgcctgtcagttttttcctaggtatttcatgcctagcagctattacatgtttcttccctcttctctgtaggtgagaaatgagtggggtccctgcaatatcttgttggattttcaagtaaactaaa

SEQ ID NO: 54013 - DNA, 601 bp, Human
tgaccgtccgtggaaggcctgaattgttgttttttccccctaaggtctccaccaattcaggtttagggtgaccgttgtagcttttaggaaggttctcaatctgcacatcagccacctcctttcaataagctttcaccattacttgacctgttctcccatgaagaatattgatttgacatttgtcttgttgtagctgttgtctttagtatgacctcattccctataaagtgacccataggcaaattggtaattgtttgatttacagagaagccccaggcacttgcctgtcagttttttcctrggtatttcatgcctagcagctattacatgtttcttccctcttctctgtaggtgagaaatgagtggggtccctgcaatatcttgttggattttcaagtaaactaaaactgtttgggatagtaggacgcctgtaggttatggctctttcaagccttctaagaattcaaggagcaaaggaacatctactgtatctaataattattaaaaactacatctttagctgaacagattagttatatgataggtttattgttgaaaaataattttagggactgtttccttaaatgtattctagagactt

SEQ ID NO: 54014 - DNA, 601 bp, Human
gaatattgatttgacatttgtcttgttgtagctgttgtctttagtatgacctcattccctataaagtgacccataggcaaattggtaattgtttgatttacagagaagccccaggcacttgcctgtcagttttttcctaggtatttcatgcctagcagctattacatgtttcttccctcttctctgtaggtgagaaatgagtggggtccctgcaatatcttgttggattttcaagtaaactaaaactgtttgggatagtaggacgcctgtaggttatggctctttcaagccttctaagaaytcaaggagcaaaggaacatctactgtatctaataattattaaaaactacatctttagctgaacagattagttatatgataggtttattgttgaaaaataattttagggactgtttccttaaatgtattctagagacttaaaatatctagtatagtggttctcagagtttctacccagtatcagcattacttgaatttgttgaaattcatattttttaggcctcaactgagacctactgcatcaggagctctgactagggcccagaaatctttttttttttgatggaggaggggcagatag

SEQ ID NO: 54015 - DNA, 601 bp, Human
agtaactaggactgtagacatgctccaccaggcctggctcaattttaaaattttaactttaatttttctggagaggtgtcttgtattgctcagcttggtcttgagctcctggactcaagtgaaactcccaccttggcctcccaaagtgctgagattacaggcatggaccatctcacttggcccagaaatcttttttaacaagccctttaggtggtcctgataacattttaaaattttggaagcactgatcttgtgcatgttatggtttcaatcttgtcaataagagtagtaaatgaaaaaagtacatatatatccatttttatttatttttgttactggagataaaataggaatcgatattatgtagtccaggaaggatcacaattcaagtttaaatggagctagaatctcttttagcatgtctaaaatgtgcatgttctgccctttggatagtaaaattgaaattggttttgtcggattatttatcttgaaggattcttttagaaaaaaattactttgttttgcttttgatcacagagaaaaatggaaacaggaaccctcagaagatgaacaggaacaaggcaccagtgcagagagtgag

SEQ ID NO: 54016 - DNA, 601 bp, Human
ttttgatcacagagaaaaatggaaacaggaaccctcagaagatgaacaggaacaaggcaccagtgcagagagtgagccagaacaaaaaaaagtaaaagccagaagacctgtccccagaaggtgcactgtttgcttaagatctctacttgggatgagcttaatctgctgtagattgggaaggataatgtcgtgctgaaatgagagctttaatgagatgcattgtgttttgattctgcgttttagatatctgtggttcactttcagccagcctacattgcaggtcttactgcttctttcttcrcagactggctatcgtggggcaaacatgtcttccgcttttagtaaaactccttatatgtttggccagggtacagtctctttttgggagaacaaattgtttaaaacactgtttgcctggcttaaagcatacttgagtggtttattaccttgttcataaaatctatataacattaaacaaataatctgattgtgtagagaaggaggtaggctgaaatagcagcaaattatgctaatttttgataagacagatggcagcctaagatagtgatgacaggaaaagggagtcagaagacaggcccca

SEQ ID NO: 54017 - DNA, 601 bp, Human
tatcgtggggcaaacatgtcttccgcttttagtaaaactccttatatgtttggccagggtacagtctctttttgggagaacaaattgtttaaaacactgtttgcctggcttaaagcatacttgagtggtttattaccttgttcataaaatctatataacattaaacaaataatctgattgtgtagagaaggaggtaggctgaaatagcagcaaattatgctaatttttgataagacagatggcagcctaagatagtgatgacaggaaaagggagtcagaagacaggccccagggaaaattwcctccttgtagtattgcttagaatggactcagcaaactatgccctttgggccaaatttcatccaccacctattttcatatggcctgtgagctaagaatagtttttatagatgaacatttctaatttacagtttaaggatagagagcactaaatttgaactccaattaagtgaaatgttatcccctcaaaaacaattctgttctcattagtagatatatattgcagtaaatgtacctgattatttcattttgaattatttaaaaaaatttgtgaaaatttattttctttcattatgtaagg

SEQ ID NO: 54018 - DNA, 601 bp, Human
ggactcagcaaactatgccctttgggccaaatttcatccaccacctattttcatatggcctgtgagctaagaatagtttttatagatgaacatttctaatttacagtttaaggatagagagcactaaatttgaactccaattaagtgaaatgttatcccctcaaaaacaattctgttctcattagtagatatatattgcagtaaatgtacctgattatttcattttgaattatttaaaaaaatttgtgaaaatttattttctttcattatgtaaggacctatacattggtccccattttgyctcttggctggcagagcctaaaatatttactctctggccatttacagaaaaagtttgccaacctctggcctaggacattgtacttaccccccaacaccagcaggggaatttgtcaactgaattttatcttattttatctcagcttaataagtttatctcagaactgtcacgccagttctgtcttttagaattttgctcattatttattacatcgttgatcatctgtttaggtttggttatgagaaaggtatgggaggtatgagagaaagagataataaatgtgatcatgagtatccattt

SEQ ID NO: 54019 - DNA, 601 bp, Human
ttgcaaataatgctatagtgaatactttattatgcctgtttaggtgtatatcaataggattaattcctacaagtaaaactgttaattcctacaagtaaaatagtttgatagctatttccagtttgcccaccaaagagatactatcatgaacaacatgctgtgtatgtgtttttatatcaggtaatcctgatgaacatttgtgaaacattcacgttctttcccataaatgattgaggattatcagcattagaatgaccttcctgttggaaatccagatttctagtgaattagaatttcaggragtagggcccaagaatatgcatgtttaacattccccaagtgaaatgttacattctgatgtatgaaccactgctctgggaaatactgttatataaagtagacaccaaatgataaagtgaagacttagccttttgtttctcttctcattttagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttaggtaagttg

SEQ ID NO: 54020 - DNA, 601 bp, Human
gctttgagtatgctagtgtatagcctagcactttttcttactgtaactgtactacatccaggattgtttttctttcttgtgactcaatcattcattgttaatatgtgataggaagttacatatataaaaatatatataaaaaatataaaaaatatataaatatataaataaatataaatatatataaatattataaatatataaaaatatatataaatatataaatatataaaaatatacatataaatatatataaaaatatatataaatatatatataaatatacatataaatatatattaaatatatataaatataaatatatataaatataaatataaatataaatatatatataaatatatatatataatttttttttttgagacggagtcttgctgtgttgcccaggctagagtgcagtggcgcgatcttggatcactgcaacctctgcctcccggattcaagtgattctgctgcctcagcctccagagtagctgggattacaggcgcccaccatgccggctaatttttgtatttttaatcgatacggtcaccatgttggccaggctggtttctaactcctgacctcgtgattcac

SEQ ID NO: 54021 - DNA, 601 bp, Human
tagtgtatagcctagcactttttcttactgtaactgtactacatccaggattgtttttctttcttgtgactcaatcattcattgttaatatgtgataggaagttacatatataaaaatatatataaaaaatataaaaaatatataaatatataaataaatataaatatatataaatattataaatatataaaaatatatataaatatataaatatataaaaatatacatataaatatatataaaaatatatataaatatatatataaatatacatataaatatatataaaatatatataaatataaatatatataaatataaatataaatataaatatatatataaatatatatatataatttttttttttgagacggagtcttgctgtgttgcccaggctagagtgcagtggcgcgatcttggatcactgcaacctctgcctcccggattcaagtgattctgctgcctcagcctccagagtagctgggattacaggcgcccaccatgccggctaatttttgtatttttaatcgatacggtcaccatgttggccaggctggtttctaactcctgacctcgtgattcacctgtgtcagcctc

SEQ ID NO: 54022 - DNA, 601 bp, Human
tatagcctagcactttttcttactgtaactgtactacatccaggattgtttttctttcttgtgactcaatcattcattgttaatatgtgataggaagttacatatataaaaatatatataaaaaatataaaaaatatataaatatataaataaatataaatatatataaatattataaatatataaaaatatatataaatatataaatatataaaaatatacatataaatatatataaaaatatatataaatatatatataaatatacatataaatatatataaaatatatataaatatawatatatataaatataaatataaatataaatatatatataaatatatatatataatttttttttttgagacggagtcttgctgtgttgcccaggctagagtgcagtggcgcgatcttggatcactgcaacctctgcctcccggattcaagtgattctgctgcctcagcctccagagtagctgggattacaggcgcccaccatgccggctaatttttgtatttttaatcgatacggtcaccatgttggccaggctggtttctaactcctgacctcgtgattcacctgtgtcagcctcccaaa

SEQ ID NO: 54023 - DNA, 601 bp, Human
gcctagcactttttcttactgtaactgtactacatccaggattgtttttctttcttgtgactcaatcattcattgttaatatgtgataggaagttacatatataaaaatatatataaaaaatataaaaaatatataaatatataaataaatataaatatatataaatattataaatatataaaaatatatataaatatataaatatataaaaatatacatataaatatatataaaaatatatataaatatatatataaatatacatataaatatatataaaatatatataaatataaatawatataaatataaatataaatataaatatatatataaatatatatatataatttttttttttgagacggagtcttgctgtgttgcccaggctagagtgcagtggcgcgatcttggatcactgcaacctctgcctcccggattcaagtgattctgctgcctcagcctccagagtagctgggattacaggcgcccaccatgccggctaatttttgtatttttaatcgatacggtcaccatgttggccaggctggtttctaactcctgacctcgtgattcacctgtgtcagcctcccaaagtgc

SEQ ID NO: 54024 - DNA, 601 bp, Human
tcaatcattcattgttaatatgtgataggaagttacatatataaaaatatatataaaaaatataaaaaatatataaatatataaataaatataaatatatataaatattataaatatataaaaatatatataaatatataaatatataaaaatatacatataaatatatataaaaatatatataaatatatatataaatatacatataaatatatataaaatatatataaatataaatatatataaatataaatataaatataaatatatatataaatatatatatataatttttttttttgagacggagtcttgctgtgttgcccaggctagagtgcagtggcgcgatcttggatcactgcaacctctgcctcccggattcaagtgattctgctgcctcagcctccagagtagctgggattacaggcgcccaccatgccggctaatttttgtatttttaatcgatacggtcaccatgttggccaggctggtttctaactcctgacctcgtgattcacctgtgtcagcctcccaaagtgctgggattacaggtgtgagcctccgcgcctagccaatatgtttctttttttaaaccaggaag

SEQ ID NO: 54025 - DNA, 601 bp, Human
aatatatataaaaatatatataaatatatatataaatatacatataaatatatataaaatatatataaatataaatatatataaatataaatataaatataaatatatatataaatatatatatataatttttttttttgagacggagtcttgctgtgttgcccaggctagagtgcagtggcgcgatcttggatcactgcaacctctgcctcccggattcaagtgattctgctgcctcagcctccagagtagctgggattacaggcgcccaccatgccggctaatttttgtatttttaatmgatacggtcaccatgttggccaggctggtttctaactcctgacctcgtgattcacctgtgtcagcctcccaaagtgctgggattacaggtgtgagcctccgcgcctagccaatatgtttctttttttaaaccaggaagtatttgtgttgaagcttccagcagtctgggaatacttaaatttcatattcttattactgggagacaacatacagggttgacatttttaattttagaaatattgcttctctttttgcctgatgaaatagtagcaaattttttcttccattatggtttttcttt

SEQ ID NO: 54026 - DNA, 601 bp, Human
aaatatatatataaatatatatatataatttttttttttgagacggagtcttgctgtgttgcccaggctagagtgcagtggcgcgatcttggatcactgcaacctctgcctcccggattcaagtgattctgctgcctcagcctccagagtagctgggattacaggcgcccaccatgccggctaatttttgtatttttaatcgatacggtcaccatgttggccaggctggtttctaactcctgacctcgtgattcacctgtgtcagcctcccaaagtgctgggattacaggtgtgagcctcygcgcctagccaatatgtttctttttttaaaccaggaagtatttgtgttgaagcttccagcagtctgggaatacttaaatttcatattcttattactgggagacaacatacagggttgacatttttaattttagaaatattgcttctctttttgcctgatgaaatagtagcaaattttttcttccattatggtttttctttttttgtgtggtagtctacttgtttacataataatctgatactaaaaaatgaaaaaaatagaagtgtccttatagttttctatatcttgcttatacaaatc

SEQ ID NO: 54027 - DNA, 601 bp, Human
gctaatttttgtatttttaatcgatacggtcaccatgttggccaggctggtttctaactcctgacctcgtgattcacctgtgtcagcctcccaaagtgctgggattacaggtgtgagcctccgcgcctagccaatatgtttctttttttaaaccaggaagtatttgtgttgaagcttccagcagtctgggaatacttaaatttcatattcttattactgggagacaacatacagggttgacatttttaattttagaaatattgcttctctttttgcctgatgaaatagtagcaaatttttycttccattatggtttttctttttttgtgtggtagtctacttgtttacataataatctgatactaaaaaatgaaaaaaatagaagtgtccttatagttttctatatcttgcttatacaaatcagtataaatatagaatttttattttcaaattgagttagactccctacagttgtttaggagcattcatcagcactttaggaaaaaaaagtaagctttgagcctactgtaaatggcagatctataaaacaacatgcttttggaaccaaaagggtatggtttcttattctagtgacggttat

SEQ ID NO: 54028 - DNA, 601 bp, Human
aaaaggtcttagattcaagactgggaaagaaaggaggtatgtgtatttggggagcaaattacattttatgtatgcttagtaagacttagattttaggtattttaactctaatgtgatgaattttagtctactgctgtatttgttgtgatatgtagaagtctttctgacccagtgtttcagagctgaggacaaaggtatgtgtacactatgtctttaagattttaaattaagctagtatagataagtgtcaatgttttataaagcagtgatatagcagagatacctgctaattaacattaarcaaatccacctttggttatttgtttcttaagctccttgtgaaaatatcaaactggttaaataaatattgtggtaatattgaagatttttaaatatctaatttagatatctcataactaagttgcattaaagtaaactttctgtaaaggaaataccaaaataatacttaatgctttttcttttggcttttttttttttttctttttttcattctggcttcgattgaggttaagaaagttaaccggggacttcgagtaggggaggttggaggaggatattttggtgttctatccttagtctt

SEQ ID NO: 54029 - DNA, 601 bp, Human
tcttagattcaagactgggaaagaaaggaggtatgtgtatttggggagcaaattacattttatgtatgcttagtaagacttagattttaggtattttaactctaatgtgatgaattttagtctactgctgtatttgttgtgatatgtagaagtctttctgacccagtgtttcagagctgaggacaaaggtatgtgtacactatgtctttaagattttaaattaagctagtatagataagtgtcaatgttttataaagcagtgatatagcagagatacctgctaattaacattaagcaaatscacctttggttatttgtttcttaagctccttgtgaaaatatcaaactggttaaataaatattgtggtaatattgaagatttttaaatatctaatttagatatctcataactaagttgcattaaagtaaactttctgtaaaggaaataccaaaataatacttaatgctttttcttttggcttttttttttttttctttttttcattctggcttcgattgaggttaagaaagttaaccggggacttcgagtaggggaggttggaggaggatattttggtgttctatccttagtcttggagag

SEQ ID NO: 54030 - DNA, 601 bp, Human
agtaaactttctgtaaaggaaataccaaaataatacttaatgctttttcttttggcttttttttttttttctttttttcattctggcttcgattgaggttaagaaagttaaccggggacttcgagtaggggaggttggaggaggatattttggtgttctatccttagtcttggagagagggatttgttttccgagttagtaagggaccaaaacaaaaggatgttgctgctctgtttttattgtttttgaataagggatttctttgatttcacctgcaaatttaggaatatgtaaaaagtggtttacatttttaaaatacttgaaatttttgattgagtccgttctgtgttgtttgtgagtttgtacttatttcaagttgaagtattttggtgcttcatccacaaagggagtcttcagataattgcattcttgggaagctttttaatatctggtgtaatatactctctttcaagtgtacttaatccttttgcagccactggagcatctactactgtatatgcgattgaagctaatggcgaccctagtggtgactttgacactgaaaaggatgaaggtgaaatccagtacctcatcaagtgga

SEQ ID NO: 54031 - DNA, 601 bp, Human
aagaaatgtatttgcagcctgaaagaagggaaggttttaaaataatgcatggagatcacagctatctagaatctcagattttgctttgatcatctaaacatggagccatttacaattctattttataagattgtgaccttcagatactatatttttatatgtggctaccaagtttttggagttaactagcttatggagcgttattcacacattctttagttttcacaataagtgcatgagatttgtactgttattacccattttgtagatggggagaatacggcacacagcaattctgcargtggactcaggttttgaattctgatgccctgaatccagagcttattctcttaagcaccttgttattttcctgtagttaggctggggtggcttagatgtagagagttaatattctggaactctctgggttatgatatacttaaaacaaattctggttttatacaatttgcagaaatgatgtgaaggaaattattaggttaactactgaaactgtgatagtcctcgtgtgtttagtttacttacagccttgaatgtctgggtgttgtatatgggaaatatgtggagctatagcacacaaaaa

SEQ ID NO: 54032 - DNA, 601 bp, Human
gatcattggagtggagaccaagagcttagtttgatatttgtaagtttgatttacttcttagtcatctaagtggagaatatagtgaaggctggagcatatgtgaacctggagcttaggactctttagtctgggctggagatttaaatttggaaatttatcagtatttagtatttaaaggccaagattgaacaggaccatcagaaatagagtatcacgtggtaagaagaagtagtctgagagcatttcagcttttggaagtcagaaagaagctagcaaaggagactgagaaagaacagtcggwgagacaggaggagagctgagagagagtggtgtactggaagccaagtgattcacatagccaggagagaggaaatgctgtcagtcaaggacgattaggactgagacttgatctgtgaatttggcactggcaaaacgcatccatggagtggtgagggtgcggcctgattagggtaggttcaagagaaaatgagaggggatagcaagtataaacaactcgttgggggagttttcttacaaaggggaacagagaagtggagtgtcagcctgagagagagatgagaaaaagaatttttttcttctt

SEQ ID NO: 54033 - DNA, 601 bp, Human
gtatggtgatggttggcttttgttttttcagggagaagatatactgataaagaggattggacacatatgtgctgagaaaatattacaaaatgaaatgatgattgccattttgaagtgaaagaaggtgatttaaatatgacattaaagcaaaaggagagaatgaattatttcatggctttgctgacttgtttaatcttgcaatttacataattagaaatagagatatttgagagaatacttgaaaggatttaggcacttttattttattttattttattattttattttgagacagagtttygctgtgtcgcccaggctggagtgcactggcactatcttggctaactgcaacctctgcctcctgggtttaagtgattctcctgcctcagcctcctgagcagctgggattacaggcacgcaccaccacttccagctaattttttgtatttttagcagagatggggtttcaccatgttggtcaggctggtctcaaactcctgacctcaaatgatccacccaccttggcctcccaaagtgctgggattacaggcgtgagccaccatgcccagttgcatttaggcactttaaaagagaagtgaag

SEQ ID NO: 54034 - DNA, 601 bp, Human
tgtatttttagcagagatggggtttcaccatgttggtcaggctggtctcaaactcctgacctcaaatgatccacccaccttggcctcccaaagtgctgggattacaggcgtgagccaccatgcccagttgcatttaggcactttaaaagagaagtgaagccagttgcagtggctcacacctgtggttccagctacttgggaggctgaggcggcaggattgcttgagcacaggagtttgaggccaacctggggaagattgtgatacccgttctctaaaaaaaaaaaaaaatagagagcgggmagtgatagaaaaggcgagtgtctttgaattctaagttagaaattaaatatataggcttatttgctagattggctgaataaatcctttccttggaatttattccatcaggaaactgatgtgcttgggtcctcagtaatgaaatatcagacaagtgatacgtctctgagaagttgacattcatgttaatggcactagaattctatctgtgaaaaccagtatttaattgccaaagagtgtgatagggaaaatgtggtcagagaagcaccaatgtagaagtctctgagctccagtggtcattga

SEQ ID NO: 54035 - DNA, 601 bp, Human
gccatgagccaccgtgcctggccagcatttttttactttaaaccaaaggaataaaaatcagttgaaaagggctcaagcacctgttaagccctggtcacaggaatgttactacattacataatgtgctattttggtctggttccagaaaaacaggtgaatcaattcaaacctactgtagtctgtatatgtagacaatggcattttctaggggcaggaaatactggagaaacttaactgtgcttcctcctgaatagtattgaaaagtgagggaaataagaaggaaattactcaaaggaatatrctacatcgtttaaactgtgtagaaaattaggtgtacctgagatgtataggggtatggcttcatcattctccctttcccaagtgtgatcttctttgtttctgtattttaccctttaaactagctagtttgtagaacacagaaggtatttttagaaattatgtctttttggtgaattaaatgtcttgttttttgaatcagttaggttgcctttaactcataaattacttttagttctttctgatttgctgattaagcacatattatatatacgtgcaaactttcagtgtccttattttccag

SEQ ID NO: 54036 - DNA, 601 bp, Human
tttctttctgcagaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacggtgtgtaaacaaaaagagctgggttagaatctgtgttataaatgtaatttagaaattcacttaaagccttyagtagatcatcagtaaaatttgtggttattattctgatactgtgctgtgttctcaatattaggaggtttatctatcacaaaagtgcaactcagatgttctttaacaaatatgcttactagttaaaaagcaacagcagtatgtgagtgggaatctcttttagctgggttgcaatattaaatttttcttctctctgccctttttacttctaagattgctttatatgagataatatggagttaatactttgtgtaatattaatattatttttgctttctcaatagacatattactgaaaataa

SEQ ID NO: 54037 - DNA, 601 bp, Human
tttgaaatctgggcaccagagattaacgtagtggtttacataggtgacctgatgagcagaaatacggtgtgtaaacaaaaagagctgggttagaatctgtgttataaatgtaatttagaaattcacttaaagcctttagtagatcatcagtaaaatttgtggttattattctgatactgtgctgtgttctcaatattaggaggtttatctatcacaaaagtgcaactcagatgttctttaacaaatatgcttactagttaaaaagcaacagcagtatgtgagtgggaatctcttttagctrggttgcaatattaaatttttcttctctctgccctttttacttctaagattgctttatatgagataatatggagttaatactttgtgtaatattaatattatttttgctttctcaatagacatattactgaaaataatcattcttcgaatttcttaatttcttaaacagtgaggttgcataacttataaaaaaggaataaaagtaaaggaaaacaagctattttaggactgtagaaataagaattatcctaaactgttaccaaactttatttgggcatcatgaatttagaacacagtgact

SEQ ID NO: 54038 - DNA, 601 bp, Human
agatcatcagtaaaatttgtggttattattctgatactgtgctgtgttctcaatattaggaggtttatctatcacaaaagtgcaactcagatgttctttaacaaatatgcttactagttaaaaagcaacagcagtatgtgagtgggaatctcttttagctgggttgcaatattaaatttttcttctctctgccctttttacttctaagattgctttatatgagataatatggagttaatactttgtgtaatattaatattatttttgctttctcaatagacatattactgaaaataatcaytcttcgaatttcttaatttcttaaacagtgaggttgcataacttataaaaaaggaataaaagtaaaggaaaacaagctattttaggactgtagaaataagaattatcctaaactgttaccaaactttatttgggcatcatgaatttagaacacagtgacttaagtttatctttgtttagcagatcttttctttatagtaactttttttaaagcacctactgtgtgctagatgttgcgctgggtgctttacgtataatacctgtaatcttcatgatagtcttcaaagctgatggcattctt

SEQ ID NO: 54039 - DNA, 601 bp, Human
cttcgaatttcttaatttcttaaacagtgaggttgcataacttataaaaaaggaataaaagtaaaggaaaacaagctattttaggactgtagaaataagaattatcctaaactgttaccaaactttatttgggcatcatgaatttagaacacagtgacttaagtttatctttgtttagcagatcttttctttatagtaactttttttaaagcacctactgtgtgctagatgttgcgctgggtgctttacgtataatacctgtaatcttcatgatagtcttcaaagctgatggcattctttyctgctactgatgaagaattgactcagagagtcttaacacgcgaccctagcgagcaagaatgtggcagagctcagattcggacacaggtgtttctatctagtctagagctttgctctttcatcactgtatataaactatttctgggaaattgcttgtaataagagcaagccattagcaatgtttaaatatttgagttgcatgttgtaaccatatattttcatacaaattcaaatttatttttggtaaatactttcattaaaattgtgtaacttaaacactggctgatttcattggcctaat

SEQ ID NO: 54040 - DNA, 601 bp, Human
aggactgtagaaataagaattatcctaaactgttaccaaactttatttgggcatcatgaatttagaacacagtgacttaagtttatctttgtttagcagatcttttctttatagtaactttttttaaagcacctactgtgtgctagatgttgcgctgggtgctttacgtataatacctgtaatcttcatgatagtcttcaaagctgatggcattctttcctgctactgatgaagaattgactcagagagtcttaacacgcgaccctagcgagcaagaatgtggcagagctcagattcggayacaggtgtttctatctagtctagagctttgctctttcatcactgtatataaactatttctgggaaattgcttgtaataagagcaagccattagcaatgtttaaatatttgagttgcatgttgtaaccatatattttcatacaaattcaaatttatttttggtaaatactttcattaaaattgtgtaacttaaacactggctgatttcattggcctaattttgagtttctaagaatatagttttagctttgttaaatcattagttaaccgttaaagacgaaaaaagagaaatttataggtt

SEQ ID NO: 54041 - DNA, 601 bp, Human
tagctttgttaaatcattagttaaccgttaaagacgaaaaaagagaaatttataggtttacaaaatagcgtaaagcactacattccaaaaatgattgcaaacaaagaaaatgaactctaaaaaattgtagtcagagaagttttccttgctatctccagttctccttttctttgttctttttacccccacttgggggcgatcacctgcaggcacttactgtcttgttctccagttcctaacttgacagccaaactgcaagagcgttgtcatgagtcttcgtgcttgctgagtgtccagttayacttcagtatgaatgtgctcatctttgtgttcttttacattgacgttattatacgtattgcattatattttcatcttacaagcctccctttttgttgggggacatatctctttggtctatggttgatgaagttccaaaggttggaatttgttttacttgttaatatatgtattttcctattcaaaaagtaaataaattgcatttttaaaagaaatttctaaggatctgggagatcccttgttgagttccaatcaccagggttcagtagctgatgaagtgcattttcttcagtagatgtat

SEQ ID NO: 54042 - DNA, 601 bp, Human
aatgtttcagctcatcttaaacgaccacctcctttcagaaatcttttgcagattgcctaacctaaagtagccctttagacatcttatccctaacctgttttagtgtctatatagcatctctttttacatttatgttctcattcatctcatgtcattaaattatgtatgaaaatcgcagggattttgtttgcttgattcattgctggttcccattgtctagaatagcacctggtgcacagtaaacaattcagttaatagttgttcagttgatagatatatgctctacaatctttttttttttaattcaggattaaattttattttttacttttatttttatttttaaattttaaatttaaatttgtttagtaactttatagtttgcaaccatcatcattgtccagttttggaacattttcctcatcccaaaaagttccccctttcttgtttgcagttaacctctgcttccacatatagccttaggcaaccagtaatcagcttttgtctctagagatttaccttttctagaagttttatataagtggaatcctaatatgtaggcttttgtttccggcttccttcacttagcatattttttttg

SEQ ID NO: 54043 - DNA, 601 bp, Human
tggaactctaagcatgtgggaattatttatatcctactgctcaaggtcattgccaaggtctgattgcaaaaaattcaaaaaattgcaacctctatcataaatgggttaaaaaaattggattgtttgtcttattatgagttgaagaggttttttatttcttttaaaaaaattctaaagacaagtgctttatcagtacagtccccaactttctatagtttgatgtaaaatgttttgacttttcagtggtatgaaagcaatacactttcagtagaaagtatactttgaatgaacacaaccattytgtttttcattttcagtgtaatattcgataaattacatgagatattcaactctttattataaagttggctttgcgttaggtgattttgctcaatatcctcatgataagcgttctgagcacattcagggtaggctacggtgtgatgttctgtaggttaagtgcattaaatgcatttttgatttaacaatgttttaaacttacgatgggtttctcaggacataaccctgttgtaagttgaggagcatctgtatataatttgaacatattttatcccaatctgtggcttcttttcactttttg

SEQ ID NO: 54044 - DNA, 601 bp, Human
tatatcctactgctcaaggtcattgccaaggtctgattgcaaaaaattcaaaaaattgcaacctctatcataaatgggttaaaaaaattggattgtttgtcttattatgagttgaagaggttttttatttcttttaaaaaaattctaaagacaagtgctttatcagtacagtccccaactttctatagtttgatgtaaaatgttttgacttttcagtggtatgaaagcaatacactttcagtagaaagtatactttgaatgaacacaaccattctgtttttcattttcagtgtaatattcrataaattacatgagatattcaactctttattataaagttggctttgcgttaggtgattttgctcaatatcctcatgataagcgttctgagcacattcagggtaggctacggtgtgatgttctgtaggttaagtgcattaaatgcatttttgatttaacaatgttttaaacttacgatgggtttctcaggacataaccctgttgtaagttgaggagcatctgtatataatttgaacatattttatcccaatctgtggcttcttttcactttttgaatgttgtctttcaaagagaaaaagtt

SEQ ID NO: 54045 - DNA, 601 bp, Human
ccaggctggaagggaagtggcgcaatctcagctcactgcaacgtctgcctcccgggctcaagtgattctcctgcctcagcctcccaagtagctgggattacaggcacgcaccaccatgctcaactaattttttgtattttagtagaaatggggttttgccatgttggccaggctggtctcgaactcctgacctcaagtgatccaccgtccttggcctcccaaagtactggtattataggcgtgagccactgcacccggcctagactgctttttaaaaatggagaagtacaagttccatttycttctttttcaaaattgttttggttattctagaattcttgatacttccatgtacattttaggatcaggttgttaatttctgcaagaaaaatatggaattttgatagaaattgtgttgaatcatatatcagttaaagcaaaattattaatattgagtcttctaatccataatcatggaaagtttttctccatttatttagatcttctataatttttctcagtgtttagtggtttttagtttagaaatcttatacattcaaaatattcttttaattctgactatatttggagtggaattttt

SEQ ID NO: 54046 - DNA, 601 bp, Human
atgtgtgtgtatattgttctgtatttcttagtatttttctatagacaggattatgttttctgtacctaaagatttcttttccaaaatggatgctttttatttcttcttcttgccttattgtattggcaggaacctccatcttaaatagaaatggtgggagcaggatgttggctatagatgttttttgtagataacctttattgggttgaggaggttttcttttcttcctagtttgtgaggttttaataaagaatggatattaggttttgtcaaatgcttattttctgtgtctgttgagatraccatgtggttttgtcctttaacaatatagtatattacattaattgctttttagacattaggccaactgtttttttcctagcataaatctgacttgttaacagtgtttgatactttctatgcattgctagattcagttggctaatattttgttaaagatttttgcatctgtttggtgtttttttttttttttttttttttttttaagacagagtttccgtctgttgcccaggctagagtacaatggcaccatctcggctcactgcaacctccacctcccaggttcaagcatttctcatgc

SEQ ID NO: 54047 - DNA, 601 bp, Human
agatttcttttccaaaatggatgctttttatttcttcttcttgccttattgtattggcaggaacctccatcttaaatagaaatggtgggagcaggatgttggctatagatgttttttgtagataacctttattgggttgaggaggttttcttttcttcctagtttgtgaggttttaataaagaatggatattaggttttgtcaaatgcttattttctgtgtctgttgagatgaccatgtggttttgtcctttaacaatatagtatattacattaattgctttttagacattaggccaactktttttttcctagcataaatctgacttgttaacagtgtttgatactttctatgcattgctagattcagttggctaatattttgttaaagatttttgcatctgtttggtgtttttttttttttttttttttttttttaagacagagtttccgtctgttgcccaggctagagtacaatggcaccatctcggctcactgcaacctccacctcccaggttcaagcatttctcatgcctcagccttccaggtagctgggattacaagcatgcaccaccatgcccggctaatttttgtatttttcgt

SEQ ID NO: 54048 - DNA, 601 bp, Human
gttgaggaggttttcttttcttcctagtttgtgaggttttaataaagaatggatattaggttttgtcaaatgcttattttctgtgtctgttgagatgaccatgtggttttgtcctttaacaatatagtatattacattaattgctttttagacattaggccaactgtttttttcctagcataaatctgacttgttaacagtgtttgatactttctatgcattgctagattcagttggctaatattttgttaaagatttttgcatctgtttggtgtttttttttttttttttttttttttttaagacagagtttccgtctgttgcccaggctagagtacaatggcaccatctcggctcactgcaacctccacctcccaggttcaagcatttctcatgcctcagccttccaggtagctgggattacaagcatgcaccaccatgcccggctaatttttgtatttttcgtagagacagtggggttttgccatgtcagccaggttggtctcgaactcctggccgtaagtgatctgcatctgcctgtctccgccgcctaaagtgctgggattacaggcgtgagccactgtgcctggccgcatttgtg

SEQ ID NO: 54049 - DNA, 601 bp, Human
gtcttagtatgctttctttcctggagactgtccgataagtgcttgtaaagaataatctgtattctgcctttgtttgagtagtgttttgtaaatgtccgttcagtgtggtgttaatggtgttgttcaagacttttatatcttttctaactgccagtttagttgtgctttgaattattgagaatgaaatattttaatttttaactgtagttgagtttttgtcttctagtcattttttgcttcattattttggggttgttctgttaggtatgtatccattcataacttttgtatgttcctgagrtattgacctttttctggtcaataccagaatgtcccatttgacctctaatgatatttattgttttgtaaatccattttgtgtgattttattatagctcctcagctctcttctgattcctgtttgcatgatatattgttttccatcattcgaactggttaccatttgcatggtatactgttttccatcattttactttcaacttacttctttctgtaagtctaaaatgtgtcttatagacaacctgtacttggatgtaccttttttatccaggcaaataatccttgccttttgattggaata

SEQ ID NO: 54050 - DNA, 601 bp, Human
ataacactatactgtttcttccctaggtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtaagttcttgtttgggttaggcctgaaggggttgagatcagtaccatgaaactattagataggagatatatatatatacttttgttttttttttttttggagacagagtctcgcgattctgctgcctcagcctaccgagtagctgggattacagggatgcgccaccacgcccagctaattttttttgtatttttagtagagatgggatttttccatgttggtcaggctggtcttgaactcccgacctcatgtgatccgcccacctcggcctcccaacgttttgttgttattaagcaaaatttcaatactgttgttatgtctaaaaaattttaataattccttaacagtttcgtaatatctagtgtttacattttcctggttgtca

SEQ ID NO: 54051 - DNA, 601 bp, Human
gaacagattctcagggtggagatgtcagcccttcagaaacagtattacaagtaagttcttgtttgggttaggcctgaaggggttgagatcagtaccatgaaactattagataggagatatatatatatacttttgttttttttttttttggagacagagtctcgcgattctgctgcctcagcctaccgagtagctgggattacagggatgcgccaccacgcccagctaattttttttgtatttttagtagagatgggatttttccatgttggtcaggctggtcttgaactcccgacctcakgtgatccgcccacctcggcctcccaacgttttgttgttattaagcaaaatttcaatactgttgttatgtctaaaaaattttaataattccttaacagtttcgtaatatctagtgtttacattttcctggttgtcatatacatgtatgtatatctccgtttgtgcatgtgccattttgcttgttttgggatcgatgtaagctccgtgcattttgcttgttttgggatcgatgtaagctccgtgcattttgcttattttgggatcaacgtaagctccatgcattttgcttgtttggggatcg

SEQ ID NO: 54052 - DNA, 601 bp, Human
aatttcaatactgttgttatgtctaaaaaattttaataattccttaacagtttcgtaatatctagtgtttacattttcctggttgtcatatacatgtatgtatatctccgtttgtgcatgtgccattttgcttgttttgggatcgatgtaagctccgtgcattttgcttgttttgggatcgatgtaagctccgtgcattttgcttattttgggatcaacgtaagctccatgcattttgcttgtttggggatcgatataagctccatgcattttgattggttggtatgtctcttaagtatawtttaatcaatttatttttctttgccttataaattttttgagtcaggaaactgaatttatgttttgtagacttttctcacagtctggattttgctgattctagctccatggcattctttaatattttcagccaggtgtggtggctcacgcctataatcccagcactttgggaggctgaggcaggaggatcgcttgagcccagtagtttgagaccagcctgggcaacacagtgagactccatctctataaaaataaaaaaatttttaaaaaccacttttcctctgaactgtgttttctgtat

SEQ ID NO: 54053 - DNA, 601 bp, Human
atgtacttttactattttggagtttgtggttaaggaatatacatgggtatacatgaatatatctgtatttctcctccaaatttgggtagaaaacatactgataagttattttgtcagataaaatactcttttacaatgttaaaatgggtatgtagcctctattttatggtatatttacatttatttaacctcataatgttagcttatttccaatttttatatttcagtgaagagtgtttcagtgacagtcattttccattcacacatgcacacacaggttgagtctcttatcaaaaatgcytggggaccagaagtatttcagattttgggatatttgctttatacttactagttaagcattccaaatctggaaatcagaactgtaaaatgctctaatgagaatttcctttgagcgtcatactggcactcagaaagttttgagtgccattttggaacattttagattttcacatttaggattctcagcctttgtgtacacacacacacttaaatatgtataaagtacatgtgtgtaaatatgtaaaatgtatgtatgtatgtgtgtgtgtgtatatatgtaaagcatatgtgtgtgttgtgt

SEQ ID NO: 54054 - DNA, 601 bp, Human
acttgcatgcctttaggctaccatatgaaagtggtcatgaggagacgattctttttttgaaggtgggtggggaggattagagaaagtcaaacggggcaagataaaaaaaggatgtcagatggcatcttattgcatgtgtatggtgaaagtagagaggaagtaagtgtgagctcaattccaggagcccaaatcctagaaggagagggcagtatcagacattccccccaaaagttgaccctggctgtgaggctgggaacatagcagaacactgctacttaaaaccttgctactccctgaagtragtgatgatggcttcccctattttctgtggagttccttaactggagttactgtcttcacacagttatctcctatggggaaaatttcttccgcatagtaacatttttctaggtgtatataatctagtagaaacttattctctgatctatttatagacacatagacatatacgcaatttaccttgtctcttggcatgtttatagtgctttgatttttaagatttattacattttttttaaaactttgaatggatgaactcttctaccaactcacataattatgttgggattgaagaaacttg

SEQ ID NO: 54055 - DNA, 601 bp, Human
tctcttggcatgtttatagtgctttgatttttaagatttattacattttttttaaaactttgaatggatgaactcttctaccaactcacataattatgttgggattgaagaaacttggaccaatgattatctcctaagaaggcccacctttgagactatcagattgattatctttcaaaataccctgaaaggcattgttatatccataatatcttatatggtctttcagttgctgtcttagaatatagcttaaggctgtgcttgttatcaagaaacagcctattgcaaaaagtcacttctstgtcagtgaatcgaatccctatgagctttcattcctaggaaatcccgtgataccaagtaaatcaagaatgcatcgtttttctctctagggaatagataagcttggtcagtgacttttagataattaatgccctctactaatgggaatattaaaaggcggcattaggttttctgatttcaagtaaaggctctgaatctcccattgaatacgtcttcggtttaaggctctgagtagagtagtcagtgagaaagaagtaagggactcctcacctgtcagttgacttgagttaggtctggtggg

SEQ ID NO: 54056 - DNA, 601 bp, Human
gcatttattcagagccaaggctctggttcattaaggataagaggaatggaataattaaagacatcggtcatcaactaattcccattcctcctttccttgctccttgtttcctcagctgtaaaatcacaatgattctgataccccacttcataatattgctctgaggattaaatttggtaatcaacataaagcactgatcacattgcccagtgcatagtaagcgctctaaatatctgctatttttatcatgtagtgttggttgaaattggttttgtgttctccactcttagtttaaaaaatwgtatgagtcgaatgtttcatattgccctgtctcaggggaaaaaaaaaattgctttttgcatagctctcagttgattcccactcactatgatggctatatagaacacaagttctctaccatttctgcagtattttaaaaattcctttaaaaaactaaatatttattgtgggacaaaatattatatgcttacttagaatattgggaagatggtaaagaatacaaagaaaaaaacaattgtacccctcattctagacacaacttgctgttcacgtctttggggtgtatttccattcctactag

SEQ ID NO: 54057 - DNA, 601 bp, Human
atggcataatgttgttgaatgtgactattagaacatggagaccttttcattgcatctctatgtgtatgctaaatatacccatttatcaagatggaactcaggactaccagtttttcaatgctgcttctctctgctacaaaggcatcagcttttgacatatatgattaaattccctgaaaatagaaatatttcaccttttccccccggcttatatattttattctttttctcctgcccccatatttttctgagcactcagacgcaggcaggtgtgctgtgcttgcccagtgtctactgtcaytgctgtggatactgcagtgtcagtgcctgggtggttccacacatcgctctccagccaaacctgttttgatttttttataattttggcatgttttgtggtaattgaggatcctgtggttctcaacacttaccatatatgatctctttagtgcagtgtttctatatttctcgccagcctaacaaacataaatatttatataataaagtatctctgtttatactaactgacttacatggcataatctaccttttccctaaaaataattatacaggtgacttcctggagttaatgatctccatg

SEQ ID NO: 54058 - DNA, 601 bp, Human
tatgaatcttaaagtctgttctatattggataacccgtaagtttcattcttggccaaagattctgtttttgtggaactttccatcactgaagcacgatttttattgatggaacaggccataacgacagatctttagaggcaattttatttaagactgtaacctgctgcacatagtaaaagtattgcatctacttaagctgcctgcttggatggcttacagtcttctatggttagagaataaattctgttaaaattttcccctcttgggttttgacagagctaatccttctctctttttttrggggggttggggggtggttcaggcataagcataacagttccttttcctacaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaagtaagtgccaggaagattgggaggtaggcagaatcaaattgattctacatcactgttggatataataggattttctaccacagacattagtctgttcat

SEQ ID NO: 54059 - DNA, 601 bp, Human
gctggcacgatcttggctcattgcaacctctgtctcctaggttgaagtgattcttgtgcctcagcctcccgagtagctgggactacaggtgtgcaccaccacacctagctaattttttttttcttttttttttttttttagtagagacagggtttttccatgttggccagactggtctcaaactcctgacctcaagtgataggcccacctcagcccctcaaagtgctgggattataggtgtgagccattgtgcccgctgcagctatgttaaaggtgtattcaaattagcccttcctaaatraaatgttttcagatagttttctgtttaagaggaagctagatgagaaaagcctagctcttttattttggaccggggttgagaaggttgaaaattcttggtgaattataactttctgagtaaaaggccaaaggaaagagctccattctataacattgctagtcacctttctggcttacccatgcaataggtgaaccagtaggactgtaactaattttctattctgctggtttagggttaccatcacagactcatcctgtagatagaaaatgcgatgtttgagaaatcatttttcttgaggca

SEQ ID NO: 54060 - DNA, 601 bp, Human
agagaaattggatcagttggctatcccaaggtgggagattggcttgggaggcacaggaaagtcaaaatagcaaaggttttcaagattcatgtgacagcttggaaggaaggattgaccatgggttgattccatggaggtagagaagcaagagagacctgatgattacaatgatggctaagtgtagtatgcccattaggattgaattgaattaggggaaattgtgtgaagtgtttggaaggaagcaatattgtgtgattagctccaaagctggccactggtagaagttgtttcaatggaagarcaaggatggaattgagtgggccagagagccctagattaatgggttaggatgcagaggatggggtagagaagggggaaggtgatttattagtgttcgtcatagtcggtttgggctcctgcagtaaaataccgtagactgggtggtttataaacaatagaaatgtatttctcacagttctgaagatttgaagtttgagatcagggtgccaacatggtcaggttctggtggaggctctcaggttgcagactgctgacttttcttatcttcccatggtagagagagagaagctagagagctctc

SEQ ID NO: 54061 - DNA, 601 bp, Human
ccttactgcatgaaccactaacgtatgtgcatatttacatcaatcttaattttagttaattttagccaaaagtcataaagtaagagtcttaacttgacttcactgttggctccaaggaatggagcctccagaagctcatttataccttatgactgtctcaaaggctaggagggagggaataagaagaatgcggagccaggctgggggctgcctgccactgctcagatgctgtccagaggtggtagatgtttctgtgtactcctcctctggttctttgaaatggatacacttagatggcttkctttctgggatacctactgttttagtacaaatacatatcggatattaaataatatttgataagaaatgaagagagtattcttctagatttatttaaattttttctgttttatgttttcattttatttcctaagactaaagtgcacttgtgagcatatgaaatcaccacacatctttaactttcatatttttgataaaaatgaataaagcaaccagttggctagatgataatgagtgctttgagttatgcattgtttcaaatgaactctatacaacttatagaaatgtaagttcatcatgg

SEQ ID NO: 54062 - DNA, 601 bp, Human
taaattgttttagtagatggtgtttagaaatagggaaatgtcagacaatgggttgtctgttttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggtgatcaagtgagatgaaagatatgaaattatttcttatgttgtgaatgctacagaagtgttgwttattcaaagaagaggccttgcattgttcccctgacacagaggcttcaagagcagagttgatactgtaggaaacttaacaaaggaaagtggagaaatctgcagagctcctgagcacacctgtgagacatcggatttggtctttgcaaattggctctttgtgaagctgataaacagggtctgaaatttccagaagtttgcattttgcctttgagtagtcctcacagtttggctgttaattgccactgccttcaactttcagaaagtcacacctctgtttgtccataacagttcacagcact

SEQ ID NO: 54063 - DNA, 601 bp, Human
agaaatttatatgctgcctcgaattcggagttccactaaaaaggtgatcaagtgagatgaaagatatgaaattatttcttatgttgtgaatgctacagaagtgttgattattcaaagaagaggccttgcattgttcccctgacacagaggcttcaagagcagagttgatactgtaggaaacttaacaaaggaaagtggagaaatctgcagagctcctgagcacacctgtgagacatcggatttggtctttgcaaattggctctttgtgaagctgataaacagggtctgaaatttccagaastttgcattttgcctttgagtagtcctcacagtttggctgttaattgccactgccttcaactttcagaaagtcacacctctgtttgtccataacagttcacagcacttgatataaatacttagtaaaggattatataactataaataagaaacatataccaacttgacagttcacaaagctccatcacagacactatctaatttgatttttgtaacaacattgaaataggtagaacaagtttttttacccattttgttggaggtaatagacacagatttgttcaaggtcacagtaaatcag

SEQ ID NO: 54064 - DNA, 601 bp, Human
gagttccactaaaaaggtgatcaagtgagatgaaagatatgaaattatttcttatgttgtgaatgctacagaagtgttgattattcaaagaagaggccttgcattgttcccctgacacagaggcttcaagagcagagttgatactgtaggaaacttaacaaaggaaagtggagaaatctgcagagctcctgagcacacctgtgagacatcggatttggtctttgcaaattggctctttgtgaagctgataaacagggtctgaaatttccagaagtttgcattttgcctttgagtagtcctyacagtttggctgttaattgccactgccttcaactttcagaaagtcacacctctgtttgtccataacagttcacagcacttgatataaatacttagtaaaggattatataactataaataagaaacatataccaacttgacagttcacaaagctccatcacagacactatctaatttgatttttgtaacaacattgaaataggtagaacaagtttttttacccattttgttggaggtaatagacacagatttgttcaaggtcacagtaaatcagtatgaggtaacactagctaccatttat

SEQ ID NO: 54065 - DNA, 601 bp, Human
tatacatttcttggtatctgattcaaatgtctctatcctccataaaaaaatctaaaattgttgcttacaaattattttttttccagtttccatcttttttttttaagcctgaagaaaatagaaagtataaagatggttttaaggcctaatccatattataattatattaaatagtcctttaagtttcatgtatttgaaactgtgaggtgtttcttttcacttaaaggtcacacctattcttctttctttgtttaatttactatggaaaaatagaaatatttcaaaatactgacagaatagyatgtaacacatcccctcttgtgcttatcatcttaacaattttgaatttgtagccaaaattgtatgtatatatacacaccccacctcttcttgctccctattcccagtattattttgagaagaatgtgttttctgctatggggcagtatgttctatagctgtatttggcttagtgtttttcaggtctttaatttcttcattgattttctgtatagttgtggttattttggtagagtcagaatcttgctctcttgcacaggctggagtatgatcctatctcactgtaacctcacactcctgg

SEQ ID NO: 54066 - DNA, 601 bp, Human
tttatttccccattactactttcctttgtgttaaatatataatataccattttaattaccttaaaaaaaaaactatttttttcacttattttcttagtggttgccctagaaattacaagtaacatcttagaacaatttactttgaattaacatcaatttaatttcaatggcattataaaaactttgccccagttatagctcaccatccccatttgtgctgttgtcgcacattacatctttacacattttaaacccatcaatgcagttttataattcatactttatatagttagttgtctcttttttttttttcttttgagacggagttttgctcttctcaccaaggctggggtacagtggtgcaatctcggcccactgcaacctccacttcccaggttcaagtgactgtcctgccttagcctcccaagtagctgagattactggctcctgccaccacgctggctaattatttttgtatttttagtagagatgggatttcaccatgttggccaggctggtcttgaacttctgacctcaggtgatcggtgtgcctcggcctcccaaagggctgggattagaagcgtgagccacccacacccag

SEQ ID NO: 54067 - DNA, 601 bp, Human
agtagagtttccaaaattgtttgcctaagaagttttaaatcatattttactgtgccttattccaaaaactatttgagacagtcaaaaaaatcttaacagctgaaaaatcattggttttctaataacgaaaaatatggtattgaaggtaacagtggtgaactgaatacgctgatgaaacgatataagggtttgtcacaatagagtcgtgatgattgaatcctttatgacacagtgaagtctataaacttgtatcttctaaaaaggatattagagctaagtcacagttctctagcatgttatytaagcaggtttatgtacagtcactgagaataaagttgatctttaatttgaatagatttttagcagtcattattttaagttgactagtttcaaagacattcaacatttattcatttttttggtagtgcaaggattgagtccactctatttttgacaatttgcatggctcatatgtcatcacaggatatgctagcatcaacataactaaagtaagtctctgtttttttaatatgttttattgatcctattcttaggttcatcaaggcttataagaagtttggtctccctcttgaacggtaag

SEQ ID NO: 54068 - DNA, 601 bp, Human
aggatatgctagcatcaacataactaaagtaagtctctgtttttttaatatgttttattgatcctattcttaggttcatcaaggcttataagaagtttggtctccctcttgaacggtaagttcagtgtaatagtcccttatcttcctcttttttgcttttattatatagtacgttcttttttggtaaatttttccatttaatactaatgctgggaacatttttttttctggaaacatttatttacaaacatttatatattgggtgcctgttcattcatgtctctctgcagagggatgacaragatgataaagacaggccatccataaaaagactttcaccttcgtgagggagataaagcaagtatattcaaaaccatagtgcgtgaaataatttccagagagatgttcatgtaactccagttgaaaagaatgtatgtagttattatttgtatcctagttcttagatttaataatgtcaaaggtaaaaggctctttatgattttataatcttctgctaattagcaggattttatgaggattaaatacaaaggacttaacatagccttgactataaaaacttccaaaagggtagctgttgtta

SEQ ID NO: 54069 - DNA, 601 bp, Human
ctggagaaaggaaagtgaacacaaaagaagcaagctagtacggatggtgttcaggcacttcacctgctgccactaacagcctatttatttaataaactttgctttgcttgtttctttctttcctctctgttttttggaattattttgttttgtggaatattcaagacacaattctttatgatggaaaatgaatgtgttagccttcagtcaatgtccaggggttcttgttggagccttagaatgaccactaaaggaacgcaaagaaaagtgtctttgcaggagaagattatgtgaggcctastggcatctcatgacacttaagaagagtgggcacagggtcctaaagtgtccccatatttgttcctcctcaggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggtaagcgaagttggctttagtgagtcttcgcaacctggcactcttggactggatttctgttgctaaagggcgttttaaggacaggcttga

SEQ ID NO: 54070 - DNA, 601 bp, Human
acatgcctagtgatttcaggtgtttattctgagctgcgtttctgtgagcttaatattctactctcctacaggtctactcacaaatgaagttgatttgcagaaggtgtagagtgaagaaaaagatgaaatggtttttttttgtgttgctgtagaaagtttaaattcgtcggagtgatgtaaaaacccaggggcagagcttggtggacacctctgtattttggctgcaaataagaggtgttatagatcacaagcattgttaattatcttggatatatattgtgcgttatggcaaacacaaagkatttagagaattaattggaataaataaaatattggatgaatatcgtaaacatttttgggttacgttgagattttcatgccactagaatttgttctcattggattggacatgcagtgtgttttctctttgataccagaaagtgattttgcctgtcctgtgtgatatctttaaaagcaagaggtataggaatgcttgtgaggagagaactctgaagtagttattggtaaggacaccctcatagtgaactttaaagaaacgaagagaggccaggcgcagtggctcacgcctgtaatcccagca

SEQ ID NO: 54071 - DNA, 601 bp, Human
atagatcacaagcattgttaattatcttggatatatattgtgcgttatggcaaacacaaaggatttagagaattaattggaataaataaaatattggatgaatatcgtaaacatttttgggttacgttgagattttcatgccactagaatttgttctcattggattggacatgcagtgtgttttctctttgataccagaaagtgattttgcctgtcctgtgtgatatctttaaaagcaagaggtataggaatgcttgtgaggagagaactctgaagtagttattggtaaggacaccctcayagtgaactttaaagaaacgaagagaggccaggcgcagtggctcacgcctgtaatcccagcagtttgggaggctgaggccagaggatcacttgagcccaggagttcaagtccagtctgggcaatatgtaagtgagaccttgtctctacaaacagtttaaaaattagccgaaagtagtaggatgcacacctgtaatcccagctacatgggaggctgaggtgggaggttcgattgagaccaggaggcagaggctgcagtgagttgagatcatgccgctgcagtgagttgagatcatgccactg

SEQ ID NO: 54072 - DNA, 601 bp, Human
tatggcaaacacaaaggatttagagaattaattggaataaataaaatattggatgaatatcgtaaacatttttgggttacgttgagattttcatgccactagaatttgttctcattggattggacatgcagtgtgttttctctttgataccagaaagtgattttgcctgtcctgtgtgatatctttaaaagcaagaggtataggaatgcttgtgaggagagaactctgaagtagttattggtaaggacaccctcatagtgaactttaaagaaacgaagagaggccaggcgcagtggctcasgcctgtaatcccagcagtttgggaggctgaggccagaggatcacttgagcccaggagttcaagtccagtctgggcaatatgtaagtgagaccttgtctctacaaacagtttaaaaattagccgaaagtagtaggatgcacacctgtaatcccagctacatgggaggctgaggtgggaggttcgattgagaccaggaggcagaggctgcagtgagttgagatcatgccgctgcagtgagttgagatcatgccactgcacttcagcctgggtgacagagcgaaaccctgtctcaaaatataa

SEQ ID NO: 54073 - DNA, 601 bp, Human
ttaatattattgaatttgatataatttaaaaatatcttcaagagagtcaaaacttattttaagataatgttcttttttgtaaaagacaaataacttgtatggtttgcaaaatgatctgaatatgtgcttttataacattcagaatacacccaaaagtaaactttaggtttaatgtacagtatgttttctatgtaattgttttgaataagtaatacatctacatggcttaaaactgaaaaacgtattcctgttacttcttgatgcttttgagaaatgaataatgttttctcccttttaaatrgtagtacagcatgcacacttttctgtgcttgcttttttatctcatagtatcttgtggagctgttttcttaacagtcccttctccccaaagtctcccttttttttgtgcatgtccacattctggatctggctgattgcttcttcctggtattaacttatttcctcacacctgtatttcctgtaaactggtattcagcatattctgaatccaggctgacatttctagatcaaatggaagattattgataccttttttcccttaggttgaaatttttgtttctaaaaatgttaacataattac

SEQ ID NO: 54074 - DNA, 601 bp, Human
tatttcctgtaaactggtattcagcatattctgaatccaggctgacatttctagatcaaatggaagattattgataccttttttcccttaggttgaaatttttgtttctaaaaatgttaacataattacatatttgctttatcccaaacatatgtttccaaataccaataccaatcttactgttaacaaaagaatgctgaaatgcgaagtgtgatttctttgcatttctttttgatcttagaatatatcacactaacaatataaagtcaaaatatatgtttaaattattcaaagttattcstttctctgtgtggttaatgccaccaccttaatatatagttagactcttttgttttcatttattttcagtacttagggactgcttttctcatttagattcgatttaatttttttaattatgtaaaaacatttacatggttcaaagtcacaactataaaacaaggtacatttggagcatcttgttttcgttttttgttccccagctgccttctcttcctccttaataggtcactgtttctattagttgtaagtttatctttgattgtttcttttaaaatttaagtgtgtgtgcgtattttcc

SEQ ID NO: 54075 - DNA, 601 bp, Human
gcatttctttttgatcttagaatatatcacactaacaatataaagtcaaaatatatgtttaaattattcaaagttattcctttctctgtgtggttaatgccaccaccttaatatatagttagactcttttgttttcatttattttcagtacttagggactgcttttctcatttagattcgatttaatttttttaattatgtaaaaacatttacatggttcaaagtcacaactataaaacaaggtacatttggagcatcttgttttcgttttttgttccccagctgccttctcttcctcctyaataggtcactgtttctattagttgtaagtttatctttgattgtttcttttaaaatttaagtgtgtgtgcgtattttccttcttacacagaagagaacatactcttttgcacctgcttattttcatgactgagataaattcatatcattatgtagagatcatcctctttccttttacagttgcagagtattctaccatgtagatagatgtcaattcacacttcccccctagtatttaatatttgggttgttttcggtcttttgttattataaagaaagtcacaatgaataatgatctaat

SEQ ID NO: 54076 - DNA, 601 bp, Human
tgaaatttgggttagggtaagtttctttttttttttttttttgagatggagtctcgctccatctccaaggctggagcacagtggtgtgatctcggctcactgcaagctctgcctcctgggttcacaccattctcctgcctcagcctcacgagtggctgggactacaggcgcccaccaccacacctggctaatttttttgtatttttagtagagaaggggtttcactgtgttagccagtatggtctcgatctcctgacctcgtgatctgcctgcctcagcctcccaaagtgctaggattacwggtgtgagccaccgcgcccgcctgggttagtgtaattttcttaagccaccacttgttcatcatttcacatgtgttagatgtgaacttaagctcatgtgttttcagtaatagtgttgtgaagatcaagttcatttttaaaacacttgagagttttttgaccttcgctagtgggatgggtaggaaaacaaaaagagaaaccttcagcactaatattataccctcagaatctacttttgttcatttggaaacaaagtagtataaaacaagcaggaagattaaaatacaactataaacatcagt

SEQ ID NO: 54077 - DNA, 601 bp, Human
tcaagttcatttttaaaacacttgagagttttttgaccttcgctagtgggatgggtaggaaaacaaaaagagaaaccttcagcactaatattataccctcagaatctacttttgttcatttggaaacaaagtagtataaaacaagcaggaagattaaaatacaactataaacatcagtgaattaaaaaagaattccaaatcttaaaagactgaatgttcagaggttattttacagacattagttgagaaaaaaatttgtcttatagattatatcttcaaaataacaataagccagagatayattcagagagactaagaggtcagggttcgttgatacatgttttctgtggaacttctgcagattttcatttaactaatgtgaaactggtatttttcaggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaagtgagtatattttgtgtacatgcttagatggtcgtaccgtaagaaaatagatttgaagttagac

SEQ ID NO: 54078 - DNA, 601 bp, Human
ttacttgttgaagctgctcagaaagggtctggagaagaagggggctgtgacaggtggggaagaggtgagtacgctgccagctggttgtttttcaggggcctgaggctcctaccctgcagaattaggtaggaagagagaggccctctctgagcactgcacagaatgtcaccttctcatgggcatattttgtttttgaggttccagtaatgatggtttgcttggtaataatagaaatgttcatttaggcctggcgcagtggctcatgcctgtaatcccagcactttgggaggccgaggcgggyggatcacaaggtcaggagattgagaccatcctggctaatatggtgaaaccccgtctctactaaaaatacaaaaaaattagccgggcgtggtggcacacgcctgtaatcccagctacttaggaggctgaggcaggagaatggtgtgaacccgggaggcggagcttgcagtgagccgagttcgggccactgcactccggcctgggcaacagagcgagactccgtctcaaaaaaaaaaaaaaaaaaaaaaaaaaaaaaaaaattcatttaagaccacggcatcttggcagctttcttacaaac

SEQ ID NO: 54079 - DNA, 601 bp, Human
tgaggttccagtaatgatggtttgcttggtaataatagaaatgttcatttaggcctggcgcagtggctcatgcctgtaatcccagcactttgggaggccgaggcgggcggatcacaaggtcaggagattgagaccatcctggctaatatggtgaaaccccgtctctactaaaaatacaaaaaaattagccgggcgtggtggcacacgcctgtaatcccagctacttaggaggctgaggcaggagaatggtgtgaacccgggaggcggagcttgcagtgagccgagttcgggccactgcacyccggcctgggcaacagagcgagactccgtctcaaaaaaaaaaaaaaaaaaaaaaaaaaaaaaaaaattcatttaagaccacggcatcttggcagctttcttacaaacccatccttctgaaatgttgcttcaaattcatcctctgctccccagtcccactattccacacatactgttactgtttctttatcctactttctcaattttggaacatagttgcagttactgcattgaatacctgtgggtttgcctgttgttctgtctgtctctgtggttcttgtaatagtggatcccagagata

SEQ ID NO: 54080 - DNA, 601 bp, Human
gtgaaataccaactaaattctcagtgaactcagctgagctttatctccttttgtttccccaatttataatttcagttcaggcccagaaagatggaatcccagctaagaaatacaagttacaccctgtactagcagcccatgtgtgcatgttctttaagtgctcttgcagctatgtcatttatattgatttccctgtattattataagcaaagcaaatttgaggaaaaaaacccataataccacacctcatttttttcaagtaatagggtcataagtctcattcttcatataatatgttgaktatgcaatatattatgtgttaggctctggaaaggcagaggttagatcatgttacagatcatatctgattaggcagataaacagtattttaaccttttccttattatatgtaacttgctttcaggttttttaatgttactattatgtctttaatatattatctttatttgtacttttgtatacagagtgattttccttttttaaaaaaaattgtgtctttaggatggattccaaagatgtggaatcagtaggtttaaggaatatggatattttggctggcaaggtggctcacacctgtaat

SEQ ID NO: 54081 - DNA, 601 bp, Human
gtaatcccagcactttgggaggctgaggtgggtggatcacctgaagtcaggagttcgagaccagcctgaccaacatggcgaaaccctgtttctactaaagacacacaaaaaattagccagtggtggtggcatgtgcttgtagtcccacttagctactcgagaggctgaggcaggagaatcgcttgaacccgggaggcagaggttgcagtgaggcaagatggcacctctacactccagcctgggtgacagtgcaagactccatctcggaaaaaaaaacgaaaaaggaatatggacattttawtgtggtataggccatgtataaggcctataggtttttatttgttttggtttggtcttgtgaggtaaaatgagttgcactcttttgatttctttggaattttcttgtttgaattatatggctgctactgctttaaagagtcatcatgttgtttggttatgcttttgagtgtcttgatttgtattttaatcatcattttctctccttttccaggccaaattaaagaagcggaagcctcgggtaaagaaggaaaacaaagtgcccaggctgaaagaggagcatggaattgagctttcatctcct

SEQ ID NO: 54082 - DNA, 601 bp, Human
ctgctttaaagagtcatcatgttgtttggttatgcttttgagtgtcttgatttgtattttaatcatcattttctctccttttccaggccaaattaaagaagcggaagcctcgggtaaagaaggaaaacaaagtgcccaggctgaaagaggagcatggaattgagctttcatctcctaggcattcagataatccatcagaagagggagaagtgaaagtatgaagtggggtttcggttgagggttatttatttattttagctatacttatcatgccagctggaataaaatcatctgaaatgtrtttggtttacgagtggattaaatggaaatagaatatgtaagtcttcgcttaatctgtcagcgaggatagtttaagtcagcaactgcaaatttgtacataatggaagtaaatgaaggggactatgacatttttgttgttgttgtttgtttgtttgtttttgagatgaagtctcgctcttgtccgcgaggctggagtgcaatggcacaatcctggctcgctgcaatctctgcctcccaggttcaagcaattctcctgcttcaacctcccaagtagctgggattacaggcacctgccaccacg

SEQ ID NO: 54083 - DNA, 601 bp, Human
gaagcggaagcctcgggtaaagaaggaaaacaaagtgcccaggctgaaagaggagcatggaattgagctttcatctcctaggcattcagataatccatcagaagagggagaagtgaaagtatgaagtggggtttcggttgagggttatttatttattttagctatacttatcatgccagctggaataaaatcatctgaaatgtgtttggtttacgagtggattaaatggaaatagaatatgtaagtcttcgcttaatctgtcagcgaggatagtttaagtcagcaactgcaaatttgtacrtaatggaagtaaatgaaggggactatgacatttttgttgttgttgtttgtttgtttgtttttgagatgaagtctcgctcttgtccgcgaggctggagtgcaatggcacaatcctggctcgctgcaatctctgcctcccaggttcaagcaattctcctgcttcaacctcccaagtagctgggattacaggcacctgccaccacgccaggctcatttttgtattgtaagtagagatggggtttcaccatgttggccaggctggtctcaaaactcctgacctcaggtgatcttcctgcctcgg

SEQ ID NO: 54084 - DNA, 601 bp, Human
ctggaataattgtctttttatgggtatgttcaagaaggatgggtggggccgttgatgggatacctgcacctgtccttgcagagagaggggaacctgcaagtttggggtgttctttaaaaaagaaggcctttacttggtcttttatgacatatttcagggggaaatgtttgaatgagataggacaggtgagagaaatctgcatttacatgtaaatacgaaatacgttctcagattcatattagaggagcacaatccacaactgaatttgaatacttgaagagtttgagtcaaaaacaaataytagcaagagttattggaatataaatggatgaaaagccttgctattataacctttacattaggggttttatgaagttcattctaaaccaaagaatttggtacagtgttgcagtgtatacttgctgacctctgaacacagtaaaatcattgccaaaacacaaacaactgctgtaattctaatatccagttgataactctaatagatttcttgataagtgcctttgaaacttttactttgaaattttatattaaatataaaataaacttctatttaagaacaaatataaaaatcagattaggc

SEQ ID NO: 54085 - DNA, 601 bp, Human
attttatattaaatataaaataaacttctatttaagaacaaatataaaaatcagattaggctgtttgggtagtttttcctcctcacttagcagtatatcacaactttccaagtgattaaatgttaaagtcatttttacagccttggcaacgtagggagacctcgtctctacaaaataaaaacaagcaaaaatctagctgggcattgcggcatgtgcctacgggcccagttgcatgggaggcagaggtgagaggattgcttaggcccaggagctcgaggctgcagtgagccatggttgtgtsacacttcactccagcttgggcaacagaggaagaccttgtctcaaaaaaaaaaaaaaaaaaatcatttttaatagttggggaggattctgtttgggtgtaacatgttagaagcaatttgaatttcccattttgaaatactttctaatttttgatgttaatagaccatactgtgataaataacctgtgcatttgtgctcccacagaaagacattatttttcttaaagtaaaatattaaaaaaataaaaaaagagcaattttagcaaacatctgtttatccactctccagataccacaactgt

SEQ ID NO: 54086 - DNA, 601 bp, Human
tttctgggagattgcttcaactttgtttcacattatttctttccaagatctttttcctccaccgctctcgaatatctttatacttctctttgctttccattgttcacgttacacactttgcttcggtggctttgctgaccctcagttgtcagctcatgtttaagagtggaggacgaaacatgtgattggaagtttgagcatgtgggtggtggggcttgatctcctttgaaagttttcattataggatgatgtagcagaaacttctgacagatagtcaggatcatttggtgtttcctctggsgcggtcacattttgtgaagaatgccccagtttcctgactctccagagcgtgaaggcctggctccatccactctggaatgtgagaggcagagacctgggtgtgggtcatcctgtgtgactgtgctcatgtgctcaggtaatcctgttttcagtgtggtgggctcagccctcatctgtgcctgtgcagtcccgctcagaggtccttttatccttttctggagaataagtctttatatttgctgctggttggagttagagatctgggtatcttatgaatctggatatgtgttacttcttaagc

SEQ ID NO: 54087 - DNA, 601 bp, Human
gtgggtggtggggcttgatctcctttgaaagttttcattataggatgatgtagcagaaacttctgacagatagtcaggatcatttggtgtttcctctggggcggtcacattttgtgaagaatgccccagtttcctgactctccagagcgtgaaggcctggctccatccactctggaatgtgagaggcagagacctgggtgtgggtcatcctgtgtgactgtgctcatgtgctcaggtaatcctgttttcagtgtggtgggctcagccctcatctgtgcctgtgcagtcccgctcagaggtycttttatccttttctggagaataagtctttatatttgctgctggttggagttagagatctgggtatcttatgaatctggatatgtgttacttcttaagcagtttttaaaccgctccccattttagccctcatccttccttctgaagacacctcgccgttgggggaattttgccgtgtaagtcaggttagttctaggctgtcttccctcctggcttcgaatttcattttctcaggtctgttttgtcatttcccgtgctgccaatattttgttgccattatcctctctcttgttttctcttg

SEQ ID NO: 54088 - DNA, 601 bp, Human
tcctttttatggctgagtagtattccatggtatgtatgtaccacattttctttatatacttgttggttgatgggcatttaggctggttccatgtttttgcaattgcagattatgctgctataaacatgtaagtgcaagtgcctttttcatataatgacttcttttcccctgggtggatacccagtagtgggattgctggatatatatccactgtccactttggatattttaagaaaacatgactggaaatttttttttttttttttttttaaatgagacagagtctgactctttcactctrtcgcccaggctgaagtgcagtggcacaatcttggcactgcaacctccacctccctggttcaagagattctcctgcttcagcctcctaagtagctgggattacaggtgcctgccatcacgcctggctaatttttgtatttttagtagagatggggtttcatcatgttgaccaggctggtctcgagctcctgaccttaggtgatccgcccgccttgacctcccgaaatgctgggattacaggcatgagccactgcgcccagccatggctggaaattctaaaaggcaattgtaacattaaatc

SEQ ID NO: 54089 - DNA, 601 bp, Human
tgcgcagtaacaccatgctagggtgaacataatggaattggagggaaaaagccactgagagttttaaggaagaaatgaaaggttgtggtggcgacaactgggaggaaggaggggcagcaacacagagatgaccaactgaatggaggccacaacctgggagatggtggtgctgatggatttgtggtagagtccagaaagtgaaggaaaacttaaaaggactggagtctggggtgtcattgatagaaatttggaggagttctaggtattgatagagccttagtctctaaatccctctgtcagrctcttttggcagaaccatgtaaaggtgtacggtaagtcctcacataacgttgtttccttcagctttgtttcattataacattgatgagaaaaaaaattgattttgtttcccttaaagttgcaatttccaagaacctatcgacaacattaagttaggacttactgtattattaatgcaaatacctgaaataatatttctgtagcttaatttctatgcttagggagtataccacagcaaaatttaatagcttgccatccatgaagatcataaaaaattgcttttctaattctataattcacc

SEQ ID NO: 54090 - DNA, 601 bp, Human
ttattaatgcaaatacctgaaataatatttctgtagcttaatttctatgcttagggagtataccacagcaaaatttaatagcttgccatccatgaagatcataaaaaattgcttttctaattctataattcaccagaactgttcatttttctttttaggaacctatggatttttgtttccaagtttacagaatttgatgctcgaaaactgcataagttatacaagatggctcataagaaaaggtctcaagaagaagaggtaaagtacaaattcagtcctaattcatacaaacaaataccarttccacagaaaaatctcttaatttttgtttttccatggggagatgatcacagaatcatgggttattgctggtgctaatagtcaaacaataagaccagatgggtgaaatagccaatgtattggagcctaacatggttgaaattctgacaaagagtgtttaccctgtgtttttaggtcctaaaatcatttgttcaccaggttttttcttccatttgcatttttcttctgtacatgtcagtagcttataaatgtggctcctaggaagtaatagggtggtgggcagaaaatactttttctcttc

SEQ ID NO: 54091 - DNA, 601 bp, Human
aagctgaataacaaaaacagtggtatcctactagtgggagtatacattgtcacaacctttctggaggagaattcagcaagatttattaaaagactaaagcatgcagttttgcttccaggaatttagttttgagaaggagatagagatttaaacatgtttataatggaaatggcttggaagcccaacagtaagaaatacattcaatgtggctaggcgcggtggctcgtgcctgtaatcccagcactttgggaggctgaggcgggtggatcacttgaggccgagagttcgagaccagcctggscaacgtgatgaagcctcatctctacataaactacaaatattagctgggtgtggtggcacatgcctgtagccccagcccctcaggaggctgaagtgggaggatcgcatgagaccaggaggtggaggtagcagtgagctgagatggcatcactgaatgcctgcgacagagtgagactctgtctcaaaaaaaaaaaaaaaaaaaaaaaaaaatacagaaaacaaaaacattcagtagttcatgatatatccatattggggagtattaatcagttattaaacataatattgtagaaataagtat

SEQ ID NO: 54092 - DNA, 601 bp, Human
gagatatcacttcacacttgttaggatggctagtaccaaaaagtcaaaagataagggttgccaaggatgtggaggaaagggaacccagcgcattgttgctgggaatgtaagttagtgcagccattatggaaaacaatgcagagatgcctcaaaaaaatcacaaacagaactaccatatgatgcagcagtccctttaccaggtatatattcaacgaaaatgaaatcagttatgttgaagaaatgcctgcacttacatattcattgcagcattatttacgatagccaagatacgtaatcatcytaagtgcccatcagcaggtgagtggataaagaaaatgtgtatatacacaattgaatagtattcagctttaaaaagaaggaaatcctgtcgttcgcaacaacatggttgaatctggagggcatttatgttaagtgaaataagtgaggcacagaaagagaaaaactgcatattctcacttatgtatggaatctgaaaaagtcaaactcatagaagcagggagtagaacagtagttaccagggtcggagggcaggggagaattgggaagatattaacaacggagataaaatttcagttagata

SEQ ID NO: 54093 - DNA, 601 bp, Human
aagggttgccaaggatgtggaggaaagggaacccagcgcattgttgctgggaatgtaagttagtgcagccattatggaaaacaatgcagagatgcctcaaaaaaatcacaaacagaactaccatatgatgcagcagtccctttaccaggtatatattcaacgaaaatgaaatcagttatgttgaagaaatgcctgcacttacatattcattgcagcattatttacgatagccaagatacgtaatcatcttaagtgcccatcagcaggtgagtggataaagaaaatgtgtatatacacaatygaatagtattcagctttaaaaagaaggaaatcctgtcgttcgcaacaacatggttgaatctggagggcatttatgttaagtgaaataagtgaggcacagaaagagaaaaactgcatattctcacttatgtatggaatctgaaaaagtcaaactcatagaagcagggagtagaacagtagttaccagggtcggagggcaggggagaattgggaagatattaacaacggagataaaatttcagttagatatgaggaataagttgagaaatctgttgtacagcatggtgactgtagttaataa

SEQ ID NO: 54094 - DNA, 601 bp, Human
cgatagccaagatacgtaatcatcttaagtgcccatcagcaggtgagtggataaagaaaatgtgtatatacacaattgaatagtattcagctttaaaaagaaggaaatcctgtcgttcgcaacaacatggttgaatctggagggcatttatgttaagtgaaataagtgaggcacagaaagagaaaaactgcatattctcacttatgtatggaatctgaaaaagtcaaactcatagaagcagggagtagaacagtagttaccagggtcggagggcaggggagaattgggaagatattaacarcggagataaaatttcagttagatatgaggaataagttgagaaatctgttgtacagcatggtgactgtagttaataacaatgtattatataagtgaggtagtgcatatgttaattaggctgattgagccattccataatgtatatgtattttaaaacattgcattgtaatcaataaatacatacaatttttaattgtctattaaaaaatttgtacagtctgggcaacatagactcagtctctacaaaagtgtgaaaattagctaggcgtagtggcgtagtagtcccagctacttgggaggc

SEQ ID NO: 54095 - DNA, 601 bp, Human
agtgcatatgttaattaggctgattgagccattccataatgtatatgtattttaaaacattgcattgtaatcaataaatacatacaatttttaattgtctattaaaaaatttgtacagtctgggcaacatagactcagtctctacaaaagtgtgaaaattagctaggcgtagtggcgtagtagtcccagctacttgggaggctgaggtgggagaatttcttaggcctgggaggtggaggttgcggtgagccaggattgcaccactgcgctccagtctgggcaatagagtgagaccgtctcaaaaaaaaaaaaaaaaaaaaaaaaattgcagttttgaaacaaaactcaaaggaatccagattgaattaaaattttggaaatttgattagaaaaaaactctgtggagcttatccattgttttaaaacaaaatgagcaaaagttatgaattagacagttcatgtaaaagagaaaattcaaatggccaatatgacgagatgaccaaccttgctactaggaaaatataaattaaagcaacaataggttaatcaatttttttacccattcagatcatcaaaaattaaaaagggaaatacacaccga

SEQ ID NO: 54096 - DNA, 601 bp, Human
cacctctacaaaaccacagacattgacaccctgttagaaatctcactttccatttgatatgaagccatcctcaagtgatccttcgcatatttagaaggtgtctctttttgttgttatttgttaattcttagggtgaatagtcaaaagttttttactttgtggtgctctcatctgatctacccaggtcagccatgaatttaagccactggtggactgtacatcatattaatgctatcagtttctgagctcagcacttccttaatggtgttgttcttcagctctgtagaaaaaagctggaagkccagtaaaatgagtagagacacttatttggtggcatgtctttgatcttcacataattatagacagaagatggatttttccatgaggtcataggttccttttggttagtcctctgtattagtttcctagggctgtatataacaaagtatcacagactaggtggcttcaaacatcaaacatttattttctcacatttctggagaccaggaagtctgatatcaaggtgtcagcagggttggttccttctggaggctccgagggaaaagctgttccatgcctctcttctgccttctggtggctg

SEQ ID NO: 54097 - DNA, 601 bp, Human
tatttggtggcatgtctttgatcttcacataattatagacagaagatggatttttccatgaggtcataggttccttttggttagtcctctgtattagtttcctagggctgtatataacaaagtatcacagactaggtggcttcaaacatcaaacatttattttctcacatttctggagaccaggaagtctgatatcaaggtgtcagcagggttggttccttctggaggctccgagggaaaagctgttccatgcctctcttctgccttctggtggctggcagcagttcttggcgttcttgastcacgccgatttctgcctccatctttgcatagccttctcctatgcatagcctgtcatagctccctctgcctttattttgaaaggatgcctgtcctggaatttgtagcccaacctaaattcaggatgatgtcatctagagatttttaacttaattacatctgcaaagacctaggtaaaatcacactcacaggctctgggtggacatgacattttggtagccacagtttaactctccatccctggacttctgtgtcttcactacattttctgattcaagtgagtatgattcttttccttagg

SEQ ID NO: 54098 - DNA, 601 bp, Human
cactacattttctgattcaagtgagtatgattcttttccttaggagaaaaggaaggctacagaagttaaaaggattgtagtttggccttaatccgtaagagacagagcactgatccaagctcaaagttagagaaattacttttttataggaggaggtccatttttgtgtgtgtgtgcagaatagggaagaataatagaatcggtgagtgtagtctggagagattttcagagaccaggcacagcaggtaccagcaggtgaaataaacgttagatgtgtaaccggaggatattactcgcagcygtgaaactcagcggtatcattttctgaattagtttggttttgttgttaagagtctgccacagattggaaggttaaacaggtatggagagtgaaaagcggtagttgttaagatttcagaaggagaggagtagtaaattttgccttaaaattttgttggaaagaatgtttaggagtcattactgatacgttagccagcagcaacaagaccaagaagaaagaaatttaatgtctgtttgtaacatgtgtcaggctttcagtttgaacttcagcaaagtagtgcttacttcagcagcataccta

SEQ ID NO: 54099 - DNA, 601 bp, Human
tttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtatyctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtggg

SEQ ID NO: 54100 - DNA, 601 bp, Human
aatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttytaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaa

SEQ ID NO: 54101 - DNA, 601 bp, Human
ttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttggcgcacagttccgcaggctgtacaagcatagcaccagcatctggttggcttctggagaggcctcagggagcttttactcatggtggaaggtgaagtggsagtaggcgtcccatggcaagagagggagcaagagagagaggaggaggtgccagcctcttttaaagcaccagctctcacgtgaactcagagaactcactcattatcacaaggacagcaccaagccatttatgagggatctgcccaaacacctcccactacaacattggaggtcacatttcaacatgagatttggaggggacacatacccaaaccgtatcaccatctggaggtctttggtgtggctggtgagaacaggcacgatgccagttctttgtgagcacagggcactgttaccttcag

SEQ ID NO: 54102 - DNA, 601 bp, Human
tcaagggctaatgattgcccacccccaaggtaaagagcctcattgcactctacccaattgcgttagtctgttttgcaggaatacctgaggctgggtaatttatagagaaaagagttttatttggcgcacagttccgcaggctgtacaagcatagcaccagcatctggttggcttctggagaggcctcagggagcttttactcatggtggaaggtgaagtggcagtaggcgtcccatggcaagagagggagcaagagagagaggaggaggtgccagcctcttttaaagcaccagctctcacrtgaactcagagaactcactcattatcacaaggacagcaccaagccatttatgagggatctgcccaaacacctcccactacaacattggaggtcacatttcaacatgagatttggaggggacacatacccaaaccgtatcaccatctggaggtctttggtgtggctggtgagaacaggcacgatgccagttctttgtgagcacagggcactgttaccttcagtcttttcgggtggtcctttccctggccttgggtagtttccccacatgcacatcctaagcagtattcagctgtatacctg

SEQ ID NO: 54103 - DNA, 601 bp, Human
ctgatgtctggtgtcttgaaaaccactgttctatacattttgtcccttttggctgtttcaggcaggatggtaaatctagtccctgttattccattttgactggaacttgagattgctcacttcttcctccctctttctttcattgaggtgaaattcatattacataaaggaactattttaaagcgaacaactgaatgaccttagtgcatttataatattgggcagccaccacttctatctagttccaaaacactttcatcagtcagagaaaaccctataaccattaaataatccttccccmttattccctctccccagcctctggcagccaccagtttgcattctgtctctctggatttgcctgttctagacatttcatatagaaagagtcatacaatatgtgaccttttgtgtctggcttctttcacttagcataatgttttcaaggttcattcatcagtactcattccatccttatggctgaataatatttcgttgtgtggatatataccacattttgtttatccattcatctgttgatggacatttgagttgtttccatctttgggctgttgtgaataatgctgcagtgaagattggt

SEQ ID NO: 54104 - DNA, 601 bp, Human
accctataaccattaaataatccttccccattattccctctccccagcctctggcagccaccagtttgcattctgtctctctggatttgcctgttctagacatttcatatagaaagagtcatacaatatgtgaccttttgtgtctggcttctttcacttagcataatgttttcaaggttcattcatcagtactcattccatccttatggctgaataatatttcgttgtgtggatatataccacattttgtttatccattcatctgttgatggacatttgagttgtttccatctttgggctrttgtgaataatgctgcagtgaagattggtgtacaggtacttgactacctgttttcagttttggatatgtgcctgggagtggaattattagtcatattctttacgtttttaggaaacaccaaaatgtttctacgatggctgaaccattttacattcctaccagcaatgtgtaagagttgaaggttttccttatctttgccaacacttatttcctgggttttttttttgtgtttttttttaatgagtatctccatcttcgtgggtgtgaagtagtctcattgtggcttgaacatgcatttcc

SEQ ID NO: 54105 - DNA, 601 bp, Human
ttgtttttgttgttgagttttagtaattctttttttaatggtatcatgagcagtttaccatggtccaagctaaaaattttaatactcttcacactgagttggtttttaagataattttattaactagtcactcacttgttgcatatttaggttgatggtgttattaataacttacaaaataatttctgtggctctttttctcatgggctgggtccaggaatatggtaatgtttatggatcttaccagatttttcctaaagggagtgagtttgcaaaagccatcagtaatttttcaagtgtctacttgtgtcactgcacacttgagccttatttcataggatgtattttgctaataagtgtaaaatgactctgttattaatttttttgattcctaataatgtgagcatttgtccttgaatatgagtatatgaggaagagccaagtgggtagtgaagagaagtggatgggaatctggcttcagtctttcgactaatccttgcatctctatttcaggcaccatcatgactccaagcggaggagatccgatgaatttaggcctcaaaattaccaccagcaggatttccgacgaatgtctgatcac

SEQ ID NO: 54106 - DNA, 601 bp, Human
gttgcatatttaggttgatggtgttattaataacttacaaaataatttctgtggctctttttctcatgggctgggtccaggaatatggtaatgtttatggatcttaccagatttttcctaaagggagtgagtttgcaaaagccatcagtaatttttcaagtgtgtacttgtgtcactgcacacttgagccttatttcataggatgtattttgctaataagtgtaaaatgactctgttattaatttttttgattcctaataatgtgagcatttgtccttgaatatgagtatatgaggaagarccaagtgggtagtgaagagaagtggatgggaatctggcttcagtctttcgactaatccttgcatctctatttcaggcaccatcatgactccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgcaccctgcagtctcagatcctcgctcacccccttctca

SEQ ID NO: 54107 - DNA, 601 bp, Human
ttgcatatttaggttgatggtgttattaataacttacaaaataatttctgtggctctttttctcatgggctgggtccaggaatatggtaatgtttatggatcttaccagatttttcctaaagggagtgagtttgcaaaagccatcagtaatttttcaagtgtgtacttgtgtcactgcacacttgagccttatttcataggatgtattttgctaataagtgtaaaatgactctgttattaatttttttgattcctaataatgtgagcatttgtccttgaatatgagtatatgaggaagagycaagtgggtagtgaagagaagtggatgggaatctggcttcagtctttcgactaatccttgcatctctatttcaggcaccatcatgactccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgcaccctgcagtctcagatcctcgctcacccccttctcag

SEQ ID NO: 54108 - DNA, 601 bp, Human
tgcatatttaggttgatggtgttattaataacttacaaaataatttctgtggctctttttctcatgggctgggtccaggaatatggtaatgtttatggatcttaccagatttttcctaaagggagtgagtttgcaaaagccatcagtaatttttcaagtgtgtacttgtgtcactgcacacttgagccttatttcataggatgtattttgctaataagtgtaaaatgactctgttattaatttttttgattcctaataatgtgagcatttgtccttgaatatgagtatatgaggaagagcyaagtgggtagtgaagagaagtggatgggaatctggcttcagtctttcgactaatccttgcatctctatttcaggcaccatcatgactccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgcaccctgcagtctcagatcctcgctcacccccttctcaga

SEQ ID NO: 54109 - DNA, 601 bp, Human
aacagataatagtagtattcaatagagtttgctcaaatgattaagtttagatatgcagagtacatgataagcatttagaaagtgttagctattattattacccttatggaggtcaattaggtaatatatttcagttatgtgcagcccaataattccataatcatagatggactcaaatatttatgtgtctaaatagtcatagttgcaatcttttttaacagaaaaaatatggactccctggaatcaaccaaaatatttggcaatagggaaatggttaagcaaactgaagtatgatagtcaytaaaaactatgttttcaaaaatttacagtaagaaattttttaacagcagcatatacaatgattatcttaccttaattttactgtctgttcagccaacaatatgaaattaaaattccaaaaacacatgaaaatgttaatgttgtttgtttccaagtggtaggattacaggtgattttttttatttccctacttgtacatttagataattatcaatttttctaccaggaatatacatcattgttataattagaaaagctactaaaataaattcattgctttaacagactatggttgaatagt

SEQ ID NO: 54110 - DNA, 601 bp, Human
atccctatattcatatgttgaatactccagtgcaaaagtaaatgaaaattctctacagactattcatagttttattctcctaagtagtcaaagaaatgcaaattaaagcattaaagtactattttttcacctataaaattaaacatacattatgctgggtaagatactgctacacagaagttaaacggatacaaccttgagaaatataattaattcttaagagtgctcactttagagccagattgcttgggtcagaatcctagttctgccacttggaagaataccttaagcaaattatttmgcctctcaaagcctcatttgtagaacagataatagtagtattcaatagagtttgctcaaatgattaagtttagatatgcagagtacatgataagcatttagaaagtgttagctattattattacccttatggaggtcaattaggtaatatatttcagttatgtgcagcccaataattccataatcatagatggactcaaatatttatgtgtctaaatagtcatagttgcaatcttttttaacagaaaaaatatggactccctggaatcaaccaaaatatttggcaatagggaaatggtta

SEQ ID NO: 54111 - DNA, 601 bp, Human
ttagaggactagtttctcatgtaatcaatcattcactaaccactcacactatgctaaatgctgcatggttcaaaacgatgtctggcataagctttggacagggaccacaacctaacctagttcaggagtgaaaaaaaagggggggggggaggagaaggaggagaaagggaggaaaggaaggaaaaaagaaaaactagatgtgtttttagatgcacatttaacgtacatattatagaacatgcaaaccaaatgagtgtttattccttcaataaagttacaagaggttacacacttactctawggattacatgtgaatcatatatgaacttctgtttttgaagccacccctcaagagccaacaggattctttaagtatcccagtggtactaaacccatatcctttgagaatgctttcttagaacgattcacaaactggctctgcaggcttttcaaaacttaagttctagaagttgtacaataaaatgacaggatcgctaaaataagtgtatggcattcgatgtaactgcttgcaaaaacaacatccaattttaatattggcctaatcatggctaaatattggtataataatagttaactatct

SEQ ID NO: 54112 - DNA, 601 bp, Human
aggagactaggctgactaccctgctacatacagaagtgccacatgatctttaacgaccctctactacatcttaagacttcacttagagttacaaaaacttcaaacatttcagagcatcatttgcgctgactcactgaatttatcaattactatggtttggcttagaggactagtttctcatgtaatcaatcattcactaaccactcacactatgctaaatgctgcatggttcaaaacgatgtctggcataagctttggacagggaccacaacctaacctagttcaggagtgaaaaaaaagggggggggggaggagaaggaggagaaagggaggaaaggaaggaaaaaagaaaaactagatgtgtttttagatgcacatttaacgtacatattatagaacatgcaaaccaaatgagtgtttattccttcaataaagttacaagaggttacacacttactctatggattacatgtgaatcatatatgaacttctgtttttgaagccacccctcaagagccaacaggattctttaagtatcccagtggtactaaacccatatcctttgagaatgctttcttagaacgattcacaaactggctct

SEQ ID NO: 54113 - DNA, 601 bp, Human
aaatggaagtttgaagatttttaaactagtaggatgacaagctctaagcgtgaagatccctgcaatacaagcctgtctgatcgccactgtagatccaggacctgacccatagcagcaacacacaataaacgtattttaaattgaataaatgaatgacttccacatgcaatgaacaaaattaaaatagaggctagacataatatctgtgaggaatgtattaacatagtatctgtgaggaaggtattaaactcctcaatgactgagggagcatgagttcaggaagtcagatggtcatagggaragagcaggagagtaattctcaagccaaaaaagatgatgatggaagtggcaataaaccacatctgggcccaataattcaaggactgtaatagaaacctcaattcaaaaagataagcctgagaaataggggaccagagtgtacaatttaacagtgtgacaggaagggatgagatgcgaagaacagtcatggtggaggaagtgaaatgtagaccacagctagtaaacagaaagactggaccgcagactaagtcttctaactcccaattcagggtcactgacaatttcaactcatttttccagg

SEQ ID NO: 54114 - DNA, 601 bp, Human
tttttgcaaaagagggaacagacaagacactaagtgatttgctcaaagtcctacatctaacaaacagaagagctaggataaaatgcaaaatggaagtttgaagatttttaaactagtaggatgacaagctctaagcgtgaagatccctgcaatacaagcctgtctgatcgccactgtagatccaggacctgacccatagcagcaacacacaataaacgtattttaaattgaataaatgaatgacttccacatgcaatgaacaaaattaaaatagaggctagacataatatctgtgaggaaygtattaacatagtatctgtgaggaaggtattaaactcctcaatgactgagggagcatgagttcaggaagtcagatggtcatagggagagagcaggagagtaattctcaagccaaaaaagatgatgatggaagtggcaataaaccacatctgggcccaataattcaaggactgtaatagaaacctcaattcaaaaagataagcctgagaaataggggaccagagtgtacaatttaacagtgtgacaggaagggatgagatgcgaagaacagtcatggtggaggaagtgaaatgtagaccac

SEQ ID NO: 54115 - DNA, 601 bp, Human
tcatcattttttcctttttgcaaaagagggaacagacaagacactaagtgatttgctcaaagtcctacatctaacaaacagaagagctaggataaaatgcaaaatggaagtttgaagatttttaaactagtaggatgacaagctctaagcgtgaagatccctgcaatacaagcctgtctgatcgccactgtagatccaggacctgacccatagcagcaacacacaataaacgtattttaaattgaataaatgaatgacttccacatgcaatgaacaaaattaaaatagaggctagacatartatctgtgaggaatgtattaacatagtatctgtgaggaaggtattaaactcctcaatgactgagggagcatgagttcaggaagtcagatggtcatagggagagagcaggagagtaattctcaagccaaaaaagatgatgatggaagtggcaataaaccacatctgggcccaataattcaaggactgtaatagaaacctcaattcaaaaagataagcctgagaaataggggaccagagtgtacaatttaacagtgtgacaggaagggatgagatgcgaagaacagtcatggtggaggaagt

SEQ ID NO: 54116 - DNA, 601 bp, Human
aataattaaataataacaccttgcatttatgtataatgcttattatgtgccaagcactattctaagaagctttatatgtattaactccatctttaaaacaattttatgaggtaggtatcatcattttttcctttttgcaaaagagggaacagacaagacactaagtgatttgctcaaagtcctacatctaacaaacagaagagctaggataaaatgcaaaatggaagtttgaagatttttaaactagtaggatgacaagctctaagcgtgaagatccctgcaatacaagcctgtctgatcrccactgtagatccaggacctgacccatagcagcaacacacaataaacgtattttaaattgaataaatgaatgacttccacatgcaatgaacaaaattaaaatagaggctagacataatatctgtgaggaatgtattaacatagtatctgtgaggaaggtattaaactcctcaatgactgagggagcatgagttcaggaagtcagatggtcatagggagagagcaggagagtaattctcaagccaaaaaagatgatgatggaagtggcaataaaccacatctgggcccaataattcaagga

SEQ ID NO: 54117 - DNA, 601 bp, Human
caaatgtgagaaaatgcatttctgttctttataaattactcagtctgcaggattttgttatagcaccacaaaaagatttcaagagtcacttttagccctcaaaaattaaaatactaacacaagagcacacaaattattatttggctagtgatagcattcatcaaaaaagcattatttctttcatgttgcatttgcgtacaccaaaagtagtaaattattactagagaatttaatctttgtatttctaatacattttactgtttaatctatctctttagtatattcttaaagacaaaaaatyaaaaatcaaagtattttagacatattaacttcaaggaatcactttttgctaagtatatacttaaatttctattaaccaaatttttttaatgtgtgtcgtcggccttacaatttaaagtagcaaagtgttaactcataaataggtcaactagtaataataagcctttcttacaggttatgcttttgactgctttattcaagtcaatacacactaaggtccccttaaacaagttatatattcaaatgttactgaacaatacacatttcccaagtttttcataacttttataaatggtccatt

SEQ ID NO: 54118 - DNA, 601 bp, Human
tcatcaatttaacagtattaaaaggtacggcaatgcaggtgcagcagctcacgcctgtaatccttgcacttttgaaagccaaagtgtgtggatcatttcagcccagtagtttgagaccagcctgggcaacacagtgaaaccctgtctcttaaaaaaaaaaaaaaaaaattgctgctgacctgcacctgtcgtcccagctacccaggaggctgcggtgaaagaatccattaggccctggagggcatggctacagttagccaagatcaagccactgcaatccagcctgggtgagagtgagagaaaaaaaaaaaaaaaaaaaaggtggggtcttcaggaagtgattaactcataagggtagaacccttgtgaatgggattaggtggccttataaaggaggctgacagagagtttatttttttgcccttctgtctctgccatgtgcagatacaggattcgtccccaccaaaggattccgagaggacaatgcatcaagacatcgtgttggaagcagacagcagccctctccagacagcagaacctgcagcaccttgatcttgaacttcccagcctccacaaatgtgagaaaatgcatttctgttct

SEQ ID NO: 54119 - DNA, 601 bp, Human
cagttgtggcaatataaactacctaattatacaagctagaaacataagccttatattttttcttatctctcatctccttcttatccaatcatcaagtactactgacattaaccccaaggtatttctcaaatatgttcccattttttcatcccgaatacagctgaccactgaaccatgtgagagttaggaaaaactgacctcctgagcagtcaaaatactgtgtataacttttaagtcccccaactactaatagcttactgtcgacccaaagctttaccaataacataaacagtctattaayacctgttttgtatgttacatgtattacacaccgtattcttagaataaagagaaaaaatattaagaacattgtaagaaaaagaaaatgtatttggtattcaataagtggaagtggattgtcataaaggtccccatccttctggtcttcacattcagtaggctgaggtgtaggaggaagagaagtagttggtgtcttaggggtggcacaggcacaagagatggaggagggagaggtagaaagggaggcaggagagggagccatactctgtaacttcacaaaaacacattgtaatttgcctga

SEQ ID NO: 54120 - DNA, 601 bp, Human
agggtggtggctcacacctgtaatcccagcactttgggaggcccaggtggacagttcacttgaggccacaagttcaagaccagcctggccaacatgatgaaactccatctctactaaaaatataaaaattagatgagtgcagtggcacacacctgtaatctcagctacttgggaggctagggcacaagaatcacttgaacccaggtggaggctgcactgagctgacattgtggcactgtgctccagcctgggcaacagagcaagactctgtctcagaaaagaaaagaacacatcttcttcwatccacgaaactgtggagaaggaaaaagaatctgcactagttttgctgtcgcaactcaaaactacagaagtatggccactatcattcaccttacttcatctcatcacataggcagtgtatcatctcataccatcacaagggttaagtacagtacaagatattttgagagaccacattcatgttcttttattacaatatagttataattgttttactttattattgttgttgctaatctcttattgtttctaaattgtaaattaaacgtcataggaaaaaacagtacatatagggctcagg

SEQ ID NO: 54121 - DNA, 601 bp, Human
aaggaaaaaaaaaggtatgctgagattgctaagatctatgttaagaataaatcttctcgccagggtggtggctcacacctgtaatcccagcactttgggaggcccaggtggacagttcacttgaggccacaagttcaagaccagcctggccaacatgatgaaactccatctctactaaaaatataaaaattagatgagtgcagtggcacacacctgtaatctcagctacttgggaggctagggcacaagaatcacttgaacccaggtggaggctgcactgagctgacattgtggcactgtrctccagcctgggcaacagagcaagactctgtctcagaaaagaaaagaacacatcttcttctatccacgaaactgtggagaaggaaaaagaatctgcactagttttgctgtcgcaactcaaaactacagaagtatggccactatcattcaccttacttcatctcatcacataggcagtgtatcatctcataccatcacaagggttaagtacagtacaagatattttgagagaccacattcatgttcttttattacaatatagttataattgttttactttattattgttgttgctaatctc

SEQ ID NO: 54122 - DNA, 601 bp, Human
cttatgtccaggcaatgtttatcttacttaatactgtccccaaaccacaaaagtagtgatgctgacaattcagaaatgccaaagagaagcaataaagtgcttcctttaagtgaaaaggtgaaagttctctacttaataaggaaaaaaaaaggtatgctgagattgctaagatctatgttaagaataaatcttctcgccagggtggtggctcacacctgtaatcccagcactttgggaggcccaggtggacagttcacttgaggccacaagttcaagaccagcctggccaacatgatgaaamtccatctctactaaaaatataaaaattagatgagtgcagtggcacacacctgtaatctcagctacttgggaggctagggcacaagaatcacttgaacccaggtggaggctgcactgagctgacattgtggcactgtgctccagcctgggcaacagagcaagactctgtctcagaaaagaaaagaacacatcttcttctatccacgaaactgtggagaaggaaaaagaatctgcactagttttgctgtcgcaactcaaaactacagaagtatggccactatcattcaccttacttcatctc

SEQ ID NO: 54123 - DNA, 601 bp, Human
ggaaaaaatgttccttctggtgatagctaaggttaaaaatttttctaacaaatgagaagaagagccaggcacagtggctcccgcctgtaatcccaccactttgggaagccaaggtggacagatcacttgaggttgggagttcgagaccagcctagccaacatggtgaaaccccaaccctactaaaaatacaaaaaatagccggatgtggtggtgcgtgcctgtaatcccagctacaggggaagctaaggcaggaaaatcgcttgaacccgggaggtagaggctgaagtaagccgagatcgygccagcccactccagcctaggcaacagagcaagactttgtctcaaaaaaaaaaaaaaaaagacgacgacaatgaaaaatagacccagagagattaaatgacttacccaaaatcatagagctgggattagaacttatatatcccaaaacctagtccaaatcagtggactaatgtcacattccattgtgctaatatggtaaagtaacatcacagtcactgattatcttggtaaacatagttagtatactggtagagaacatgggttttgctgtcagacagccttaggtttgtgccacagctt

SEQ ID NO: 54124 - DNA, 601 bp, Human
tattataacataaccattttcacatatatacatcaagagctgttttactacacaaggttgtatgtagtgcgttttttttttctttttaaattcatgccttattgatagataaaagatggggctgcaggaaaaaatgttccttctggtgatagctaaggttaaaaatttttctaacaaatgagaagaagagccaggcacagtggctcccgcctgtaatcccaccactttgggaagccaaggtggacagatcacttgaggttgggagttcgagaccagcctagccaacatggtgaaaccccawccctactaaaaatacaaaaaatagccggatgtggtggtgcgtgcctgtaatcccagctacaggggaagctaaggcaggaaaatcgcttgaacccgggaggtagaggctgaagtaagccgagatcgcgccagcccactccagcctaggcaacagagcaagactttgtctcaaaaaaaaaaaaaaaaagacgacgacaatgaaaaatagacccagagagattaaatgacttacccaaaatcatagagctgggattagaacttatatatcccaaaacctagtccaaatcagtggactaatgtc

SEQ ID NO: 54125 - DNA, 601 bp, Human
taagcctcaaagatacctatactgctaatagctgagcaaaacatcaaatcatctttacaggctctataacctaagatcctctgaaagccagaaaaagtattaaaatgtctctacccagagtaaattactaaatttttctactagaagctgaagaattttaaaactataaaaccaagaggcttcaaacattgtaaaagtactctcacattattataacataaccattttcacatatatacatcaagagctgttttactacacaaggttgtatgtagtgcgttttttttttctttttaaattmatgccttattgatagataaaagatggggctgcaggaaaaaatgttccttctggtgatagctaaggttaaaaatttttctaacaaatgagaagaagagccaggcacagtggctcccgcctgtaatcccaccactttgggaagccaaggtggacagatcacttgaggttgggagttcgagaccagcctagccaacatggtgaaaccccaaccctactaaaaatacaaaaaatagccggatgtggtggtgcgtgcctgtaatcccagctacaggggaagctaaggcaggaaaatcgcttgaac

SEQ ID NO: 54126 - DNA, 601 bp, Human
taagcaaatgactcaaactgaatcttgttattctgatcttttctgaagagcttgagaaggaactttaacagaacaatttcttttcttttaccgaaatcctatccaagacctaagtctgtcagagacttttatcaaatgactgtaaaagaatttacccctacacctatactgctacctctttttaatcagatatcctgataggatgtcatccatataaaatgtactgatgcggctaacttttcacaaacagaagattcaaggccatgtaataatgatggcctcaaataccatagctatgtamgtgcaatgtggttttagtttgttgactacatatgctgaggttctaataaagcaaactaagacactatctcttgacattgagtaacaaatagataaagcaaaatactcagaacaatttcaaaaaagagaaaagttaatgtcaactataagcctcaaagatacctatactgctaatagctgagcaaaacatcaaatcatctttacaggctctataacctaagatcctctgaaagccagaaaaagtattaaaatgtctctacccagagtaaattactaaatttttctactagaagctgaagaa

SEQ ID NO: 54127 - DNA, 601 bp, Human
gaaatatttgtttaagccacctggtttatgggatttgttacagtagcttaagatgaggaagacaacagttaaccttaaatatgggaccactttaagcaacttataatatactgaaactcagagttctcatggagtgactgctcacgtaacttcaatatctactggaccatatcttcaacatccaattgaccatactggagcccaaaacttggtcaccgaaacactgatctcacactctggccttctctcttctcctcactctttggacgagccacttctcaaccctaacacacaactactkatgtttttttctgcacctgtgcccaaggtttaaaaaaactgacatagcacacattcaggccaactcctatgaagctatcttcttctgcacttgccaattccttagtatatcccttacaaaggctactccaagtctcttcgtctcgttttcagaagatggatggtttattagattcataataattttagaaataaagaatctcagggatattatttccaactccattattaagtaaatttaaaggattcctagaatttaaaggactggaggtttacagacagtaagtccattaacttgaag

SEQ ID NO: 54128 - DNA, 601 bp, Human
atgagcgtgaaagaaaagaataaataaaagaacattttcagatgccggcaatgatcattaatgactatgtataaggaaagtaaatttaagaatttagcatatactgtatattttaaaatttatttagtacaatcaacttgaatgcatgttttgggggaatatattataaaaactgcctatattctgaaatgataattgttatggactgaatgtttgtgttattcaaattcatattatgaaaccctaatcccaaatgtgatagtatttagaggtggggcctttgggaggcaattaaatcttragaatggtaccctcattaacaggatggaaccattataagatacatgagagacatgacctctctccctccctgccctgtgaagacacagcaaggaggtggttgtctatagaccaggaaggggactctcaccagaaaaatgaacctgcaagcaccttgatcttggacttctcacttgccagaatggtgagaaatatttgtttaagccacctggtttatgggatttgttacagtagcttaagatgaggaagacaacagttaaccttaaatatgggaccactttaagcaacttataatatactg

SEQ ID NO: 54129 - DNA, 601 bp, Human
attaaagtggaattactgtcaaaaggaaacctttttctttttttaagaaacagggtgtcactctttcacccaggctggagtacagtgacacaattatagctcactgcagcctcaagctcctgggcacaagtgatgctcccacctgagcctcccaagtagctaggacttcagcagcacgcgccagcacttctggctttttgtgtgtgtgtgtgtgtgtgtgtatgtgtgtgtgtgtgccagcacttctggctgtgtgcgtgtgcgtgtgtgtgtgtgtgtgcgcgcgcgcatgcgtgtgtasgtaaggggtcttactgttttgcccaagctggtctcgaagtcctggcctcaaagtgatccttccacgttggcctcccaaagtgttgggattatacgcatgagtcaccgtgtctggcctatttttcaactgtataataaaacctgcttaatgataaattaatgtccaagctgcaatatacacatcctcaagtcagtcaaattactggtaaagagaaacaaaaggagctggaaaggaggatgacaggagacaacagcaggaatgaccaggagctacaggcttccaaactttgcccttgagttt

SEQ ID NO: 54130 - DNA, 601 bp, Human
ttttttcttctaaaaaacaaacaaaaaaacccacacaggatccacgtgcagaacgtgcaggtttgttacataggtatatgtgtgccatggtggtttgctgcacctattgactcatcctctaagttccctcccctcacctcccatcctccaacaggccctggtgtgtgttgttctcttctgtgtccacgtgttctcaatgttcagctcccacttatgagtgagaagagccctgcttttttaatgccactgattaacatttaatattaacctttggtttagaagaaaaatacctagctgtatyatatcatgtccaatgcaccatagtaatccaaagaaaaaggtcagattacaataaagtgtaagaagaaaatgtcatctgataattttaagcaaatgataccaaaagcataatttataaaagaaaaaatgctaaactggactctactgaaattaaaaacttttgttctgtagacaccactgagacagtaacagagagaagctacagaataggagaaaaaccaaatgactgtatccagaacatattaaaaaaaaaaaaactcttagaacttagcaatgacagcaaataatttaaaaatgagca

SEQ ID NO: 54131 - DNA, 601 bp, Human
ggggtccagtggcgcaatcttggctcactgcaacctctgtctcccaggtttaagccattattctggctcagcctcacaagtagatgggattacaggtgtgcgccaccacacctggctaatttttgtatttttagtagagacaacggtttcaccttgttagccaggctggtcctgaactcctgacctcaagtgatccactcgcctcggcctcccaaggtgctgggattacactgtgtccagcctctccactgaattttggtgttattctgaaaacggctctaaaaaccaaactttatatttwaaaaaaaaagggagggagggaagaaggaagaggaaggaggaagaagaaagaaagaagaaagaagaagaaatatttggggaccacacaagatcaaaagacaaccctaattttaaagtatctacccaggtgactctgatataacatccaggactaggaaaccactggctcccacactagccatttctgtctcttccctttgcagaacttcttcaacatgagtatgtttttatattattgtaataatagtatttatgcaattctgagtcctgcttttttcttctaaaaaacaaacaaaaaaac

SEQ ID NO: 54132 - DNA, 601 bp, Human
aatatatgtccaaaaccatagactgagttcattccaaaagtgagccctcatgtaaactatggacttggagtgatgacgtgtcaatgtaggttcatcaattgtaataaatgtaccactctggtgtggatgtgcatacaggggggaggctgtgcatatgttggggcaggggtgtatttgggaaatcttagtaccttccatcctccacctttttttttttttttagatggagtatcgctctgttgcccaggctggggtccagtggcgcaatcttggctcactgcaacctctgtctcccaggttyaagccattattctggctcagcctcacaagtagatgggattacaggtgtgcgccaccacacctggctaatttttgtatttttagtagagacaacggtttcaccttgttagccaggctggtcctgaactcctgacctcaagtgatccactcgcctcggcctcccaaggtgctgggattacactgtgtccagcctctccactgaattttggtgttattctgaaaacggctctaaaaaccaaactttatatttaaaaaaaaaagggagggagggaagaaggaagaggaaggaggaagaagaaag

SEQ ID NO: 54133 - DNA, 601 bp, Human
aaagaaaacctatactaaaattacacagataaagagttggaatttgaggggagagacatggaagaacaagtagcaacaccagagaaattgagagcaggatgggaccagctgtgacaaaaaagatgaagtgcaagtaatggagaactgatggctgtgcctggtactagctttgcaaaggaagaaagagaaagctcaacacagtggatcacaaatcaggcagaaaattagagtcacccgaagagcttttacaaacagattttaagtacgatgcagtagtgtgtccgtggtctcagctactcaygaggctgagggggtaggattgtttgatcccaggagtttgaggcaagcctgggcaacacagcaagatcctatctctaaaaataaataagacttcagtgaagagaatgagaaaacaagccacagactgggagaaagtatttgcaaaagacaaagctaataaagaactattatccaaaatatataaagaattcttaaaacttagaaagtaactcaatttttaaaaaggcaaaagatcttgacagacacctaaccaaagaagatatacagatggcaagtaagcatttgaggagatcataggtca

SEQ ID NO: 54134 - DNA, 601 bp, Human
acgaggttattagatttaatgatgagacaatatatctagtctactaaatatacagtataaaaatcactaggcctgtaccacataatttagaattttatcatatatttaatcttttgttcacaagactaagctccatgacttcaagttacatcacccagaaattcctccaaaaatgttaactatatcaagttagttaatggaaatacttatacaaaatgaataatgtatcatttgtttcaactcattaaatctagcacttgtcagatacaaatcccaacaaaaacccagcaagctgaaaacrtgcttattttcaaaattttacaccaagcttcatattcctttactgaagagtagcaattaaattaaaatcatgacaatgcaagagcaatctacgctacatacaaaaaaaatacgtatttcaaacatcagaatatcaagcccattaattattcttaaggacttatatgaacttctacataccgctatattataaaattaagttaaatgttaactacattaaaatcaccctgaatttggaacacgtaaatgtgcctgcatatttgttgaatgaataaaaaattgaccaattaaataaaaagtt

SEQ ID NO: 54135 - DNA, 601 bp, Human
ccaaccctccagtgacttgacatcattgtcagagtaaaatcctatattcttatagtaagttacaagggcctgtaagactggcttcatgctactgctgaatttcctactacaccttcccttccccaactttgaataatggttgagaatactgattttggagtcaattacctgggctccaatcccagctccctaacaaactgggtgacctgggataaatatttaacctctgtgcctcagtttccttatatgtgaaatagcattcttcttgtaggattgttttaagaactgaattaacgctagyaatacacttaaaacagtgcttagtactccgtaaacactctataataaactactcagtacacttcagctacaatggcctctttactaaatacagcaactgtgctctgccattccttctgcctcaattcacatggctcgtcccactcactttattttgctcaaatttcatctctggagaggtctttcccaaccaattacttcaaagaaagcctagctctacttcttcaccatacaatttgtttttttgtcatagcattcatcattacctactatattagtttatttgtttattgtttcttcc

SEQ ID NO: 54136 - DNA, 601 bp, Human
ccatgtacattagtatgtctctaatcatcaccatagctgtttgatgatcattccaagcttgatttagcgtttgaagaaagttgttattcaatgaatttagtacatcttctcgcacctagtaacagaagagttcattagtttgcacacacacatccacacactcgtatatacaggcatgcacatatctgtttaataaaataatgaagtggaatctttaatttaaatcaaagaaatgttataggctagtagaaatattttaagctataacctatacacagaagagtatcaaatgtatatgtayagtacagactcctcttctgatctccagaacataaatcaacttcctaggtatttcccaaccctccagtgacttgacatcattgtcagagtaaaatcctatattcttatagtaagttacaagggcctgtaagactggcttcatgctactgctgaatttcctactacaccttcccttccccaactttgaataatggttgagaatactgattttggagtcaattacctgggctccaatcccagctccctaacaaactgggtgacctgggataaatatttaacctctgtgcctcagtttccttat

SEQ ID NO: 54137 - DNA, 601 bp, Human
tcagaaaagctaaataatttgttataccttttatcaaatcccttaaaagtgaagtggcctctccctgacccccttgccactaagcccttacaaaaccaggggtaataggcctgactgaattcacagagcagaacaaaaaactttacagctgtttgttcttattggaaattcttcccaaacattgctttattctaccaagtaaaagaaactaggacaagctctcatcactacattaaaactaaaaaaactagaaacaaaaatataaaaaggtaaaactttgggaaaaataattatatccaayacacaaacataaacactgatgtaaaacaagtcattaacttattaattttggagtgatacagtaattaaacttaatgaatctagcgtcattctatagcaccaaattttttttaactggaatttaatctctctgaaagttattaaacagctgagatcaaagtcagtgttttccaaatgatcttgctgaacaggatttttttcttgactgatgaaaacaaaatacagcaatagccggtgaaaaatggaatatacatgtgaagaagctaatatccttaaacaagactagctgcaatattgcact

SEQ ID NO: 54138 - DNA, 601 bp, Human
accatatctagaacttcgaaaacaacaagctaacttatttcaaatttatatgccagataatatatgttgtcacataccatctcatttaacttcaaaatgataacacaaggttaatttataaccggatgagaaaaataatgctcagaaaagctaaataatttgttataccttttatcaaatcccttaaaagtgaagtggcctctccctgacccccttgccactaagcccttacaaaaccaggggtaataggcctgactgaattcacagagcagaacaaaaaactttacagctgtttgttctyattggaaattcttcccaaacattgctttattctaccaagtaaaagaaactaggacaagctctcatcactacattaaaactaaaaaaactagaaacaaaaatataaaaaggtaaaactttgggaaaaataattatatccaatacacaaacataaacactgatgtaaaacaagtcattaacttattaattttggagtgatacagtaattaaacttaatgaatctagcgtcattctatagcaccaaattttttttaactggaatttaatctctctgaaagttattaaacagctgagatcaaag

SEQ ID NO: 54139 - DNA, 601 bp, Human
tttgttacagaaatcaaggaaacatgttagaagaacgaaggaatgaccaactgtggcaaatgctgcttaaaaaaaaaaaaaaatcaaggagaatggggattagcagtctctctattctgagatgaaaagataccatggtgatactagtaagggcaaaacttaacataatagttgaggtagaagcttaactgtaatgtattcaaagtgtatgaaagatgagaaaaggaagatggcaaatgtcaacatttcttacaacacatttagttatgaatgacacacgacagatcctgggagacagtgsaggggttcaccagagaatttaacagaattgtattctgaggattgagtgagtggcttgaacatgtttaatgctggttgagtaagatccaatatgaaaggtagaaccctaaaatacttaaggttcatgacaaggtagaaagggattgacccatagcacaggttgagatgtggcctgacagaagaggacaccaccctccactaaaagaggagggaaaaagaaaaacataaaaggggagaaaatacaagtaaagttctagatttagcggcaaaaaatgagcatagttcctacctgatgctttct

SEQ ID NO: 54140 - DNA, 601 bp, Human
gtaatcctgggagcaatatggaaaacagagaagtgcccagtgaacactgtaagactagcaacactgaatatttcaagagagaaatgaaggtggtttgatgttgagtaacagacaataaagagaaaactggagagtctagcaacagatgatgtagggagaaaaaaagaacttataagaataattctcaggtttcagtatgatagtgattatcaactgaatgatagtgattatgagctcatttggacatgccaagtttgaagtacttcagagaatgaaggctccattaactagacaaatgcayatatgagtctgaatctcaggaaatgaagctagagacacaatttgggaatcatctgcacagaggcacatgaagctacataaggtgaagagagtgtaccatgagaagaacaactaggactaaaccccaagaatgcctctatttaaggggggatggtgggggcagttagtagtcattgaaggaggaggagaggctaagaaacagtaagaaggtaggtaggaggcatacaaagagagttctttgttacagaaatcaaggaaacatgttagaagaacgaaggaatgaccaactgtggcaaatgct

SEQ ID NO: 54141 - DNA, 601 bp, Human
tgaatagttggttaatgactgtgataaatgttgcaaaggaatagtactaggtacaatgagagcaactgcagccagtggggagtacgtgggtcagggaaagcttaccagaaatataaggtaagacataaagaataagtagagcaagtgacattaaagaaaaaaaaaattctagaaacatttccagacagaagatatgtaaaagaattccaagatgagagataaggatttcaacagggcagtgacatgatcagatttggctttaaaatagtaatcctgggagcaatatggaaaacagagaagwgcccagtgaacactgtaagactagcaacactgaatatttcaagagagaaatgaaggtggtttgatgttgagtaacagacaataaagagaaaactggagagtctagcaacagatgatgtagggagaaaaaaagaacttataagaataattctcaggtttcagtatgatagtgattatcaactgaatgatagtgattatgagctcatttggacatgccaagtttgaagtacttcagagaatgaaggctccattaactagacaaatgcatatatgagtctgaatctcaggaaatgaagctaga

SEQ ID NO: 54142 - DNA, 601 bp, Human
attttctgtaatgtcaaatcttttcccaatcattaatcatttgaataatttaaaactgaaagtgaaacatattaaccagtaccaaactatcttataagctaaacatggagttatttctttaataaaagaatgaatcggctgggtgtggtggctcacgcctgtaatcccagtactttgggaggccgaggtaggcagatcacgaggtcaggagattgagaccatcctggctaacacggtgaaaccccatctctactaaaaatacaaaaaaaaaaaaaaaaattagccgggtgtggtggtgggygcctgtagtcccagctacttgggaggctgaggcaggagaatggcatgaacccgggaggcggagcttgcagtgagctgagatcgtgccactgtactccgagactccctctcaaaaagaaaaaaaaaagaatgaatcaaattaacgtatgtaagtaaagcagggattacaaactcttaatgctttcaggagccaaacaggtaatgcaagtctcaagcattaggaaggggtggagtggcagaaactagaggccacatgttccatcaagagagatgtagagttgatttttgcaacaccgaacct

SEQ ID NO: 54143 - DNA, 601 bp, Human
ctagaattcagaaaactgaaatcagtttcagcaggctaaagcaaagatgttggcagggctggctccttatggaggctctcaggagcacccatttccttgcttttctaggggccatctgtcttctttgactagtgcccccgcctccattttcaaagtccatcactccagtctgtttctacaatcatatcgccttttttctctgactgactctttcatctctctggtaagaaccagtatgattacatcaggcccaggggaacagcccaggataatctcatctaaaaatccataacataatcayatctgcaaagtcccttttgccatataaaggcaatattcccaggtttcaatgattagtcatggacatatttcgggattagggggctggggagtagcctaccacactccttaagggctcaacaactcacatgcttctgtcaccctaaactgatggtcctaccttctaccttactaaggagactagaataccaaaagagagtttctcagcttctctcctcttcataaagttatttttacacaccacttcatctctttacccatccttgatgactttccaaatagctcaaagaagcagtgaccc

SEQ ID NO: 54144 - DNA, 601 bp, Human
cagattccatagataggtttcaggcacccataaaccccttgaaactgcacaaagtatgtgttctatggtatgtgcatgcacacatgcctgcctcttccaggagagagttcgtgaaatatgaccattttccaaaggatctatgactcccaaaagataagaatcagatctcttgtccaataattttacagataagaaaacaagagtcttgagagggtaaataacttgagcaaattaatgacaaagcaggaactagtttcttaattcacattaaacattcttctcactactccaaacttcccayatacattgtcagagtccactttatgtatacaagttcattccctttactctatcaagatgtgatgtatttccgggctgggcgctgtggctcatgcctgtaattccagcactttggaaggccaaggcaggtggatcacctgaggtcgaaagttcgagaccagtctggccaacgtggtgaatcccgtctttaagaaaaatacaaaaaattagctggacgtggtggtgggcgcctgtaatcccagctactcgggaggctgaggcagaagaatcgcttgaacccaggaggcgaaggctgcagtga

SEQ ID NO: 54145 - DNA, 601 bp, Human
ggaaagtaataaagaacagatgagacagaaaaaaaaaataggacagtaaatttaaacccaaatgtatcagtaattattttaaatgtaaacaaactaaatgcttcaatatatggaacaagtgatacaccttaaaattctgggtttatcataaactctactaaacagtcaattaatgtaattcttttgcactgaggtgattgatagagcacagtggtgaagaccatgagctttagaatcaacttctaaattcaaatttgaatcaaaaatcaaacactgcaaattcaaaggcttaaatccaatrttctactccagttattcagtaaatgtatgattttggcaggttaatctctctaacctcattcttaatctttctaacctcagttttccattcacaaaaatggagataacattcaactttaaggtcaagtatttaaaacatgtggcacagtgatacaggtatgtaataaatgatatctgttgttatgtatttggaaaaacatttaccttcaaagaaacacaataaatttttttgttttattgatctcctaaagtattgcttaaaaataacaaaaataatgataagataataatattgttagga

SEQ ID NO: 54146 - DNA, 601 bp, Human
acgtacacttaatagctctgaactgcacacttaagggtaagatggtaaattttatatgtatttgaccacaattaaaaaaacaaaccaaaaacccccagtgtttaaaagcatcaagagtaacaaaggcaacctagacttgtagggccaagattccggagaaaaggcaaacatactgagaggagccccataccagccttcactggttcccttcagtcacttgctgtctttggaggactggaaataagagcccaaccagaaagacaaaagtggagttggttaccaagcagctaggacttaagaygtcaaggttctgaagaggagagaaacacaaagagccgcaatttctgcaagaaatttttcactgagatgtttactgatacagcaccctaagcaaggggtgatgacaccaagaatccaaacagaaactatcaaagggaggctgaagatctgtgctgaagagacaactgttagaattctaggaacattaattcagaaggcaacctggcaaacacctcaggctttctttcagttcagaccccagaggaactatgctctgtgaataggtatgtcctggaaataaaggcaaactgttaacagacca

SEQ ID NO: 54147 - DNA, 601 bp, Human
taaacagagaaggtagaatggtagctggcagaggcttggtggaggggaaaatggaaagttactgtttagtgagtacagaatttcagttttgcaagatgaaaagaattctggagaggatggtggtgacagctctgtacaacaatgtgaacgtacacttaatagctctgaactgcacacttaagggtaagatggtaaattttatatgtatttgaccacaattaaaaaaacaaaccaaaaacccccagtgtttaaaagcatcaagagtaacaaaggcaacctagacttgtagggccaagattcyggagaaaaggcaaacatactgagaggagccccataccagccttcactggttcccttcagtcacttgctgtctttggaggactggaaataagagcccaaccagaaagacaaaagtggagttggttaccaagcagctaggacttaagatgtcaaggttctgaagaggagagaaacacaaagagccgcaatttctgcaagaaatttttcactgagatgtttactgatacagcaccctaagcaaggggtgatgacaccaagaatccaaacagaaactatcaaagggaggctgaagatctgtgct

SEQ ID NO: 54148 - DNA, 601 bp, Human
ccactactaaaaagctcagagtttccaccacagtaaaaattttcttaaaatctttcttgggaggccgaggcgggcagatcatgaggtcaggagatcgagaccatcctggctaacacagtgaaaccccatctctactaaaaaatacaaaaaaattagccaggcgtggtggcgggagcctgtagcccagctacttgggaggctgaggcaggagaatggtatgaacccgggaggcggagcttgcagtgagtcaagatcctgccactgcactccagcctgggtgacagcgtgagacaccgtctcaaaaaaaaaaaaaaaaaaaatccttctcaggggtctgaaaaattttaacaagaaaaacacagttgtgaaaattttttatttaaaaataatttccatttaagaattgtctaccaagatattggacaaatcaaacccatgtttctctaaagttgtgtaaactgcaataaatcataaaataaaaacactgttctctacttcaaatttaataatctagaggtcagagggaaaaaaaacagttaatcacactttgaggtcttagagcaatgaatttataagactatctttcaggaaagaagacctg

SEQ ID NO: 54149 - DNA, 601 bp, Human
cagaatcatagtgggggaaaaaaagtctaattataattagatcgaagtttaaagaactttctcaatactttccatgataccagtaactgactacacttctaaaacagcaccagtaacatatgaattagtaaattgtacagataaacatttctagatataaaaatattactgataaatttggtagagaagcatatgatatggtgtcaaaaaacctggtggacttagccactactaaaaagctcagagtttccaccacagtaaaaattttcttaaaatctttcttgggaggccgaggcgggcrgatcatgaggtcaggagatcgagaccatcctggctaacacagtgaaaccccatctctactaaaaaatacaaaaaaattagccaggcgtggtggcgggagcctgtagcccagctacttgggaggctgaggcaggagaatggtatgaacccgggaggcggagcttgcagtgagtcaagatcctgccactgcactccagcctgggtgacagcgtgagacaccgtctcaaaaaaaaaaaaaaaaaaaatccttctcaggggtctgaaaaattttaacaagaaaaacacagttgtgaaaattttt

SEQ ID NO: 54150 - DNA, 601 bp, Human
ccaacatatctaaatagttaaatgatgtataagaaatcaaattcagcacataaaagtatgctcaaaggtgtcaagacacacaatgcaaaaatacagttcctattgaagctaaacctatgcaaagtcaaggggtgtctcttaaagtgcgctaaatagtttcattactcagggagtggcattacaaacaaatcaaataaaaagttaaaataaaaacaaatgtgaaaattaagtccaaaaaacaacttaactcttactacttaatttacctgcaagaaaaagtttagtaaatatttttaatagycattatgttacagaaaagcaagctaggataaatgggttctaggcaaaatcaatggtgcacccaaggaaagaaacaacttaaaaattgttattttatcattcctatctaatgtttcatttgtaactatgagtaaacaggtgtttgagaacaaattctaaaactaacctttgggtcacattcaactctgaaagcttagtataaatataaatacaaaagtcctctggttctattacaaagtttaagggagcttttaataacatgtttgctttaaagtccagtagtttcatacttctttttttt

SEQ ID NO: 54151 - DNA, 601 bp, Human
gtaggcagaacacagaatgtttaaagccatgggttactgtggtgtaagagctaagcctttgtctttcaacttgagactgtcaagatgtgtgatgataattaaatgacatataatattaagaaaaacttgataaccctaaaatttcattatagataaaaaagagctaataaatggagaagaaacacagaaacttaagtgtggctctataaaactattaatagtaatactaaataatcatttatattaaatgtctgacatgtatgattaattaccatcaagtacaattaagggtacagatgcrtaacccttgagtatttgtgtgcatatgttaaacagaaatgcacacatatattcacagtaaacttgtgatatgcacatgatatgattctaatatcatttaaattcttgtgaggttttaatttttatgtgtctattttttaagattttttaaaagtcccagctccggttacctctaactagcaaactcaaagtatgaacaagattttaaaaatcattccaaaagagaaaaaaaaaaaattaaagactgattttaaaatgtcttaatcccaggctttgaccaaaatgtagtgaccaaaatgta

SEQ ID NO: 54152 - DNA, 601 bp, Human
gctaaacagcactccattgcatggatacaccacattttgcttatctataagctgatggatactttgggttgtttccattttttgtctattacaaataaggtggctataaacatttgggtacaatatttttgtggacatatgctttcatttttcttgggtggattctaagagaggaattactgggctgtatggaaattatcaaacttttctaagggggatctatcacttatggtaaattttttaataaaaaacctctaatagtaagaataatatttgatgtgaagttaggaattctttataygatcctggctctactgttaactggctatgtgaccttaagtcacttattcattgtggccctcagtaaaacaaatggctggtaaagataatctctaaaacattaatatcatttcctatgaaaatcctctcaccaaaaaataatatacatgcaggatcaaataaatgtacacttcactacttcttccccttctatttgctatcggtctcccatggcttggatttcccctgtcccaactttaagcatagtgatggtatcgctactaaaggaggtaaatctattaccttatggcctacaatgtct

SEQ ID NO: 54153 - DNA, 601 bp, Human
ttgtgatctgcccgccttggcctcccaaaatgctgggattacaggcgcgagcctctgagcccagcctccctccttgcttttgatggctaacactgttttttgttttttgttttttttgagaggaagtctcactctatcaccaggctggagtgcagtggtgcgatctcggctcactgcaatctctacctcccaggttcaagtgattctcctgcctcagccgcccaagtagctgggattacaggcacccgccaccatgcctggctaatttttgtatttttagtagagacggggtttcaccatrtgggccaggatggtctccatctcctaacctcgtgatccacccacctcggcctcccaaagtgctgggattacaggtgtgagccaccgcctgtaaacctcctctttcatctcacatgacctccaggcccaaccttttcctactgtcataactaatcgtgttttacttctcagcacagaacaatatgtacataataaaaactagcataaatttaataattcaaaaaccaacaagaatcccttttattataaaaataatcactattattgcttaaactattttacacatttgatttttctaagt

SEQ ID NO: 54154 - DNA, 601 bp, Human
gcagttcttgcttcatatgacatcattcctccaaccttctcctttcattcatcttgtatgatggtttaacacctaataacaaggaaagctattttttatattatcttcttcagtgctcacatttctacattctatataatctcagcacaagctcacatcacatttttgaaatcttaacatcaattttgatgagttcaaaatgcttattgatgactttgaacttcttggacttcacacttccatcctcaagatcttaaattccaagtttccctctgaccacgtccctccttttttgtttgcttttttttttttttttgatatggggtgtcgctctgtcaccaggctggagtgcagtggcgtgaccttggctcactgtgaactctgcctcccgagtttaagcgattctcctgcctcagcctcgtgagtacctgggactacaggcgcctgccaccacacccagctaatttttgtatgtttagtagagacagggtttcaccatgttggccaggatggtctcgatctcttgaccttgtgatctgcccgccttggcctcccaaaatgctgggattacaggcgcgagcctctgagcccagcctccctc

SEQ ID NO: 54155 - DNA, 601 bp, Human
attgatagcaaaatacactgaaataaaactactgttttttgtaatgcacagaaggattagtaatgtaattcctttctcgtctcagcaaggatctctctgggctttggtgggtctgtgagccttctaaaattattaagttatatgtttgttcacgcttaagtactttggaaagaaagcccatatctttcaccagattcttgaacatgaatctacaggttatagctaacgataaggtgaacatgaacagagctctaccacattaacaatgtaaccagaataatactaatcaactttccaaactttttttttttttttgagatggagtctcattcactctgttgtctgggctggagtacagtggtgccatctcggctcactgcaacctcttcctcctgggttccagcaattctgcctcagccttctgagtagttgacattacaggcatataccatcatgcctggctaatctttttatttttttgtggagacggggtttcatcagttggcctggtctcgaaagtcctgacctcaagtgatctgcccaccttggcctcccaaagtgctgggattacaggcgtgagccaccatgcccggccccaaac

SEQ ID NO: 54156 - DNA, 601 bp, Human
gcacagataatccagaagtgttgtgcattccttgaaaatccatattgatagcaaaatacactgaaataaaactactgttttttgtaatgcacagaaggattagtaatgtaattcctttctcgtctcagcaaggatctctctgggctttggtgggtctgtgagccttctaaaattattaagttatatgtttgttcacgcttaagtactttggaaagaaagcccatatctttcaccagattcttgaacatgaatctacaggttatagctaacgataaggtgaacatgaacagagctctaccayattaacaatgtaaccagaataatactaatcaactttccaaactttttttttttttttgagatggagtctcattcactctgttgtctgggctggagtacagtggtgccatctcggctcactgcaacctcttcctcctgggttccagcaattctgcctcagccttctgagtagttgacattacaggcatataccatcatgcctggctaatctttttatttttttgtggagacggggtttcatcagttggcctggtctcgaaagtcctgacctcaagtgatctgcccaccttggcctcccaaa

SEQ ID NO: 54157 - DNA, 601 bp, Human; identical to SEQ ID NO: 27990

SEQ ID NO: 54158 - DNA, 601 bp, Human; identical to SEQ ID NO: 27991

SEQ ID NO: 54159 - DNA, 601 bp, Human; identical to SEQ ID NO: 27992

SEQ ID NO: 54160 - DNA, 601 bp, Human; identical to SEQ ID NO: 27993

SEQ ID NO: 54161 - DNA, 601 bp, Human; identical to SEQ ID NO: 27994

SEQ ID NO: 54162 - DNA, 601 bp, Human; identical to SEQ ID NO: 27995

SEQ ID NO: 54163 - DNA, 601 bp, Human; identical to SEQ ID NO: 27996

SEQ ID NO: 54164 - DNA, 601 bp, Human; identical to SEQ ID NO: 27997

SEQ ID NO: 54165 - DNA, 601 bp, Human; identical to SEQ ID NO: 27998

SEQ ID NO: 54166 - DNA, 601 bp, Human; identical to SEQ ID NO: 27999

SEQ ID NO: 54167 - DNA, 601 bp, Human; identical to SEQ ID NO: 28000

SEQ ID NO: 54168 - DNA, 601 bp, Human; identical to SEQ ID NO: 28001

SEQ ID NO: 54169 - DNA, 601 bp, Human; identical to SEQ ID NO: 28002

SEQ ID NO: 54170 - DNA, 601 bp, Human; identical to SEQ ID NO: 28003

SEQ ID NO: 54171 - DNA, 601 bp, Human; identical to SEQ ID NO: 28004

SEQ ID NO: 54172 - DNA, 601 bp, Human; identical to SEQ ID NO: 28005

SEQ ID NO: 54173 - DNA, 601 bp, Human; identical to SEQ ID NO: 28006

SEQ ID NO: 54174 - DNA, 601 bp, Human; identical to SEQ ID NO: 28007

SEQ ID NO: 54175 - DNA, 601 bp, Human; identical to SEQ ID NO: 28008

SEQ ID NO: 54176 - DNA, 601 bp, Human; identical to SEQ ID NO: 28009

SEQ ID NO: 54177 - DNA, 601 bp, Human; identical to SEQ ID NO: 28010

SEQ ID NO: 54178 - DNA, 601 bp, Human; identical to SEQ ID NO: 28011

SEQ ID NO: 54179 - DNA, 601 bp, Human; identical to SEQ ID NO: 28012

SEQ ID NO: 54180 - DNA, 601 bp, Human; identical to SEQ ID NO: 28013

SEQ ID NO: 54181 - DNA, 601 bp, Human
cagaactacccaactgagtatcttctcaatccctaacccacagaaacgagagataataaattgttagtggttgttttaaatcactaacttttgaaatttgtcatgtggcattaaacaatacaccatcttactgaactcacacagaatattcaaaaataaaagttcaccttcctttaaattattataattaaatacttttaactatctccactaatttgtggaggtgatttctttaaaaaggctagctaataaaacattagcaacagactgtagagaaacacgtggtgttgagtaaagatamatttcttgtgccttctcacaatgccccagatttgaggtgtcagcagccagaaggctttggagccataggcatggcattctatatacactacaatcagtttctgctttgtgacttagctaaagttggaaaacttacagatattctctacttaattttaaccttccatctaataactgcttattagcatcaatgattccaagtcagatgggaaaaggaaaagcttgaaccactaaattttccagcaattccagtaacagctttaaaaaatgaattcgtattttttattatcccattattttt

SEQ ID NO: 54182 - DNA, 601 bp, Human
ggaaaaccagccaccaagatttgaggacaaagagccacatgaaaaggcccatgtgcagagaaactaaggccacttaacaacatccagaacaaatttgccagccatgtgaaccaccctggaagtgtattctccagcttcagtcaaaccgtcagatgaccagaaccccagacaacatctaaatgcaacctcatgaaccccaagccagaactacccaactgagtatcttctcaatccctaacccacagaaacgagagataataaattgttagtggttgttttaaatcactaacttttgaaattygtcatgtggcattaaacaatacaccatcttactgaactcacacagaatattcaaaaataaaagttcaccttcctttaaattattataattaaatacttttaactatctccactaatttgtggaggtgatttctttaaaaaggctagctaataaaacattagcaacagactgtagagaaacacgtggtgttgagtaaagatacatttcttgtgccttctcacaatgccccagatttgaggtgtcagcagccagaaggctttggagccataggcatggcattctatatacactacaatcagt

SEQ ID NO: 54183 - DNA, 601 bp, Human
acattaatagtgctattgtctgtagtttttaaatttcagactcattctcataaaattataaaaaataaagaacattaacaaaaatatgtattaatagttcttatccatacctctttcaaaaacccactgctaattactaaagtccaaggtacagactaccactgtatgtatttcctatttttagctgttctaaatcacaataaacttacctttagtcattcaaaaaacatgaaaagaaaaaacctcagcagcagcctgactactacagattaaatatgacactacaaattaatgccacctrttgtagccagcttctatgacagcacgtaataaccctggtatatgttaatcttgtgtggtcctctcactatcagggctgacttgggcaaccaagaaaatgagaagtgacactacatgtcttccagggaaagatcaaaaaggcactgcaggttctgcctgggtcttctggattgctcgctcttgggaaaaccagccaccaagatttgaggacaaagagccacatgaaaaggcccatgtgcagagaaactaaggccacttaacaacatccagaacaaatttgccagccatgtgaaccaccctg

SEQ ID NO: 54184 - DNA, 601 bp, Human
agtcccccacttttataaggaatgaggactggcttttatcaaatactttttgttcatctatagagatcaaatggttttctccttaaaatggtgcctggcaattaggcaactgcttgtttttacaattattacaatatcttaataacgatcttttcaaaaagttttcctatgctgacctttctttgtattgtagggataaatcctttttgaacacagtgcattattctttcaatacactactgaatatgacttgctaatattgagatttatgctttcagtgtattagaatctaaggagcaasgcagaatgatgaataaccttaagctttctttctcttttgtattttccttgctcagttttagcaaaaaaattatgctagcctcagatatttcctgagagcagtatgtctattttgccttctgagttcaaagttcgctaaacagccttcaattttaacttgctaattgtgttattcaaatttcctatatcccccttttcaactcaggttagtcaataaatttgtaaggaatttccatgattctcgagttgtctactttcccttgtactttcattttcctttctatattgtgaagttatgtcc

SEQ ID NO: 54185 - DNA, 601 bp, Human
cagtctaatagaaaggtgtctagtattttcctactaactactacaatgatttagtttgtcatcagatacaaccttatggcattaagggcaatccattctaaggtggcgatgagtcccccacttttataaggaatgaggactggcttttatcaaatactttttgttcatctatagagatcaaatggttttctccttaaaatggtgcctggcaattaggcaactgcttgtttttacaattattacaatatcttaataacgatcttttcaaaaagttttcctatgctgacctttctttgtattstagggataaatcctttttgaacacagtgcattattctttcaatacactactgaatatgacttgctaatattgagatttatgctttcagtgtattagaatctaaggagcaaggcagaatgatgaataaccttaagctttctttctcttttgtattttccttgctcagttttagcaaaaaaattatgctagcctcagatatttcctgagagcagtatgtctattttgccttctgagttcaaagttcgctaaacagccttcaattttaacttgctaattgtgttattcaaatttcctatatcc

SEQ ID NO: 54186 - DNA, 601 bp, Human
gaatacaacttaaaaaggacgtgaaggatctcttcaaggagaactacaaaccaaacaaatggaaaaatattctatgctcatggataggaagaatcaatattgtgaaaatggccatactgcccaaagtaatttacagattcaatgctattcccatcaagctaccattgactttcttcacagaaagagaaaaaactactcataagacccaaaaccataaaaaccctagaagaaaacgtaggcaataccattcaggacataggcatgggcaaagacttcatgactaaaacaccaaaagcaactrcaacaaaagccagaattgacaaatgggatctaattaaactaacgagcttctgcacagcaaggaaactatcatcagagtgaacaggcaacctacagaatgtgaaaaaatttttgcgatctatccatctgacaaaggtctaatatccagaatctacaaggaacttaagcaaatttacaagaaaaaaagaaccccatcaaaaagtggacaaaggatatgaacagacacttctcaaaagaagacatttgtgttgctaacaaacatgaataaaagctcatcatccctggtcattacggaaatgca

SEQ ID NO: 54187 - DNA, 601 bp, Human
cccaaaaaagcccaggatcagacggattcacagtcgaattctaccagaagtacaaagaggagctggtaccattccttctgaaactattccaaacaatataaaaagagggacttcaccttaactcattttatgaggccagcatcatcctgataccaaaacctggcagagacacaacaaaaaaagaaaatttcaggccagtatccctgaggaacatcgatgtgaaaattctcaataaaatactggcaaaccgaatccagcagcacatcaaaaagcttatccaccataatcaagttggcttcayccctgggatgcaaggctggttcaacatatgcaaatcaataaacgtaatccaccacataaacaaaaccaatgaaaaaaccacatgattatctcaatagatgcagaaaagacctttggtaaaattcaacaccccttgctgctaagaacactgaataaactaggtattgaacatatctcaaaataataagagctatctatgacaaacccatagccaatatcatactgaatgaacaaaagctggaagcattccctttgaaaactggcacaagacaaggatgccctctctcaccactgctattca

SEQ ID NO: 54188 - DNA, 601 bp, Human
tagattatggttttcaatttttatgttataagtaatttctcctagtctatttttaacttaatatatctcatcatatagatgtgttatcacttatgtggttaaatctgttaatcttttcctttattattttggtaatacatttttaaaaagacatttctcacattaaggttaccaaaatattcaacattttcttccattatttatatagatttgcacttatatttagattttcacatttatctggaattttatatttgatgtgatccatggaattgaggtcttaatactaccctcttctcaytcccacaaataaaaaacaattaaattcagtttttagaaacgacaaatttgagatctggcaagatggccgaataggaacagctccgatctgcagctcccagcgagactaatgcagaaggtgggtgatttctgcatttccaactgaggtacctggttcatctcaatgggactggttagacagtgggtgcagcccacagagggtgagcagaagcagggtggggcgtcacctcacctgggaagcacaaggggtcagggaactccctcccctagccaagggaagccctgagggactgtgctatct

SEQ ID NO: 54189 - DNA, 601 bp, Human
aaaatagtatatgaatatccactccctcacaccctcttcaacgccagattttcttttgctcatgtttggctaaaaatgaaatctcattattttaatttgtacttctcatgaccactatgggaaaaaatatttttatatttacaggatatctgtaatcttctatgctttctctatctatattccttcatgtttttatactcaattgtttgccttcatactgatttactgatgctctttatagattatggttttcaatttttatgttataagtaatttctcctagtctatttttaacttaatrtatctcatcatatagatgtgttatcacttatgtggttaaatctgttaatcttttcctttattattttggtaatacatttttaaaaagacatttctcacattaaggttaccaaaatattcaacattttcttccattatttatatagatttgcacttatatttagattttcacatttatctggaattttatatttgatgtgatccatggaattgaggtcttaatactaccctcttctcattcccacaaataaaaaacaattaaattcagtttttagaaacgacaaatttgagatctggcaag

SEQ ID NO: 54190 - DNA, 601 bp, Human
ttactttttaaaagcaatgttttcctattcatctatatatacacatgaatacaagtatatgcatatacatgaacgtacacgaacacatccacctatacaccagtattagtgttaaatgagaccataacatgaatttttctattaatttcttcagatttttcagctagcaaaaagagattaaagctacaaggaattccatagtactgttctatcatgacacaagtggagatttagactggatccaatgttctgttggtacatgcatttctgactttgagcacgaaagcctgtttttcaaaarcaaatttctagaaatgcacttgcttcctcaaagttataaatattttatatttgcgccaagcacggttgctcacgcctgtaatcccagcactttgggagaccaaagtaagaaaatcacttgagcccaagaattcaaaatcagcctggtcaacatagcaagatctgctctctaccaaacatttaaaaaatagcctgtagtcccagctactcatgaggctaaggtgggaggatggcttgaacctgggaggtcgaggttatagtgagacatgataataccactgcactccagtctgggcaagaa

SEQ ID NO: 54191 - DNA, 601 bp, Human
tctttctattagagttaggaacaagataaggatgcctatctttactattactattttacctgcactctggtaatcaattgtatatttaaattactttttaaaagcaatgttttcctattcatctatatatacacatgaatacaagtatatgcatatacatgaacgtacacgaacacatccacctatacaccagtattagtgttaaatgagaccataacatgaatttttctattaatttcttcagatttttcagctagcaaaaagagattaaagctacaaggaattccatagtactgttctrtcatgacacaagtggagatttagactggatccaatgttctgttggtacatgcatttctgactttgagcacgaaagcctgtttttcaaaagcaaatttctagaaatgcacttgcttcctcaaagttataaatattttatatttgcgccaagcacggttgctcacgcctgtaatcccagcactttgggagaccaaagtaagaaaatcacttgagcccaagaattcaaaatcagcctggtcaacatagcaagatctgctctctaccaaacatttaaaaaatagcctgtagtcccagctactca

SEQ ID NO: 54192 - DNA, 601 bp, Human
atgaataaagtgtaatactaggggagaaaaagcagctcaggaaagaatgctgtgtaattttaaattcactattctgtcagtgggacagcaaggaaactgtacagttatatgatttagtctctacatgtctatagtgatatgtgattgagtaaaagtcttgacactaggatttattgctttgatgcactgtatacagctatctgtctctttctcaaaagcagcttatgaagagtgggcatgaagatggtgatattcagattatacgagtaactgatctggagagtcagtcattctctctagmcaagtctttgagcaacagttctgttctcctaaaaaactgtcaggtaggcaaggattcagagaaatgtgattttcagtgattacacatattcattttcttcaaataatctctggttatatctacctactttagacatttcaaatagtataaatgctaatcccagaaaataggtgctattattagaatgaagatgtttattattacatacatgctaaaagtgatttatttacatactttagttattgcttaatcatattcaatgaaccagaaataccttaggtggtattttaagattacaga

SEQ ID NO: 54193 - DNA, 601 bp, Human; identical to SEQ ID NO: 28014

SEQ ID NO: 54194 - DNA, 601 bp, Human; identical to SEQ ID NO: 28015

SEQ ID NO: 54195 - DNA, 601 bp, Human; identical to SEQ ID NO: 28016

SEQ ID NO: 54196 - DNA, 601 bp, Human; identical to SEQ ID NO: 28017

SEQ ID NO: 54197 - DNA, 601 bp, Human; identical to SEQ ID NO: 28018

SEQ ID NO: 54198 - DNA, 601 bp, Human; identical to SEQ ID NO: 28019

SEQ ID NO: 54199 - DNA, 601 bp, Human; identical to SEQ ID NO: 28020

SEQ ID NO: 54200 - DNA, 601 bp, Human; identical to SEQ ID NO: 28021

SEQ ID NO: 54201 - DNA, 601 bp, Human; identical to SEQ ID NO: 28022

SEQ ID NO: 54202 - DNA, 601 bp, Human; identical to SEQ ID NO: 28023

SEQ ID NO: 54203 - DNA, 601 bp, Human; identical to SEQ ID NO: 28024

SEQ ID NO: 54204 - DNA, 601 bp, Human; identical to SEQ ID NO: 28025

SEQ ID NO: 54205 - DNA, 601 bp, Human; identical to SEQ ID NO: 28026

SEQ ID NO: 54206 - DNA, 601 bp, Human; identical to SEQ ID NO: 28027

SEQ ID NO: 54207 - DNA, 601 bp, Human; identical to SEQ ID NO: 28028

SEQ ID NO: 54208 - DNA, 601 bp, Human; identical to SEQ ID NO: 28029

SEQ ID NO: 54209 - DNA, 601 bp, Human; identical to SEQ ID NO: 28030

SEQ ID NO: 54210 - DNA, 601 bp, Human
tgctctatgcagaacactgcagacaaacttctgccacctgtgtgccaagcttctgctctgtgttcactgtgatgcttccttcagaaggcattctacacacaggaacagcatgttctcttttcagagcagctcaaacacccacagaagctgtttattatacaaggaaacctcactgcaggaaataataagcagaaaatgaatgggagtgagtaagtttccttctgactcaccctgtccatcaagaaagacaatggtacccagagatggaaactttgcctggtttaatgcagagtggagaggrtgattattccaattctacctgaattgtgaccacaatgatgaagggattattcttgaggcagttcataccaatggctagaccaaaaagccccctgaagcctggtattgagaacgatgcctgctatataagtgagcagggtcccagcctcatttccacctcacccctgacctgcctaaggaagcacccacatatgacattgaaaggactgcctgtctccaaaatatcctacaatggggattgaaattgtcaccattaagtcatcttttggggataaagcattgaattgttaaaattaagtca

SEQ ID NO: 54211 - DNA, 601 bp, Human
gactgtgcatctgtcagaattcatagaggtacatttacagaggctaaattttactgtatgtaaattatactgctgtagcctaatttttttaaagtgctattgcatataaaacaatgtgctagacactgaattatgaaatctaacgttcaagcatacaattctcaaggtttctagatgtattatcaaaaacttatcattaaacactttgagttcagccttcagtattttatattttatccatatttatattctataaaacgactcaaagcatcacctaaaattatcacatgaattttgaatyattatgtgttcaacatacacttatagaaaatttccttcttattcttaaaagtgaacatatcaatatctattaaatgttaattatatggttatgagttgaatttactactaaattctaccttttctgaattataaatacattaagaaatgtaaactgtgattagatttattcacatccctcagaacactacgaaatgtgtcctaaacatgttaattgatttcagaaacttctatgtcttgagcaagacttaagtgttaacaagcatctgatggcttttaaaataagaatgtttcagaaatt

SEQ ID NO: 54212 - DNA, 601 bp, Human
gtaccacttccaaccaacattgtaaatcaaaaatttggaccaaggagaggagagagaatggtagctggagaaggatataggatcaaggaaggtttggtgtttgggttttattttaatactatatgtaattaataatgagtatggaattttatatttcattttttttttacatggagtttcgctgtgtcacccaggctggagtgcagtggtacaatcttggctcactgcaacctccgcctcttgacttcaagtgcttctcctgcctcagcctccctagtagctgggattacaggtgcctacsaccatgcccagctaattttttgtacttttagtagagatggggtttcaccatgttgaccagcctggtcttgaacttccgacctcaaatgatccacccgccttggcctcccaaagtgctgggattacaagcgagagccaccagccagaattttgtattttaattacttagattcctgatcaacataaacaattccttattcttaacagaaaatatgcaggataaaacatatagtgataactattgccaaaactagcagtttctaaagtggttttttgttttgaaatgaaatctcactctgtc

SEQ ID NO: 54213 - DNA, 601 bp, Human
ttcactcttgttgcctaggctggagtgcaatggcgccatatcagctcactgcaatctctgcctcccaggttcaagcaattatcatgtctcagcctcctgagtagctgggattacaggcatacaccaccacactaatttttgtatttttagtagagacagggtttcaccgtgttggccaggctggtctcgaactcctgacctcaagtgatctgcctgtttcggcctcccaaagtgctgggattacaggcatgagctaccatgcccggccacagtaatagacaattaatacaatatctgaggkgtaattcatcactttctttcccaaaaccactcatttcctatttgtgttaatagaaaaagcccatcatagttacctttgacttctccccttgactcagttaactttactcatcaaggcacattggctttttttcccaatgccttttttccactgtcttttgctgccatcttgaagtaagctctcattatcgcattactttttttttttttttttgagacggagtctcgcactgtcacccaggctggagtgcagtggcgcaatctcggctcactgcaacctccaccttccaggttcaagcga

SEQ ID NO: 54214 - DNA, 601 bp, Human
caggtgtcctgccttttcaggctgaatcaatgtacatcttacatgcattgattaatgccttatgtctccctaaaatgtataagaccaagttgtggcctgaccaccttgggcacatgttctcagatctcctgagggctatgtcacaggccatttgtcactcatatttggctcagaataaatctcttcaaatattttacagagtttgattcttttcatcaacaagttgatttaaaaaaaaaaatccagaaggcgtttagagaaagttagggaaataatctaaacacagcccagaaaacaaggrgattgtgaactgagaccctcctagcctaggggaagaaatgtgtctagatcaattctcaaagtccactgtagctgaattcctgatttctgaccatttccaaaaaatgtgtttattctttcttcctcaggagccagcccaccatcatgactgttaagcatgctatatattaaatttaagtaaaagaaagaaacaatctttgcaactccttgtgagcacattttttccaagagacatcttcacaaggttgtaactcgatgtcttctatccaacacccatgtgggtgaacgaggggtaagaccc

SEQ ID NO: 54215 - DNA, 601 bp, Human
gtgactaccaacatttcactcctcaccatatcctggattctatcagtatttctctgcttaaggtaaaacatcctcttagagttatcaatgggtgagttaatttagtaaattgctatttgccatttacacactatgaattctctcaacgttgcttttcttaactggcaaagaacaaagcattggggctttgatagaaaaaggaagggagctttcagatggaaacatagggtgttgcctgggagggagcagttgagggacaggttatggggcaaatagagaaaacaagagtaagcaagaaagygacttcagcaaatcagggctggtacgagagaaggagtgtagcaaagacacatgcagggagatgagctgaccagccttgaaatcaggggtgcacaacttgaagtttataaaccaaaaaataaaattctaaggcccctcaaccatctgaatgggtccctcctcttggccaagggcattacaaagttaacctgaaaaataagtttaggccatgatggaacaagggagacagacatggttcattataccctccctccccttttggaatcactgatagaacagaccctttaagacccctaagaaa

SEQ ID NO: 54216 - DNA, 601 bp, Human
aaaagaaggatctctttttaaaagatatggttagtagtaataggtccaaacgttcttaaggggtaaaatcctagaaactcagcaagatacaaaatagtcatcgtatcaagaattcagttcagaatttcagaaaatcaatattgttcttatcatatagccaggaaatggacttggccttataatctactgttaagattgtcacaaataaaatatttgagcactgaatatgttttcatataatcaaccttatttcatctttagaaaatccctatgagtatctccatttcacagaggaggaaayaggctaggaggtgaagtcgcagagctagtaattataaaatccaggacaaagaggctgccattcatacagggtgaatttcaggggacaggtaggaaggtgactaccaacatttcactcctcaccatatcctggattctatcagtatttctctgcttaaggtaaaacatcctcttagagttatcaatgggtgagttaatttagtaaattgctatttgccatttacacactatgaattctctcaacgttgcttttcttaactggcaaagaacaaagcattggggctttgatagaaaaaggaag

SEQ ID NO: 54217 - DNA, 601 bp, Human
atcatattcaaggaattggtaagtgccactagtgaacaaaatggacaaaaatccttgccctcatggaatctataatctattgtcttgttcaccactgcatccgtagagcctggtacaatgctcaataaatatttgttaaatgaacaccaataggaaagagaacaaaaagtaaaggataagctcaaaaaataagccatgctgtcatctggaccagatgaagtgatgaggtccttctccctatgtcctccttcctctgtgctccataacccagtagagaaacaacagcacttatcactctgayggcaactcattgtgtgaagaagccaacaaagtatcaatggaaaagcaagcacaacacagcttccagtgcatttgtacagtgaaggggacaggtacatgactaagatatggtcaattagcttataaatcaagttagcaagacaagtttaaaattataaaaaacataagaatgggccaggtgcggtggctcacacctgtaatcccagcactttgggaggccgaggcgggcggatcacaaggtcaggagatcgagaccatcctggctaacatgccgaaaccctgtctctactaaaaatacaaa

SEQ ID NO: 54218 - DNA, 601 bp, Human
ctgaataaagaagataaaagagaaaatacaaatggcagatagatttatgagaaaacatttacctcactaataaagagaagcaaattgaaaccaaaagatactatacatcacgtatcaatgtagcaaggtttttttctttttgataagagtcaatgctaccaagaggttggaaaaagcgacactcacactgctggtaaaagagcaagtctgtacaaccttcttaagacttgaacacttgaaaacatctgtcaagaactttaaacattaatgcactctgaccccacagatttgttctaaaaayatatccagagaaacttatttttttcaaaacttcatgaacaaataaagtaaccatagcattaaaacaatgaaaataattgatagggccttcaataataaagagttaaataaattaaatctgatcataagatagaatattacacagttgtgcagttgtgaaaagggtctctggaaatttaacaacagaaatgcttatacgacaatattaagtgaaaaatgatacagaactctgtgtataagcccaattaattttgaaaaatcatattcaaggaattggtaagtgccactagtgaacaaaatg

SEQ ID NO: 54219 - DNA, 601 bp, Human
ccagaacccaatataaaaacgggcaaaatctctgaataaagaagataaaagagaaaatacaaatggcagatagatttatgagaaaacatttacctcactaataaagagaagcaaattgaaaccaaaagatactatacatcacgtatcaatgtagcaaggtttttttctttttgataagagtcaatgctaccaagaggttggaaaaagcgacactcacactgctggtaaaagagcaagtctgtacaaccttcttaagacttgaacacttgaaaacatctgtcaagaactttaaacattaatrcactctgaccccacagatttgttctaaaaacatatccagagaaacttatttttttcaaaacttcatgaacaaataaagtaaccatagcattaaaacaatgaaaataattgatagggccttcaataataaagagttaaataaattaaatctgatcataagatagaatattacacagttgtgcagttgtgaaaagggtctctggaaatttaacaacagaaatgcttatacgacaatattaagtgaaaaatgatacagaactctgtgtataagcccaattaattttgaaaaatcatattcaag

SEQ ID NO: 54220 - DNA, 601 bp, Human
tattatcatatagttgcttataatagcctataatgatcctttagatttctgcggtatcagttgtaacatctcctttttcatctgattttattcgactcttctatcttttttttaaaaaaattagtctggctaaagatctgtcaggtttattttctcaaaaaaaccttcatattttgtcaatcttttgtgttgttttcttggtttcaatttcatttatttctgctttgatctttttatgaatatttcttttcttctattaattttgggtttggcttgctcttgcttttctagttctttaagrtacatcattaagttgtttacttcaagattttctactttttagatgtaggcacttaagctataaactttcctcttagtactgctttcactgtatcctataggttttggtatgttgtttccattaccatttgtttcaagaaatttttaatttccttcttaatttcttcattgacacactggttgttcaggagtatatggtttaatttccatgtttgtatagtttccaaaattctttattgatttctagttttattccattgtggtcaaagaaggtgcttgatttgattccagtttttttgaa

SEQ ID NO: 54221 - DNA, 601 bp, Human
gagagtttccccgtgttttcttttagtagtttcatagtttgaggccttagatttaagtcactgatccatctggacttgatttttgtatatggtgagagatagggatctagttttattcttctgtacatggatatccagttttcccagcaccatttattgaagagactattttcaaaaatgagttaactgtagatgtatggatttgtttctgggttctctattctgttccattgatccctatgtctgttttaggctagtaccacgttgttttggttgctatagctctatggtataatttatrgtcaggtaatgtgattcttccacagttttgatatttttgctcagaatagctttggttattctggatcttttgtggttccatacaaattttagggttgttttttctatttctgtgaaaatatcattggtattttgataaaattgcactgaatctgtagattgctttgggtagtatggacatattaattcctccattccatgaacatggaatatctttccattttttttgtcctcttcaatttctttcaccagtgttttatagttttcattgtagagaactttcacttatttggttaattcc

SEQ ID NO: 54222 - DNA, 601 bp, Human
agttcagtggcatgatctcgactcactgcaacctccacctcccgggttcaagcaattctcctgcctcagcctcccgagtagctgggactacaggcgcatgccgccacacccagctaattttttgtattttagtagagacagggtttcaccgtgttgcccaagctggtctcgaactcctgagctcaggcaatctgcctgcctcgacctcccaaagtgctaggattacaggcatgaggcactgcaattgtttttatttttagctcccacaaataagtgagaacatgggaggtttgtctttgtrtgtctggttatttcacttaacatgacctccagttgcatctgtgttgttgcaagtgacaggatctcattcattttatggccgaatagtggtgtatatgttccacattttctttatctatattcacctgtggatggacacttaggttgcttccaaatcttggctattgtgaacagcgctgcaacaaacatgggactgcagacatctcttcgatatactgatttcctttcttttgggtgcatacccagcagtgggattgctggatcatatggtagctctatttgtagttttttgaggaaactt

SEQ ID NO: 54223 - DNA, 601 bp, Human
tattaactatacttcatatatttgatttcaaacaataacatctctagtatggcccaattttattaaaatactttgatttatcatctttttttttttccgagacagggtctccctctgttgcccaggctggagttgcagtggtgtgatctcaactcactgcaacctccacctcctgagcttaagcaatcctcccatctcagcctcccatgtagctgggactcccactttccccactcccactacccttcctagcctctggcaaccaacctgctactttatccccacaagttcaattgttttctttctttttcttttttggagacggagtctctctctgtcacccaggctggagttcagtggcatgatctcgactcactgcaacctccacctcccgggttcaagcaattctcctgcctcagcctcccgagtagctgggactacaggcgcatgccgccacacccagctaattttttgtattttagtagagacagggtttcaccgtgttgcccaagctggtctcgaactcctgagctcaggcaatctgcctgcctcgacctcccaaagtgctaggattacaggcatgaggcactgcaattgtttt

SEQ ID NO: 54224 - DNA, 601 bp, Human
ctattacacttatattattaactatacttcatatatttgatttcaaacaataacatctctagtatggcccaattttattaaaatactttgatttatcatctttttttttttccgagacagggtctccctctgttgcccaggctggagttgcagtggtgtgatctcaactcactgcaacctccacctcctgagcttaagcaatcctcccatctcagcctcccatgtagctgggactcccactttccccactcccactacccttcctagcctctggcaaccaacctgctactttatccccacragttcaattgttttctttctttttcttttttggagacggagtctctctctgtcacccaggctggagttcagtggcatgatctcgactcactgcaacctccacctcccgggttcaagcaattctcctgcctcagcctcccgagtagctgggactacaggcgcatgccgccacacccagctaattttttgtattttagtagagacagggtttcaccgtgttgcccaagctggtctcgaactcctgagctcaggcaatctgcctgcctcgacctcccaaagtgctaggattacaggcatgagg

SEQ ID NO: 54225 - DNA, 601 bp, Human
tagctgggactacaggcacatgccaccacgcccggctaatttttgtatttttagtggagacaaggtttcaccctgttgaccaggatggtcttgatctcttgacctcatgatttgcatgccttggcctcccaaagtgctgggattacaggcgtgagccaccgcacccggccttaactaaactttcacagaaaaaaaccaaacttgtcttttcctattcataatatgtttgagtaaattttaattaaattttataatgtaacaattacagtgagtagaaacaggtttgaaaagaagcccaccrgtttctgacaaggataatgtgaagcggtgggaatggaaatgtttaggtgtttgagagaataaccaataatacacgctgtgaggctatgggcactggcaggatgttctacagaggaaatgaagatcatcagtgactctaggaagccagagaagcatgatcagatgaagagaacttctgctgtaactgaactataatagctgagggttctaatctgttacatacacagagaaaagaaaagggcagagaatgctcacaaggcaaagctactaagaaattgtcagggagggctgggtacagtgg

SEQ ID NO: 54226 - DNA, 601 bp, Human
ttcctgggctcaagtgatcctcctgccttggcctctgaaagtgctgggattacaggcataagccaccacatccggcccaagaattaagttttagtgatatagaaacaaggtggaaccaaaataacaaacaataacatgcaaaatcagagaggaatgattttggttagaatttctaagattcttttttgggaagatagaagcttaaattctcaaattaatcaagaacacgttacaaaacataaacgtcattaaaggaattgaaacatggccaaacatggtggctcacacttgtaatcccagmactttaggaggccaaaggtggtttcggcgggtggggcgggaggggacggatcacttgaggccaggagttcaagaccaacctgggcagcatggtgaaaccccatctctactaataatacaaaaattagctgggcatggtggcaaatgcctgtaatcctagctgtttaggaaggtgaggcaggagaatcacttgaacctgggaggcagaggctgcagtgagccaagatcacaccactgcactccagcctgggtgacacagcgagactctgtctcaaaagataaaagggaattgaaacagaat

SEQ ID NO: 54227 - DNA, 601 bp, Human
gagccttgctctgtggcctagactggagtgcagtggtgtgatctcggctcactgcaagctccgcctaccgggttcacgccattctcctgcctcagcctcccgagtagctaggactatgggtgcctgccaccatatttttccacgttttatacacaaaattatttatttatttttgagacggagtctcactctgtcacccaggctgcagttcagtggcacattcttggctcactgcaacttcagcctcccgggttcaagcgattctcctgccttagcctcccaagtagctgggattacaggmgcccgccaccatgcctggctaatttttatatttttagtagagatgtgatttcaccatgttggccaggctgctctcaaattcctgattctcaagtgatctgcccatcttggcctcccaaagtgctgggattacaggcgtgagccactgcacccagcctttatacacaaaattagattgtagtatctacactattttaattgtatttttgagacagagtcctgctctgttgcccaagctggagtgtaatgatgcaatcatagctcactgcagccttcatctcctggactcaagcaatcctcc

SEQ ID NO: 54228 - DNA, 601 bp, Human
tcgcctgaggtcaggagttcaagaccagcctggccaacatggtgaaaccacttctctactaaaaatagaaaaattagcctggcatggtggtggacacctgtgatcccaactacttgagaggctgaggcagcaggatcacttgaatccggtaggcggaggttgcagtgagccaagattgcacctctgcactccagcctgagcaacagagagagactccatctcagaaaaaaaacaaaaaacaaaacaaaacaaaacaaaaaaaaacaaaagagtgagttaaagcatgtgaaaataaacttgrcacatttctaagaattttatcacctgtccagaaagctccagatataattggtcactataggtacaaaaaacagcaggacaacttaagattataacctgaaaatggaatttttaatggagaaaaatctgtgtcgacttatacacatagtggccacatacctacgggatacagtcccctattaaagcgctggcctgtaaatgctgctgcaccacagattaaaaatgagtcacaggaccctgaatccttggacccaactctctccttctctggttcttgacccagtgaaggagctgatgatgc

SEQ ID NO: 54229 - DNA, 601 bp, Human
taatttgtaagaaaaataacttttcttctattaactaaaaggtaggcctaatatttttccaggatttgtgtccacttatagtaatgtatacacacaattacaggaattaaagaacgcatacagagaaatgggagagtggagagttaattgtactaaaaaccaggaatgaaatagtcaccaaaaataaacactaaatttggcatcaatttagaaatcaagacaaaagataaaataatcctaaagtctgcaaattatttgtcaagggatggaatgtgttcctaggactaacttcaaggaaaaytatatgtgtatatttatacatatgtatatttggccccagttaaaacaccaagcagaatacaatgaatgaatgagagcaatggcttggctaggtgcttggcttttcagcctgccttgcgacatggtaccctgagatgacagtggggagagtgggtttctgcagtgtgttacaagtaaaacagggctgttctctaccaaaacatctctgttctgcagaatgtgctctttgtcaacattgtcacccataacaacaggtagaataaagtagagagttagtttgccatttggcaaccccccaagt

SEQ ID NO: 54230 - DNA, 601 bp, Human
gttaaaagagttgaattaaagacagggctggctgggtaaagtggcccatgtctgtaatcctcgtgctttggggaggccaaagtgggaggatcacttgaggccaagagttctagaccagcctgggcgatgtagcaagaccttgtctctacaaaataataataaaccaggcatggtagcatacacctatagtcccagttcctcagggggctgaagcaaaagatcacttgaggccaggagcccaaggttgcagtgagccgtgatggcaccactgcactccagcctgggccacagagcgggaccctctctaaaaaaaaaaaaacaaaaacaaaaacagggcatatgatttgaatgttaaaatattgaaacaatgtatcaaccaaactgacctactcaggaaatttatttttgcacactatctgtccataaactactaaataaaatcagtaataacatggaatatctttgtattagtccattttcacattgctataaagcactatctgagactgggtaatctatgaagaaaaaaggtttaactgactcacagttctgcatggctggggaggcctcaggaaacttacaatcatggcagagagcaaag

SEQ ID NO: 54231 - DNA, 601 bp, Human
acagggttaaaagagttgaattaaagacagggctggctgggtaaagtggcccatgtctgtaatcctcgtgctttggggaggccaaagtgggaggatcacttgaggccaagagttctagaccagcctgggcgatgtagcaagaccttgtctctacaaaataataataaaccaggcatggtagcatacacctatagtcccagttcctcagggggctgaagcaaaagatcacttgaggccaggagcccaaggttgcagtgagccgtgatggcaccactgcactccagcctgggccacagagcgrgaccgtctctaaaaaaaaaaaaacaaaaacaaaaacagggcatatgatttgaatgttaaaatattgaaacaatgtatcaaccaaactgacctactcaggaaatttatttttgcacactatctgtccataaactactaaataaaatcagtaataacatggaatatctttgtattagtccattttcacattgctataaagcactatctgagactgggtaatctatgaagaaaaaaggtttaactgactcacagttctgcatggctggggaggcctcaggaaacttacaatcatggcagagag

SEQ ID NO: 54232 - DNA, 601 bp, Human
caccagtgccccctggaagtcactcataggaaaaggccgtcttagagaatccagagcactgggcaaagagtgccaaatctacaggaagcctcatctttccacctccccagctctaggctctcccaggcaacctgatgcaggcatccagtaaggacaacacaagccctgcacagagataacacaaaaaacacctgaatcaccttgcctgcggacaattaattattggaaattgtaactgttggacttggggacatttgatactaaggaaagctagtttgaaaatatctctatggggcaaaacaaaaaaaaaacaaaaaaacccaccaactcctgcattgatatttgattatctctttattcttctgtgctgatgtgggattatacacacatgcacaatacatacacacacacacacacactcacacacacccctccccaagtggtatggtaagggaacccacctgaaatcaatcctattttccagaagtacctgtgccttagttcctcaatattgaaattggtatcatttcctcattaaaatatatgccattttcactgcaaatttatgttccaaaaatgggaggagggttggcatactgag

SEQ ID NO: 54233 - DNA, 601 bp, Human
acatttttagcaatcgacagagtaattttaaatcagttgaatgtgataactaataatattataaactaggacttgtattttacacttttatttttctcataattcatttttgttatattttgcaaaagtaactatccttaacactccagcctggtcaacagagtgaggctctgtctcaaaacaaacaaacaaacaaaaaaactagtgccaatatccaagagtctgtgagagaagacacgtatgaaggtcagctggccccagatcaagaggcagctggaaacatgtgaccacagtgaattcygcattgaatcttggcttcaggaactgctactttggctgatttaaagaccgtagtataatatgatctgatatatccctgttgtttcaagtatcgaactctaagattggataaataaggcccaatatgttgtctaaatagagatatctgtaagtcttcaggtgaacattaaaacctggatatacagtgtttgaggaagaaaaaaagtcaataacctaaaggctcgacaagagtaaatggctaagcaaagccatcaatatctgctagagcggctggcttagacaccaggtagatcgtgaaatg

SEQ ID NO: 54234 - DNA, 601 bp, Human
ccctccaccctagatccaagcaactcttggacagtatcctgtgctctctccagagctaatgtatggtctgttgcccatttacaaagagatgggtagaaattgagtgtaagcatttaggaacatttttagcaatcgacagagtaattttaaatcagttgaatgtgataactaataatattataaactaggacttgtattttacacttttatttttctcataattcatttttgttatattttgcaaaagtaactatccttaacactccagcctggtcaacagagtgaggctctgtctcaaaaaaaacaaacaaacaaaaaaactagtgccaatatccaagagtctgtgagagaagacacgtatgaaggtcagctggccccagatcaagaggcagctggaaacatgtgaccacagtgaattctgcattgaatcttggcttcaggaactgctactttggctgatttaaagaccgtagtataatatgatctgatatatccctgttgtttcaagtatcgaactctaagattggataaataaggcccaatatgttgtctaaatagagatatctgtaagtcttcaggtgaacattaaaacctggatata

SEQ ID NO: 54235 - DNA, 601 bp, Human
ccaccactgcactccactctagcctggccaacacaggaagactctgtcaaaaaaaaaaaaaaaaaaaaaaaaaaaaaaaacacacctggctggactttccttatatgcacatcaacataatcatcagtataagctgggccctcatgttattctgtaaaaggtgaatggtaacaataaacagggaagggtgtgttgggtgcaggggaaatgacctgttaggcaggtaaggccagattgagacttaactaggaaatgctcaaaggttgtcttccaggtctctgtaccttcacatggccttcarattccttcttcattctccctcacccagttcttcaggggctaaccccaccctccaccctagatccaagcaactcttggacagtatcctgtgctctctccagagctaatgtatggtctgttgcccatttacaaagagatgggtagaaattgagtgtaagcatttaggaacatttttagcaatcgacagagtaattttaaatcagttgaatgtgataactaataatattataaactaggacttgtattttacacttttatttttctcataattcatttttgttatattttgcaaaagtaacta

SEQ ID NO: 54236 - DNA, 601 bp, Human
cactgcactccagcctgagtaacaaagcaagacttcatctcaaaaaaaaaaaaaaagaaagaacagtggactaagtaaggaagatctgcccttagccaatgttggcaggcaccgtccaattggctgagtgcccagatagaacgaaatggcagaggaagagaattctctctctcggagctggaacacccattttctcctgcccttggacatcagaactccaggttctccagcctccagaccctgggactcacaccagtggcctcccagtttctcaggccttcaatctcaaactgagggttayaccaccagctccctagttctcaggtctttccatttacactgagccatgctactggcttccctggttcactagcatgcagacgcatatcatgtgacttctcagccttcataattgttcaagtcagttttcataataaatcccctctcatttatctgcctacctacctatccatcctattggttctgtttctctggagaaacctaacacacccatccctgctttgcaacctggaaactggctccaggcagtaaactggacaatcaaagggctctcctcgtttgtgtccctcctcctggggat

SEQ ID NO: 54237 - DNA, 601 bp, Human
tattggacttacagttccacatggctggggaagcctcacaatcatggcagaaggtgaaaggcacatctcatgtggcggcagacaagagaagagggcttgtgcagggaaactcccatttttatataaccatcaaatctcgtgagatttattcactatcatgagaacagcacagtaaagacctgctcccatgattcaatcatctcccaccaggtccctcccacaacatgtgggaattatgggcactacaagatgagatttgggtggggacacagagccaaaccatatcacttggtattattcmttcctcaaatgcatggtagaattctcccagaattccagatggtggtggggccaccagttggtggagcagtcagaacacacaaatttataggttaagtttgccagcttatatgggcatagtttgtggcaccccaaaacaattacaatagtaacatcaaaaatcactgattacagatcactgtaatagatataatgaaaaagttagaaatattgcaaagtgttatcaaaatttgacacagacataaagtgagcacatgctgttggaaaaaatggtactaacagacttgttcaatgcagcatt

SEQ ID NO: 54238 - DNA, 601 bp, Human
taatcctagcactttgggaggccaaggcgggtggatcacctgaggtcagcagtttgagaccatcctggccaacatggtgaaacctcatctctactaaaaacacaaaaattagctaggcatggtggcaggcacctataatcccagctactcaggaggttgagacagaattgattgaacccagcaggcagaggttgcggtgagccctgagatagcaccaatgcactccagcctgggcggagagtgagactgtctcaaaaaaaaaaaacaaaaaaaacaaaacaaacaaacaaacaaaaaaaatatatatatatatataaaatcatatggtttttcattattattctgttaatatgaattttgattgattttcaaatgttaaagaaaccttgtattcccaaaaattctgcttgttcatgatgtgctattcttttaatacagttttggattctagttaccaaaaaaaaaaaaatttagagaacttttgcttatacatgcatgagggaaattggtctgttgtcttcttttcttctagtgtgttagtctgagtgttctatcagagtaatgctggcctcacagaatgaattggaaaacattccatgct

SEQ ID NO: 54239 - DNA, 601 bp, Human
cacacctgtaatcctagcactttgggaggccaaggcgggtggatcacctgaggtcagcagtttgagaccatcctggccaacatggtgaaacctcatctctactaaaaacacaaaaattagctaggcatggtggcaggcacctataatcccagctactcaggaggttgagacagaattgattgaacccagcaggcagaggttgcggtgagccctgagatagcaccaatgcactccagcctgggcggagagtgagactgtctcaaaaaaaaaaaacaaaaaaaacaaaacaaacaaacaaacaaaaaaaatatatatatatatataaaatcatatggtttttcattattattctgttaatatgaattttgattgattttcaaatgttaaagaaaccttgtattcccaaaaattctgcttgttcatgatgtgctattcttttaatacagttttggattctagttaccaaaaaaaaaaaaatttagagaacttttgcttatacatgcatgagggaaattggtctgttgtcttcttttcttctagtgtgttagtctgagtgttctatcagagtaatgctggcctcacagaatgaattggaaaacat

SEQ ID NO: 54240 - DNA, 601 bp, Human
ttcagtattccataaattacatgaaatgttcattactgtattataaaataggctttatattagatgattttgcccaactgcagggtaatgtaagtattctgaacacatttaagataggctaggctggccgggcgcggtggctcacgcttgtaatcccagcactttgggaggccgaggcgggcggatcacgagatcaggagatcgagaccatcctggctaacacggtgaaaccccgtctctactaaaaatacaaaaaaaattagccgggcgtgatggtgggcgcctgtagtcccagctactsgggaggctgaggcaggagaatggcgtgaaccctggaggcggagcttgcagtgagccgagattgcgccactgcactcccgcctgggccacagagcgagactccgtctcaaaaaaaaaaaaaaaaaaaaaaaaagataggctaggctaagctatgatgttcagtaggttaggtgtgttaagtatatttttgactagcaatattttcaacttaagatgggttttttgggaaatcaccccatcataaattgaggaacatctgtagttgtatagattatttctggactctctgttccattgatct

SEQ ID NO: 54241 - DNA, 601 bp, Human
cacatacacaggaaaacaggagaccaaactatgcaggagaccatcgtcagacagcccaatgcttatctagcctggcaaggccatctagcagcaaccaaatgcagcgcttggaaactctgctatcctaacatggaatagagaagttcgcagccttttgacttaagagacctacccccatttctcctctcctgacccttatcctccagggcctccaccctgtgatttggttccccgcttggtggtatttcttttccatttagcctacaaactttgctctcttaatctttttgttttgctttcmttacattgtttacagattcatccaggtatacctgacatgcaataacctgcacatattttgcgtgtacgatttgatgtactttgacatacatatacatggtggagccatcaccacaaccaagataatgaacacactcagctgcaagtttttgcattcagtagaaactgtacttccagtacacatacaaccattgtgttttttcgtttttcagtacagtaactttcagtattccataaattacatgaaatgttcattactgtattataaaataggctttatattagatgattttgcccaact

SEQ ID NO: 54242 - DNA, 601 bp, Human
ttatcagctgggaacagctgtgtgctcctctcaccagcccacctggtgacattctgagcagcacagtggtgggggacagccacctctccttcaagatttgccacgtctgatttgttcaaaggatgaaaacataagctttccttgactgaaggcaaataaatgagaaaaatctaatgtgctaatagaagtcccagaatactgaccaaagggaagaagtcctggctttggggagccgtatgtggcgtttgcttgtttgctttgaggaaaggaacctctggccatgacccacgccctctgtcaycacctcctgcccccagcacatgagggcagatgggactcaaaaggtgccatggtgtgaggctgcaggctgctgttcaactgtgctttgccccagtgttcttggtcaacagaaaaggacccccgcatctttcctcatcagcatccatctatgtctttgtcttctccacccacccactccatgggaactctccctataaactcagagggaactagggtttaagccagtgtctcttaataattttcttaatgtaaaataggatttcctggcttaacccctctatttctttcatttaatgaaaag

SEQ ID NO: 54243 - DNA, 601 bp, Human
taaagggcaactcaaaatttctgccactctgttcatgacctcaaaaacaccacaaatattgattttggggttacaaataaattttagcaagcagataaattcacaatgaaggaatctacaaacacaggatctgttctgcaaatggctatgtgctgagcaatcattaaaggggaaaggcagaggtcttcatctcacttaagattctcgaggtgtatattgtccttctccacagcctctagacttgcctcctcagtgaccagttaattaccttccaccctcccctcccctcctccagctccarggcaaggctaccctcatcgtgggtgacaccaagcactgagcatcattgtaccaacagtagccaccactgcacaccctcttcatcagcacacacaattacgtttcctgatcagaaacatgccctacctacagccctgccttcctaaatctgctgggtccaccacttctcttaagtcttatccttaatttcctgatgccaccgaaagaacaactcttagggaagcatttgtgcacttcttcgcatcaccagctcgaggggccatctaggggagcgggtcttagcctctccacaaaaagtggc

SEQ ID NO: 54244 - DNA, 601 bp, Human
ctttctaaagatgccttatgtgataaataccattgactcattaacattgaactcatggccagcagcactataactcacacccgagcaaagcttaacacatactttctccataaggcacatcacagctttttcacaccgaggaacactagacaggtcttcagcaccacaccaggggggcattttaaacagtgaagtcaccaaaagcacaaaaatgtaaaaccatggcactaagtagaccaagtaaaggacacttgttgacagtatgagagcagctgcttgttccatctcagctgggactgtrcataaagggcaactcaaaatttctgccactctgttcatgacctcaaaaacaccacaaatattgattttggggttacaaataaattttagcaagcagataaattcacaatgaaggaatctacaaacacaggatctgttctgcaaatggctatgtgctgagcaatcattaaaggggaaaggcagaggtcttcatctcacttaagattctcgaggtgtatattgtccttctccacagcctctagacttgcctcctcagtgaccagttaattaccttccaccctcccctcccctcctccagctc

SEQ ID NO: 54245 - DNA, 601 bp, Human
gcagttatcgaatcactctctaataacaattagactattattcagtggaaaagaaccagatttcatcgtggctgcataaaaagcaaatacaggtcttatattattttttaaaaaatttttaaatcattattttaaaatcaaagaaaaagactgcatccaaaacgcgtctagttaatattcataaaagctctctgcaaagctgcataaagtcctcctcaaaattccaggataaaattcccatctgttacaagagaaatgacaacgtggagaaccagtaacacaagaaggaagaaaactaccmctcattttgttttcttaaacctatcactggggataaaaaccactcagattccttgatactgactttcagctggaagatttagaaaagagaagcacaggagacatttttatttacatatttaagcaaaaagggaggcgagaagaaaatcagagtgtagagaaaagcatgaaagaaattaagaaggtgaagccatgaaaagagagaaaagggctgggcaagaacccaaaaaccaaagacataagaaggggtggaggaggaaagattgactttaggatggttttggaaaaagtgacagagaaa

SEQ ID NO: 54246 - DNA, 601 bp, Human
aaaattgtgtgttttcacacagcagttatcgaatcactctctaataacaattagactattattcagtggaaaagaaccagatttcatcgtggctgcataaaaagcaaatacaggtcttatattattttttaaaaaatttttaaatcattattttaaaatcaaagaaaaagactgcatccaaaacgcgtctagttaatattcataaaagctctctgcaaagctgcataaagtcctcctcaaaattccaggataaaattcccatctgttacaagagaaatgacaacgtggagaaccagtaacmcaagaaggaagaaaactacccctcattttgttttcttaaacctatcactggggataaaaaccactcagattccttgatactgactttcagctggaagatttagaaaagagaagcacaggagacatttttatttacatatttaagcaaaaagggaggcgagaagaaaatcagagtgtagagaaaagcatgaaagaaattaagaaggtgaagccatgaaaagagagaaaagggctgggcaagaacccaaaaaccaaagacataagaaggggtggaggaggaaagattgactttaggatggtt

SEQ ID NO: 54247 - DNA, 601 bp, Human
tgaaaattgtgtgttttcacacagcagttatcgaatcactctctaataacaattagactattattcagtggaaaagaaccagatttcatcgtggctgcataaaaagcaaatacaggtcttatattattttttaaaaaatttttaaatcattattttaaaatcaaagaaaaagactgcatccaaaacgcgtctagttaatattcataaaagctctctgcaaagctgcataaagtcctcctcaaaattccaggataaaattcccatctgttacaagagaaatgacaacgtggagaaccagtarcacaagaaggaagaaaactacccctcattttgttttcttaaacctatcactggggataaaaaccactcagattccttgatactgactttcagctggaagatttagaaaagagaagcacaggagacatttttatttacatatttaagcaaaaagggaggcgagaagaaaatcagagtgtagagaaaagcatgaaagaaattaagaaggtgaagccatgaaaagagagaaaagggctgggcaagaacccaaaaaccaaagacataagaaggggtggaggaggaaagattgactttaggatgg

SEQ ID NO: 54248 - DNA, 601 bp, Human
aaacaaaggttatttgcaaaggaattatctttaaaattaatatcaatgcattcatcttagtattgtcattaaaattttaaaaatgacaatgttagagttccaagggaccttacagattttctagatcaagcttcttattttaaaagatgagaaaactgtagactagaaagtctaaatgaaaagaccaaagagctagctcagccagagacttcagcatgggagcttcctaacttccagtacttccttctttctaacatactgtgctgcttcatgtggttctaacttctctgccttggatgaragtactggttgcctcttatgctattctgaggcatagttgtcatttgtaactttcccataaaattcgaattttccaacctgttttctgaatgaattacacaactgaacatgttaatcctcagctttccaaatttcaaagcaataaatacagaattcaaaaaatacttgattcaaacgtgcaatatatataatcaaactgcaaagaaaaatcctcctttcctggataattcaggctacaaattcgaaaaaaaaaaaaccatttagtgagcacctatcacatgctgagactatgttaagtgct

SEQ ID NO: 54249 - DNA, 601 bp, Human
ctaaagttttactaagctaaagagaaagacgcagttatatagttaccacttactaacaaacaaggagcatacataattttttctataaataattttctttgtagctaaactcagcagaaatttatgttaatgcatgtgtgaaaaacattctgtgacacatttaacaatattaactattattctgccagagatatcaaaacaaattccaaaggcagtttcccaattaggcctctgtataaaaacagaaagcataaaaataaactacaatttaagggaatcatttctgcaaaaactgagatawtataggccaaacagcaataattttgctttgtcaaaggctaatgaaacaaaagaaataacttaaacaatctagatagacacttaacatagctatgagaccaaagcaggccacactggcaatgtattagagtcacctgcgatgaagtgttagcctagattgtttaaaattaagctttctaactagtgtctataatgtatctattacatactgttgattaaggagagtgccacaaacaggtatgatgattaatgaaataaaagatacatagaatttagcagggaaacttccatacagtagaca

SEQ ID NO: 54250 - DNA, 601 bp, Human
agcctactcttattatcacatctgacctacagtattattttacctatatcttataaagtcatacttatatcaagaatcagagcacacccaacaaaagtaaaattacagaatataactagattatcaggatgctaaagtgaagttttccacaactccctctctctttctgtggggatagatatacatgaagaatggccaacagcaagatatacaagagttgctgaacagtttactgaagtatggcaatattaagcaggactcaccaaagacaactattgttttttttgtttttgtttgagayggagtctcactctattgcccactctggagtgcagtggtgcgttcttggctcactgcaaccttggcctcccaggttcaagtaattctggtacctcagcctcccaagtagttagggttacaggtgcgtgccaccacgcccagctgacgattacttttttttttttttttttaaagatgcaggatgacataactatagctggttaggaaactactacctggatatcatatgaagaatgaaattgcccttttgtgggcaaaagcatcagatctatgatgacctagaaggcataactggagacaa

SEQ ID NO: 54251 - DNA, 601 bp, Human
actagatatcttaccatttgattatgcacaatacaaactaatcaaagaaacccactaaagcagtgcattttataatagtgtataaactgaaaaatggaaaaccagactaagatggcagattattaccaatataatgtcaaattctgctgtgtaactcattacagttctgagactcaagcctactcttattatcacatctgacctacagtattattttacctatatcttataaagtcatacttatatcaagaatcagagcacacccaacaaaagtaaaattacagaatataactagattatyaggatgctaaagtgaagttttccacaactccctctctctttctgtggggatagatatacatgaagaatggccaacagcaagatatacaagagttgctgaacagtttactgaagtatggcaatattaagcaggactcaccaaagacaactattgttttttttgtttttgtttgagatggagtctcactctattgcccactctggagtgcagtggtgcgttcttggctcactgcaaccttggcctcccaggttcaagtaattctggtacctcagcctcccaagtagttagggttacaggtgc

SEQ ID NO: 54252 - DNA, 601 bp, Human
aataatctgggataaacaagtatggtacccagaataactaaagcctgaggttatatgaaggatgacaagaacacacattaattaaaacgactaacaacacaagttagagcaaaaggggcaaaagtaatcaagagtagcagatggataaataggtagttgaagaggacataataacctcattgtgtgtaggactgggcacagaacagtaaaatcagctcaagatgtccagtctcccataaaaataacttcagcttagacctgaaattgcaagtgttcaggccaaattcaacagaaggaatcytttttaatcctttgaatgggaacaacaaacaagaccagtggtgaacattccgtcaacattcttttatttagatgttcactcagcacctattcggcactagatatcttaccatttgattatgcacaatacaaactaatcaaagaaacccactaaagcagtgcattttataatagtgtataaactgaaaaatggaaaaccagactaagatggcagattattaccaatataatgtcaaattctgctgtgtaactcattacagttctgagactcaagcctactcttattatcacatctgaccta

SEQ ID NO: 54253 - DNA, 601 bp, Human
actagatcttcaggcatgtgtgttctttagagcacacagaccctgaagtcaaatggacttgaattcacatgtcaaggtaccctctctaatcttccgttttcttctctgtaaaatggaaacattaacactctctactttatacagttatgaggattatatgagaaaatgcatagaagaaatgtagcaccatgcccagcatagtaagcatgcaataaatgttgtgctatttatattattgttgtgtttaatattaacattattattactataactgtctaccactaggaaagcaaggcttgtyttcagtgttgctattttgaggcaatgcctttggttatgataaaagaatgttgttatctaatattggtaacagagaacagagaacaaaattttatttttgaactttgctgggcttcttggctcgctcaagaatattaaggcttgtaatcaccagcccatcatcagccagttattttcccttttgctaatgcataacctccagacaaggcctcctccctacctcagcaactgctcatttgctgctatcagtaaaagcaattctgccgagaagagaaatggatatgtttctgacttaatgtct

SEQ ID NO: 54254 - DNA, 601 bp, Human
actgtaaataaacacaaaggaacttaggggaattcagaaatttaaggaaccctaaaatattctaaatcattgtgcaaagcctgcagggcagggagtggtggggaggaggctttggcaattacttgcttcatactttacatgatcttcaaaatgtaaaactgttcttttgaatgaaatgatactaccgatactaccctcttaatcatcaggtaatgaatgaaatgatactatcctcttaatctcaggcaaagaaaaaaaaacatcctattttctgtcagaaggcaaacaaaattcaaaggtgaaattctctccaaatacaaactctcacttggtgaatgtatactgtatctttatccttctccagcaaaatagcaggtcaaggaaactcatgtccttatcactaccacccaatcaacctgccctgggactgccctctaactacaaagctttggtctgcacctggggcactagatcttcaggcatgtgtgttctttagagcacacagaccctgaagtcaaatggacttgaattcacatgtcaaggtaccctctctaatcttccgttttcttctctgtaaaatggaaacattaacactctctac

SEQ ID NO: 54255 - DNA, 601 bp, Human
aatagctctatgacctcagaggaaaaccacaacctttcctggccctctaacatttattgtgctttggggtaaattattagagttctctagatctatttccacatctgaaaacttttggaactagactagcatccaacagcatttggatgggtggttcttcaactgttaaatgccgattcctaacgtcacctcaatgattcagaatgtccacgctgaaacctaggaagttaaatgttcaccaagttcacagttgactgaaatacataggtggtcctcagccacagttgaaaaacactaattrgttgatctctaatccctctaagagtgtgaaaagatgatataattcatttcagcaccaagcttttaggaattcagaatctagcacagtgtgtaaggcacagtagatgttaaacaattatttgcagaaagaaaggaagggaaagaggaggggaaaaaaagaaagaatagagaaagagggggaaggaaggcggctaactaactggtcatatttttggctaagaaacatacaaaacagtagtaaaattacacttgaataacatacacaacacacatcaatagctggaaagcaaagaccttagta

SEQ ID NO: 54256 - DNA, 601 bp, Human
acatacacagcatgtttgcccaagaacattaaagcatgccttctatattctgattgtgaacaagcttttctaggaacgcaaattttgctctcaatacttaacacaatgcactatagtatcataagcactgttcatgctctattagtcattctgttgaagattttatttaaaaaaaataataaaaggcctgcagtgtgtataaaacatttgagacacaaaagacttattgtcagaatatttgcaggatcctcaaaacagaaaaacaacccccccaaaacaaattaatttataatttttaatwatgtttaaaaatgctgtgccagaaccctgcattaaacttagccaattcataagataaaaacgattatataaatgatcatcatggcatctgattgacagaaataagagacaacatgttgtattcttccgagaaacaaaggagatttgagctctgggacagccttccaactggtgcatgttggcacttagtttggaaaatcccaaggttctaaggtacatgtgaccctggacacagttatcaatttatttccaggtctattaattacatttcccaaaatataacacaggcatatgatttcat

SEQ ID NO: 54257 - DNA, 601 bp, Human
tcaatcacagcaacacctgaaggtacttcacagcaatgaacagaatctaatatttataatttaacaaaaatattttttataaaattgaaaaagtatttctgaaaattaaagatgcagatgaacaaacatataaagagtatatacactttagagtatatactctaaagtgaaaacaacctggaaacttcaagtcatctatcttttcatatatcctagtaaacaaatgcctctagaagatttaggagaggctgcatttctactgaccatagtcattacaataagatctaaaccacttgccttwaactgtttcactcttgctgccaattcaatttttcttcaatattccgtaaaaagaaaaggttctttttaaaaagtgattttcttgtaagtaatgtcctgagcacatacacagcatgtttgcccaagaacattaaagcatgccttctatattctgattgtgaacaagcttttctaggaacgcaaattttgctctcaatacttaacacaatgcactatagtatcataagcactgttcatgctctattagtcattctgttgaagattttatttaaaaaaaataataaaaggcctgcagtgtgta

SEQ ID NO: 54258 - DNA, 601 bp, Human
cctgctgggctgcattcccaggagattaaggcattctaaatcacaggatgagataagaggtcggcacaagacaggggtcttaaagaccttgctgataaaacagcatgcggtaaagaagccagccaaatcccaccaaaaccaagatagtgacggaggtgacctttggttgtccttactgctacactccctcaagtaccatggcaatcatgaataatccaccccttgtttagtatataatcaagaaataaccataaaaatgggcaagccacagcccttggggctgctctgcctatggagtagstagctattctttattcctttacttaataaacttgctttcactttactctatggactcaccccgaattctttcttgagcaagatctaagaaccctctcttggggtctggatcaggacccctttccggtaatatatatgcagtgcttccaattcctcacttctcattctttcctaaatccacttcagtcaggcctttgcctccaccacaccaacaaaaatgcttttgtcaaggtcatcaataatctccactttgctaaacctgttaatacttcctcctcatctatcagcagcatttaacata

SEQ ID NO: 54259 - DNA, 601 bp, Human
cttgaataggggctgggtaaaataaggctgaaacctgctgggctgcattcccaggagattaaggcattctaaatcacaggatgagataagaggtcggcacaagacaggggtcttaaagaccttgctgataaaacagcatgcggtaaagaagccagccaaatcccaccaaaaccaagatagtgacggaggtgacctttggttgtccttactgctacactccctcaagtaccatggcaatcatgaataatccaccccttgtttagtatataatcaagaaataaccataaaaatgggcaagccrcagcccttggggctgctctgcctatggagtaggtagctattctttattcctttacttaataaacttgctttcactttactctatggactcaccccgaattctttcttgagcaagatctaagaaccctctcttggggtctggatcaggacccctttccggtaatatatatgcagtgcttccaattcctcacttctcattctttcctaaatccacttcagtcaggcctttgcctccaccacaccaacaaaaatgcttttgtcaaggtcatcaataatctccactttgctaaacctgttaata

SEQ ID NO: 54260 - DNA, 601 bp, Human
aaaatacaaaaaaattagccaggcgtggtggcacacgactgtagtcccagctactcaggaggctgaggcaggagaatcacttgaacccgggaggtggaggttgcagtgggccaagatcactgcacttgatcttgccaagaccactgtactccagcctgggtgacagagcaagagtccatcttaaaaaaacaaaaaacaaacaaacaaaatccctcattaaactctatctcctcttgtttacacaagaaaatctctccagcaattctctcctccagttactgcatcataaaattttccctcwctactcaatctcgctaatcagcatagaaacaaagtattatttctctcatcttaatccctccaaatagtgcttcatttctctgagcttctttatagcaaaattcactgaaagagatgtctatatgtcagaggtgtttgaaccagagcaactccatcttgaataggggctgggtaaaataaggctgaaacctgctgggctgcattcccaggagattaaggcattctaaatcacaggatgagataagaggtcggcacaagacaggggtcttaaagaccttgctgataaaacagcatgcggtaa

SEQ ID NO: 54261 - DNA, 601 bp, Human
gcattaccaattaactgcaatcactccctaatttaaatttcaaacactctactgtctgaccatcagctctttttctctagtacccccaaccaacacttcgaattgttcaatttcaccaaaacctccactgttcctactacactccagagtacctatttcatgttctcacttctcgcttttcccagcttttaaaactccatgcctgttattacagtcgttcccttgcccttgcttacttcatagtacttacttgtcaacacggaaagctgcttaaagccaactttctgactattccagaccrtacccacacagttgaacgagttgacagaaaaaaaacaccaccacagagcgtggactcattttgaattcatggccgcttacctcaactagacccttaatactgcctagatattacacaacatttctctagttcatacactctctcattctgctagattactatttcatattttctttgctttcttcaccctgtatcatcctctccaccctgaatttcctagatgctctaacttcctgtttcactcaaaaatacagaaccaaacacagattttccacaagctctccaactataacctgtgtg

SEQ ID NO: 54262 - DNA, 601 bp, Human
tcaatgatcatatcctccggactggcattaccaattaactgcaatcactccctaatttaaatttcaaacactctactgtctgaccatcagctctttttctctagtacccccaaccaacacttcgaattgttcaatttcaccaaaacctccactgttcctactacactccagagtacctatttcatgttctcacttctcgcttttcccagcttttaaaactccatgcctgttattacagtcgttcccttgcccttgcttacttcatagtacttacttgtcaacacggaaagctgcttaaagycaactttctgactattccagaccatacccacacagttgaacgagttgacagaaaaaaaacaccaccacagagcgtggactcattttgaattcatggccgcttacctcaactagacccttaatactgcctagatattacacaacatttctctagttcatacactctctcattctgctagattactatttcatattttctttgctttcttcaccctgtatcatcctctccaccctgaatttcctagatgctctaacttcctgtttcactcaaaaatacagaaccaaacacagattttccaca

SEQ ID NO: 54263 - DNA, 601 bp, Human
ctttggaaggccaaggagggtggatcacttcagcccaggagttcaaaaccagcctgggcaacatggtgaaactccctctctactaaaaatacaaaaattagccaggagtggtggcacatgcctgtagtcccagctactcgggaggctgaagcatgagaatcatttgaacctggcaggtagaggttgcagtgagctgagatcataccactgcactccagcctgggcaacagagcaagactctcaccaaaaaaaaaaaagaaagaaagaaagaaaccaaatggctctttagagcccaagtatraagtaaataaatctaagagagagaaaataacaaatccaggtactgcaacttatactttgcagtctcagattcaaagaatcagtctttctagcaaaagtgtggtaaacagcctttaattattaacttctcttcagacacacataaacataggtagatattatgatccacagtgttatagtttaataagcactaatgtatatttctgtataaccagtctacaaagggttttactctccaggcaaatattgaactggaggggtacagtgtgggaatacatcatagtactgttcttgtgattac

SEQ ID NO: 54264 - DNA, 601 bp, Human
gatactacaaatagttgaataagggtgaatggataaaagagcagatgaggatggaaagagaagttctttgtaccttgtaccttcccaccacatcaaacaaccctgcctgaagtatctacttcttccattataagtaatcactctacagttacttttactttcttaaattcctatagaactttttttttttttttctgagacagagtttcactcttgtcacccaggctggagtgcaatggtgcgatctccggtcactgcaacctccgcctcccaggttcaagcgattctcctgtctcagackcctgagtagctgggattacaggcacctgcccccatacctggctaatttttgtatttttgtagagacgaggtttcaccatgttggccaggctggtcttgaactcctgacctcaactgatgtgcccgcttcggcctcccaaagtgctgggattacaggtgtgagccactgcgcctggccaaactttcgatacctgatcacgcttttattgtttattttgtctcaccaactagtgccccaagaacaaaaattatgtcttttttggggggggaggggggcgggggagaaatgaggtctcactat

SEQ ID NO: 54265 - DNA, 601 bp, Human
atgatattcaaactgagtctcaaaagataggagattatcagaccaacaaacaaggaaatttcaagaacaaacaaaaggcaatgcaaaggtatagaagtatcaaagtctacagaacatctcagatactacaaatagttgaataagggtgaatggataaaagagcagatgaggatggaaagagaagttctttgtaccttgtaccttcccaccacatcaaacaaccctgcctgaagtatctacttcttccattataagtaatcactctacagttacttttactttcttaaattcctatagaactttttttttttttttctgagacagagtttcactcttgtcacccaggctggagtgcaatggtgcgatctccggtcactgcaacctccgcctcccaggttcaagcgattctcctgtctcagactcctgagtagctgggattacaggcacctgcccccatacctggctaatttttgtatttttgtagagacgaggtttcaccatgttggccaggctggtcttgaactcctgacctcaactgatgtgcccgcttcggcctcccaaagtgctgggattacaggtgtgagccactgcgcctggccaa

SEQ ID NO: 54266 - DNA, 601 bp, Human
cacacaaacaccccacatacatacaaatatctatgggagaaaagaaaaggaagcagccaattctggccagaaagttcagggaagacttctcagaggagatgatattcaaactgagtctcaaaagataggagattatcagaccaacaaacaaggaaatttcaagaacaaacaaaaggcaatgcaaaggtatagaagtatcaaagtctacagaacatctcagatactacaaatagttgaataagggtgaatggataaaagagcagatgaggatggaaagagaagttctttgtaccttgtaccytcccaccacatcaaacaaccctgcctgaagtatctacttcttccattataagtaatcactctacagttacttttactttcttaaattcctatagaactttttttttttttttctgagacagagtttcactcttgtcacccaggctggagtgcaatggtgcgatctccggtcactgcaacctccgcctcccaggttcaagcgattctcctgtctcagactcctgagtagctgggattacaggcacctgcccccatacctggctaatttttgtatttttgtagagacgaggtttcaccatgt

SEQ ID NO: 54267 - DNA, 601 bp, Human
cttgttgaattctgttttgacaatgaaatggatgaaaaagatataagtatcctcaacttatgctcaacagcaaatgacttccttaaggaaaacaatgttttagctaaaattgtgtaagtgtaaccagtgagaaagcagccacatgtttggaataaaaagattctgacatactgtccatcaggtgaggatacaagaagacataccctcatcagataatggatttgccagcaccttgatcttggacttcccagcttccagaaccatgagaaataaatgtttattgtttcgtgttttttggagaaaaaaaaaacgattatgaagtaaagttaaagggttagcactacacatataattcattttctcaatcattcatagacaagcagttatagaaaagtagataaatccagaaatgtacagagtgctacaggatatcactaatgtggttaatttcatagaaacgagacctttaataaatagaggaatacttacaaactataatgagatgtgtaggaactatcacacagtgtttaagtgacttagctcccgaactggactgcatgggctggaacaccggcaatagaatttattagctatgagatct

SEQ ID NO: 54268 - DNA, 601 bp, Human
tcattctttctcccactgatttgttatacatctgtcatatacagagttcctacaaacatcagtctgtttctaaacttgactgatttattcctattctgatttactttagcttatgcctgattgggtgaatctccccactttatttttcctctgggttaatcttgaccttttacccttgcatataaattttagagtcagctaaaattttgccaagttctgcaaaacaaacttttgaatttttttggaattatattcaattaacagatatatttgaaaatattttacacctccagactattgatttacccatccatttatttagatatccttttagcttctttaataaagttttataactttcttcataaagttcttctatatctcgttttaacttattcctaagtaaggtacttttgttgctgttgtaactgggatcttctttaaatcacattttctaaacatttttgctaaggtacaaaagcatgatctttttatgttatcttgtatccggcaacagtggtaagctatacaattagttctggtagtttgtatatagattttctcagatttcccatacagacaatcctctataaataatgaa

SEQ ID NO: 54269 - DNA, 601 bp, Human
attcatctttaccactcagcagagttttaaagtttcttcacatattttctgcatatttaagtttattcctagatattttacatttttagttattatagaatttttctcttatattttataagtatttttataatagaaagctataattcttatatataaattttgccttttagtgtgccttgtaattttttcttggaagtcagacatgtaaaaggtactaggtaaaaagaactgaggtaaacaggcctttggtgatgtggtgaagcaagagagaaactgtaagatactcaatacattactygtgtgttttaggaggagcttgtattttctcaactgcatatatgtctataatcaatatatagtatgttttgtttattgaaatttacttagctagatagataccattctgtcatagaatataccacaatttattaatgatcaaatgatgtacatttatcacgtacacaaataatgtacaattaagatctttattccagtctcctggaataaatgtgggactttctacattagtaaaactggaactgctaagaagaatgagcatttgtagatattgctatatttctctctactgtggctgttt

SEQ ID NO: 54270 - DNA, 601 bp, Human
taatagattatatgccaaaaacaagaaagacagaagataggtgaatagatataatattatctaaatttctttcatttcacctcataccaaggagaatgagcccagtttatgtactgtttttagaagatcattattcattcagtgctcttaacacccttgaaagataagtagtattcatatgcccatttataaatggggtcattgacccttatagaagttaaggaacttttccaaggtgacatatatctcccaacagtggctggaattgaacagatgtctgattacactaagaccatgatcrtaacatgataacatcccaagcaagcaagggatatgaaggaccagaggctgagaaagagatcagaaccagaggtaaaaatgtgggagtcatccaaaaagagatgacagctgaaaccacgaagaagaaagagaatgtggaagaaagagagtggggaaagcaagggatgaagaaaactttagcattaccccacttataagagaaggaacagcaaagtacacataggaggggagggcagatgagaaatgaaccacatattgtcaccagatttgaaacctggaatcatcatctttgactcctctc

SEQ ID NO: 54271 - DNA, 601 bp, Human
attcagtaataaaaagaaattagctatcaagccatggaaagacttgaggaatcttaaaaggatattactaagtgaaagaagccactctgaaaagaccgcacactagatgattctaactacatgacattctggaaaaggcaaaaatgtggacacagaaaaagattagtgattgcctggtgttcagggagaggggaaaatgaaagaggtgacgcaaaggggatttttagggcactaaaactattctacatgatacagtaacaatgaatatatgccaccataccttcgtcaaaacccgcagaaygtacaccacaaagtatgaaccctaatgcaaactatgtattttagtattaatataaaaatgtatcagtatcgtttcatcagttgcaacaaatgcaccacacaaggtacagtcaacgtaataaatatcaattccttcacttttctgcaaaaacttctacaaaaaatcctgtatctctaaagggtaacatattattctatacatcagctaagtcataatttaatgcttccttgactctcatatttaatctatttctacattttgtcctgtctcatcctttcattccccacaccaatatagccc

SEQ ID NO: 54272 - DNA, 601 bp, Human
taatctacgaaagaaatagaatcctggattagtctatggtaatagaaataaagaggaatatgatacattggaaaagtgatcaaatctgaccctaggcttataaaacaaatagaagcaattatatgaataatacttgatgatttttacttgagaggaattgcatctcagatatgtcagcaatgggagaagagagaaagcagattcaatgaataaatgaagtgaggtcaaaacaagagaggcaactcaaaaacaccaggaacctatcttcttttttttttttaaggttctttttttctttttytttttttttttattatactttaagtttcagggtacatgtgcacaatgtgcaggtttgttacatatgtatacatgtgccatgttagtgtgttgcacccattaactcgtcatttaacattaggtatatctcctaatgctatccctccccccttcccccaccccacaacaggccctggtgtgtgatgctccccttcctgtgtccatgtgttctcattgtccaattcccacctatgagtgagaacatgcggtgtttggtgttttgtccttgtgatagtttcctgagaatgatggtttccagctt

SEQ ID NO: 54273 - DNA, 601 bp, Human
tacaggtgtatgcatttttctaaactcatagaatgtacacttaagatttctgtatttcaatagatataaattttatatcaaaagaaaaattacatatatttatttgcatgctgacatatttagttggaaaactactaatgtctgcaatttactttgaaatgcatcaaaaagtaagccagataaatagatggatagagggacacacagatgatggatgtcagataaaaacaaggaagtagggtaaaacgttaatggaaaaattctgatggtggatacagcagggtcctttgtaaactttatkttgtgttcagaaatttttataataaaatactggggagaagttaaggactttaaacttgaccagtcatgtaaaaaaaaacaaaacactgcaggcctttgataggggcagatggcatggtcaaggagggcaaagaaatgaaaaggaagaagatgaaatgatgataatctacgaaagaaatagaatcctggattagtctatggtaatagaaataaagaggaatatgatacattggaaaagtgatcaaatctgaccctaggcttataaaacaaatagaagcaattatatgaataatacttgatg

SEQ ID NO: 54274 - DNA, 601 bp, Human
agaaatactttttagaaaaaaaaaaagaaaaagaaaaaaatatcttaaactgtgattcagctaaaaagggaaaatcaaaattaaaatatacaagggatttgtggtgtactgcaaaaccttatgtttcatatcctaagaacccctaaaaaaactccacattcactaccaccatactacgctctgagtcttagtttcaccattcatgttattaacatgatattaatacccaccttaaaagttagcaactatgaaatcaagataactgcaccataaagagatttgcaaaacaccatgaaaatgaaaaaaaaaaaaatacagacagtccctgacttacagtggttcaacttatggtattttcaacttacaatgggtttatctggatgtaaccccatcataggtcgaggagcatctgtacttattattcacgtaatagaagcatcaacagaagttttcaccgccttttaccaaaatggcctattgacatggtgcttttttctctgctctagagattccctatatgacacactttctctaatactcatcaaagggattaatatttgagaaagcatgtcatatagggaaccataaatcaatctctccc

SEQ ID NO: 54275 - DNA, 601 bp, Human; identical to SEQ ID NO: 38041

SEQ ID NO: 54276 - DNA, 601 bp, Human; identical to SEQ ID NO: 38042

SEQ ID NO: 54277 - DNA, 601 bp, Human; identical to SEQ ID NO: 38043

SEQ ID NO: 54278 - DNA, 601 bp, Human; identical to SEQ ID NO: 38044

SEQ ID NO: 54279 - DNA, 601 bp, Human; identical to SEQ ID NO: 38045

SEQ ID NO: 54280 - DNA, 601 bp, Human; identical to SEQ ID NO: 38046

SEQ ID NO: 54281 - DNA, 601 bp, Human; identical to SEQ ID NO: 38047

SEQ ID NO: 54282 - DNA, 601 bp, Human; identical to SEQ ID NO: 38048

SEQ ID NO: 54283 - DNA, 601 bp, Human; identical to SEQ ID NO: 38049

SEQ ID NO: 54284 - DNA, 601 bp, Human; identical to SEQ ID NO: 38050

SEQ ID NO: 54285 - DNA, 601 bp, Human; identical to SEQ ID NO: 38051

SEQ ID NO: 54286 - DNA, 601 bp, Human; identical to SEQ ID NO: 38052

SEQ ID NO: 54287 - DNA, 601 bp, Human; identical to SEQ ID NO: 38053

SEQ ID NO: 54288 - DNA, 601 bp, Human; identical to SEQ ID NO: 38054

SEQ ID NO: 54289 - DNA, 601 bp, Human; identical to SEQ ID NO: 38055

SEQ ID NO: 54290 - DNA, 601 bp, Human; identical to SEQ ID NO: 38056

SEQ ID NO: 54291 - DNA, 601 bp, Human; identical to SEQ ID NO: 38057

SEQ ID NO: 54292 - DNA, 601 bp, Human; identical to SEQ ID NO: 38058

SEQ ID NO: 54293 - DNA, 601 bp, Human; identical to SEQ ID NO: 38059

SEQ ID NO: 54294 - DNA, 601 bp, Human; identical to SEQ ID NO: 38060

SEQ ID NO: 54295 - DNA, 601 bp, Human; identical to SEQ ID NO: 38061

SEQ ID NO: 54296 - DNA, 601 bp, Human; identical to SEQ ID NO: 38062

SEQ ID NO: 54297 - DNA, 601 bp, Human; identical to SEQ ID NO: 38063

SEQ ID NO: 54298 - DNA, 601 bp, Human; identical to SEQ ID NO: 38064

SEQ ID NO: 54299 - DNA, 601 bp, Human; identical to SEQ ID NO: 38065

SEQ ID NO: 54300 - DNA, 601 bp, Human; identical to SEQ ID NO: 38066

SEQ ID NO: 54301 - DNA, 601 bp, Human; identical to SEQ ID NO: 38067

SEQ ID NO: 54302 - DNA, 601 bp, Human; identical to SEQ ID NO: 38068

SEQ ID NO: 54303 - DNA, 601 bp, Human; identical to SEQ ID NO: 38069

SEQ ID NO: 54304 - DNA, 601 bp, Human; identical to SEQ ID NO: 38070

SEQ ID NO: 54305 - DNA, 601 bp, Human; identical to SEQ ID NO: 38071

SEQ ID NO: 54306 - DNA, 601 bp, Human; identical to SEQ ID NO: 38072

SEQ ID NO: 54307 - DNA, 601 bp, Human; identical to SEQ ID NO: 38073

SEQ ID NO: 54308 - DNA, 601 bp, Human; identical to SEQ ID NO: 38074

SEQ ID NO: 54309 - DNA, 601 bp, Human; identical to SEQ ID NO: 54245

SEQ ID NO: 54310 - DNA, 601 bp, Human; identical to SEQ ID NO: 54246

SEQ ID NO: 54311 - DNA, 601 bp, Human; identical to SEQ ID NO: 54247

SEQ ID NO: 54312 - DNA, 601 bp, Human; identical to SEQ ID NO: 54248

SEQ ID NO: 54313 - DNA, 601 bp, Human; identical to SEQ ID NO: 54249

SEQ ID NO: 54314 - DNA, 601 bp, Human; identical to SEQ ID NO: 54250

SEQ ID NO: 54315 - DNA, 601 bp, Human; identical to SEQ ID NO: 54251

SEQ ID NO: 54316 - DNA, 601 bp, Human; identical to SEQ ID NO: 54252

SEQ ID NO: 54317 - DNA, 601 bp, Human; identical to SEQ ID NO: 54253

SEQ ID NO: 54318 - DNA, 601 bp, Human; identical to SEQ ID NO: 54254

SEQ ID NO: 54319 - DNA, 601 bp, Human; identical to SEQ ID NO: 54255

SEQ ID NO: 54320 - DNA, 601 bp, Human; identical to SEQ ID NO: 54256

SEQ ID NO: 54321 - DNA, 601 bp, Human; identical to SEQ ID NO: 54257

SEQ ID NO: 54322 - DNA, 601 bp, Human; identical to SEQ ID NO: 54258

SEQ ID NO: 54323 - DNA, 601 bp, Human; identical to SEQ ID NO: 54259

SEQ ID NO: 54324 - DNA, 601 bp, Human; identical to SEQ ID NO: 54260

SEQ ID NO: 54325 - DNA, 601 bp, Human; identical to SEQ ID NO: 54261

SEQ ID NO: 54326 - DNA, 601 bp, Human; identical to SEQ ID NO: 54262

SEQ ID NO: 54327 - DNA, 601 bp, Human; identical to SEQ ID NO: 54263

SEQ ID NO: 54328 - DNA, 601 bp, Human; identical to SEQ ID NO: 54264

SEQ ID NO: 54329 - DNA, 601 bp, Human; identical to SEQ ID NO: 54265

SEQ ID NO: 54330 - DNA, 601 bp, Human; identical to SEQ ID NO: 54266

SEQ ID NO: 54331 - DNA, 601 bp, Human; identical to SEQ ID NO: 54267

SEQ ID NO: 54332 - DNA, 601 bp, Human; identical to SEQ ID NO: 54268

SEQ ID NO: 54333 - DNA, 601 bp, Human; identical to SEQ ID NO: 54269

SEQ ID NO: 54334 - DNA, 601 bp, Human; identical to SEQ ID NO: 54270

SEQ ID NO: 54335 - DNA, 601 bp, Human; identical to SEQ ID NO: 54271

SEQ ID NO: 54336 - DNA, 601 bp, Human; identical to SEQ ID NO: 54272

SEQ ID NO: 54337 - DNA, 601 bp, Human; identical to SEQ ID NO: 54273

SEQ ID NO: 54338 - DNA, 601 bp, Human; identical to SEQ ID NO: 54274

SEQ ID NO: 54339 - DNA, 601 bp, Human; identical to SEQ ID NO: 38041

SEQ ID NO: 54340 - DNA, 601 bp, Human; identical to SEQ ID NO: 38042

SEQ ID NO: 54341 - DNA, 601 bp, Human; identical to SEQ ID NO: 38043

SEQ ID NO: 54342 - DNA, 601 bp, Human; identical to SEQ ID NO: 38044

SEQ ID NO: 54343 - DNA, 601 bp, Human; identical to SEQ ID NO: 38045

SEQ ID NO: 54344 - DNA, 601 bp, Human; identical to SEQ ID NO: 38046

SEQ ID NO: 54345 - DNA, 601 bp, Human; identical to SEQ ID NO: 38047

SEQ ID NO: 54346 - DNA, 601 bp, Human; identical to SEQ ID NO: 38048

SEQ ID NO: 54347 - DNA, 601 bp, Human; identical to SEQ ID NO: 38049

SEQ ID NO: 54348 - DNA, 601 bp, Human; identical to SEQ ID NO: 38050

SEQ ID NO: 54349 - DNA, 601 bp, Human; identical to SEQ ID NO: 38051

SEQ ID NO: 54350 - DNA, 601 bp, Human; identical to SEQ ID NO: 38052

SEQ ID NO: 54351 - DNA, 601 bp, Human; identical to SEQ ID NO: 38053

SEQ ID NO: 54352 - DNA, 601 bp, Human; identical to SEQ ID NO: 38054

SEQ ID NO: 54353 - DNA, 601 bp, Human; identical to SEQ ID NO: 38055

SEQ ID NO: 54354 - DNA, 601 bp, Human; identical to SEQ ID NO: 38056

SEQ ID NO: 54355 - DNA, 601 bp, Human; identical to SEQ ID NO: 38057

SEQ ID NO: 54356 - DNA, 601 bp, Human; identical to SEQ ID NO: 38058

SEQ ID NO: 54357 - DNA, 601 bp, Human; identical to SEQ ID NO: 38059

SEQ ID NO: 54358 - DNA, 601 bp, Human; identical to SEQ ID NO: 38060

SEQ ID NO: 54359 - DNA, 601 bp, Human; identical to SEQ ID NO: 38061

SEQ ID NO: 54360 - DNA, 601 bp, Human; identical to SEQ ID NO: 38062

SEQ ID NO: 54361 - DNA, 601 bp, Human; identical to SEQ ID NO: 38063

SEQ ID NO: 54362 - DNA, 601 bp, Human; identical to SEQ ID NO: 38064

SEQ ID NO: 54363 - DNA, 601 bp, Human; identical to SEQ ID NO: 38065

SEQ ID NO: 54364 - DNA, 601 bp, Human; identical to SEQ ID NO: 38066

SEQ ID NO: 54365 - DNA, 601 bp, Human; identical to SEQ ID NO: 38067

SEQ ID NO: 54366 - DNA, 601 bp, Human; identical to SEQ ID NO: 38068

SEQ ID NO: 54367 - DNA, 601 bp, Human; identical to SEQ ID NO: 38069

SEQ ID NO: 54368 - DNA, 601 bp, Human; identical to SEQ ID NO: 38070

SEQ ID NO: 54369 - DNA, 601 bp, Human; identical to SEQ ID NO: 38071

SEQ ID NO: 54370 - DNA, 601 bp, Human; identical to SEQ ID NO: 38072

SEQ ID NO: 54371 - DNA, 601 bp, Human; identical to SEQ ID NO: 38073

SEQ ID NO: 54372 - DNA, 601 bp, Human; identical to SEQ ID NO: 38074

SEQ ID NO: 54373 - DNA, 601 bp, Human
aaatagttggcaaaaaacaggtatttcaaaatcttttgatttaactgtggcaaaatttgtaaaagagaaaaatgcttatgtaaaggtactctttccaaatatcatctgaccattttattgactccagaaagtaaagtgaggaggcatcacttattatagccctcacagattctggagctgagtcagggaaacagcttggttagcctgtcatcgtgagtttcgttggaattttatcatcagctccatccttgttgcagaatatctgcatactgaaaagatgtcaaagaaaaaaccagggttmcaggttctgtgcctcataaggtaatgttgattttttaaaaatcattgtcacacatcccttcataaacaaactgataatgaacataaaaagatacatgagaaaatgcattcatttgtgattacagctatgattttaagacatctatattaggatatcatgcaaaaaacatacactttgcagattccaaaggctgcatgttcacacttcaatctgtgatcaaatatccctgaataaccatatgtaaatattctctttaagtatttaccaccgtaaatgaaggaaagccatccacggcttggg

SEQ ID NO: 54374 - DNA, 601 bp, Human
ttctgtgcctcataaggtaatgttgattttttaaaaatcattgtcacacatcccttcataaacaaactgataatgaacataaaaagatacatgagaaaatgcattcatttgtgattacagctatgattttaagacatctatattaggatatcatgcaaaaaacatacactttgcagattccaaaggctgcatgttcacacttcaatctgtgatcaaatatccctgaataaccatatgtaaatattctctttaagtatttaccaccgtaaatgaaggaaagccatccacggcttgggctgaygtaaccaggaagtattccaatgctgtgaattattaatgtagaataaagtaagagaggaagtattcagtgaaggggtgaacgtcaacacagatccccaaggatctagccatgtatttgctgtgaaattcacactctgtgtgactactaaagacagttcagctactcgtacttcactccatttcctttgtgaaatctgaagaactctaggtgaatcaggtgatggttgtaaaaaataatcatcatcttaaaatctttaaagcactttttacaacacaaatagcattgttgccatagaagatt

SEQ ID NO: 54375 - DNA, 601 bp, Human
tgattttttaaaaatcattgtcacacatcccttcataaacaaactgataatgaacataaaaagatacatgagaaaatgcattcatttgtgattacagctatgattttaagacatctatattaggatatcatgcaaaaaacatacactttgcagattccaaaggctgcatgttcacacttcaatctgtgatcaaatatccctgaataaccatatgtaaatattctctttaagtatttaccaccgtaaatgaaggaaagccatccacggcttgggctgatgtaaccaggaagtattccaatgmtgtgaattattaatgtagaataaagtaagagaggaagtattcagtgaaggggtgaacgtcaacacagatccccaaggatctagccatgtatttgctgtgaaattcacactctgtgtgactactaaagacagttcagctactcgtacttcactccatttcctttgtgaaatctgaagaactctaggtgaatcaggtgatggttgtaaaaaataatcatcatcttaaaatctttaaagcactttttacaacacaaatagcattgttgccatagaagattaagttttaaaaagtgctttatct

SEQ ID NO: 54376 - DNA, 601 bp, Human
ggtgaacgtcaacacagatccccaaggatctagccatgtatttgctgtgaaattcacactctgtgtgactactaaagacagttcagctactcgtacttcactccatttcctttgtgaaatctgaagaactctaggtgaatcaggtgatggttgtaaaaaataatcatcatcttaaaatctttaaagcactttttacaacacaaatagcattgttgccatagaagattaagttttaaaaagtgctttatctaaatgatgtttcccctttttcctttccagttttcctctccaattgtgatgycattttacatctataatgccacatattcttaaaaaaaaaaaaaaagcggggagggggcaggttatttcaggatactagaaacagcagtggctaaaacctcgtaagaatcagttttacaattataattgtgagaatattgccatggggaaaagttacaagctgtggactcaaacagatccgagaatgcgtcacagtgctgccagttgccaattatgtgacctaggacaggttgttaacctttctgggctttcatttcttcatctagaaagtgcatgcagcaatgcctacctggtggagttg

SEQ ID NO: 54377 - DNA, 601 bp, Human
agccatgtatttgctgtgaaattcacactctgtgtgactactaaagacagttcagctactcgtacttcactccatttcctttgtgaaatctgaagaactctaggtgaatcaggtgatggttgtaaaaaataatcatcatcttaaaatctttaaagcactttttacaacacaaatagcattgttgccatagaagattaagttttaaaaagtgctttatctaaatgatgtttcccctttttcctttccagttttcctctccaattgtgatgtcattttacatctataatgccacatattcttaaaaaaaaaaaaaaagcggggagggggcaggttatttcaggatactagaaacagcagtggctaaaacctcgtaagaatcagttttacaattataattgtgagaatattgccatggggaaaagttacaagctgtggactcaaacagatccgagaatgcgtcacagtgctgccagttgccaattatgtgacctaggacaggttgttaacctttctgggctttcatttcttcatctagaaagtgcatgcagcaatgcctacctggtggagttgcagtaaagtgataaaggcactagtgacaggg

SEQ ID NO: 54378 - DNA, 601 bp, Human
caggatactagaaacagcagtggctaaaacctcgtaagaatcagttttacaattataattgtgagaatattgccatggggaaaagttacaagctgtggactcaaacagatccgagaatgcgtcacagtgctgccagttgccaattatgtgacctaggacaggttgttaacctttctgggctttcatttcttcatctagaaagtgcatgcagcaatgcctacctggtggagttgcagtaaagtgataaaggcactagtgacagggacaaagtaggtgcataaagaagttactattattggtaaaaaatccgttgtatatgttctactaaatccatgtgcaacacattgaagtggcatattgactttcatatcactgcagaagtaaactgaggtaattaacaaagctcagtggaaaatacacagaatcatggcaaaatctctttacaaccacagctttgactggattcgttggatttggatattttatgggcagctagataaatttccctccctcttcatcacctgtccttccctgctgcccctccttctcctccttgtagttataacacatgagatatttgctggaaaaaaaaatcaagggc

SEQ ID NO: 54379 - DNA, 601 bp, Human
agaaacagcagtggctaaaacctcgtaagaatcagttttacaattataattgtgagaatattgccatggggaaaagttacaagctgtggactcaaacagatccgagaatgcgtcacagtgctgccagttgccaattatgtgacctaggacaggttgttaacctttctgggctttcatttcttcatctagaaagtgcatgcagcaatgcctacctggtggagttgcagtaaagtgataaaggcactagtgacagggacaaagtaggtgcataaagaagttactattattggtaaaaaatccrttgtatatgttctactaaatccatgtgcaacacattgaagtggcatattgactttcatatcactgcagaagtaaactgaggtaattaacaaagctcagtggaaaatacacagaatcatggcaaaatctctttacaaccacagctttgactggattcgttggatttggatattttatgggcagctagataaatttccctccctcttcatcacctgtccttccctgctgcccctccttctcctccttgtagttataacacatgagatatttgctggaaaaaaaaatcaagggcaacaactga

SEQ ID NO: 54380 - DNA, 601 bp, Human
agtggaaaatacacagaatcatggcaaaatctctttacaaccacagctttgactggattcgttggatttggatattttatgggcagctagataaatttccctccctcttcatcacctgtccttccctgctgcccctccttctcctccttgtagttataacacatgagatatttgctggaaaaaaaaatcaagggcaacaactgaatttgtcaaagttgcctcatggctgtatcagacacgcgttagaggtggttttgagctgttgatatggcatttcctcaaattcctctttgaagttatrtgatataaacagatgaaacaattagactagtattttttaccacaattaaaaataatagaaaaaaatacatttttaaaaaagataaaggagagagttgcccctcatttgtggccacaagttggtccacctttaatttatctgggataaaagagacacctgatgcgattatccagctccactaggtcaggaaacttttggcaggaaaaaacgattagaccagagcagaggttccaaaactttacttggttcacagagcccttaggctcaaagaaataccttatagtgccatgtattaaatag

SEQ ID NO: 54381 - DNA, 601 bp, Human
cctccttttccttccttttttttattttatttattttttcttcttttttgagcgggggtcttgctctgtcacccaggtttaagttcagcagcgcagtctccgcttactgcagcctcgacttcctgggctcaagatgtcctcctgccccaactcccaactagctgagactacagacatgaaccaccacaccaggctatccctgaaaattgttaaatatttcctggtcagctcccccctgcaatccaggttgcctcagtgcatactctgggaaccactagaatagttcgcttgacatataaargtgtaccaaggctaatagaacctttaatcatgccattcaagcagattactactaaataaaaatcactcagagcttaacatgggtgcctaacactcaaaagatctatctgtatgtggaaggatagaagcattaactgaggaaaagtaatgctgttgagaaaataacacttaaaatagaagaaagaaatatttaccttataaacatctgtttgtgttgatttgaaattatgatgacacaaattaatttgtgataagtcatcgtaggatggtggagtgaggaaaatgagagtaagtgagggaa

SEQ ID NO: 54382 - DNA, 601 bp, Human
caactgaagcacaagcaactgcagcgagaccttcctcctctgtcttaaccttcctcagccttccactgcgttctgttgccagtgagatgaatgcagagacacggacaagacaaggtggggaggaatagtggagaaagcccattatagctgaaatattgacaaaccaaattctgatttataagaaaatgtcaacaaccactcacttaaaatggtagtggcagggacaagtaacaggataggaagaaataagtggtcctgtgtcgggtaagtttctgagttcgtgagtttaagatataaaaaygggatgtgattgttttctaaaccacatctccatttgggggctgcttggagctgctttagcttgagtggcatctgtggcacctgggaacttgttaggaaggcagagtctcgggccccacctccaatctgaatgaatcagaaatctgcattttaacaagatccccaggtgaatcgtacgcatgttaaaatttgagaagtgctgcttttaaaaataccttccctgggtctcacctccccagaaattctgatttagttggtttttaattatttatgattctaacatgttgccaaatttgggaac

SEQ ID NO: 54383 - DNA, 601 bp, Human
ccacacaatgtatacataagaccagcctccactaacgcattcgaggtgcttctatttttagtaacatgccaggaaatctgtttttatggaatttaataaactgtatattttcaaaggtattttctgatggaagttggtgttggttttggggggatagttttcaaaaaaattgataggctgtatttttttaaaaacattatgaaaatgtgggttctatttgaggccttaatgtacaggctttcccaatatgcctttatcctcagtctttaaaattaatgcctacccaattcaatgaagccaytcttctcaagataattaaacagtaacgttttaacggaccataaaaataaaagttgtcagccatacacacctttaaaattagaaatgagcaattatttgttactataattacatgatccaaattagtaaacatgaagcaatattttatccgttctgaaaggttacttaaaagatgccatcgttgaaatgttgcttttttaaattcttacactaatttttttttcctaaaaagagcataagctgaagaatagaaacctcctggcactaattccatgcgtgattcagcgagtctctgaaccac

SEQ ID NO: 54384 - DNA, 601 bp, Human
agaccagcctccactaacgcattcgaggtgcttctatttttagtaacatgccaggaaatctgtttttatggaatttaataaactgtatattttcaaaggtattttctgatggaagttggtgttggttttggggggatagttttcaaaaaaattgataggctgtatttttttaaaaacattatgaaaatgtgggttctatttgaggccttaatgtacaggctttcccaatatgcctttatcctcagtctttaaaattaatgcctacccaattcaatgaagccactcttctcaagataattaracagtaacgttttaacggaccataaaaataaaagttgtcagccatacacacctttaaaattagaaatgagcaattatttgttactataattacatgatccaaattagtaaacatgaagcaatattttatccgttctgaaaggttacttaaaagatgccatcgttgaaatgttgcttttttaaattcttacactaatttttttttcctaaaaagagcataagctgaagaatagaaacctcctggcactaattccatgcgtgattcagcgagtctctgaaccacttgttgcttcaaatagca

SEQ ID NO: 54385 - DNA, 601 bp, Human
gttggatcctcgcagcaaccctaatgcatgggtattgtttccatacagatgagtaaactaaggctcagagcagtcaagtatttcaggccattgtctcacactgctaagaccccgacagacgatactgtctgaccacctagctactcagttatacaccctcgcctgtatgtccactttgcaaagccattttgaagcacaagtgaaaaaaacccggaacatgcgttggtgttcaatgattgcattctacgcaataccacaaatacttattgagaatctattgtgtgaaacccaaaggtagagaaaaaaaaatttttttaaaggctacttttaaagagctgcacgaatgtctgccttattgttatgcacattcctttcactttttaatttccagaacacattagtggtattcaaaatagttacatgtgagcattttaaaagtagatatgcaattagtgatctttctggtcattgtgatttttttttaagcgtctttttctttcccttgataaccctctctaaacttccgttctggttcaatgacctgcaataatcttttctccctgaatcagggcaagtgccttgggcacatctctcgtcttca

SEQ ID NO: 54386 - DNA, 601 bp, Human
cttttctccctgaatcagggcaagtgccttgggcacatctctcgtcttcatcatttaaatttaatgctcagccatttaactaacatttttatgtttctatgagttagcacatttaagaaaaagtgcatgcatacacttgctcattggatatacttcttagaaaatatttctagaagtaacttctcaacagccattattggcaataatcctcatttgtttccactgaaagtgaaaccaactgatttcactttcttaatgacaaaagtttcaatctgctatttaatactaagaaaacgtcttstatagcagcaattttctggctcttaaacttccctctgtgcacagtagctcatgtggaaagcagaaaagttagaatgtctggccttgatcataaagccaaggtaactcttaccctggccagccgcacagcagagtaacagagaaagcctcacaaggaaccgatcccagatcctccggcttccatttcatcatgcctgtggaatcctagagcctcctgctcgaatttagtttgttgaacaaaagggagggatcgagctgggcatgtggcttacgcctgtaatcccagcactttgggaggccg

SEQ ID NO: 54387 - DNA, 601 bp, Human
atgagttagcacatttaagaaaaagtgcatgcatacacttgctcattggatatacttcttagaaaatatttctagaagtaacttctcaacagccattattggcaataatcctcatttgtttccactgaaagtgaaaccaactgatttcactttcttaatgacaaaagtttcaatctgctatttaatactaagaaaacgtcttctatagcagcaattttctggctcttaaacttccctctgtgcacagtagctcatgtggaaagcagaaaagttagaatgtctggccttgatcataaagccmaggtaactcttaccctggccagccgcacagcagagtaacagagaaagcctcacaaggaaccgatcccagatcctccggcttccatttcatcatgcctgtggaatcctagagcctcctgctcgaatttagtttgttgaacaaaagggagggatcgagctgggcatgtggcttacgcctgtaatcccagcactttgggaggccgaggcaggcatatcacttgaggtcaggaattcgagaccagcctggccaacatggcaaaaccccatctgtactaaaaatacaaaaattagacgggcgtgg

SEQ ID NO: 54388 - DNA, 601 bp, Human
tttatcacaattatcaatacataagtaaaagtaatgggtattctcaaaggcccatgtaaggagtcaaatttgaaattatgtgacctggaataagaagcaaagaagcatgccaaaatatttcccagggaaagcatttataatttcttccagttttttattcacagagaatatatatgctcaaaaaagagaggcattttaaaagattaaaatatatacatataaaaatatgaataaatattttaggtgagttggtgtgtttcaaaggacttgagggcagtgataagggcataataaaaagctkgaaatatcactctgaatatgggatttaatgcccactagagggaatggagattggagttaagaaggtagttgaagaagttatctcagttatggcctttttggaatagatttggagagaaaatgcttttcattcattcaacaattacttgctagagagtgtaagtccatagcatgagcagactgtctatgtttcagcctcagctgcacttctgactacgtgtgtaatattaggcaagtaatttaatctccctgtgccccctcgattcctcaactgttaaatgaaaggagtcataaaattatt

SEQ ID NO: 54389 - DNA, 601 bp, Human
gggaactaaagacaacatggtggtccgtgcacaaactaacaagaaaaataagaaaagatataacaaataatattgtatcatgaaagctggttcctttgagacttttacaaattaaaatcagacattatttagggtctcagtagaagaaagtttgaaacaaaatgagaaaaaggcaaacagatttggccaatggaaaacaaatttatttttcttaaaattgctaagaagctacattgtacagacaattcaagtgttcagcaaaagagaaatcatttaaaacctgagattgttgattgcaacsattcacaaaaatatcagctatagagagaaatgtgataatatagggacagaaaaattatatgtaatgacattctttttttaaccaactatatatcttttaatcaacatattttgagttctcacagaaaacaatcatttctggaaaataatctcatcttaatgctttctactacttatgagtacaaatcagaaaagaagcacaaaagaggaaatgtagagaaaatcctgctttaaaatacagttacacaaagctttagcatgctggattgttttgttttcataaattgtgaaacataaaaat

SEQ ID NO: 54390 - DNA, 601 bp, Human
gatttggccaatggaaaacaaatttatttttcttaaaattgctaagaagctacattgtacagacaattcaagtgttcagcaaaagagaaatcatttaaaacctgagattgttgattgcaaccattcacaaaaatatcagctatagagagaaatgtgataatatagggacagaaaaattatatgtaatgacattctttttttaaccaactatatatcttttaatcaacatattttgagttctcacagaaaacaatcatttctggaaaataatctcatcttaatgctttctactacttatgartacaaatcagaaaagaagcacaaaagaggaaatgtagagaaaatcctgctttaaaatacagttacacaaagctttagcatgctggattgttttgttttcataaattgtgaaacataaaaatctggctcatttccttattattctagagcatgaggctttttgaggggtcagaggtattaggggtcaatgaggatcaacatcccccaggcagcaaagttcccctttaagaaataagaaaagcattatacttgaacattgaacaacccaagggttcagggcaccaacctgcatagttgaaaa

SEQ ID NO: 54391 - DNA, 601 bp, Human
gcaaaagagaaatcatttaaaacctgagattgttgattgcaaccattcacaaaaatatcagctatagagagaaatgtgataatatagggacagaaaaattatatgtaatgacattctttttttaaccaactatatatcttttaatcaacatattttgagttctcacagaaaacaatcatttctggaaaataatctcatcttaatgctttctactacttatgagtacaaatcagaaaagaagcacaaaagaggaaatgtagagaaaatcctgctttaaaatacagttacacaaagctttagyatgctggattgttttgttttcataaattgtgaaacataaaaatctggctcatttccttattattctagagcatgaggctttttgaggggtcagaggtattaggggtcaatgaggatcaacatcccccaggcagcaaagttcccctttaagaaataagaaaagcattatacttgaacattgaacaacccaagggttcagggcaccaacctgcatagttgaaaattcttgtataactttcaactccccaaaaacttagctacaaatggcctaccattgactggccgccttaacacatattgt

SEQ ID NO: 54392 - DNA, 601 bp, Human
aagaggttacactataaagcaaaaaaggtagcattctaactggtgagttacaacgccttactcaatcaatttttgactgggatctggctctcagcttgatttaccactggctttctgaaaatgaaaatgttagactaagcaggagctgagactaatgtcacagtctgccaaggcaagagggaccttggacttcaaaagccaagcataaagcagtaaacaatgcctttttggggaaataactttatgcagttaataaactaaaaggcatttgtttaattgacaaatcctgaatgaacaatarcatttattatagtttgtatcatttgtggcagtagaatttacaaataacttagcctggggtctgataataaatacaacgaatacagaaatgtttataatcagtgtggggagggttgctttgatgtgaatgagaatagactttggagtcaggcaggccttggtatcctttctggctctgcgcttaactttgggtaaattacttaatctctctggcctcagtttcctaatctgaaaaaaatggagaaaataaaagttaccccctggagtcattgtgagaattaatgcatgcaacacaccaacc

SEQ ID NO: 54393 - DNA, 601 bp, Human
tggtatcctttctggctctgcgcttaactttgggtaaattacttaatctctctggcctcagtttcctaatctgaaaaaaatggagaaaataaaagttaccccctggagtcattgtgagaattaatgcatgcaacacaccaaccatttttgcagtacctgatacacagtaaagtgttcaggaagggttagttttcctccctcctccactgggattcttgaaggaccacacgcagtttcagttcacgttgaatttcagaaatatggagctactgtcttagtttcttgttgctgctgtaacaartcaccacagatttgtggcttaacacaatataaatttatcatctcataattctggaggtcagaaatgggtttcactgggctaaaatcaaggtgtctgcaagatgtctttatggaggcttcagggaaggatccatttcccgtcttttccagcttctagataccacctgcattctttggcttctcagctcatggcgccttcctccgtcttcaagcccagaagcatagagacttcaaattctctctctctctttctctcttcctctctctctctctctgtccttggctcctatcatcacatttc

SEQ ID NO: 54394 - DNA, 601 bp, Human
aaccatttttgcagtacctgatacacagtaaagtgttcaggaagggttagttttcctccctcctccactgggattcttgaaggaccacacgcagtttcagttcacgttgaatttcagaaatatggagctactgtcttagtttcttgttgctgctgtaacaagtcaccacagatttgtggcttaacacaatataaatttatcatctcataattctggaggtcagaaatgggtttcactgggctaaaatcaaggtgtctgcaagatgtctttatggaggcttcagggaaggatccatttcccrtcttttccagcttctagataccacctgcattctttggcttctcagctcatggcgccttcctccgtcttcaagcccagaagcatagagacttcaaattctctctctctctttctctcttcctctctctctctctctgtccttggctcctatcatcacatttccatctctcactccaactctcccctctttcccttgtaaggacccttgcaattaccttgggctcacctgggtaatccaagataatctccccatctcaaaatccttatcttgatcacatgtgtaaagttctttttgccatgt

SEQ ID NO: 54395 - DNA, 601 bp, Human
ggatccatttcccgtcttttccagcttctagataccacctgcattctttggcttctcagctcatggcgccttcctccgtcttcaagcccagaagcatagagacttcaaattctctctctctctttctctcttcctctctctctctctctgtccttggctcctatcatcacatttccatctctcactccaactctcccctctttcccttgtaaggacccttgcaattaccttgggctcacctgggtaatccaagataatctccccatctcaaaatccttatcttgatcacatgtgtaaagtyctttttgccatgtgaggaaacacagtcacaggtcccgggaattaggacatggacatctttgggggagcaggtgcattagtctgcctactaccactattatcactctaaagttttgttcatttaagttactctggtacttttgacatgaaattcaaggtattgagtgtaaaaaataattgtcaagggaattagtaaatttctgctgtgtttaggcttaaacttcttttgcttttagcactttgtcaaacattctcctccacatgacacaaggtctatttcaggggttattaaatgtaacaa

SEQ ID NO: 54396 - DNA, 601 bp, Human
ggtcccgggaattaggacatggacatctttgggggagcaggtgcattagtctgcctactaccactattatcactctaaagttttgttcatttaagttactctggtacttttgacatgaaattcaaggtattgagtgtaaaaaataattgtcaagggaattagtaaatttctgctgtgtttaggcttaaacttcttttgcttttagcactttgtcaaacattctcctccacatgacacaaggtctatttcaggggttattaaatgtaacaaaaaacaaaaaattgaattgagtagggttatrctgaatctctgcaaatacagatcccttatggtattatttaagtgtattttaaaagtcacaaagtacacattgataagaaagatggaaggatggatggatggatggatggatggaaggaaaaagagagagagacagacagacagatttaagtttgatcaatgttctcaattttctgaccccaggggacatttggaaatatctggagacatttttggctgtcacatcttgggaagacgctactggcacctagtaggtagggacaaaggactctgctgaacatcctataatgtatgggacagc

SEQ ID NO: 54397 - DNA, 601 bp, Human
atggatggaaggaaaaagagagagagacagacagacagatttaagtttgatcaatgttctcaattttctgaccccaggggacatttggaaatatctggagacatttttggctgtcacatcttgggaagacgctactggcacctagtaggtagggacaaaggactctgctgaacatcctataatgtatgggacagctccccaaacagttacctagcccaaaatgccaatagagcagagactgaaaaacactgaattagataattcgttgtaactcaaaatattgtttggtacagagtaagcytttaatgaatgtttacagaactaaatgtaaaaacacagggaaaaaaatgtgttgtggttaatagagtaggccacctggactcaaatcttgctcttattcatcgtgccatgctgagaagtgatttacctcctatattgcctcagttgcctcatcacttaagaggggataagaatagaatcataatgagtaacaaattatgtaatctttgtgaccagttcaggtcatgtcccggcccatgatatgggcttaacaaatgtctgctattatcatttttccaaatcccagccagaccaattgcca

SEQ ID NO: 54398 - DNA, 601 bp, Human
agcagagactgaaaaacactgaattagataattcgttgtaactcaaaatattgtttggtacagagtaagcttttaatgaatgtttacagaactaaatgtaaaaacacagggaaaaaaatgtgttgtggttaatagagtaggccacctggactcaaatcttgctcttattcatcgtgccatgctgagaagtgatttacctcctatattgcctcagttgcctcatcacttaagaggggataagaatagaatcataatgagtaacaaattatgtaatctttgtgaccagttcaggtcatgtccyggcccatgatatgggcttaacaaatgtctgctattatcatttttccaaatcccagccagaccaattgccagatgatgaatcacaaaagagaagactttgaagataaaatatttacaccattataaaaatcaattaaatcatttctactatataggaaaatacaaatatggggggtcataagagccaacatggtgtaatagaaaaagaacaggagatatgaaggcagcctgatcccaggttttgtcagaaaaatagattttctagattctctcttttttttattttttttaagatggagtc

SEQ ID NO: 54399 - DNA, 601 bp, Human
catcgtgccatgctgagaagtgatttacctcctatattgcctcagttgcctcatcacttaagaggggataagaatagaatcataatgagtaacaaattatgtaatctttgtgaccagttcaggtcatgtcccggcccatgatatgggcttaacaaatgtctgctattatcatttttccaaatcccagccagaccaattgccagatgatgaatcacaaaagagaagactttgaagataaaatatttacaccattataaaaatcaattaaatcatttctactatataggaaaatacaaatatggggggtcataagagccaacatggtgtaatagaaaaagaacaggagatatgaaggcagcctgatcccaggttttgtcagaaaaatagattttctagattctctcttttttttattttttttaagatggagtctcactctgtctcccaggcttgagtacagtggcacgatctcagttcactgcaacctccgcctcctgggttcaagcgattctcctgcctcagcctccttagtagctgggcctacaggcaggcaccaccacgcccagctaatttttgtgttttgggtagagacagggttttg

SEQ ID NO: 54400 - DNA, 601 bp, Human
tctttgtgaccagttcaggtcatgtcccggcccatgatatgggcttaacaaatgtctgctattatcatttttccaaatcccagccagaccaattgccagatgatgaatcacaaaagagaagactttgaagataaaatatttacaccattataaaaatcaattaaatcatttctactatataggaaaatacaaatatggggggtcataagagccaacatggtgtaatagaaaaagaacaggagatatgaaggcagcctgatcccaggttttgtcagaaaaatagattttctagattctctcttttttttattttttttaagatggagtctcactctgtctcccaggcttgagtacagtggcacgatctcagttcactgcaacctccgcctcctgggttcaagcgattctcctgcctcagcctccttagtagctgggcctacaggcaggcaccaccacgcccagctaatttttgtgttttgggtagagacagggttttgccatgttgcccaggctggtctcaaactcctgagctcaagcaattcacccacgttgtcctcccaaagtgctgagattacaggaatgagccaccgtgcccagccct

SEQ ID NO: 54401 - DNA, 601 bp, Human
accagttcaggtcatgtcccggcccatgatatgggcttaacaaatgtctgctattatcatttttccaaatcccagccagaccaattgccagatgatgaatcacaaaagagaagactttgaagataaaatatttacaccattataaaaatcaattaaatcatttctactatataggaaaatacaaatatggggggtcataagagccaacatggtgtaatagaaaaagaacaggagatatgaaggcagcctgatcccaggttttgtcagaaaaatagattttctagattctctcttttttttattttttttaagatggagtctcactctgtctcccaggcttgagtacagtggcacgatctcagttcactgcaacctccgcctcctgggttcaagcgattctcctgcctcagcctccttagtagctgggcctacaggcaggcaccaccacgcccagctaatttttgtgttttgggtagagacagggttttgccatgttgcccaggctggtctcaaactcctgagctcaagcaattcacccacgttgtcctcccaaagtgctgagattacaggaatgagccaccgtgcccagccctattttcta

SEQ ID NO: 54402 - DNA, 601 bp, Human
aggtcatgtcccggcccatgatatgggcttaacaaatgtctgctattatcatttttccaaatcccagccagaccaattgccagatgatgaatcacaaaagagaagactttgaagataaaatatttacaccattataaaaatcaattaaatcatttctactatataggaaaatacaaatatggggggtcataagagccaacatggtgtaatagaaaaagaacaggagatatgaaggcagcctgatcccaggttttgtcagaaaaatagattttctagattctctcttttttttatttttttwaagatggagtctcactctgtctcccaggcttgagtacagtggcacgatctcagttcactgcaacctccgcctcctgggttcaagcgattctcctgcctcagcctccttagtagctgggcctacaggcaggcaccaccacgcccagctaatttttgtgttttgggtagagacagggttttgccatgttgcccaggctggtctcaaactcctgagctcaagcaattcacccacgttgtcctcccaaagtgctgagattacaggaatgagccaccgtgcccagccctattttctagatccttt

SEQ ID NO: 54403 - DNA, 601 bp, Human
tctactgaagtttgtatggtaggacattcccaaaaccaaggaacttcacattcctggatgtcaaataacacatacaaagacttatttctactgccctgagacacatgaatctgaatccacagggtggaacagtggcaaggtttgggtaaaggtgaaagcagagtgggtttttcccacttgccctggggcgatcacgtggtgagggagaagccctgtttcattcccatgagccttcctgggcttctccagaacaagaagggggtggattgatccaatagatggtccagtagaaggacaaagmaatcctgtagctaggactacatgtgctaagggtgacaaagaagacatagccagacctcgagggcagtatgtgatgccagtgagggacgtgagatgtagctattcaccttgatcactggagagcaaaggtcatgatctgccagaaccacagatgccactgaggaaagtaatacataagagatattctctagagaccagaggatcagagggcagcatgaggactatccttggctccaaaagcccccaaattcctcactggcaaaggccatgtggcttcctctccttcatacatgcagatgtc

SEQ ID NO: 54404 - DNA, 601 bp, Human
agaaagaaaccagaaagactgggatttatcctaaagagaccgtattactgaatcaggaagattttattgggattgcactaaattactgagttgatattcaacctgtattgagcttctaatcctcaatggcactagagcttgagggaaaagctataaacaaaaataattataaggaagctgcatctttccttgcacatttgagtgcagtgtgagaaaatatgtgaccctgcaacttacgggaaggagtgtttctatttttgctgactttatggcttttcttaccccaggcacatactcaagrcctcttctgattttctcccacactgagccttgaaaccatgccatgtgctcatatcggttgctaaatcatttttctcccatcagtagtctaagcttctccaagaagtcttcctaaaccatcaaagagctttcacattccctgattcagtcttctccaacttacaagttccttctatgctattctccagctttttacttaccttgtgaatcctaatacctaataacagtaaagtgtctaatttctgcttttttctgtatattttattccaacgtaaatggcaagtttatagaaggcagagtt

SEQ ID NO: 54405 - DNA, 601 bp, Human
ctaaatcatttttctcccatcagtagtctaagcttctccaagaagtcttcctaaaccatcaaagagctttcacattccctgattcagtcttctccaacttacaagttccttctatgctattctccagctttttacttaccttgtgaatcctaatacctaataacagtaaagtgtctaatttctgcttttttctgtatattttattccaacgtaaatggcaagtttatagaaggcagagtttagatgcttttattcattgctttatgcaactggtcagaccaattagtgtttttaaatggtygtggttgacagaattaaattattttattatgaaataatgtttccatgaaatagagcatttctctttagttgctgcaacgggaggatacttgaaatatagttcggtaaaatcttgcagctttttcaccattaacagatgacttctgacccagcatccaatgtatttatgatggtcaatgaattcaatgtacttacaattggtccatttttgtcaacaaatccaatacaagttggctttactattgtgttgaagttgaatttgttattaaagaaatgctttcaggtctgaggcaataacttg

SEQ ID NO: 54406 - DNA, 601 bp, Human
tgattcagtcttctccaacttacaagttccttctatgctattctccagctttttacttaccttgtgaatcctaatacctaataacagtaaagtgtctaatttctgcttttttctgtatattttattccaacgtaaatggcaagtttatagaaggcagagtttagatgcttttattcattgctttatgcaactggtcagaccaattagtgtttttaaatggttgtggttgacagaattaaattattttattatgaaataatgtttccatgaaatagagcatttctctttagttgctgcaacrggaggatacttgaaatatagttcggtaaaatcttgcagctttttcaccattaacagatgacttctgacccagcatccaatgtatttatgatggtcaatgaattcaatgtacttacaattggtccatttttgtcaacaaatccaatacaagttggctttactattgtgttgaagttgaatttgttattaaagaaatgctttcaggtctgaggcaataacttgaattacctcctcagattgttcagattagaccatgtgtctaatgtttagtagtaattgataaattatctggcaatttcag

SEQ ID NO: 54407 - DNA, 601 bp, Human
tcagtcttctccaacttacaagttccttctatgctattctccagctttttacttaccttgtgaatcctaatacctaataacagtaaagtgtctaatttctgcttttttctgtatattttattccaacgtaaatggcaagtttatagaaggcagagtttagatgcttttattcattgctttatgcaactggtcagaccaattagtgtttttaaatggttgtggttgacagaattaaattattttattatgaaataatgtttccatgaaatagagcatttctctttagttgctgcaacgggaggatacttgaaatatagttcggtaaaatcttgcagctttttcaccattaacagatgacttctgacccagcatccaatgtatttatgatggtcaatgaattcaatgtacttacaattggtccatttttgtcaacaaatccaatacaagttggctttactattgtgttgaagttgaatttgttattaaagaaatgctttcaggtctgaggcaataacttgaattacctcctcagattgttcagattagaccatgtgtctaatgtttagtagtaattgataaattatctggcaatttcaggaac

SEQ ID NO: 54408 - DNA, 601 bp, Human
tgcttttttctgtatattttattccaacgtaaatggcaagtttatagaaggcagagtttagatgcttttattcattgctttatgcaactggtcagaccaattagtgtttttaaatggttgtggttgacagaattaaattattttattatgaaataatgtttccatgaaatagagcatttctctttagttgctgcaacgggaggatacttgaaatatagttcggtaaaatcttgcagctttttcaccattaacagatgacttctgacccagcatccaatgtatttatgatggtcaatgaatycaatgtacttacaattggtccatttttgtcaacaaatccaatacaagttggctttactattgtgttgaagttgaatttgttattaaagaaatgctttcaggtctgaggcaataacttgaattacctcctcagattgttcagattagaccatgtgtctaatgtttagtagtaattgataaattatctggcaatttcaggaacgtatatttttgatctacagaattatcctaaagtcaagaaagagtatagaggacactaagatttattgagtgtctgctatgtgccagaaaccttcactga

SEQ ID NO: 54409 - DNA, 601 bp, Human
gaattatcctaaagtcaagaaagagtatagaggacactaagatttattgagtgtctgctatgtgccagaaaccttcactgatcattgatatcttatccaatttaatttttacaagattcatttatttattctttcattcattccttgctatcattgactattagtgtctataaagtgcctgtatatcaggctctgaggatacagaagtgacctagacaggtttggtgccttcctttatgaacctgcaatctagcttggaaaacagctgtgaaacacatcatcagcaacaatagaatgtgcygatggctaagtggggaatgaattgattgcatataggaggagactgtaacttagaccagcagcttaaggaaggcttctctgaggtgataaagattaagcagacctggcacaagagttggcttaactaggtgaggatattaaaagggattgatgtcaagggaaccacatgcaggaaggcgtagctacgaaagagctagttagtgatgttatcttcaagaaactgcaagaagtagggtatggctggaaccaggagagttaaggggagaacgatggctgatgaagccaaagagaggaggagcag

SEQ ID NO: 54410 - DNA, 601 bp, Human
attgagtgtctgctatgtgccagaaaccttcactgatcattgatatcttatccaatttaatttttacaagattcatttatttattctttcattcattccttgctatcattgactattagtgtctataaagtgcctgtatatcaggctctgaggatacagaagtgacctagacaggtttggtgccttcctttatgaacctgcaatctagcttggaaaacagctgtgaaacacatcatcagcaacaatagaatgtgctgatggctaagtggggaatgaattgattgcatataggaggagactstaacttagaccagcagcttaaggaaggcttctctgaggtgataaagattaagcagacctggcacaagagttggcttaactaggtgaggatattaaaagggattgatgtcaagggaaccacatgcaggaaggcgtagctacgaaagagctagttagtgatgttatcttcaagaaactgcaagaagtagggtatggctggaaccaggagagttaaggggagaacgatggctgatgaagccaaagagaggaggagcagaggccgtgccgggctttggaggccatgcgaaggggtggggatgag

SEQ ID NO: 54411 - DNA, 601 bp, Human
tttggagagaaggtgatgaggtcaatattggatgtgctgagtgtaagttgtctaagagaaagaggtgactatattcttgactccagatctcaagaaaatgttcttccctggggtaacagatagatttaggcactgatggtacagagatagcaattgaatccatgaaaagagatagaggatctcatgtggggagagcatgtgaaaggagggagacaaggaccaaagacacaggcctacaggataccagcatataaggggcagatagaggaggcaaagttaatcatttccagttctatattakgactgaatggagactaagatcagttaatttatttcactgattgataggaaagtcagaattcagatccaaatcccaccactttcccaaaatccacctttggatatttggtgtttatgaattcaagagtaatttattgaaggttttctctgaggtaggccctctactaagcatcttacatacattattttatttattgtctgagaaacctacttgtaaattaagtattattattattcccatcacatggatgaggaaataaaggcctggagaggttaactaagttccccaaggttatgtgac

SEQ ID NO: 54412 - DNA, 601 bp, Human
ctttctaattggtaaaataatcatcacatataaattagttaactcatgccaaattattaacattcaaatacagcagaataaaatgtgtcatatggaattttattaaaatgcacttttgatttacctaatcctataatctctaaaacagaagcaactctaatccctgccatgtacttcaagcaagttcaatttcttcctgatataaactctacccaacaagcttttcccagccttcacaacactgtctatttattagcattacgtatacatgcattatatataaagatgtatgtatacatgyagacatctatacgtatacatagatattgatgcagttaagcctcaatttgtcataatttgattgattgtgctaatttaaagtaacattccacctatttaacacaaagatgttctctctctctgctgtaattcctgtttctttcctcaatcccagacagcatcttttcaacaccactgttctctaattgtcttataatagctcagattagcaaccataacatttcttaaagagcaacattacatttgcactacaccgtacaagtccttagccataattcaatatttcattttagccaaacat

SEQ ID NO: 54413 - DNA, 601 bp, Human
ctaattgtcttataatagctcagattagcaaccataacatttcttaaagagcaacattacatttgcactacaccgtacaagtccttagccataattcaatatttcattttagccaaacatcacttcataccttttctaagcccacgtaaggctgctgtaggtacttttctatgtgtgtcatctaggtaagcttttgtttggattgtttttgttggggggagagggggttcttttatttaatttttattttagattcagagggtacatgcacttgttacgtgagtattacacgtgtaatggkgggggttgggcctctagtgtacctatcaccccagtattggacattgtacccagtaggtgatttttcagccatcactccccttcttccccactttggagtcccagagtctattttccccatgttatgtccatgtgtactttttgtttagctcccacttataagtaagaacatgtggtatttgattttctgtgtctgtgttagttcatttaggataatggcctccagctccatccatgttactgcaaaggacatgatttcattcttttttacagctttgtagtattctggggtgtatatgta

SEQ ID NO: 54414 - DNA, 601 bp, Human
caagaaaagaactggccccaggggagtttgatggcagaggaggagagtggggagaaaaagcagaggctttgggaggtttctgctccgtgtactcggtcagacccagaaaatgcactttggagggaggaagggggaggaagtgaaattgctttactatcagacgatgcaaagagaagagatacattttcccactagttttcaaatattgataaatcagaattgtgatctgcaaagcaacccttgctcacactcttctcactcttctttaacgtctcctctgccctttaacattgtttcgggtgtttgttctataagtcatcgaaatggtctcacctgacagctaaaaatacatttctgattacttttacctgaataaatcttgtgaccagatgtggaattcacctattaagtgtgcaacaattacatactgaaaccgatgaaagaactagtggaggagagtgtataatccagtggaatgcagagtataataaatcatatgtaaagatagcaattgccccccgccgcccagttaaagaatactggcttttgatcacagattttaccttagagataccatgtgtctgtaaaattgggttttcaa

SEQ ID NO: 54415 - DNA, 601 bp, Human
ggaagtgaaattgctttactatcagacgatgcaaagagaagagatacattttcccactagttttcaaatattgataaatcagaattgtgatctgcaaagcaacccttgctcacactcttctcactcttctttaacgtctcctctgccctttaacattgtttcgggtgtttgttctataagtcatcgaaatggtctcacctgacagctaaaaatacatttctgattacttttacctgaataaatcttgtgaccagatgtggaattcacctattaagtgtgcaacaattacatactgaaaccratgaaagaactagtggaggagagtgtataatccagtggaatgcagagtataataaatcatatgtaaagatagcaattgccccccgccgcccagttaaagaatactggcttttgatcacagattttaccttagagataccatgtgtctgtaaaattgggttttcaaagtcttcaaaacaaagttctcaaaagtcaaaataggagaaaaagcatgctgattataaactaagagttaataacggtagcactctcttaaatttgggaggcactttgtaatctataagacccatattatgctttt

SEQ ID NO: 54416 - DNA, 601 bp, Human
cacggtatccttagtattcatttaattccaacttttacccaaacccatttcactgacagttagtcatcagagtctctgcttgattacctttaggagcagggaactcaccactcataagacagactatttcaattttaggttggctctaattattagaaggtcctttcctatcttatacttaagtataaatatgaaatgctattgttccaagtgacctgtaaattatctagtcaggtgattttcaaggtattgcccttggcagcacttaggatatttctcaaatgctttgagttgaatttcataaataaataaatatcacatcttcccagaaaaaaatgattataatctctatcactaaagactcaaggaggttgccaagcttccctaaattcaccaagataataaatgtaaggtagaaatagaatatacccaagtctctctgattcaaaaatcaaagtccttttctaaataggatattgcttccctaatatgtttgtgtacatgcaagtgagggcgagagtgtattagtggaatgtgaaagctgtagtgaaaaataggaaaatcgtgaaaagagtctcattccagccaccctaatacgtcc

SEQ ID NO: 54417 - DNA, 601 bp, Human
cagcatgggagcaaaaatggactttggtatcaaacagaactgaatttgaaactatctccactaagaaccagcagtgtagccctgggcaaattatttgatttctctgatcctctagttttgtatcttgaaaaaataaataataaatgtcaactccaaagggctatcatgaggattagatgataaaacaggtacagagtccctagtacaatatctggcaacgaatagacatttaaaatgtccagatatcatattctaaagcaatcaaattttgtgttaatgttaaataagaacttgagtgttkgttgacttgactcaccctaaaatcataagatgttctcagtctccccacctcccttgccaaattacaacggtgggtggtctgttttgtgcatcagcactatacattcagggcatccaaccctaacatactacaatctatttcttcaataagtgaaattggctatataatacaaaagcaatgtagaattcctaatattccctggatgtaacttacctacccctttcatggaaaggggaactccagcagtatgcttactggttatctgatacaaataacaaaaaacagccattaagtgatctt

SEQ ID NO: 54418 - DNA, 601 bp, Human
gtcaactccaaagggctatcatgaggattagatgataaaacaggtacagagtccctagtacaatatctggcaacgaatagacatttaaaatgtccagatatcatattctaaagcaatcaaattttgtgttaatgttaaataagaacttgagtgtttgttgacttgactcaccctaaaatcataagatgttctcagtctccccacctcccttgccaaattacaacggtgggtggtctgttttgtgcatcagcactatacattcagggcatccaaccctaacatactacaatctatttcttcrataagtgaaattggctatataatacaaaagcaatgtagaattcctaatattccctggatgtaacttacctacccctttcatggaaaggggaactccagcagtatgcttactggttatctgatacaaataacaaaaaacagccattaagtgatcttaatccgagactcttatcctttcgggaagtcacagagccctttgaggatcatataaaatctacagaatttctcctcagtgaaatagacatgtaggcatacacatgaaaatttatgtggaatttcagggggttaggaatactttgaa

SEQ ID NO: 54419 - DNA, 601 bp, Human
tgaccttttggaattgcagattccagatgtttgtgctttgctgttccaattcattgattctttatgtaatccataactacattctttaagtttcaaggtctttcaaccgtttagaactatcagatagatttatcatttaggatgcttttattggtaagtaacaagaaatccaactcgaactagtttaaacaacaacaaataagtatttatttgtcacattacttaagtccaaaagtaaagcgggctttggacaggatttgatctgagttctagctgtttttctgtgattttctattctatccagctttgtcctcaggctggcatttctaagatcacaaaatagctgctgcaaatgtatatcagcacattacggtccaagaaaaagagtatctatgacagaatttccagcaaaatcatgagtggcccctgattggacaattcctaaactaattcctgtggacaaaggaagcaagatgctgattgactttgtcctggataactcgaaagaatcactaaagcaagagtccagtcaaatcccgccattggagatgggttggaatcagttccaccccaagtcatgatcattcccatgcttttctgt

SEQ ID NO: 54420 - DNA, 601 bp, Human
tatgaactcttgatgtgttttcagtttatatttctgtcattacaggtacatttgttgtccaagtcactgcgacggatgcagatgatccaacatatgggaacagtgctaaagttgtctacagtattctacagggacagccctatttttcagttgaatcagaaacaggttagactttttgatcttcctttttataatctataattttaattgacatgctcagctgagctagcatatttttaataaaaataatcaatgtgattggattttcttgcatacatccaccaaacactaatgatatatktgtaaacatgacatctgaatcattttaatcaaaaaatctggcaatgaatctttcacccaccctttctatggagtagattgagaaaaattatgtattgccttagttttcttccagtttggggtgaagctaaaaggtaaacccctttttgatagtattggcctgtttacagatattcagaatcttctttttctaattatttagtaggattgtgtctctctattctgctctgaaattagatgtagccatgtgatttatttgggtgaataaaatgtgataatgatacaagtcgcttctaattaa

SEQ ID NO: 54421 - DNA, 601 bp, Human
cttgaaccttaattccaaaattctctagaatcatacaagatgatcattatgagagaattgatgttctattttctaaagaccatagttttacaatttagaaaatcctcagagcattcgttatggtaggtgtatctgagggataattagctaatccataatgggaaactcaacagtcagttcaagtatgtggctttcctaacaatttcctcataattcacctaaatgtcttttatcaagcatattatagtatacctttataccacaagccattttagattctgctgtgtcatcttataacacytaatgtttatacatccataatgtaattataatattgagtgtcttataacccttaatagtctatactattgcagaatctgacttgtacttatttttattctccttgtattacaggctttttttaatgtatctatctcccctgtgtggttgtaatatccttcagtataaaggctgcatataattatttttatatcaccatgacatctgcatagcattttgcatattgtgggtgacagtttatgttgtttgcataaatcaatgattccataaagtattcttaatgcatccctttgcactctta

SEQ ID NO: 54422 - DNA, 601 bp, Human
taacgtaacttttcatccaggaacaaaatccctttgggaccatgatctcctacgaaagctatctcaattattcaatagaaaacccactcattctatcatggcattttaaaaaaactaatcagctgatacgggcttcctttagggtagagctatacatggatcaataggaagtagttttattttctttattttttcaagtttttaatcagagttagctaaatgcaaaaagatcagagctaattaaagaatatctcatataacaagtagaagaaaggttctatgaggcctaccatttcccttmcagaggcctgaaatgaaaactattaggatcaccaacagtttgcccaaaacctactttttaatatggagattccctggggaagaataacataaggattcccccgcaccctggtaccacaggaatttgtaactcactctgctctgcttagatagcctgtgacttgttaatgagcaatatgccaaggcaagggagggagaagttagaaaggggcaggaggccctaaaaatggaagttgaaaacactagagaatacttaacctggggcacaccaactcatgcctgtaatcccagagctttggga

SEQ ID NO: 54423 - DNA, 601 bp, Human
ccttctatgcctcctgtagccattcagttgttctcacaatcacaccataaactttggagcctgtttacagacaagaaaagtgttctccatttgcaaggaaacaggtcatgaaatagaagaaacattcttaacaaccacgaaagtagacataagaagaacaggccaccattagttattttgaggaaagcacacatctacctgatggtaatgtcttaaagaactgttagagaataggttttgtttttatgatgataagagtgtggttagtctatgtttgacttatatctgtctggtgattaayaggtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaaggtaatgccgcttcttaaacaccatacagagtgaacccatttacttttctccagttcctaagttaccaggggcaattatatctcacataaacattcctttagatttttatt

SEQ ID NO: 54424 - DNA, 601 bp, Human
agaaaagtgttctccatttgcaaggaaacaggtcatgaaatagaagaaacattcttaacaaccacgaaagtagacataagaagaacaggccaccattagttattttgaggaaagcacacatctacctgatggtaatgtcttaaagaactgttagagaataggttttgtttttatgatgataagagtgtggttagtctatgtttgacttatatctgtctggtgattaataggtacataccagtttaaaactcctgaatcttctccaccggggacaccaattggcagaatcaaagccagcgaygctgatgtgggagaaaatgctgaaattgagtacagcatcacagacggtgaggggctggatatgtttgatgtcatcaccgaccaggaaacccaggaagggattataactgtcaaaaaggtaatgccgcttcttaaacaccatacagagtgaacccatttacttttctccagttcctaagttaccaggggcaattatatctcacataaacattcctttagatttttattttacttattattttcagaaaaatgccagttctggccgggcatggtggctcccgcctgtaatcccagcactttt

SEQ ID NO: 54425 - DNA, 601 bp, Human
tgaatgatgatgagggattcacaatgcaaacctgtggctctcaattctggctgcaccacagaatcaccgggggaagtgtttaataatgtagatattaatctgcacgcccagatatgttggtttaatggtccacgctggggccaagacattggccagttttaaacactcatcagtgcaattaaagccagatatggccaggcaccgtggctcacgcttgtaatcccagcactttgggaggccgaggcaggtggatcacgagttcaagagatcgagaccatcctggccaacatgatgaagcccygtttctactaaaaatacaaaaattagctgggcctggtggtgagtgcctgtagtcccagctactcgggaggctgaggcaggagaatcacttgaatccgggaggcagtggttgcagtgagccgagatcatgccaatgcactccagcctggcgacagagcgagactccgtctcaaaaaaaaaaaaaaaaaaaaaagccagatgtgagaacatctgacatggaataacccactgtgtatttgccaacttgcccctgatggccccctctagtgaaacatgagtattttttaagtggggacagtgt

SEQ ID NO: 54426 - DNA, 601 bp, Human
tttccttacaccttagttgtaaatcatgttgcagtaaggccttattgctctttgggaccactgatgcttcagtattctcggatcttaacaggaaaatgctggagtcaaccaacctccagccttcagccagtagcttagttgactaaatgagaaaagtgctagctgggcacggtggctcacgcctgtaatcccagcactttgggaggccaaggtgggcagatcacttgaggtcaggagttcaagaaaagtgctagaccagaatagcattgtgtcaattactccccataaacaaagtaagcasactgaaaaactagagaaactcttgccaatgagttcacaaatagattctggtcaaggtgccagccaagtgccaggtacattctaggcactagggaatacagccctcatcccatgaagcttacattctaattggggcaagcagaaatagacaaacagtaaatatgtaatacgtcaggcaaaagtaaattttaagtggaaaataaggcagaataaggaaataaagagcacctggagtactattttagataatggggtcagatttgacattcttggtaggggaccatttagtaaagatttgaat

SEQ ID NO: 54427 - DNA, 601 bp, Human
ttctacaggctgtacaggaagcgtggctaggaggctgcagaaaacttgtaatcatggcgaaatgtaaaggggaagcactacacttttaaaccatcagatctcatgagaattcactcactatcacaagatcagcaagggagaagtctgcccccatgatacaatcacctcccatcacgcccctcctttgacacatggggattacaattcgagattagatttgggtggggacacagagccaaaccatatcacatagctattctaaaaactagtaatacatttacaaataagacaacatttctcaaaatccactagtcttccatcagtattagggttggaatgtttggtttccaaatgcttctcttggtttccctcaaatttattcaaactctccttcttaaatatttatcaagttcctagtctgttccaggcaccactgtggtctcccactgatttaagtgatgtaagtgattctgtctttagtgtttttcttcctccactggacattgttttcttagacagctgaataggaaatctgggatcagtccagatcttaatctagagcttcagactagatatctcttcctgaacttttctcaggcac

SEQ ID NO: 54428 - DNA, 601 bp, Human
aaccattctcctcaattcaaccagtgatctttattaacaatgatttagattgtggcattcccctgcttaaaaccttttgtagccagtcgtggtggttcatgactgttatcccagcacttcgggaggccgaggtaggtggatcacttgagctcaggagttcaagaccagcccgggcaaaatggccaaatcctgtctctacaaaaaattagcagggcatggtgacacgcacctgtggtcccagctactctggaggctaaggtgggaggatcgctcaagcctgggaggtcgaagttgcagtaarccaagatcatgccactgcactccagcctgggtgacagagtgagagagtgagaccccatctcaaaacaaacaaacaaacaaaaaaacccttgggtagattcgcattgcatctagaataaattccaactccttatcacagccttcttctgcagtctagactctggctctctcaccaatgtcatctcctatctccttcttctgcctcactaaccttggccacactagccatcttttgcttatttcaacagatgatttttaaaattaaatggaaagtagaaaaataaccaaaaccctacatatg

SEQ ID NO: 54429 - DNA, 601 bp, Human
tagccagtcgtggtggttcatgactgttatcccagcacttcgggaggccgaggtaggtggatcacttgagctcaggagttcaagaccagcccgggcaaaatggccaaatcctgtctctacaaaaaattagcagggcatggtgacacgcacctgtggtcccagctactctggaggctaaggtgggaggatcgctcaagcctgggaggtcgaagttgcagtaaaccaagatcatgccactgcactccagcctgggtgacagagtgagagagtgagaccccatctcaaaacaaacaaacaaacaaaaaaacccttgggtagattcgcattgcatctagaataaattccaactccttatcacagccttcttctgcagtctagactctggctctctcaccaatgtcatctcctatctccttcttctgcctcactaaccttggccacactagccatcttttgcttatttcaacagatgatttttaaaattaaatggaaagtagaaaaataaccaaaaccctacatatgcatacaagcacacacacacacacacacacacacacacacattaaagttctcaggttgtaaaaacttgagttaaaaatga

SEQ ID NO: 54430 - DNA, 601 bp, Human
aaaagatgagaggggtcaagtatattgtaaaatgtgggcattgtttagaaaattttagatatcaattctctagcttactatagaatttttatttcaaagtctttacagaattaagagagataaattatcacttttctatggtataccaaagtgagtaatacaaaccatcaagtaatcagtaaaatgattagaatgaattttatggtagcccccatgaaattgaaggcaaagaacaatagtgccaaaagaatgcttcaaataaaatgattacacacaatgaaaactaatgtagatggtcaawacaatgtgcaggctgaagaacataagtgaaaaatgatctttttttaatttttttattatacttaagttctagggtacatgtgcacaatgtgcaggtttgttacatatgtatacctgtgccatgttggtgtgctgcacccattaactcgtcatttacattaggtatatctcctaatgctatccctcccccctccccccaccccacaacaggccccggttaaaatagaatttcaatgtttaaaactaggcttctaaattacagctcactttttagtgtttgtgtttaattttaaaagttcta

SEQ ID NO: 54431 - DNA, 601 bp, Human
gagagataaattatcacttttctatggtataccaaagtgagtaatacaaaccatcaagtaatcagtaaaatgattagaatgaattttatggtagcccccatgaaattgaaggcaaagaacaatagtgccaaaagaatgcttcaaataaaatgattacacacaatgaaaactaatgtagatggtcaaaacaatgtgcaggctgaagaacataagtgaaaaatgatctttttttaatttttttattatacttaagttctagggtacatgtgcacaatgtgcaggtttgttacatatgtatacmtgtgccatgttggtgtgctgcacccattaactcgtcatttacattaggtatatctcctaatgctatccctcccccctccccccaccccacaacaggccccggttaaaatagaatttcaatgtttaaaactaggcttctaaattacagctcactttttagtgtttgtgtttaattttaaaagttctaaacatttttagctcactttgggtatctagtgtgaaatagtccatatcgaatagtttattacatttgtattctctgtcaatataactcatgagatttgaagtgactaaaggatat

SEQ ID NO: 54432 - DNA, 601 bp, Human
tgcacccattaactcgtcatttacattaggtatatctcctaatgctatccctcccccctccccccaccccacaacaggccccggttaaaatagaatttcaatgtttaaaactaggcttctaaattacagctcactttttagtgtttgtgtttaattttaaaagttctaaacatttttagctcactttgggtatctagtgtgaaatagtccatatcgaatagtttattacatttgtattctctgtcaatataactcatgagatttgaagtgactaaaggatatttggtagaatagtaaccartatgggcaaaatgaagcattgcttttagatagtgataaggacagcacattagaaattagttaggtaggaatttgctcttcagaatttttcaagatttatcttgaagttcatgttaatttatgttatgggactgatgtagataccaaagacagagcatctttaaagttttaaaattataaatttatttcccactgaaaatgaccatttttcctaagacaatgaaattttattttttaccaaagcagtcatttcataagtattttaatctttgtgccttaaaaaaagtttttaagagttaat

SEQ ID NO: 54433 - DNA, 601 bp, Human
aaccagtatgggcaaaatgaagcattgcttttagatagtgataaggacagcacattagaaattagttaggtaggaatttgctcttcagaatttttcaagatttatcttgaagttcatgttaatttatgttatgggactgatgtagataccaaagacagagcatctttaaagttttaaaattataaatttatttcccactgaaaatgaccatttttcctaagacaatgaaattttattttttaccaaagcagtcatttcataagtattttaatctttgtgccttaaaaaaagtttttaagakttaatgtttctatgacacatttgaaagtattggtgactatctcttgaaagttaatattcagctgctctaactttcaaagaataatatgagtaaaattttagacattttaaagaatcttactgtctaatcttcttaacaacctttgatataacagaaaccaaaagcttgtgtaaaaccagctcccactcacctcggggcctttgcatatactgattcctcgacctgaagagccagaaatattcacatggcttaaaccttctcttcattcatgtctctgggcaaatgatatctcatcagaga

SEQ ID NO: 54434 - DNA, 601 bp, Human
ttaacaacctttgatataacagaaaccaaaagcttgtgtaaaaccagctcccactcacctcggggcctttgcatatactgattcctcgacctgaagagccagaaatattcacatggcttaaaccttctcttcattcatgtctctgggcaaatgatatctcatcagagaagcagtccttggtcatcattctaagtaacacctctatttctctcaatcctttttccctacttaatttctctatagcacttaccatctgacacattatatatttatgagtttatggtttgtccatccccattayaataaagctccaggaaacaggatctttgttatgtttcctacgtgccccaacatcgcaaatagaggctgctatatattaggtattagatgctcactaaataattacaaagtgaaaaaacaaatagacatacaagtgaagtaaatgaagagaggtgaggtgatagattctaactcctgatccttacactagaaatctgtcttccatactgtgctagaagattatcacagaaggcaaccaaaatacttcatttatctcaggtctgcaaacattgattccgctttatcattaattccaaatgaa

SEQ ID NO: 54435 - DNA, 601 bp, Human
gattgtcacactagaaggtgctactgatatctcgtgggtagaggccagggtggctgctaaacatcctacaatgcacaggacatcctacagtgtccccacaacaaagaatcattccctgccctttggctttctaacccataatagagcagattcactgtatattacttaaaggctatcatttttataattaaatttttaaatcattttgtcaagcaatttattgcaaaacggtaagaaacacttttgagttatcaaaattttatggcagcgttttggtttttctcttagttgattcagaccytgcatgctgttgacaaggatgacccttatagtggacaccaattttcgttttccttggcccctgaagcagccagtggctcaaactttaccattcaagacaacaaaggtaaatgagttcaagttaccttctctatctatctccatctatatccgtaactgtttctgtatgtatatgtgtatatgtatatgtacatatctgtatctatatctatcttttcttatcacagttgatttaatacatgacgcagtatccacatacattcaccactttgctttccggttccagacaacacggcgggaa

SEQ ID NO: 54436 - DNA, 601 bp, Human
gggtagaggccagggtggctgctaaacatcctacaatgcacaggacatcctacagtgtccccacaacaaagaatcattccctgccctttggctttctaacccataatagagcagattcactgtatattacttaaaggctatcatttttataattaaatttttaaatcattttgtcaagcaatttattgcaaaacggtaagaaacacttttgagttatcaaaattttatggcagcgttttggtttttctcttagttgattcagaccctgcatgctgttgacaaggatgacccttatagtggrcaccaattttcgttttccttggcccctgaagcagccagtggctcaaactttaccattcaagacaacaaaggtaaatgagttcaagttaccttctctatctatctccatctatatccgtaactgtttctgtatgtatatgtgtatatgtatatgtacatatctgtatctatatctatcttttcttatcacagttgatttaatacatgacgcagtatccacatacattcaccactttgctttccggttccagacaacacggcgggaatcttaactcggaaaaatggctataatagacacgag

SEQ ID NO: 54437 - DNA, 601 bp, Human
gtttctgtatgtatatgtgtatatgtatatgtacatatctgtatctatatctatcttttcttatcacagttgatttaatacatgacgcagtatccacatacattcaccactttgctttccggttccagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccaygcggaggcgctcatccaccccacgggactgagcacgggggctctggttgccatccttctgtgcatcgtgatcctactaggtaaactggttctccctgcctcctatctccccatggtgaggggctcacactgttactgtgacactctagatttatctgcctcccccattaaggcatacagcctgatctaggtgagtcgagttacatactgagaatctgtgctgtacgatgtgaactcatttttgcttgcaaatggctttggaaaatgaacagatgtgaaacttgctcgtgtctttgcttgc

SEQ ID NO: 54438 - DNA, 601 bp, Human
atctgcctcccccattaaggcatacagcctgatctaggtgagtcgagttacatactgagaatctgtgctgtacgatgtgaactcatttttgcttgcaaatggctttggaaaatgaacagatgtgaaacttgctcgtgtctttgcttgcccaggaagcaaagaatctcttgtctatcagactgggaatgaatctcgggggatttcagggcaacataaatgtgcccttttcatttcattcgttgtgtaatttttttacttggaaaacgttgttaagtgtctggcatggagtgtatgatgaggkccctttctataaaggtaaagtttaaagatctatgggaaagtgggaagaggagtatgatgacttttctctcatcctagaaaaataaaaactatgaaatttttttaacccagcaaactaatgttgatttaccatttaaatgattaccttcttagcattactctctgattgccacatgcataaggtctatttctcacactcaacaataaataacttctgtgattgaggaaatcagtatgggggcccaaaagaaatgaatgtaataaaaatggaaatcagggtctaacaatgattcaaatgaaa

SEQ ID NO: 54439 - DNA, 601 bp, Human
atctcgggggatttcagggcaacataaatgtgcccttttcatttcattcgttgtgtaatttttttacttggaaaacgttgttaagtgtctggcatggagtgtatgatgaggtccctttctataaaggtaaagtttaaagatctatgggaaagtgggaagaggagtatgatgacttttctctcatcctagaaaaataaaaactatgaaatttttttaacccagcaaactaatgttgatttaccatttaaatgattaccttcttagcattactctctgattgccacatgcataaggtctattyctcacactcaacaataaataacttctgtgattgaggaaatcagtatgggggcccaaaagaaatgaatgtaataaaaatggaaatcagggtctaacaatgattcaaatgaaatttttacccctaaccaactaattaagcctacaagtcgagctcagatttctcaacaggtccttgactgtgaactaagaaatcaaatatttgttaatgcagcccttccaaaaatgaaagcaagatttgtaaagcttgcctatatagtgaaaagaaaaggtaagaagttaagagtcaacctgaattatacag

SEQ ID NO: 54440 - DNA, 601 bp, Human
tcttccccaggcttggtgcctgaagactgcactctactttcttttcaaacttatgaaatgcagggcgatttccaggccaaaagacagcccaaacttaaaatgtgacgattgaagaaagtggaggaaaatgaagcaaagccacattgatataggaagaaatctggagtccagaaagtggatcatatggtaatggatattttacaaaaataaaacaacagtaaaaacaactagacaactactacatctcatgtcttatggtgccttagaacttgcaaaactttcacatttattaactcattcrtgacaataagactgggcactgtgctattaattttcttttacaaataagaaaataggcttagaacggtcaaatcatttaatttaacccagatctctttaccctctagttttacgatgaaatttgaacacaaatttgcccaattgtccctctatcccgccaaaaatcttactgctgtcctctggcttcaaaagggtaagggaaagggggagactcagttcctgctgagggcacctcatagggcatcactttctaagaatgtgtttgccccatgtgcttagcaatcacattttcactttataa

SEQ ID NO: 54441 - DNA, 601 bp, Human
aagaaatctggagtccagaaagtggatcatatggtaatggatattttacaaaaataaaacaacagtaaaaacaactagacaactactacatctcatgtcttatggtgccttagaacttgcaaaactttcacatttattaactcattcgtgacaataagactgggcactgtgctattaattttcttttacaaataagaaaataggcttagaacggtcaaatcatttaatttaacccagatctctttaccctctagttttacgatgaaatttgaacacaaatttgcccaattgtccctctatyccgccaaaaatcttactgctgtcctctggcttcaaaagggtaagggaaagggggagactcagttcctgctgagggcacctcatagggcatcactttctaagaatgtgtttgccccatgtgcttagcaatcacattttcactttataaaagttagctctgagagctctccttctagacagcgacactctcaagaaatcctgttcagatgtgcattgggctaatgagaaaagatataagcagttttagctgtagaagaattagaccttgaataaatgcctttgattttttgaaagtgccctc

SEQ ID NO: 54442 - DNA, 601 bp, Human
caaaagggtaagggaaagggggagactcagttcctgctgagggcacctcatagggcatcactttctaagaatgtgtttgccccatgtgcttagcaatcacattttcactttataaaagttagctctgagagctctccttctagacagcgacactctcaagaaatcctgttcagatgtgcattgggctaatgagaaaagatataagcagttttagctgtagaagaattagaccttgaataaatgcctttgattttttgaaagtgccctctcccttctagacagttgcgctttcagacgtgcrtaagactaaaataaaagctatagataccttaagccagggaagaattaggaggtgataaatgcctgccccttgccttacgtgactgaatgagcccatgtacataagagcttaattcttggagagacagttggcttgattctgttctctaatcccaatggatgtccttacttccaaccctctgttttgcaaatccgtgtcattgttcacactggcaaccagtatgaaaggtagatcatgagcatccctctgcccaaagccctgcagtgctcttcatgtctttgctcaaattatgcaacctcc

SEQ ID NO: 54443 - DNA, 601 bp, Human
agaacatgaacctttgaaaaataaaaaataaaaaatctcacttacatgtatttatttcatttagctcaaacagaaataatatggcatgtggattcttacctgcccccttcaaattagccaatctcaaaatccaaaatggctttctgaattatatctgggtctctccaggtattttctggaataatattgctttatatgtaggaaaggtatgcaaatattcagtgtctactttggattttaaactaattttacacttttctcaggtaaaaaaaaaaaaggcatagcgcaaaagttattttasatgtggagttgtgcaaacccttcaacacattcccaaaggtgccagtcttgtccttgtaaccagtttcagagcattttaggtgttcagcataatttgcaccctgattgcagtactttcactgaggccgagcttcttttctttattatttttttccttaccttgaaactagtttgccatttcaaagtaaaaaggaactactgccaaaatatgatggtgttttatcctctacttaaattataaccttctttcaaatatttactccattttatgggtcccggtttgatcatggatggaggcaag

SEQ ID NO: 54444 - DNA, 601 bp, Human
ctccacctcctgggttcaagcaagtctcctgcttcagctcccacatagctgggactacaggcatgtgccatcacgccccgctaatttttgtattttttagtagagacggggtttcacaatgttggccagactggtctcaaattcctggcctcaagtgatccacctgcctcagcctcccaaagtgctgggcttacaggcataagcctccacgcccagccaaaagtgtcattttctttattgcccactttcaaaaaacaaaaaacaaaacaaaacaaaaaaaccctctagtaatattgtatcrtatagggaatgaaattcaaactcctaaacccagcattgaccactcacaacacgctccattttacacgtccgtcactctctcttaccttatggtaacgtgccacgagttttccttctgtattatacaccacattggtattgtattgaaagtagccattaggaggacatgtggagtcacgggaattacatggctttttgtcccccaaatttgccaagacatagatagagttgtccttggccaggcagctgagtcttgcttgtactggtgtgtgaccaaatctaaaccaaattataattaaga

SEQ ID NO: 54445 - DNA, 601 bp, Human
tatctcaatcctggaccatcatgctacttttttttttttttaacagttctctgcctacatgtttttctgagtagttttttacaacgtgtcattttcttttttctttttcttttttttctttttttttttttgagagtctccctctgtcacccaggctggagtgcagtgacacaatctcggctcactgcagcctccacctcctgggttcaagcaagtctcctgcttcagctcccacatagctgggactacaggcatgtgccatcacgccccgctaatttttgtattttttagtagagacggrgtttcacaatgttggccagactggtctcaaattcctggcctcaagtgatccacctgcctcagcctcccaaagtgctgggcttacaggcataagcctccacgcccagccaaaagtgtcattttctttattgcccactttcaaaaaacaaaaaacaaaacaaaacaaaaaaaccctctagtaatattgtatcatatagggaatgaaattcaaactcctaaacccagcattgaccactcacaacacgctccattttacacgtccgtcactctctcttaccttatggtaacgtgccacgagttt

SEQ ID NO: 54446 - DNA, 601 bp, Human
acagtttaagatgcttacaaaatatctgggtgtggagaagggacattcatactgcctgtacatcacacatatccatttaaaaggccaggcttctttctctacctagtttagtataaaattatgacttaaaggttatttgattccttttttcaattcagaatttaaagtaaacattttatggtttgatcttaaatctataagatggtaattaaattagctggtgtagaaaataaggtattttgtggtttgatagcaaattaacttatgcaaagctgattcatacaattttgaaacatctttmtaccatttcaatattaaatagtatttagattatggctgtgctcagtggctcatgcctctaatctcagcattttgggaggccaaggtgggaggactgcttgaggtgaagagttcaaagacagcctgggcaatgtagtgagactctgtttccaaaaaaatatttaaaaattagcatggtggcacatgcctacagtctcagctacttgggaggctgaggcaggaggatcactagagcccaggagtttgaggttaacagtgagccatgatggctccactgcactccagcctgggcaacagtgag

SEQ ID NO: 54447 - DNA, 601 bp, Human
tcattaggttcacatatgtcagaggtcatgggttacaaacggtccctgaggtaccctcagggaagagtgagagcctttcaacttagacagggtgactgcaggttccttgctagtttgtccacattcagtgcactgtgccatcctgcacatttacagaatggcagaatagcttcaaatgattactgcaaataaactgcattgaaagataatacaaataatgcaaacaatctcccaagcaagaaaatggaagcactgacctttctatttttactatgagacacattttaagaagaaagtgaartgcagtgatatatatgaaaagaagctgtcaaaatccacaaaattatgaagaaagcattttgaaattgttgcactttataaatacacacacaaaaatacatatattgaggacttatgttaacgattttttccaataggggtccatgatcgaaatcatttgaaaaccattggtttaacatccctcctcttaattaatatttatattttaactgagactgccaggagataatttctccactccaaagattctgaggctacagtttaagatgcttacaaaatatctgggtgtggagaagggaca

SEQ ID NO: 54448 - DNA, 601 bp, Human
accgtgtcagccaggatgatctcaatctcctgacctcatgatccacccacctgggcctcccaaagtgctgggattacaggaatgaaccacagcacctggccctataagcttcttaaaagttaaaaaacatgcattattcttctttgaatccttggtgcctagaaacgtaatattaatagatgcataataaatacctgtaagtcaggtgagagatgtcatctctctctttagtgtcccatccaaagtaatctcagtgactcttgcccacctttcaaaattaccatagaaatgtatttaattycccgattccttctaggtaaactaaaaaaaaacttagtctaatataataaatggaatcaacagttaataaaatggtctgcagtgtagaaaaaatatctaaaaaatagaaaagaaattgggctttactactattttaagaattgacaggccaggcaaggtggctcatgcctgtaatccaagcactttgggaggccaaggcaggcagataacttgaggccaggagctcaagaccagcctggccaacatggagaaaccccatctctactaaaaaatccaaaaattagccgggtgtggtggtatg

SEQ ID NO: 54449 - DNA, 601 bp, Human
ctcttctttttgtaacattctgtagcttaaatgacagcaaagctccttttgacagactgtaaggtttcctgcattttcaaaaagttctgtgaagttgaacccatccctggaaataaatcccctgaaagtgtttttctgtactggaaatggtttgatggtggtggcgtaggcattccaattaacagctgttgggtaggcaagcgaggataggggatgtgaatccacctctgaaaggagaagttttcccaactctgtcttcatgtcataatgatacactttgggaccatttggtgcataaatrccacttcctgtgaatgaaagacaagtcttctaaaaacaacaccacacacaaaaaaaccaaaactgccaatttccccatcagaattgggcatgtgatcacgccaccatattagtcacgatgagagaggatacatgcttctaattgcactgaacacctaactacttctattctctaatggaagagattaaaataaacattccttggtctcatttcaattaaaccttaaatataatagcattatttattagcattatggaaaattaaaccaactacaaaaatctttgtagtcaggagttcctg

SEQ ID NO: 54450 - DNA, 601 bp, Human
acccgggacatctgattagaagagaaactaaaataaaagtagtatctctatttactgttagttttgcaagtgaaaataagactgtttataatttagatatgttggcaaacccacttaaggaagtcttcttgatgttctccacagtaggctggtttattagtcaaatcgaaactcatcatggttaggttaataattttttaaatatgcttaaagcaagcaataagattatacttaattcccattgtaaatattttatcccagtgtatgtacgtgcataaatgcacgtgtgtgtgtgtgtgttgtgtgtgtgtgtgttgccatcaatgcatggagtcaagccaaggaaaagcacctggttttctggaacaaatataaaaagttaacctggaatttacctttcacttgaatgccctttcatttgaactgaaattacctgccagtactctcttctccttcggccatgtaatcctgtaaaagctcctagaacgtatacttcattctcttctttttgtaacattctgtagcttaaatgacagcaaagctccttttgacagactgtaaggtttcctgcattttcaaaaagttctgtgaagttgaaccc

SEQ ID NO: 54451 - DNA, 601 bp, Human
aacccgggacatctgattagaagagaaactaaaataaaagtagtatctctatttactgttagttttgcaagtgaaaataagactgtttataatttagatatgttggcaaacccacttaaggaagtcttcttgatgttctccacagtaggctggtttattagtcaaatcgaaactcatcatggttaggttaataattttttaaatatgcttaaagcaagcaataagattatacttaattcccattgtaaatattttatcccagtgtatgtacgtgcataaatgcacgtgtgtgtgtgtgtggtgtgtgtgtgtgtgttgccatcaatgcatggagtcaagccaaggaaaagcacctggttttctggaacaaatataaaaagttaacctggaatttacctttcacttgaatgccctttcatttgaactgaaattacctgccagtactctcttctccttcggccatgtaatcctgtaaaagctcctagaacgtatacttcattctcttctttttgtaacattctgtagcttaaatgacagcaaagctccttttgacagactgtaaggtttcctgcattttcaaaaagttctgtgaagttgaacc

SEQ ID NO: 54452 - DNA, 601 bp, Human
ggcacatgcctgtagtcccagctactcaggaggctgaggcatgagaatcgcttgaacctgggaggcagaggttgtagtgagccgagatcatgctactgcactctagccagggtgacagagtgaaattgtctcaaaaaaaaaaaaaagaaaaagaaaagaaaagaaaaagaaagctatacaaaacccgggacatctgattagaagagaaactaaaataaaagtagtatctctatttactgttagttttgcaagtgaaaataagactgtttataatttagatatgttggcaaacccacttaargaagtcttcttgatgttctccacagtaggctggtttattagtcaaatcgaaactcatcatggttaggttaataattttttaaatatgcttaaagcaagcaataagattatacttaattcccattgtaaatattttatcccagtgtatgtacgtgcataaatgcacgtgtgtgtgtgtgtgttgtgtgtgtgtgtgttgccatcaatgcatggagtcaagccaaggaaaagcacctggttttctggaacaaatataaaaagttaacctggaatttacctttcacttgaatgccctttcatt

SEQ ID NO: 54453 - DNA, 601 bp, Human
cctgccactgtttgccacaattcagagaagacattaatattcaaaccactggaatatgtgtatgtatgcgtgtatgtgcatgtgtgcaagtgttgtatattagcagatataagcctgcagagtcataattctaatttgaagccagcttaatttgtgaattaattagctacagccactgtaatttatgaacaaatgctgggtgcagtggcacatgcctttaaatcctagctactcaggaggctgaggcaggaggattgcttgagcccaggagtttgaggcttcagtgagctatgatcatgcyactgcactctaacctgggtgacagagcaagactctgtttaaaaaaaaatgtgaaataaacatctgattttctgtttgtcttcactagtgacaaaaggaaattaaaaatctataaacaaacattcttcaatgaatggtatctcagactcacagttctaggtatgttctttattatgttcttccaatgaagtatcatcattttataattagttgttataaattgaaaaaatgatcacaatattttcccctccttgacccatgtccttttgccgtgtgattttatagctcttcccattgagag

SEQ ID NO: 54454 - DNA, 601 bp, Human
tgtagttggcacttcagcttttattccagcctcaatttgctcatgagattctacctaaacaggttctatggcagcaaagcattcctgatctttggattttatggccttaaggttacactgtatgttaaattgttggtttcatagaattaagcatttttataagtatgatatattccactctgataacacagcagatacagatacatgaccataagcaatctgcaattttaaagacttccttacttgatgccttgattgaattaacttggaccctattttatagaatatgcaatgatttcaycctagttactgaaaccctgccactgtttgccacaattcagagaagacattaatattcaaaccactggaatatgtgtatgtatgcgtgtatgtgcatgtgtgcaagtgttgtatattagcagatataagcctgcagagtcataattctaatttgaagccagcttaatttgtgaattaattagctacagccactgtaatttatgaacaaatgctgggtgcagtggcacatgcctttaaatcctagctactcaggaggctgaggcaggaggattgcttgagcccaggagtttgaggcttcagt

SEQ ID NO: 54455 - DNA, 601 bp, Human
gaaaattagattgtgtgctcagtttaaatcttcaggcttacagaatataatgcatcaatatggctagaccctatgtcctcctaagtttaccttggtgaccctgatttctctctctcacttccttgaagtgatctcagatagatatttatgtcagtccagccaccttttagctactggattttagccccagactccttgctgtagatttaatcatgattttctgtagttggcacttcagcttttattccagcctcaatttgctcatgagattctacctaaacaggttctatggcagcaaagsattcctgatctttggattttatggccttaaggttacactgtatgttaaattgttggtttcatagaattaagcatttttataagtatgatatattccactctgataacacagcagatacagatacatgaccataagcaatctgcaattttaaagacttccttacttgatgccttgattgaattaacttggaccctattttatagaatatgcaatgatttcaccctagttactgaaaccctgccactgtttgccacaattcagagaagacattaatattcaaaccactggaatatgtgtatg

SEQ ID NO: 54456 - DNA, 601 bp, Human
catggaaaaagtggcaaagtagtacgagaaaattagattgtgtgctcagtttaaatcttcaggcttacagaatataatgcatcaatatggctagaccctatgtcctcctaagtttaccttggtgaccctgatttctctctctcacttccttgaagtgatctcagatagatatttatgtcagtccagccaccttttagctactggattttagccccagactccttgctgtagatttaatcatgattttctgtagttggcacttcagcttttattccagcctcaatttgctcatgagattctrcctaaacaggttctatggcagcaaagcattcctgatctttggattttatggccttaaggttacactgtatgttaaattgttggtttcatagaattaagcatttttataagtatgatatattccactctgataacacagcagatacagatacatgaccataagcaatctgcaattttaaagacttccttacttgatgccttgattgaattaacttggaccctattttatagaatatgcaatgatttcaccctagttactgaaaccctgccactgtttgccacaattcagagaagacattaa

SEQ ID NO: 54457 - DNA, 601 bp, Human
agtagtaatggaataaattatttacgttctccaactcttcatgcactatcaccatccaccttcaaacacttatgtggttcagagtaagagtgaaatggtatttctggctttggacctttaacctagtttggaaaactctagcatttttttgtccttctcccatggatgaagtagtttcatcaggtaaatgttcagtcctactatgggacaattcctcaaagagatagatttctatgagtacaagacatggaaaaagtggcaaagtagtacgagaaaattagattgtgtgctcagtttaaaycttcaggcttacagaatataatgcatcaatatggctagaccctatgtcctcctaagtttaccttggtgaccctgatttctctctctcacttccttgaagtgatctcagatagatatttatgtcagtccagccaccttttagctactggattttagccccagactccttgctgtagatttaatcatgattttctgtagttggcacttcagcttttattccagcctcaatttgctcatgagattctacctaaacaggttctatggcagcaaagcattcctgatctttggattttatggcctt

SEQ ID NO: 54458 - DNA, 601 bp, Human
agaatgggttattggacttttttttggctctttttgaggaaagtgggcaccttgatcctacatggtcttcagatcaccagccctaaagagaagaatcacattgcctcaggcttctgtgggttcttggaaatcttttccaagaatgcccaactccttttgttttaattctgcactcacaaaacaaactgatctatcatttgtacttttgagaggatttgccaatgaagagtctccttgacatacagttcattgttcccagctaagggaacctattttttaaaataacaagttggtgttctcscttatctatcttgcaaatttgattagtatctgttccttagaacctgatgaacttcagtgaaagtcatgccacagagaatctacacttacaaaataaagacctgcctcaccctcatcatgatgctccctccaagggactacaattccaaagaccctccctgccagctgtcacatggctctttcatatcttttttggtgtaatacaatctatatctcatttccttcttctgcaaatggtctggagcaggtaagacaagatccaaataatgattacaggtgcccaatttaaacggtaggtgct

SEQ ID NO: 54459 - DNA, 601 bp, Human
caagtgtgttgaaatctctgcaatagtgatcctctaagataacgtgtaaatatctatggagagagtgtgcatccatcaacagaactgagaagctactcaagaagccataatgagcatgactgatgtaaaacatttgtcatcttcaatattatgactgctgtttctagaaacaacatattcacagaagggccatgccctgcaaggtctctagagaaaagaagcactaaaaaaaccaagaatgggttattggacttttttttggctctttttgaggaaagtgggcaccttgatcctacatggycttcagatcaccagccctaaagagaagaatcacattgcctcaggcttctgtgggttcttggaaatcttttccaagaatgcccaactccttttgttttaattctgcactcacaaaacaaactgatctatcatttgtacttttgagaggatttgccaatgaagagtctccttgacatacagttcattgttcccagctaagggaacctattttttaaaataacaagttggtgttctcgcttatctatcttgcaaatttgattagtatctgttccttagaacctgatgaacttcagtgaaagtc

SEQ ID NO: 54460 - DNA, 601 bp, Human
gagaagaaattgaaaattaggaaaacagatgctttacaactgggaggagaaaatgactaaatatcctagaagataatgattgtacttcaccattcacaaagtgtcttcacatgcattatcatatttgatcctcaccaaatcagtgaggaaaatattctcttctatgagtaggaaattcagaggttaagtgactttcccaaggttatctaactagttagttacagagaacagactctgccagtgcttctgacaatacaccagagttgcctaaggtgctaaagcaagatgtttccacatttgygggcatggtgagtaacaccacccttttaacataaaactaaagtggtggtgggggttgaggatacacaacaagtgtgttgaaatctctgcaatagtgatcctctaagataacgtgtaaatatctatggagagagtgtgcatccatcaacagaactgagaagctactcaagaagccataatgagcatgactgatgtaaaacatttgtcatcttcaatattatgactgctgtttctagaaacaacatattcacagaagggccatgccctgcaaggtctctagagaaaagaagcactaaaaaaa

SEQ ID NO: 54461 - DNA, 601 bp, Human
cctgaagccacagtggagttttcataagagaggaatatgtacaaagcaattgaacaagaacagaaggaaacatgcatagacagtcaataaacagaacaagaataaaagaaaatgaacccattagttgtggaaatggagttggaatggagaagaaattgaaaattgggaaattagttggagtggagaagaaattgaaaattaggaaaacagatgctttacaactgggaggagaaaatgactaaatatcctagaagataatgattgtacttcaccattcacaaagtgtcttcacatgcattaycatatttgatcctcaccaaatcagtgaggaaaatattctcttctatgagtaggaaattcagaggttaagtgactttcccaaggttatctaactagttagttacagagaacagactctgccagtgcttctgacaatacaccagagttgcctaaggtgctaaagcaagatgtttccacatttgtgggcatggtgagtaacaccacccttttaacataaaactaaagtggtggtgggggttgaggatacacaacaagtgtgttgaaatctctgcaatagtgatcctctaagataacgtgtaaa

SEQ ID NO: 54462 - DNA, 601 bp, Human
gaagctggtgggatcatggcgggaatattgacacaatgaaaactggcaaattccataagtcagggctttttgttttctacctcagagaaggaattgtttaaagttacatcacaccactggctagcgctgaagattagtgaagaagagaagaaggaatatgatcagaggaaggtggagatcagactgtgaaaggcattaatgactagatctagcctgaagccacagtggagttttcataagagaggaatatgtacaaagcaattgaacaagaacagaaggaaacatgcatagacagtcaatraacagaacaagaataaaagaaaatgaacccattagttgtggaaatggagttggaatggagaagaaattgaaaattgggaaattagttggagtggagaagaaattgaaaattaggaaaacagatgctttacaactgggaggagaaaatgactaaatatcctagaagataatgattgtacttcaccattcacaaagtgtcttcacatgcattatcatatttgatcctcaccaaatcagtgaggaaaatattctcttctatgagtaggaaattcagaggttaagtgactttcccaaggttatc

SEQ ID NO: 54463 - DNA, 601 bp, Human; identical to SEQ ID NO: 29883

SEQ ID NO: 54464 - DNA, 601 bp, Human; identical to SEQ ID NO: 29884

SEQ ID NO: 54465 - DNA, 601 bp, Human; identical to SEQ ID NO: 29885

SEQ ID NO: 54466 - DNA, 601 bp, Human; identical to SEQ ID NO: 29886

SEQ ID NO: 54467 - DNA, 601 bp, Human; identical to SEQ ID NO: 29887

SEQ ID NO: 54468 - DNA, 601 bp, Human; identical to SEQ ID NO: 29888

SEQ ID NO: 54469 - DNA, 601 bp, Human; identical to SEQ ID NO: 29889

SEQ ID NO: 54470 - DNA, 601 bp, Human; identical to SEQ ID NO: 29890

SEQ ID NO: 54471 - DNA, 601 bp, Human; identical to SEQ ID NO: 29891

SEQ ID NO: 54472 - DNA, 601 bp, Human; identical to SEQ ID NO: 29892

SEQ ID NO: 54473 - DNA, 601 bp, Human; identical to SEQ ID NO: 29893

SEQ ID NO: 54474 - DNA, 601 bp, Human; identical to SEQ ID NO: 29894

SEQ ID NO: 54475 - DNA, 601 bp, Human; identical to SEQ ID NO: 29895

SEQ ID NO: 54476 - DNA, 601 bp, Human; identical to SEQ ID NO: 29896

SEQ ID NO: 54477 - DNA, 601 bp, Human; identical to SEQ ID NO: 29897

SEQ ID NO: 54478 - DNA, 601 bp, Human; identical to SEQ ID NO: 37662

SEQ ID NO: 54479 - DNA, 601 bp, Human; identical to SEQ ID NO: 37663

SEQ ID NO: 54480 - DNA, 601 bp, Human; identical to SEQ ID NO: 37664

SEQ ID NO: 54481 - DNA, 601 bp, Human; identical to SEQ ID NO: 37665

SEQ ID NO: 54482 - DNA, 601 bp, Human; identical to SEQ ID NO: 37666

SEQ ID NO: 54483 - DNA, 601 bp, Human; identical to SEQ ID NO: 37667

SEQ ID NO: 54484 - DNA, 601 bp, Human; identical to SEQ ID NO: 37668

SEQ ID NO: 54485 - DNA, 601 bp, Human; identical to SEQ ID NO: 37669

SEQ ID NO: 54486 - DNA, 601 bp, Human; identical to SEQ ID NO: 37670

SEQ ID NO: 54487 - DNA, 601 bp, Human; identical to SEQ ID NO: 37671

SEQ ID NO: 54488 - DNA, 601 bp, Human; identical to SEQ ID NO: 37672

SEQ ID NO: 54489 - DNA, 601 bp, Human; identical to SEQ ID NO: 37673

SEQ ID NO: 54490 - DNA, 601 bp, Human; identical to SEQ ID NO: 37674

SEQ ID NO: 54491 - DNA, 601 bp, Human; identical to SEQ ID NO: 37675

SEQ ID NO: 54492 - DNA, 601 bp, Human; identical to SEQ ID NO: 37676

SEQ ID NO: 54493 - DNA, 601 bp, Human; identical to SEQ ID NO: 37677

SEQ ID NO: 54494 - DNA, 601 bp, Human; identical to SEQ ID NO: 37678

SEQ ID NO: 54495 - DNA, 601 bp, Human; identical to SEQ ID NO: 37679

SEQ ID NO: 54496 - DNA, 601 bp, Human; identical to SEQ ID NO: 37680

SEQ ID NO: 54497 - DNA, 601 bp, Human; identical to SEQ ID NO: 37681

SEQ ID NO: 54498 - DNA, 601 bp, Human
agaaattcagctcaatggtatcagtgccctgggtcataagaggagggaaccaggtagtgaaagcacttcaaaaactgttcactacagataaatacaggataattgctcattaaaggaggttgcctggtatggtggttagaagacagaactctggagtcaggctggcagggttctaagcctgcctctgccacttcatagcacagtgaccctcagcaggtttctttatttcagttactttgtctgaaaaatggtgtggggcggtgggggcgggtggggtgggaatagtattatccatcttacmgagttgtttgaagattaaaagaaatgcttaagataaaaagccttttctggttggcacatagcaagtacctagtaaccatgagggattatagatgatcatcatcatcatcgttgttttctttttttttttttttttgagacagagtctcagtctgttgccaggctggagtgcagtggcacgatctcagctcaccgcaacctctgcctcccgggttcaagcgattctcctgcctcagcctcccaagtagctgggattacaggcgtgcaccaccacacccagctaattttttgtatttttagt

SEQ ID NO: 54499 - DNA, 601 bp, Human
tgcctctgccacttcatagcacagtgaccctcagcaggtttctttatttcagttactttgtctgaaaaatggtgtggggcggtgggggcgggtggggtgggaatagtattatccatcttacagagttgtttgaagattaaaagaaatgcttaagataaaaagccttttctggttggcacatagcaagtacctagtaaccatgagggattatagatgatcatcatcatcatcgttgttttctttttttttttttttttgagacagagtctcagtctgttgccaggctggagtgcagtggcaygatctcagctcaccgcaacctctgcctcccgggttcaagcgattctcctgcctcagcctcccaagtagctgggattacaggcgtgcaccaccacacccagctaattttttgtatttttagtagagacggagttttaccatgttggccagaatggtctcgatctcctgacctcgtaatccacctaccttggcctcccaaagtgttggggattacaggcgggaaccaccgcacccagcctgttttcttttttctaactctaaaatgctaggcagatgctatcaaaagctaaaaacaactgct

SEQ ID NO: 54500 - DNA, 601 bp, Human
ctggcacagtttgctgagtgtcctgtatagcccactaccctctctgtgccatgtgttgtatctctggcaagaaaatcagatgacgccatgcccaccccaatattggagctagttgccagggctggagccacatcagcactcagaagtcagcctatgggtaaggaagggctttgaactgctggggttctctgggaagcagctagaactcttgcctgaatggacctaggtaggtgactgtctgcatgtgccttcaccctctgtgctctgtggctctggctgggacacagatctgccctgcccwtgtctgtgccacaatagtggggcccagaaacctttgctctttctgcaagagcatggcctgcccaggccagcactgctcaccccagacccctcagaggagaggtcacagcctcatggtgtgacaggccagtgctcctgcagttgtgtattgacgaggcccaagtggtgcaggcccttggcccaggtgcaggccactagtgccagacctgggcttctgtccagtgctcctgtgagctgccttggtgtcctctctgcagaaagcagctctcttctgatgagggcaggtgtgtggtgcagggcc

SEQ ID NO: 54501 - DNA, 601 bp, Human
caggccagtgctcctgcagttgtgtattgacgaggcccaagtggtgcaggcccttggcccaggtgcaggccactagtgccagacctgggcttctgtccagtgctcctgtgagctgccttggtgtcctctctgcagaaagcagctctcttctgatgagggcaggtgtgtggtgcagggccaggctcggctctttgaggctacactatgcctgtgtgtgagctgccatggctgggagtggaaagggaagacagtgagagaggccctccaggtcagcagcctgctcaagggccaggttaacccsagtcagccctccagggaagacacagcctggagtcctcatcctgtagcaggtgggagggagtggggaggctgaacatcctgagaggaaagccctgcccttcctccttaccacctcttgctttgcttaggaggtgagacctgggaagaagaggggaaatgaagcaactgagtcaggagggacttgggaaactgtgttagcagttcctgtaattggtggcctgtgaattctgggacatcacagtgtcccctgggaagggggtcttggaagacttgatctcctggctccctatctctgggctgt

SEQ ID NO: 54502 - DNA, 601 bp, Human
tgggaaaatagggatgtctgagcctccctccttccagccagcacgcacgctgtaagcacctggctccctgttaagggccctgtggagggacagcacgggtggtttttctgtcttgctttggtttgtttgccggagcaccccctttctcctaacccacctattcccaaccccaagtggttcatctggggtttaccctgcgtttaagcctgaaggggatttgctgtttcactcaggcagctcaggactcctccaggaaggctggggaaagccaccccttcccagtgtgaactccctgggggaygtcacatgtgcacctgcaaggccagtgtagcctgaccagcgggtccagagaggactccagcctctgcggtttccaaggacactgtactaggaattcagagttctgggctttagaacctgtgtgtgtctcaacaggtcacattttcagtgtccccatgtgtaacaaggggtaatgatatgtaccacacagccgtcttgtgaggtctatagaccatatgaaaacacgggccatagccctgggtctggatcaccatgagctaccttcctccctccctccctgtcagttggcaccacctatcat

SEQ ID NO: 54503 - DNA, 601 bp, Human
ccctccttccagccagcacgcacgctgtaagcacctggctccctgttaagggccctgtggagggacagcacgggtggtttttctgtcttgctttggtttgtttgccggagcaccccctttctcctaacccacctattcccaaccccaagtggttcatctggggtttaccctgcgtttaagcctgaaggggatttgctgtttcactcaggcagctcaggactcctccaggaaggctggggaaagccaccccttcccagtgtgaactccctgggggacgtcacatgtgcacctgcaaggccartgtagcctgaccagcgggtccagagaggactccagcctctgcggtttccaaggacactgtactaggaattcagagttctgggctttagaacctgtgtgtgtctcaacaggtcacattttcagtgtccccatgtgtaacaaggggtaatgatatgtaccacacagccgtcttgtgaggtctatagaccatatgaaaacacgggccatagccctgggtctggatcaccatgagctaccttcctccctccctccctgtcagttggcaccacctatcatacaatcccagagtaatctgtgtgaa

SEQ ID NO: 54504 - DNA, 601 bp, Human
aggacactgtactaggaattcagagttctgggctttagaacctgtgtgtgtctcaacaggtcacattttcagtgtccccatgtgtaacaaggggtaatgatatgtaccacacagccgtcttgtgaggtctatagaccatatgaaaacacgggccatagccctgggtctggatcaccatgagctaccttcctccctccctccctgtcagttggcaccacctatcatacaatcccagagtaatctgtgtgaatagtttcccttgtagttgtgcagtgcacagcctgtgcacctgtatgtggcrggctggttcccagggactcctgccttcctcagttcctatcctattctattcttttcctatttctgtttttgttgttgttgttgttgttgctgttgttgttgttttgagacggagtctcgctctgtcaccaagctggactgcaatggcgtaatctcggctcactgcaacctctgcctcctgagttcaagcgattctcctgcctcagcctcctgagtagctgggacgacaggcatgcgccaccacacccagctaatttttgtatttttagtagagacggggtttcactacctctctcctgcc

SEQ ID NO: 54505 - DNA, 601 bp, Human
taacaaggggtaatgatatgtaccacacagccgtcttgtgaggtctatagaccatatgaaaacacgggccatagccctgggtctggatcaccatgagctaccttcctccctccctccctgtcagttggcaccacctatcatacaatcccagagtaatctgtgtgaatagtttcccttgtagttgtgcagtgcacagcctgtgcacctgtatgtggcaggctggttcccagggactcctgccttcctcagttcctatcctattctattcttttcctatttctgtttttgttgttgttgttgytgttgctgttgttgttgttttgagacggagtctcgctctgtcaccaagctggactgcaatggcgtaatctcggctcactgcaacctctgcctcctgagttcaagcgattctcctgcctcagcctcctgagtagctgggacgacaggcatgcgccaccacacccagctaatttttgtatttttagtagagacggggtttcactacctctctcctgcctttgtctttggaccccagtgactgccttaagcaaattaggcccttggtgttcttgcctgcacttcctaatgcctcccatcccac

SEQ ID NO: 54506 - DNA, 601 bp, Human
gatcaccatgagctaccttcctccctccctccctgtcagttggcaccacctatcatacaatcccagagtaatctgtgtgaatagtttcccttgtagttgtgcagtgcacagcctgtgcacctgtatgtggcaggctggttcccagggactcctgccttcctcagttcctatcctattctattcttttcctatttctgtttttgttgttgttgttgttgttgctgttgttgttgttttgagacggagtctcgctctgtcaccaagctggactgcaatggcgtaatctcggctcactgcaacytctgcctcctgagttcaagcgattctcctgcctcagcctcctgagtagctgggacgacaggcatgcgccaccacacccagctaatttttgtatttttagtagagacggggtttcactacctctctcctgcctttgtctttggaccccagtgactgccttaagcaaattaggcccttggtgttcttgcctgcacttcctaatgcctcccatcccacattgactaagcaccaggtccccctacctctgggagaaatgatggccccaggagtggctttgcaggccagtttgttttctgctttc

SEQ ID NO: 54507 - DNA, 601 bp, Human
ttaggaaagcagggcggggctttgtgctcacatcacagactgcacagcttgaagctcctccccacaggcccctttctgcacaggtgagctcagtaaggccagagcaggttgaaaatttgcccggatcacacatctagggaactcgggtcttcctattcctggtccacggcttctcagcacattatcatcacctgccccggaagagcacagggggtaggaatgagggcaaacctctcatctccaggtttcctctaggggtctttagggctcagaccttggcaggtctgggctgatccttgcwgcctcacattcctagcccatccagggcaccctcattggagcagagcctgcacttaaaggcctctgggtcttcccagactacgtgccggtacaggcacgcctgtgtgggcgctcctgtgcctgggcagagcagccgagtcctgacgcccttcaaaaggccttgccaaccatctgctcgggccgctctttgccgttacttctgggaagcatctaatgtggcatttcttccccgttgtcagccaaactcttcccacattttggaaattgatgccttgttattcctcttttgctcaaatgcctt

SEQ ID NO: 54508 - DNA, 601 bp, Human
ctgtgcctgggcagagcagccgagtcctgacgcccttcaaaaggccttgccaaccatctgctcgggccgctctttgccgttacttctgggaagcatctaatgtggcatttcttccccgttgtcagccaaactcttcccacattttggaaattgatgccttgttattcctcttttgctcaaatgcctttaaatcttgacggagatttttttggggagggatggggttttgtatgtacccaccgcaagtaagtgcctggtttgagggctcagcctctgagcttcaggctcacatggctgtgarctgttatagaaagagaatgtgggctgcaagtcaaggagctgggttccaggcctgagtttgccaccacctggctgtgtgagcttgggcaagccccttaatctctttgtgtccagattccctgtcctgtaagatgtgtatgccctacttacctcctgggatacagagaattatgaagagcgaatgaggtcacgtggctggaaacccgaagaagtatgctgccctgtgagggcccaggcactgcatgccagaccatgatggaagccggcgggtgaggaaggggtggctttccttactgtgttt

SEQ ID NO: 54509 - DNA, 601 bp, Human
gtgcctggtttgagggctcagcctctgagcttcaggctcacatggctgtgagctgttatagaaagagaatgtgggctgcaagtcaaggagctgggttccaggcctgagtttgccaccacctggctgtgtgagcttgggcaagccccttaatctctttgtgtccagattccctgtcctgtaagatgtgtatgccctacttacctcctgggatacagagaattatgaagagcgaatgaggtcacgtggctggaaacccgaagaagtatgctgccctgtgagggcccaggcactgcatgccagrccatgatggaagccggcgggtgaggaaggggtggctttccttactgtgtttgtctgattgatttcctcttgcctggcattacttcaaagtgctttctttccagtcatctggagcctccggttggaggggaccatagatccctgcaggctgcccagtctccaggcccggagctggctgactagacctcttagagccagcagacttgtgctatgaagtccaggaagggcagcttctctgctctgtctcttggggcttgaatctcccccgactcactagtccatatttcatgaacacttgggc

SEQ ID NO: 54510 - DNA, 601 bp, Human
ctcggggttagccaggagcagggaagtcgagcttcagagcaacccatggagtcattgcttgatggtcatggtcttcacagccacacctggctggaagcttctggcattactgagtctgtaattggatagcagctttccagagcaaataggaggcctctgcttataaaatcacggaaagagttcccagaagcccttggcctgtcctcaggcagaggcagacttcacacaggcatccccgaggcctgtaagacagcagcctgcagcctctctctcttgctgtgcctgcaaagggtcccttgtrgctaatctccatccatcctgttgtactccccaccctcacacctctggtctcagatgcagagaattgtgaaccgagaaaggaagctcggaggttgtccagctcaatcccctgatttgacaggcaaagagacagaggactagagaggggagattcttgcccaaggacacacagtaagttagtggctaagcggaaacgagaggtggactcacccaggccagtgctcctctggtgactcctacagagcacatcccatctcatagaaactagggcttaaaaggagtgctttacaaaaaacagcag

SEQ ID NO: 54511 - DNA, 601 bp, Human
ttgacaggcaaagagacagaggactagagaggggagattcttgcccaaggacacacagtaagttagtggctaagcggaaacgagaggtggactcacccaggccagtgctcctctggtgactcctacagagcacatcccatctcatagaaactagggcttaaaaggagtgctttacaaaaaacagcagggcaatgagaacagccaaggtcacagctcagcagtttcacctgcatcctctgatttgtttagatcctcacaataaccctacgactgagtcactgattcctcaaccataaaactraggcccagagattactcatttactgtctcccagatgccaaacgtggaacaggtttccacgttttccacgtttcacttccgttcagcaaatactgatagtgcacctgctgtgtgccacacaccgtgctgggtgcaggggaagcccagaagggtgaggtgctgcccctgccctgtccagctcccagtgcaccgaggatgatttcagtgagctgaagagcagaacaggagcgtgcatgatgctacaagaccactgagggcagggacagggataggcaggggtctatcctgttctggcagcatg

SEQ ID NO: 54512 - DNA, 601 bp, Human
atgagaacagccaaggtcacagctcagcagtttcacctgcatcctctgatttgtttagatcctcacaataaccctacgactgagtcactgattcctcaaccataaaactaaggcccagagattactcatttactgtctcccagatgccaaacgtggaacaggtttccacgttttccacgtttcacttccgttcagcaaatactgatagtgcacctgctgtgtgccacacaccgtgctgggtgcaggggaagcccagaagggtgaggtgctgcccctgccctgtccagctcccagtgcaccraggatgatttcagtgagctgaagagcagaacaggagcgtgcatgatgctacaagaccactgagggcagggacagggataggcaggggtctatcctgttctggcagcatggacatattgctgcccctcagcctttgcagacacagccttctcttacatcgctggtgtcatcagggattgcagcaagttgcagggacagagcctcttcccttctctgcagcttctctggtgtctttgttttccccagcctggtggaggcgtggctacagtgcaagagttgagtttggagttcaggtcttggc

SEQ ID NO: 54513 - DNA, 601 bp, Human
attgcagcaagttgcagggacagagcctcttcccttctctgcagcttctctggtgtctttgttttccccagcctggtggaggcgtggctacagtgcaagagttgagtttggagttcaggtcttggctctgacccccagcattgcatggccttgggcctttctctcaccctctataaacctccattaccttgtcagcataggactcaacactggctgccctggctgccttagcctgttctgagccattgagccaatatattggggctgagatttgctggacaggtgagagggagctgcagcycagtcttggtcctcccagcagcccctcctgtggcctgcactggcacagctaaaatccagattggggaataaggagcagcagaaggccagaggcctggcagggagttgtggaggggccctactgccctcctgctgtgagctgtttgcagaggtgggggttggggattttcttagccctctggcccctccctacccacagctctgagggactgcctttgggaggtgacagccgccttgccatgcgctgtgctgaagggaagataaaaataggctggagccatccctgggaagggaaggatgg

SEQ ID NO: 54514 - DNA, 601 bp, Human
ccttgggcctttctctcaccctctataaacctccattaccttgtcagcataggactcaacactggctgccctggctgccttagcctgttctgagccattgagccaatatattggggctgagatttgctggacaggtgagagggagctgcagctcagtcttggtcctcccagcagcccctcctgtggcctgcactggcacagctaaaatccagattggggaataaggagcagcagaaggccagaggcctggcagggagttgtggaggggccctactgccctcctgctgtgagctgtttgcakaggtgggggttggggattttcttagccctctggcccctccctacccacagctctgagggactgcctttgggaggtgacagccgccttgccatgcgctgtgctgaagggaagataaaaataggctggagccatccctgggaagggaaggatggacagagggatgtaggaaggaggggagtagtgcgggctgcaggcttcacctgaagtgggaatgcttaggcttcccgggctccagtgaggagctggctgtgcctgcgtgccagggagggagggagggaggcagggagcggccaggtgcag

SEQ ID NO: 54515 - DNA, 601 bp, Human
gctaaaatccagattggggaataaggagcagcagaaggccagaggcctggcagggagttgtggaggggccctactgccctcctgctgtgagctgtttgcagaggtgggggttggggattttcttagccctctggcccctccctacccacagctctgagggactgcctttgggaggtgacagccgccttgccatgcgctgtgctgaagggaagataaaaataggctggagccatccctgggaagggaaggatggacagagggatgtaggaaggaggggagtagtgcgggctgcaggcttcayctgaagtgggaatgcttaggcttcccgggctccagtgaggagctggctgtgcctgcgtgccagggagggagggagggaggcagggagcggccaggtgcagaatggctggatggctgacagctgggtcatctggcctcacgacttgccaactgtttgactctctcctctctgaacctcagtttcctcccctggaagtgagaacgatactcctcgcgctgcctgcctcagagcgtgtcgtgagggtgaaatgagataatgacatgaacatcttaccgtctgcagcaagcactgaacttcgag

SEQ ID NO: 54516 - DNA, 601 bp, Human
cttagtctgaaatgacagcctttgaaagtgaaagccaactcggtgcagtggttcatagcactgactccagggctaccttcctggacttgagtcccagcccattgcttaccagctgggtgaccttagacaagttcctttatctgtttgtatctctggttactcctcagagaagtggggctgatattagtgtctaatgaccctacacagagtcatcgtgaggattaaaggaatgaatgattataaagtacttaggtcagtgctgaacaccttttgaatgctattgttatttttatgggccagyggtattcaaagtgtggcccttggaccaacagcatcagaatctcctgggagcttgttagaaatgctctgcgccagacctactgaatcagaaactttggggatagagtccaaccatctgggttttaagaagccctgtgggggattctgatggaggctaagtcaggacccctgttaaagacagtcagagcttcttaagtctgactcactcacaaggcagttgcctgatgatcttgcctggtctctagcctccctctgtgaggcagggcaggctttttcctaatgatttggtttcccattcgat

SEQ ID NO: 54517 - DNA, 601 bp, Human
aactttggggatagagtccaaccatctgggttttaagaagccctgtgggggattctgatggaggctaagtcaggacccctgttaaagacagtcagagcttcttaagtctgactcactcacaaggcagttgcctgatgatcttgcctggtctctagcctccctctgtgaggcagggcaggctttttcctaatgatttggtttcccattcgatggtggcaatgagctttgggtccccagtgtgtgtcaccttggaacccttgtgctatggggagccaggatggttggtcactttagtacccargaaagggctcctaccttggtgccagaggtatgccacgggggagtggcaggaggagaggctgagaaccctgctcagactcagaatgggaaagcctaacacctccatcttcatgcgactgctgctgctcatgggctgtgtgcccttcgacaaatcacttgacttctctgagccccacttccttatctcttgtcttcctattttatgtaagaggagcctgagacacagaggtaagacctactggggctctgggtgtcagtgaatgtatagactgttggtccaccctcctacttcagctcctac

SEQ ID NO: 54518 - DNA, 601 bp, Human; identical to SEQ ID NO: 37682

SEQ ID NO: 54519 - DNA, 601 bp, Human; identical to SEQ ID NO: 37683

SEQ ID NO: 54520 - DNA, 601 bp, Human; identical to SEQ ID NO: 37684

SEQ ID NO: 54521 - DNA, 601 bp, Human; identical to SEQ ID NO: 37685

SEQ ID NO: 54522 - DNA, 601 bp, Human; identical to SEQ ID NO: 37686

SEQ ID NO: 54523 - DNA, 601 bp, Human; identical to SEQ ID NO: 37687

SEQ ID NO: 54524 - DNA, 601 bp, Human; identical to SEQ ID NO: 37688

SEQ ID NO: 54525 - DNA, 601 bp, Human; identical to SEQ ID NO: 37689

SEQ ID NO: 54526 - DNA, 601 bp, Human; identical to SEQ ID NO: 37690

SEQ ID NO: 54527 - DNA, 601 bp, Human; identical to SEQ ID NO: 37691

SEQ ID NO: 54528 - DNA, 601 bp, Human
ggaaattggaaaggtagatgaattggtggtgtgcttggtcccttttgggaggggcctaagaagcggggaccctcgcttgagtcagtgggatctcactatattctcttccccatctgtgaagtctggatttgggctctacccaccttcctccttagacctgcaaagactaaatcaatgagaacctctgagctgagtttccctcgggagatgccaaacgcgtaagactctcccaagatcccagaactaatctgtccccaccctgcaaggaaaaggtgaaggaagaaagggaagcggggcgggrcgcgatatgccacaggtaaccgccgcctgcgcgcagttaaggaacagtcctgtccaataggtctccccaacctgagctttccaggtcgcctcccgcccgcaggacctctttctctcgagcagccagaggatttggagctgctgagagcggatgaggtcctgggggagtgaaggcggcgtctgtgccgcagccgcttgtcaactctctagcgtccaagccccggccccggcccccgccaggtgcgccaggcaggctggcctccgcgttcctcacagcgccccacgctgcctccttggcgtt

SEQ ID NO: 54529 - DNA, 601 bp, Human
ttgataacttttctctgtttatgggctctgttctcttcttgcatagaatatctgcctacttaaaacggctaaaaggtcttaaacctcagagattcacaagctcagatttgcatcttagcgggcaccagctgtattgtcttctttcagtcccataaccttactcagcctcagtttctttgtaaagtggacataataaatatctctcaaaaggttacaacagagttaagtgagaccatagatactaaacgattgggcatggtaggcaatttaacaatgtgttcgttcttccctttccctgtgagactttactgaggctggacagtctttctctgaaccctgacatcccttggtctctttcctgtctttccttcccagagcagaaagcaaagttctcctgaacccggattttttaaatctagaagaacatttgagctgtaagttacccactcacatttcaagtcccagggaaattggaaaggtagatgaattggtggtgtgcttggtcccttttgggaggggcctaagaagcggggaccctcgcttgagtcagtgggatctcactatattctcttccccatctgtgaagtctggatttgggctc

SEQ ID NO: 54530 - DNA, 601 bp, Human
cacacactccagtggcttcaaagaaagaattcaaaaaagaggaaagacaaacatcagatcccgatgcctcaggaacaagtagctcaagagttgtacttccagtgggcaattttccctcaggcagaatgaatctccaagtcctttactaatattttaaaatttcctctgaagaaggacaatatgtagatatttgttttatgcataattactcctttgggtttttttttaaatgcaccggtcataatgtattgtgcaaagtgccttttgatttcaaaaacaagcctaaagattacattaatakgattgtcacaaaacactaatcattaagatgaaatgacctcataaaaatattgcttatgttgccaacatacagtagttaatttgaagataaaaataattgttgacaaaaatcacatttctgtcaaatgtctgttcaaaaatcagtgaaataaaaaactaatctcttatctcctgtatccaacatccttctttctgtgcaaattaaaccatctaaatctgagtaaaataaaatctgtgtaaaataaagaatcttgttcacagcaggcttttagtaaatatttgttgaaaggatacagtttag

SEQ ID NO: 54531 - DNA, 601 bp, Human
gtatgaggatgagtaaattatttactcagagtgtttggcacacagagtgtaacaccctgtaagcactcaaataataacagatcacacactccagtggcttcaaagaaagaattcaaaaaagaggaaagacaaacatcagatcccgatgcctcaggaacaagtagctcaagagttgtacttccagtgggcaattttccctcaggcagaatgaatctccaagtcctttactaatattttaaaatttcctctgaagaaggacaatatgtagatatttgttttatgcataattactcctttgggtttttttttaaatgcaccggtcataatgtattgtgcaaagtgccttttgatttcaaaaacaagcctaaagattacattaataggattgtcacaaaacactaatcattaagatgaaatgacctcataaaaatattgcttatgttgccaacatacagtagttaatttgaagataaaaataattgttgacaaaaatcacatttctgtcaaatgtctgttcaaaaatcagtgaaataaaaaactaatctcttatctcctgtatccaacatccttctttctgtgcaaattaaaccatctaaatctg

SEQ ID NO: 54532 - DNA, 601 bp, Human
atttgatagaaattctctaaaacattaatatttaatatacttagatgtaattatgagtattttctacttttgggatttttccatttttcattaggaaaaaatgtttttataatttaaaaaatttttacataataattttaagaataaatatagtttttaaaaagcaagaatgaggtcgcatttatccaacaagtatacaacagtttactatcatacctgaagagcctgagatctggagtcatactgcctgggtttgaactctgattcctcgttattgtgtgaccttgggcaaggaagttayttaaccttttcttgctccagttttccacctgcaaaatgggcgtgcctacctaaatgggttggtatgaggatgagtaaattatttactcagagtgtttggcacacagagtgtaacaccctgtaagcactcaaataataacagatcacacactccagtggcttcaaagaaagaattcaaaaaagaggaaagacaaacatcagatcccgatgcctcaggaacaagtagctcaagagttgtacttccagtgggcaattttccctcaggcagaatgaatctccaagtcctttactaatattttaa

SEQ ID NO: 54533 - DNA, 601 bp, Human
ggaaaatactataaaatgttaggtaattaaacagaactaaaaaaccatatattcaacataacaagcatgtgtgaaaatctactaaggaaaaagatttgatagaaattctctaaaacattaatatttaatatacttagatgtaattatgagtattttctacttttgggatttttccatttttcattaggaaaaaatgtttttataatttaaaaaatttttacataataattttaagaataaatatagtttttaaaaagcaagaatgaggtcgcatttatccaacaagtatacaacagtttaytatcatacctgaagagcctgagatctggagtcatactgcctgggtttgaactctgattcctcgttattgtgtgaccttgggcaaggaagttatttaaccttttcttgctccagttttccacctgcaaaatgggcgtgcctacctaaatgggttggtatgaggatgagtaaattatttactcagagtgtttggcacacagagtgtaacaccctgtaagcactcaaataataacagatcacacactccagtggcttcaaagaaagaattcaaaaaagaggaaagacaaacatcagatcccga

SEQ ID NO: 54534 - DNA, 601 bp, Human
atcctttctccctgtctctccgtcttattctctgtcttagcaacacacagcacgagataaagccaagacagcctgatgcttgttccttaatgcaccctcagtatcaagccaaatgactccttaagcctcgaaacagatatgtatgattatatcaagaccctaaagaatgttcataacctttgaaccacttctggaaatcctaagaaaatagatctaacctttgaaaagaatttagatgcaaaaaatgtacatcacagcttcaatgaacctagcctcaccccaagacaaattaaatgtccarctataaatgaatatataggtaaattattatttttacagtagatgaaataagcagatattaagaaatctgtgataatgttggaaaatactataaaatgttaggtaattaaacagaactaaaaaaccatatattcaacataacaagcatgtgtgaaaatctactaaggaaaaagatttgatagaaattctctaaaacattaatatttaatatacttagatgtaattatgagtattttctacttttgggatttttccatttttcattaggaaaaaatgtttttataatttaaaaaatttttac

SEQ ID NO: 54535 - DNA, 601 bp, Human
gttaaaggctcctgggttgagcacagaaacttttaaaacaacttgagtccagactttgatgtccccattgccatacatggcagggagtcaacagcagaacgggaagtaccccaagttgcagaaacaagttgccaggctgtggcaaaattcaataagtagacaacgtttgtattccatctagtaacaaaaaatatttatgctccccctacagctggctgagggcccttcattagagcatcactgcaagcccttccactgtccctcacccattcctcctcaggcaaggaaatgtgaattaccygatgggtcaatctgggagcaggacctgccaaaggatgcgtacagctcagcccttctgctgtcttttcagaacaggtaccactgtgagaggcctgtggttgcccagccatgatcatagctaattatttctgaggtactgtgttataaggcccatataatccaaaaatctaagccacattcccccaaaccagctttaccagtaataaaaggtggtaatatgtctctagttacctaattcctggatctctcagttagttctgaacttgaatggagaagaagggtgccattttgaggccccctc

SEQ ID NO: 54536 - DNA, 601 bp, Human
acttgaacctaaaaataatttttttaaaacaaaagacagttaagagaataaaagagacaagtcacaaactgagagaaaatatttgctaagtttatacctggcaaaatacttctatccagaatacataaacaacttttaaaactcaataataagaaaacaaacaacccaatacactagaacttagatttgtttatcacatgagtaacttttggcaagtaaagggcattgactgacagcatgagacacagagttaagttttaaaagatagaagtaagatcatgtactgctgatacaagagggmaggcagagaggcaagagagaaccagagtctatacatgaaaaaagatcttgggatgtttcgtggttagaaagaaaaaatatcaaaaccaaattaccctgttttcttcacagtaacttctaggatcagccttaacaatatggagcaaatattaaaaaaaagaaattgaaagaggcccagagcctaatttaagacttgggtagtaggactggataatatggcatagttacagaagatgtttggaatctaaaagtagagagatactccaagactgagtatacaaagtataaggcaaatttaagt

SEQ ID NO: 54537 - DNA, 601 bp, Human
aaaatatctgcaaactgtgcatctgacaaaggtctaatatccagcatctataaggaatttaaactaatttacaagcaaaaaccaaacaattcaattaaaagtgggcaaaggacatcaacagatacttttcaaaacaagatatatgtggccaacaaggatatgaaaaaatgctcggcatcactaatcattagagaaatgcaaatcaaaaccaccataaaatatcatctcacatcaatcagaatagctactattaaaaagtcaaaaataataaatgctggcaaggttatggagaaaagggaaygcctatacactgctaggaggaatttctcaaataatttaaaacagaatcaccattgaactcagcaatcccattattgggtatatccccaaaggaatatatattgttctaccataaagacacatgcatgtgcatgctcattgcagcagtattcacaacagcaaagacatgaaatcaacctaaatatccatcaatggtggactggataaagaaaatgtggcatatatacaccatggaatattatgcagccatgaaaaataatgagatcatgtcctttgcaggccattatcctcagctaactaa

SEQ ID NO: 54538 - DNA, 601 bp, Human
taaaaccataaacaccctagaagaaaacctagaaaatgccattctggacataggatctggcaaagacctcatgacaaagacaccaaaagcaattgcaacgtaaccaaaaattgacaaataggacctaattaaactaaagagcttctgcacaggaaaaaaaactatcaagagagtaaacatgcaacttacagaatgggaaaaaatatctgcaaactgtgcatctgacaaaggtctaatatccagcatctataaggaatttaaactaatttacaagcaaaaaccaaacaattcaattaaaagygggcaaaggacatcaacagatacttttcaaaacaagatatatgtggccaacaaggatatgaaaaaatgctcggcatcactaatcattagagaaatgcaaatcaaaaccaccataaaatatcatctcacatcaatcagaatagctactattaaaaagtcaaaaataataaatgctggcaaggttatggagaaaagggaacgcctatacactgctaggaggaatttctcaaataatttaaaacagaatcaccattgaactcagcaatcccattattgggtatatccccaaaggaatatatat

SEQ ID NO: 54539 - DNA, 601 bp, Human
ttccagctcttccacatcctcacaaacacttggtatggtcagtattttttatttgagccattctatcagacacatagtgataccccattgtggtttaatttgcatttccctaatcactaataatgagcatcctttcatgttcttgtttgccaatcatacgttttctttggcaaagtatctgttcatataattctcctatttttaaagttaaggtgcaaaggcagttcattggacaaaaagtagtattttcaacaaatggtactaaaacaattgactgtccacatgcaaaaaacaaaaaacaaaaaaaaaaaaacacaacaaaaaaactttgattcaaacttggaaacctactttaaaaattaattcaaaatgtgtcatagacctgaaattaaaacctaaaactacaaatcttgtagaaggaaatataagagaaaatcactgtgaccttagattaggcaaaaattttttagatatcacatcaaaagccaaagaaaaatggaaaaattagacttcatcaaaattaaacatttctgtttttcaaaagacagttaagacaaattacaccagatgtgtaaagaagagctggtaccactcctactta

SEQ ID NO: 54540 - DNA, 601 bp, Human
gaggctatggttggaccagatgtaccccaagtggcttccactgtgggcacccacatctggatgaagggaacatggtggtgcctggaagcttggagatgccaggaaccacaaagccccaaagagggtgtcatagccctggctcagggctcccctagttctgggctccccgaagggtcccagctcttctctccttcttgttgcctgcaatgtgacaagcaggggggcatgtttcagacctgtttgtgttacagctctttcagtccccgcattcagcaggtcctgatttcttgtcccgtgtccrggaacaatgaggtacgcaaacaactggaggatgagcaaggcagagaggagcttcagtgagtgacagagaggctctcgggagacccaaagtgggcagttccttcccacagctggtagtcctgatgtctgcccaagtctggatgagtccagagtttttatagcctcagaaggaagggcgtgctgattggtccatgggccaccatgagcaggttcagaaaaagcaccataaattgtcactctgggccactgactccatccagaattgacagcccagcacccaggcttcaggccatccctggct

SEQ ID NO: 54541 - DNA, 601 bp, Human
ctgagatgatcaatacaatttctaaagctctagtcaaaaagatctggaaaaaaagtggaaaatataaattaccatgattaaggatgaaagagatgagatcctctcagattcaaaatattaaaaggataatagtttggactttgccaagtgctactttgccaggtaacatgattgcatgttaagggatcatcaacatcttgatacaaaggagaaatagaaagatgacaatttcataagtgggttgtgtcatagcagctcagtgggggagatctcacacacgaagtgtgacttttaaaatccytcagaacagtaactacttatggggtgtcatatctctgctgagatttaattgcatggtcagtttgtaaaatacatcttaaaattttgtaatacagtattatttcttctataaggtataataggagttaaataattaaatactttaataatactaaaaggaaaaaatacaaacctaaattatcagctatttacatcactttatattccaatcatggtcaattttcatttgtacatgtcaacatggattaaatcagagtgtactctttatgtgctactttttaactaaatggctccatatatt

SEQ ID NO: 54542 - DNA, 601 bp, Human
tttcaagacagagtgctgaaaaggacagagacacacggagacctgcagagaattttcctcaagtattagcagagtgttaattcatgcatttgtgtgaggaaagaatcacccaaaagaattaaagggaacagtatccagtgatcacacatggccacaaatagagcctgtacccataagccagatagaaaagctcatataagacattgggtagaatactcaaaaaggctttacctcagaggaaattattaattagccctagcattaacactcttctggaaccactgaacaaatcagatcaaarcctgaaatgatcaaattgtttccaagtaacttaacttcatcccagaacaaagctcaagaatatttatagaaacacaaaaatatccaacacccaatgaggtacaattttctgaccctccaatcaaagattaccaggcatgcaaaaagggaggaaaacactgcttattataggaaaaataattaatcagtcaaaactgacaccgaaatgacacagatattaggttagcaatgatattaaaacagctgttataactgcattccatgtgttcacaaaattaagtagggacatggaagagagaaa

SEQ ID NO: 54543 - DNA, 601 bp, Human
ttcttcctgcctctacattaaaatagatgttcaatccaaacatctaatgaattaccaaggttttaaaaaactttgaggattccccagaatgatagaaagaataatgatcattggagtgaaacctcccataggcatgctactgaccactggctccattttaaaaaaatttttaataccccagaagatcaaaatcaaagagaatcagatcaacttcatggcctgagtaactaaatcaacttatttgaataactagtttaccgttttctataaattgatcaacttgaggtggattttggcatcrtgaaacaacagttgctcagccactcatgctaactgattattacaaaatcaagaaaatacaaatattgacatgggatggttttcagcttgaagtaaaaagctcagcaagcctatgaagagcagctaaggacataacaggcactttcactgttggataaatacatgccatttctctgagctataattttgtctcctttatttctcaatgtttgcaaaaagaaaattgtggttttctaagttcagttgtttagcttcttagtgcagcccaggtttacaggtcttttttttcctttttaaaaaa

SEQ ID NO: 54544 - DNA, 601 bp, Human
tggtaatactgggagaccttggaactgtccactcagtatctttcttcctgcctctacattaaaatagatgttcaatccaaacatctaatgaattaccaaggttttaaaaaactttgaggattccccagaatgatagaaagaataatgatcattggagtgaaacctcccataggcatgctactgaccactggctccattttaaaaaaatttttaataccccagaagatcaaaatcaaagagaatcagatcaacttcatggcctgagtaactaaatcaacttatttgaataactagtttacckttttctataaattgatcaacttgaggtggattttggcatcatgaaacaacagttgctcagccactcatgctaactgattattacaaaatcaagaaaatacaaatattgacatgggatggttttcagcttgaagtaaaaagctcagcaagcctatgaagagcagctaaggacataacaggcactttcactgttggataaatacatgccatttctctgagctataattttgtctcctttatttctcaatgtttgcaaaaagaaaattgtggttttctaagttcagttgtttagcttcttagt

SEQ ID NO: 54545 - DNA, 601 bp, Human
cccattgtcaaccccatgcaaatgttatctggttttaactatctaatggtcctaatctggcagatccatttaaatcatgcaaaatctttgagatgattagcttgtgaatatctaaaatacagcagaaaacctttaagttccctgcttatgtttttaagtatttatggcatgtcctggtaatactgggagaccttggaactgtccactcagtatctttcttcctgcctctacattaaaatagatgttcaatccaaacatctaatgaattaccaaggttttaaaaaactttgaggattccccrgaatgatagaaagaataatgatcattggagtgaaacctcccataggcatgctactgaccactggctccattttaaaaaaatttttaataccccagaagatcaaaatcaaagagaatcagatcaacttcatggcctgagtaactaaatcaacttatttgaataactagtttaccgttttctataaattgatcaacttgaggtggattttggcatcatgaaacaacagttgctcagccactcatgctaactgattattacaaaatcaagaaaatacaaatattgacatgggatggttttcag

SEQ ID NO: 54546 - DNA, 601 bp, Human
agactctattagcacagcaatattaacctaattactttctctagtaagacaaatattaaggcctcctagacatataatgatattttccccaaagagcaatgactcaagacttcttcccatcttactctgccatgctggaagacagggcagccacatcccattgtcaaccccatgcaaatgttatctggttttaactatctaatggtcctaatctggcagatccatttaaatcatgcaaaatctttgagatgattagcttgtgaatatctaaaatacagcagaaaacctttaagttccctgyttatgtttttaagtatttatggcatgtcctggtaatactgggagaccttggaactgtccactcagtatctttcttcctgcctctacattaaaatagatgttcaatccaaacatctaatgaattaccaaggttttaaaaaactttgaggattccccagaatgatagaaagaataatgatcattggagtgaaacctcccataggcatgctactgaccactggctccattttaaaaaaatttttaataccccagaagatcaaaatcaaagagaatcagatcaacttcatggcctgagtaacta

SEQ ID NO: 54547 - DNA, 601 bp, Human
atttgtatttcaattttattttagttcttcccaaattgctcttaaaaaaagaaaaagaaaagatttaaggccataaacatagatgtataaagtgctgtaagatggcctaaaatttaaagaaaaaggaggcaaatgaaaataaagatatgaaagtaaggtgaattgactaatgaagttagcacctagactctatgtcaacaagtcaggtatgtttgtctactgaataggacaaaaatttatctatgaactttctagtaaccaatacatcagtgcccataagtaaaagtaaacaaaccaacacacacacacacacacacacacacacacacacacacacacaaagccatacaacacaccccaaccaccaaagtaagctctgaagagtaatctcaaagtttcctccaggaactgttaagatttaagtagaacagagtggtttgtgaaggtacctatagaactttatcatcactttttaaaaaattgtacgttcccacaatatctatgtacataccaatccccccccccccctttttttaaaaagtcattgaccattgggaatcaagtattttaggtaggtgagaggacaggtgctccaggatat

SEQ ID NO: 54548 - DNA, 601 bp, Human
atgttgatttgtatttcaattttattttagttcttcccaaattgctcttaaaaaaagaaaaagaaaagatttaaggccataaacatagatgtataaagtgctgtaagatggcctaaaatttaaagaaaaaggaggcaaatgaaaataaagatatgaaagtaaggtgaattgactaatgaagttagcacctagactctatgtcaacaagtcaggtatgtttgtctactgaataggacaaaaatttatctatgaactttctagtaaccaatacatcagtgcccataagtaaaagtaaacaaaccaacacacacacacacacacacacacacacacacacacacacacaaagccatacaacacaccccaaccaccaaagtaagctctgaagagtaatctcaaagtttcctccaggaactgttaagatttaagtagaacagagtggtttgtgaaggtacctatagaactttatcatcactttttaaaaaattgtacgttcccacaatatctatgtacataccaatccccccccccccctttttttaaaaagtcattgaccattgggaatcaagtattttaggtaggtgagaggacaggtgctcca

SEQ ID NO: 54549 - DNA, 601 bp, Human
agaaattggaccgcaaaacctagtaaaaggcttaactcagtaaaaccataattttttttcttgtaatggtctggttgatcaatttttttcaagggttataccataggaaaaactcaatgtgaaggctacctagtaatcaacaatttgttttaattttggtattgagggagtaggaatggagaatgataaaatggagatggagtaggaatggatgagaaatggaaattcatccacatccccagaacccattctggccaatttctggtcaactctggtctggatatctgtgacctagaaatcyggagtacagcaccctgggggctcttgattttgcaattgccctagagcaaactcaaaggctgttattgcttctaaaataggaccagcttccttatattctcctgaacaaaaaggaactcatcacgaaagcagcctcctagagcctgctccaggcctgacacaggtcagtgctgcctgaccttctgatgcagagtctcaggttgaacaatcctctgataggactagtgctatctcactttcagatcggcactatgaagcactttagaaactaggctctatagagtccaaatctgccgataat

SEQ ID NO: 54550 - DNA, 601 bp, Human
gaagctggaattttccagttatgagagttaataaattagggtttcacttaagcctattcagattgatttttctatcacttgggacagaaaacatgtcctgataatgtagcatcaccctgttctcttttaaaataagcatcagacttttccaaatgtaaacccaaaattagccaggcgtagtcatgcagcctgtagtcctagctactcgggagggtaaagtaggaagatctcttgagcccaggagttcaaggccagcctgggcaatatagtgagatcatatctctaaaatgaaaacaaaatmaaaaacagccatcattggtgagattttgggtacacattttagcacaaaatagagtttctcaaaaaattgttctctttggagcaaaaccaccaggaagcctttccttgttggagctctctatatgccaaaggccattgggccaaccagtcctctgagcacttgctccacttctgtgggtccttgccgagaagtaactacaaacattgacaataaatagtcacttgtttgtatatttggatggtacctgttgtgtaaataatggttttagacatattagagaatgggatgtgcaggccaaat

SEQ ID NO: 54551 - DNA, 601 bp, Human
gtatagtttttcaatatggacattccctgtggtattggatatccccagggaacactgcctcaggagaagcagttagagaagaatcctaaaacaaatgtggaaaaacagaaagatcattttgcctgaagtctcttgatggttgccttgcatgttgagaatgatcacacaaggtgactttggctcatcccttctaaggtggcggataaggagtagtcagtgatgcaggatttcattttgcttttccctggcatcaatttgcatttttcacctggctctctggaaacatgttgctttaaacatkccttccattactcaaatggtagaaatttccaacatgtttcaggaccatgaaaaatatgtagggacagatggttcttcggtatcaatcagactgtgttcatgtaggcttattctgtttatgtgccctggtgatgaatagtcctggtaagatggcctctatcctgatcgtgtgtgtgtgtgtgtgtgtgtgtgtgtgtgtgtgtgtgtgtgtatgtgtgtgtgtgtgttaccgccaggccagtgaagaatttaaagcttacagacataaggtaatgtgcccaaggccacacagctacaaaga

SEQ ID NO: 54552 - DNA, 601 bp, Human
gatgaaggtctttaactgtcaacaccactccataaaaactgggagagatggctgttttttcaaatgtgcagacaccaaggcaaagctacaagaaacataaaaaatctgggaaacatgacacaatcaaaggaaaaaacaaatctccagcaaccaaccctacagaagtggagatcttttagatgcctgacaaagaattcaaaatacttatcataaagaagtttaatgagttacgagaggaaacatatgaacaaccaaaggaaatcaggaaagtaatacctgaaaaatgagattctcagtaaamagataggaactatacaaagaaccagacaaattctgcatctgaggaatctaattgctgaaagaaaaacaatcaatagaaagcttcaaacacagaattgatcaaacctaagaaggaatcagtgaactcaaagacaagttatttgaaattatccagttataagtgcaaaagaaaaaagaatgaaagagttaagaaagcctaagggacatatgagacatcatcaagacaacaaatatatacattatggtgattctagaaggaaagcagagagacaataggaaaaaaagcttatttaaagaaaca

SEQ ID NO: 54553 - DNA, 601 bp, Human
agaacagtgtgtggacactgcgtatggtttctactgaatgcattttgctttcataccttcatatagtcaaaaagttttaagtagaactgttgaatttcagggaccatctgtatacagaaagtcaaaggaacttggataactaaaataattggaaaaaaaaagtcagagttcctatcagatttaagacttattaaatagttatagtgatcaagactatgtgctgttggtggtgggatagacacatagattgacaaaacagaatataggacccagaaatagagccataaaaataggctcaaawgattttttataaaggtggagaagcaaatcaatggaggaaaattagcctttcagtcaggagacaatcctcaggatctaggactaagcaaagaggtctcagacttgacaccaaaagcaccatccataaaaggaaaactcataaattggacttcatcaaaatttaaaacttttgcacttcaggggagtgatatcagcaagatggtagaataaatggtccctcacctcattattccacagaaacatcaagctaacaataatatacacaccaaaatacctttgtgagactacttttatgagaagt

SEQ ID NO: 54554 - DNA, 601 bp, Human
aaaatacatttaatacaactaacccaccaaatataacagcttagcttgctttaccttaaacttactcagaacacttacattaacctacagttcagcaaaataatctagcacaaagcctattttataataaagtgttgaatatgtcatgcaatttatttaatagtactgtgctaaaagtgaaaaacagaacagtgtgtggacactgcgtatggtttctactgaatgcattttgctttcataccttcatatagtcaaaaagttttaagtagaactgttgaatttcagggaccatctgtatacrgaaagtcaaaggaacttggataactaaaataattggaaaaaaaaagtcagagttcctatcagatttaagacttattaaatagttatagtgatcaagactatgtgctgttggtggtgggatagacacatagattgacaaaacagaatataggacccagaaatagagccataaaaataggctcaaatgattttttataaaggtggagaagcaaatcaatggaggaaaattagcctttcagtcaggagacaatcctcaggatctaggactaagcaaagaggtctcagacttgacaccaaaagc

SEQ ID NO: 54555 - DNA, 601 bp, Human
ttgatagaagcattattcacaatagctaaaatgtggaagcaatcaagtgtctattgacagatgaataaatggataagcaaaatgtggtatatacttacaatggctttataaaggaagaaaattctaacacgtactataacatggatgaaccctgagagcaatgtgctaagtgaaataagccagtcacgagaagacaaattccatatgattcacttatatgaggtagttaaaagtagtcaaaagcatagaaacagaaagtagaatggtggcttccaggggctggaagtagagggaattatttttattattattattattattattattattattattattattattatttaagatggagtctcactctgtcacccaggctggggtgcagtggcacaatctcggctcactgcaaccgccgcctcccaggtccaagcgattctgctgcctcagcctcccaagtagctgggactataggtgcccaccaccacaccagtctaattttttgtatttttagtagagagggggtttcaccatattagccaggttggtctcaatctcctgacctcatggtccacccgcctcggccttccaaagtgctggg

SEQ ID NO: 54556 - DNA, 601 bp, Human
gaaatgtaaaatggtgcagccactgaggaaaacaatatggtggttactcaaaaattaaaaatagaattactacatgacatagcaaatccacttctgaatatgcatctaaaagaactgaaaacagggtcttgaagcaatatttgtgcacacattgatagaagcattattcacaatagctaaaatgtggaagcaatcaagtgtctattgacagatgaataaatggataagcaaaatgtggtatatacttacaatggctttataaaggaagaaaattctaacacgtactataacatggatgaamcctgagagcaatgtgctaagtgaaataagccagtcacgagaagacaaattccatatgattcacttatatgaggtagttaaaagtagtcaaaagcatagaaacagaaagtagaatggtggcttccaggggctggaagtagagggaattattattattattattattattattattattattattattattattattatttaagatggagtctcactctgtcacccaggctggggtgcagtggcacaatctcggctcactgcaaccgccgcctcccaggtccaagcgattctgctgcctcag

SEQ ID NO: 54557 - DNA, 601 bp, Human
gaataaatgtctctccaaagaagctatgcaaatggcccataagaacctgaaaagatgctcaacatcactaatctttagggaaattaaaatcaaaactacaatgagataccatctccaaccaaaccaattaagatggctactattaagaaaacaaaaaataacaagtcttggcaaagatgtggagaaactggaacacttgtgccctgatagtagaaatgtaaaatggtgcagccactgaggaaaacaatatggtggttactcaaaaattaaaaatagaattactacatgacatagcaaatcyacttctgaatatgcatctaaaagaactgaaaacagggtcttgaagcaatatttgtgcacacattgatagaagcattattcacaatagctaaaatgtggaagcaatcaagtgtctattgacagatgaataaatggataagcaaaatgtggtatatacttacaatggctttataaaggaagaaaattctaacacgtactataacatggatgaaccctgagagcaatgtgctaagtgaaataagccagtcacgagaagacaaattccatatgattcacttatatgaggtagttaaaagtagtc

SEQ ID NO: 54558 - DNA, 601 bp, Human
attcccctaataaatcctttcttatatctcccccgcctctctctacatagatagatagatagatagatatagatatagttagatagatacagatatagatatagatatatatctcctattaattctgtctctctgaagaaccctgattaaaacagatgtcaagaccattcagtggagaaagaacagtcttttcagcaaatcatgctgggaaaactggatatccatatgcaaaataaataaattagacccttacctaatactatatagaaaaattaactcaaaattgatcaaagacctaaayataagaaaaaaactataaaattcttaaaagaaaacgtaggacaaaagcatcatgatactgtatctggcagtgatttcttggatatgctaccaaaggtgcagccaacaaaagaaaaaacagaaaaactgaacttcatggagaatctttaaaattgtacatcaaagacactattaatagaggaaaagggcaacccacagaatgggagaaagtatttgcaaagcatatatctgacaagagattgacatccagaatatataaagcactcctaaaactcaacaacaacaacaaaaaattgggcaa

SEQ ID NO: 54559 - DNA, 601 bp, Human
gaaggaactaaaattatctctgcttacagatgatatgatcatgtgtctagaacactctaacgattccacatacatttttaaaaaactgttaatagacgaattaagcaaagtagcaggatagagagttgacacacaaaaatcagttgcatttctatacacttacaataaacaatatgaaaaggatattaagaaagtctcatttacgatagcatcaaaacaaataaaatacttaggaattaactaaagacgtgaaagacttgtacagtaaaaaattataaaatattgctgaaagaagttaaaraagaatataaaaatggaaaacattccatgttcatggactggaagacaatatttttcaaatgtccatactaccaacacaatctattgactcaatacaatccctatcaaaattccaatgacttttttttttcagaaataaaacagtccactataaaattcaaatggaatctcaagagacatcaaaaagccaaaacaattttgaaaaaggagaaaaaatattgaggactctcatttcctgatttcaaatcttactaaaaactatagtaatcaaagcaatatagtactggcatatagacaataa

SEQ ID NO: 54560 - DNA, 601 bp, Human
gaaggagctgttaaagtagcagagttttatgttattgaaattaagctggtttataagttagaatgttataaatttaggatgttaaatgtaattccaatggtaactgcaaagaaaatagctatagaatatatacaaaagggaacaagggatggggagttatacggtgtagagaaaacaaatataaaaattatagaagtaagttcctccttttcagtaatagcatacatgaaaatgtattaaactcttcaaccaatatagatgagcagaatggattttttaaatgatccaaatatatgctgtytacaagagactcactttagctccaaagacacaaataaattgaaagtggaaaaatggaagatgacatttcatgcaaatggaaatgaaaaaagagcagatgtggctgtactaacaggcaaaatggactttaaatttttttaaaaatggttacaagaaacaaaaaaagtacttaatcttaaaaggttcagtatagcaagaagatagaagacttatgagcatttatgcacctaatgacagaccatcaaaataaagacagtgaaaacttcagaattgaagtaaaaagagacatttctgcaataat

SEQ ID NO: 54561 - DNA, 601 bp, Human
gacaatacaaataaagattttgaaaacctaaaaagaacatctggagctaaaaattaaaataacagaaatgaaaaatttactagagggctttgagggaagatatgagtaggcaaaagaaagaatcagagaactcaaagataaggcaatggaaatcatcaagtctgaggaacaaaaagaaaacaaaattgaagaaaagtgagcagagcccaagagacctgtgagacatcatcaaggggctcaacatacacaccatgagagtcccagacaacgcagagagaaagaaaggagtagagagaatatrggaagaaataatggtgaaaaattcttcgaatttgaaaaaagacatgaacataaacctccaagaagctcaattaactccaagtaagatgaattcatagatacccacatggatatacattataatcaaactttccaaatacaaaggcaaagagaaaatcttgaaagcagcaagagatagaaatgacttgtcacataccaagcatctgcaataagattatctacaaatttctcatcagaaattttagagataagaaggcagtgggctgatattttcaaagtgctaatataaaaaagaaactgt

SEQ ID NO: 54562 - DNA, 601 bp, Human
tgacaatacaaataaagattttgaaaacctaaaaagaacatctggagctaaaaattaaaataacagaaatgaaaaatttactagagggctttgagggaagatatgagtaggcaaaagaaagaatcagagaactcaaagataaggcaatggaaatcatcaagtctgaggaacaaaaagaaaacaaaattgaagaaaagtgagcagagcccaagagacctgtgagacatcatcaaggggctcaacatacacaccatgagagtcccagacaacgcagagagaaagaaaggagtagagagaatayaggaagaaataatggtgaaaaattcttcgaatttgaaaaaagacatgaacataaacctccaagaagctcaattaactccaagtaagatgaattcatagatacccacatggatatacattataatcaaactttccaaatacaaaggcaaagagaaaatcttgaaagcagcaagagatagaaatgacttgtcacataccaagcatctgcaataagattatctacaaatttctcatcagaaattttagagataagaaggcagtgggctgatattttcaaagtgctaatataaaaaagaaactg

SEQ ID NO: 54563 - DNA, 601 bp, Human
gcctgtatcaaaatacttcatgtacctcatgaatatatacacctactacatacccaaaaaataaaatttaaaagcctaggcaacatagtgagacctcatctctattaaatttatttatttatttatccaggcatggatggcacacacctgtagtcctagctactcaagaggctaaggcagaaggatcacctgagccaaggaggttgaggctgcagtgagctaactgaaccatgtactacagcctggatgacagagcaagaacctgtctcaataaataaataaataaataaactaaaagtamatgtggatgaagtcaagaaaacaatgtataaaacaaaatgacaatacaaataaagattttgaaaacctaaaaagaacatctggagctaaaaattaaaataacagaaatgaaaaatttactagagggctttgagggaagatatgagtaggcaaaagaaagaatcagagaactcaaagataaggcaatggaaatcatcaagtctgaggaacaaaaagaaaacaaaattgaagaaaagtgagcagagcccaagagacctgtgagacatcatcaaggggctcaacatacacaccatgagagtcc

SEQ ID NO: 54564 - DNA, 601 bp, Human
tcatttttctctttttctccttttgggagccagatattaaagataaggacattcacaaacaactgaatatatggggaaaattagaaagttaacacacatgaccacagaaagatgcaagctcagagaataccagtaaagaccttatgtttacacctcaggctgatccttggcacagagacagactaaagcaatttttataaacaaacaaaacaataacaaaaagcaaacaaccttgaggaaaaagaagagtctgcatcccagagttaccacatcattaaattgaaatacccaactttcaacaaaaaaaaacacaaggcattcaaaaaaaaaagaggaaaatatagcccattcaaaggaaaaaatagtcaacagaaactgcccctgaaaaagacctaacagcagatctactcaaaaaagactttaaaataactgtcttgaagatactttaagaactggaaaagagggagggtggagcaagatggccaaacggaaacctgcaacaatgatccccactgcaggaagaccaatttaacaactatctacacacacaaaaagcaccttcgtaaaaacagaaaatcagataagcaatcacagtacttgg

SEQ ID NO: 54565 - DNA, 601 bp, Human
gaaacatttggatggtacattgcagttaactttgatttcagctcagtcaattttagctcttagcacagtaacagctacccatttcctatccccacccctgtggcaggcagctgtgcatgtattcctgcagcagcttgttgcacacagcttgaaggagccaggataagcaaaatggaccctgtcctctaagtatcaggcatatgtgcttagattgatgattgctgcttctgatcagagaggtacagacaaagaggtggtgggtctttgctgttacaccttattccattgttgcaaacccctycccatccagctgaaatgacttccagagatttaaagggctggcaccctatttccactccctttttcatttttctctttttctccttttgggagccagatattaaagataaggacattcacaaacaactgaatatatggggaaaattagaaagttaacacacatgaccacagaaagatgcaagctcagagaataccagtaaagaccttatgtttacacctcaggctgatccttggcacagagacagactaaagcaatttttataaacaaacaaaacaataacaaaaagcaaacaaccttgag

SEQ ID NO: 54566 - DNA, 601 bp, Human
tgttttcagaatctggccacatctcactaactccattattccatctgagtttaatctctcattaaacctctcccgggtatttgtaaaagcctcctcatttgaccaccacatttactccaccgcaatctattctccatatagcagaccaataaagctgtaaactggatcatattacttctctctgaaaacctccttcatgactaaatgaaagcccaaattcttgactgccttcaagaccctagacaatctgattccccaactacatctctgctctcttctaccacttttgtctttgtccatytcactgcagccactctgctcaaatgttagcttccctgaccaccttatgtaaaataaataacctccaatgcctccagcactcactagcctcataaatctactttactttttccagtagcattttttactaacatattctactttctgtgtttattgtccacctcttcccacaagaatgtatgcaccataaagagagaaatgttatctattttgttcatcactatatctgcaatgccttgaacagtgcctgggacacagcaggcctggaatgaattttgaatgaaagagagtctatcatgtg

SEQ ID NO: 54567 - DNA, 601 bp, Human
cccaaacctctgactccccattcttccccagacttgcacttccctcggtcttccccatctcagtaaatgccaagtttattcttccaattgcttaagccaaagatcttagaccatctttgatctctctctctctctcattctctcacaccccacataaaatctgttagcaatttctgtcatctttatctgcaaaatgttttcagaatctggccacatctcactaactccattattccatctgagtttaatctctcattaaacctctcccgggtatttgtaaaagcctcctcatttgaccacyacatttactccaccgcaatctattctccatatagcagaccaataaagctgtaaactggatcatattacttctctctgaaaacctccttcatgactaaatgaaagcccaaattcttgactgccttcaagaccctagacaatctgattccccaactacatctctgctctcttctaccacttttgtctttgtccatctcactgcagccactctgctcaaatgttagcttccctgaccaccttatgtaaaataaataacctccaatgcctccagcactcactagcctcataaatctactttact

SEQ ID NO: 54568 - DNA, 601 bp, Human
tctgcagatttcacagataatcacagttgcattttggataggaacacccatccttcaaagtctgggaggtttgtcttagatttccttctcaaaaacaggaagtctaagaaatgccctgggcttcatgtcagggatgtgagtcaccattttttttacctggatcatatgtgagtgttgcctcctaaaattgctgtgaggatgaaattatctaatttgatgcttcctatgaagaagcacattttaaattatggagtgactggcaaaagtatgcagacaggtgttgcattatgtgtgagtcaatttttttttttttttttgagatagagtctcattctgttgcccaggctggagtgcagtggcacgatctcggctcactgcaacctccacctccagggttcaagcaattctcctgcctcagcctcccaagcagctgggactacaggcacctgccaccatgcccagctaatttttgtatttttagtagagacagagtttcaccatattggccaggctggtctggaactcttgacctcgtgatccacctgcttcagcctcccaaagtgctgggattacaggcatgagccaccgcgcccagctgagc

SEQ ID NO: 54569 - DNA, 601 bp, Human
gatgtatatcacaggccaaaataattacatacctgaaaagtacaaccactaagaaataatcaacaacatgtaatatataaataatttatgtaataaataatgaataacatgtaccatgcaaagtggaattatcatgacagaacaacaattttaaataagtacaataaatatccttaaagaaatgtttccttcaaggcagaaaaaaatacttgaaaaagaactaaataaaaataatttatcaaaaattataaagcctattagtgatagagtaagagcaaaatctaggtcttctgataatccyagttttctacattaaacctttctaattactcttgaattggcattttcaaaaagatgtactgtcactgtatgtgaatgagtgatagactcaaaaaagagaatccatagttaagtaagcttgggatctataacatcagacaagacctaatatttactcattgtggggtttcttcaagccatggcatactaaggatatgatgactctccgagaaggaacccctagtttggcacattcatcacagacttggagctccactccagaaaacactttcctaaacagggcagataatcctatacacac

SEQ ID NO: 54570 - DNA, 601 bp, Human
ataatagtaagcctttagctcattcacaaacagtcaaatcgaggtttcatatctcaacagctgattccagccccttttcttttgccatcccccactacagaggttgcactgagaaagggggtcacatgagctagttccaccaataagatgtaaagtgaagtcttggttgggggacttccttggaaatcgtttgcttttctgataaaaggtgcaggcaagaccggtgcccctacttcgtctttcttcctgtcttgattgccagatgtaatgccttgagctacagtcaacatcttgcaaccaygaagtgatgaataagaggaccacaggtaaacatgctaagaataggggagacacaaagtgcctgagttattaatggtgtcagtaagcaaccacaggaatgcagaagccacctacttcgacacttgttatgtaagaactatgaattctgaattattcccgtcactattatatggttttctgaacgcattcctgactgaaacacccactctcatgaaataacgtgagctagtttggaggcgtggccactaacaaactgacttccatcactgccagttcacacacacacacacacacacacaca

SEQ ID NO: 54571 - DNA, 601 bp, Human
tattgtatcattcgtgccctcactgtcccctctccatctgctaccatagcatcatccctgggacaggctccagggaagagtgagagtctgggggcaggggagacattaccttgtggaatcctgtagctgatttctccaggcttcctgagctggcgcaatatatagtcactatgaatgtttattcccattcccaaaataaataagaagacaccttgacaaagaagagagaaaggagaaattttttttaaatgtgtccagattgtggtgcttttttcacaaactaagctaaaatgaaaggagaggcatttaatttctaaatctaagaatggtcctaagacgtggcagaaagtggggagggcaatgagtcctggtcctgaatggggagcactgggtgtgctgtttcctagacttgggctgaaagtacacagtggcaccactgatggagacagattagaaaagagaggagagcaggaggtagcaccattgtccagtatttaaatagataaacaaacaaatgcatggatcataatagtaagcctttagctcattcacaaacagtcaaatcgaggtttcatatctcaacagctgattccagcccctt

SEQ ID NO: 54572 - DNA, 601 bp, Human
agaggtattgtatcattcgtgccctcactgtcccctctccatctgctaccatagcatcatccctgggacaggctccagggaagagtgagagtctgggggcaggggagacattaccttgtggaatcctgtagctgatttctccaggcttcctgagctggcgcaatatatagtcactatgaatgtttattcccattcccaaaataaataagaagacaccttgacaaagaagagagaaaggagaaattttttttaaatgtgtccagattgtggtgcttttttcacaaactaagctaaaatgaagggaggggcatttaatttctaaatctaagaatggtcctaagacgtggcagaaagtggggagggcaatgagtcctggtcctgaatggggagcactgggtgtgctgtttcctagacttgggctgaaagtacacagtggcaccactgatggagacagattagaaaagagaggagagcaggaggtagcaccattgtccagtatttaaatagataaacaaacaaatgcatggatcataatagtaagcctttagctcattcacaaacagtcaaatcgaggtttcatatctcaacagctgattccagc

SEQ ID NO: 54573 - DNA, 601 bp, Human
tgagaggtattgtatcattcgtgccctcactgtcccctctccatctgctaccatagcatcatccctgggacaggctccagggaagagtgagagtctgggggcaggggagacattaccttgtggaatcctgtagctgatttctccaggcttcctgagctggcgcaatatatagtcactatgaatgtttattcccattcccaaaataaataagaagacaccttgacaaagaagagagaaaggagaaattttttttaaatgtgtccagattgtggtgcttttttcacaaactaagctaaaatgaaaggaggggcatttaatttctaaatctaagaatggtcctaagacgtggcagaaagtggggagggcaatgagtcctggtcctgaatggggagcactgggtgtgctgtttcctagacttgggctgaaagtacacagtggcaccactgatggagacagattagaaaagagaggagagcaggaggtagcaccattgtccagtatttaaatagataaacaaacaaatgcatggatcataatagtaagcctttagctcattcacaaacagtcaaatcgaggtttcatatctcaacagctgattcca

SEQ ID NO: 54574 - DNA, 601 bp, Human
agcatatttctaatgatattaaatatatccacactaaattttattacccacattaaactggggatgtttcaaccgaaacaattttgttctttctacagttacataaaaatactttgttttaaatcattctctattataattcaaaagttggaaactaatcttggcaactggttttcaagtgctttctctgctcttctttatttatctagttatggagtgaatgtttttaaaatcaaagccccttagagttgaatctttcttgaagatgagactgcgtcagtggttcccaacctgtgattcyctacgccctgggaggaaccacggatctaaagcaaagggcctataaattttctatgaagacagtaaacggcacatcttaacctcctaaattatttttgtttgatgtagatactgttaggatattaacaacattcaaattcatttgaatctgttactgaattcatagtaactttgtcattaatttcttaatcaatgactattaatgtgcactaacatcatgtcataattgaggaaattttttgatgtaaataaagggttgtatttacatcaaaaacggtggaagccaaggacctacacaaat

SEQ ID NO: 54575 - DNA, 601 bp, Human
tcagaacatctgtggaggccaggcgtgatggctttgcctgtaatcccagccctttgggaggccgaggcaggcagatcacttgaggtcaggagttcaaggacagcctggccaacatggtgaaacttgtctctactaaaaatgcaaaaagttagctgggcatggtggtgggcctgtagtctcagccatttggaaggctgaggtgggagaatcacttgaacctgggaggtgaaggctgcagtgaggcaagatcgccccattgcacttcagcctgggcatcagagtgagactccgactcaaaaataaataaataaataaataaataaataaatatctgtggagctttggaaagtgctggccatggtcccacctctggagcacacttccagaaatgtggtgggaggggatgaaactgaaggtggaaatggaagcggcttcttccgcttcttgaggctttatctaagcatctccaggtaagcctgcctggtgggcacagagcctgggtcagctaacccaagaaggtgcaaggcacttctcgctggacagccttcttcaacaagacaggcacaggaccttcccggccgtcacctcagttgcctctgtt

SEQ ID NO: 54576 - DNA, 601 bp, Human
ggcccttctctgggaggtctgacatcacaggatgaggcctcaatttgggttttgttgttgcagcagctggaaacgtctggtggaattaccatccctcccctaaccaagcacagtagagtccctccttcccagggaccctccaagtgctgagtgatgccttctcttctcccattcccgctctgcctctggtgggcagcagacccagcctgaaatggtaagaactgttatgactcttttatgggctaggaaccctctgccacccctcctcacagagtctaggaggtggtaggaataggtcackagctgttgcttcattcatttcagaactgttgtcctcgaacaattctaatcagaaaaaaaggaactcattcttagttaaatcttcaaaactaggcattgagtcataaccccagggtcctggttccaagaccactcattccctgtttgagtatccatagtctccagtaattataggctttctctttccacaaaagccattttagggaaaggatctgacatttacacttggcaagttaaagcctgataacaacctaatatattacctttcacttccagcaatacttttagttaattcttttgt

SEQ ID NO: 54577 - DNA, 601 bp, Human
aaaaaaaaaaactatatgtctgagccaaacaaaacaggttttctgcccagacgtgcccctctgtctgcaattttcagtctctgcctgcaggtcctttgagggaggcattcaggctgcccctaggagacaccttcttgaacaggtcctgagaactacaaggaagaagctccaggaaaggaaagttgcttggggcttctgctgtacttcatattgttgtggacatctggtggaggcaagcagcatgtaacctcatcattaattctctttgttttacactactcattatttggatattgccacyagtttccaaaaacatgagagtttgcaatgtctattgtaaaactgttctctatcctcttagtagccatccagggtcatgttgttctctactctctcataagccacccaggttcatgcctttttgtttgtggttattaaaacctggccttcaagaatagccataccagttttccggggattgtgaaatcttctggaaaacagaggcactcatcaactaagacactgcacaaatttgaaatgaggtcaatgcatcagtatcttttcagcactatgaggagagggctcctgtattcaaggtcta

SEQ ID NO: 54578 - DNA, 601 bp, Human
gcacctttattgtacttccttgtagttctgaattgtggctgagaggctgtataagtcatacttctttatttccagcacacagcccctaatttcatgaagagagaagagaagaaaggaaacgacactacagacagggtgaatgggaatgagggacaggcgggacagggaagcacaccccaataccttgtgaaaatctccagaagtcccaggatattttaattcaaacaaaactgcttaacatccatgatttaaaggtatttaatgaacaacaaaaacacttatttatatgattgcaatttgyatttttcagtaatctacatcatcctcagacctttcaagtttcctatgtgacttatatagtgagtttctgtgcttagtaccactggtgctcatttgtcaaaacagtttgctaaatattgacaatgcattccgcaaacataggcctgagaagacaaatatttccatgtattccaattacaagcgttcggccccttccttagagagtccatatctcagcactcatgctggggtgaccccttcacaagagtttgcaaactcaaatgcttactagctacgtagttccagttctggtgtggaaatg

SEQ ID NO: 54579 - DNA, 601 bp, Human
tgcacagatgtctgaggacaaccacctgagcaatactgtacgtagccaggtacagtgtcagtctctgaaactgcctttgccagactggattcacttatcatctcccctcacctctgagaaatgctgagggggctaggcaggctttctctactttaccacatttataatatatttggtgaacttcagctgattgctggaggacacagggctgtttaacacataggtgttgatacagttcctacctaattcacatatcaccacctcagttgaagccttctccagcttcccaaggtgtgcagcrcctcatagttcatgttgtttattattttacctatcttgctcttattcttctacggctgagtccattttatttactgtattcattacctaacagttccttttagtgctcagtaaatattcattatgattgtacaatgcaaggataagtgtagaagttctaagggttcaaaggagggattcaggaaaagaacgtaatctgtgctgtcggacaaagagattcctcaccagctacatacacagacatgaaatttgactgcaactctactagctaatcatcataaagtgagagcagaggccaggc

SEQ ID NO: 54580 - DNA, 601 bp, Human
atattaagggaaaagggcagaatataatatttgtaaacacaactatgtatacctgtgtgtatatattgaaaaacgttagcatttggggtgtcgtaaaaataagtttctgttttctttataaaattacctaaattcatattcaactacacacaattataaacttaattgcagagctaggtgtggtggctcatgtctgtattcctagtactttgggaggctgaggcaggaggatcccttgaggccaggagtttgagactagcttgggtaacatagcacgatcttgtctctacaaaaaaaaaaagtgaaaattagtggggtgtggtagtgtgcttctatggtcccagctacttgggaagctgaggcaggaggattgcttgagactaggaggtcgaggctgcagtgagctgtaatcatgccactgcacttcaacctgggcagcaaagtgagaccctgcctcaaaaaaagaaaaaaatgtgtggcaaaaactgccatgaacaaagtccaaaacaaactaggacaaaggcttgaaatatatgacagatatatcccaatatacatagaattcttatgaaattaaaaggaacatgaacaacttaactca

SEQ ID NO: 54581 - DNA, 601 bp, Human
tctggagcaaaggctggagtgcagtggcatgatcttggctcactgcaacctctgcctcctgggttcaagtgattctcctgtcccagcctccccagtagctgggattacaggcgcctgccaccacacccagctaatttttgtatttgtagtagaggctaggtttcttcatgttggccaggctggtcttgaactactgatctcaagtgatctgcctcggccccccaaagtgttgggattacaggcgtgagccatcacacctggccagtttttatttatattttttatagaagatggagtcttyctatgtttcacaggctgatcttgaactccaggcctcaagtgatcctcccgccttggcttcccaaagtgctgggattataggcatgagcctctatgcccagccttatatttaactttttaaggtactaccaaagaactttccaaactggttgtataattttacatttctaccagcagtatgagttccagttcctccacatcctgtcagtacttgatactgtcagtcttttaaattttttagctcttataaaaaggtatatagttacatctcattttggttttaatttacatttctctattg

SEQ ID NO: 54582 - DNA, 601 bp, Human
caggctggtcttgaactactgatctcaagtgatctgcctcggccccccaaagtgttgggattacaggcgtgagccatcacacctggccagtttttatttatattttttatagaagatggagtcttcctatgtttcacaggctgatcttgaactccaggcctcaagtgatcctcccgccttggcttcccaaagtgctgggattataggcatgagcctctatgcccagccttatatttaactttttaaggtactaccaaagaactttccaaactggttgtataattttacatttctaccagcmgtatgagttccagttcctccacatcctgtcagtacttgatactgtcagtcttttaaattttttagctcttataaaaaggtatatagttacatctcattttggttttaatttacatttctctattgagtaatgatgttgagtttcttttcatgtgcttgtcatcctgatatctttggtgacttgtctgttcaaatctcttgcccatttaaaaattgctttcttaatggattttaagaattatttacatagtctggatacaagtcctctgtaatatatataatttgcaagtgttttctccca

SEQ ID NO: 54583 - DNA, 601 bp, Human
gagcaaaactccatctcaaaaaaaaaaaaaagttaaatagaaaaaggacataaatgaaaaagcactcaaccatcctgataataagagaaatagatattaaatttatgccaagattccatatttctcccatcagattggtaaaaatctaagcacttgctaacataaggtgttagcaacagtgtggtaaagtaggcaatctcttgcattgctgattctctaaattggtgcaatccacagggagggcaatttggcatgctctcgttctctctctcgctcgctcgcgcgctctctctctctctccccatgagaaggagagagagagagagagagagcacgcgaacaagcgattgagtgagagagagagcacgtatctgcagtctcagctgctcaggaggctgaggtgggaggattgcttgagcctaggaggtcaacgctgtggtaagctgttgactatgccactgcactgcagcctagtgacagagaatctgtctcaaagataagaagaatgaggatattctttatgtactgatgtgtagaaaaatctctaagatacatagttaagtggagaaaacaaaatgctgcatggtgcatttactgtact

SEQ ID NO: 54584 - DNA, 601 bp, Human
tgaaacccaaaactgcaatctaaaagtacaagatggctggactcgatggctcatgcctgtaatcccagcacttcgggaggccaaggcaggaggattgcttgagcccagaagttcaagaccagcttgggcaacatggtgaaactttgtctctacaaaaaattagccgagcttcacaaacaatcttacaggagtcattcattaattaactcaacaaatatttatagagtacaggagacactagagatccagcaaaggtcaataacatgtgctgtcttagagaaaacttatattctaagaatartcaagtgacaaacaggagctacatcaaataatcacaagtacacttcagagaattaaaaccagatcaacgtagagaaaggcttccttacattcgatagtcaggaaattctctctctaccaggagggaactgagtgacaaggaacagtcaggtgggagaagggcattccagatgaaccagccctgagcggggaactagaaggccagtttgagaaaaggaatggagagaggaggaacagtttgtggtcagagcaaggaccaaaccattttagacttcatgagcctaagaagttttgattttgt

SEQ ID NO: 54585 - DNA, 601 bp, Human
tgcttgaacctaggaagcagaggctgtggtgagccgagatcgcaccattgcactccagcctgggcaacaagagtgaaactccgtcttaaaaaaaaaaaaaaaaaggtagtgtgtggccgggcgcggtggctcacgcctgtaatcccagcattttgtgaggccaaggtgggcggatcatgaggtcaggagttcgagaccagcctggccaacatggtgaaaccctgtctctactaaaaatacaaacattaagccggcgcagtggtggatgccgataatcccagctcctcgggaggctgacgcrggagaattgcttgaacctgagaggcagaggttgcagtgagccaagattgtgccactactaggcgacagaatgagactctgtctccaaaataataataataataataataaaataaaaataaaagtagtatccagcgtactacaaagaggaagagtttgtgaatgtgtatgttactgttaagttaaacagtgttctagtatccatctcattatcagccttgggcagggcagggttgagttggctaatgttcattataaaccagatcatccagttggggactctgaatgagcatatgattgc

SEQ ID NO: 54586 - DNA, 601 bp, Human
gtgtgtggccgggcgcggtggctcacgcctgtaatcccagcattttgtgaggccaaggtgggcggatcatgaggtcaggagttcgagaccagcctggccaacatggtgaaaccctgtctctactaaaaatacaaacattaagccggcgcagtggtggatgccgataatcccagctcctcgggaggctgacgcgggagaattgcttgaacctgagaggcagaggttgcagtgagccaagattgtgccactactaggcgacagaatgagactctgtctccaaaataataataataataataataaaataaaaataaaagtagtatccagcgtactacaaagaggaagagtttgtgaatgtgtatgttactgttaagttaaacagtgttctagtatccatctcattatcagccttgggcagggcagggttgagttggctaatgttcattataaaccagatcatccagttggggactctgaatgagcatatgattgcccctttcatgctagacttagctaattaaactgttcatatgacctaaaaggatggctgtggtgccatagaaagaaaacaagttttgaggcaagagactttagtttgatt

SEQ ID NO: 54587 - DNA, 601 bp, Human
catttcagataaaggatactgaacctttaatccattcatgaaggcagagtcctcatgacccagtcacctcctaaaggcctcacctcttgatactaccacaatggcaaccaggtttccagtacatgaatttttagggggatcattcaaactatagcaccctcctttatcccttaccctattccattagttttaatccccactttgtctcttcctctaatcttcagtctacactgtgacatgataggtatgctcaagtctctaacagctctaaaataacgttttctgtttttttttttgtctkcatttctggtggggttggataagaaaagtttttcaagttaaatcactctctattgcaagcctcttccaccttttttttttttttttttgcttcgaagaatgattgcctttaccttctcagttctcagttattttccagcacattatgattttatgaccttgatacagaagggctgggctcctggctaaattccacccttaaacctggaactgcaaccctaagtgaaaacagctaaccccattttttttcccacccaaatgttgcctctttggcctgccatgcccctatcctgtgctcata

SEQ ID NO: 54588 - DNA, 601 bp, Human
tcaagttaaatcactctctattgcaagcctcttccaccttttttttttttttttttgcttcgaagaatgattgcctttaccttctcagttctcagttattttccagcacattatgattttatgaccttgatacagaagggctgggctcctggctaaattccacccttaaacctggaactgcaaccctaagtgaaaacagctaaccccattttttttcccacccaaatgttgcctctttggcctgccatgcccctatcctgtgctcataaaaatatttcagctgggctgggtgcggtggctcactcctataatcccagcactttgggagaccgaggcaggtggatcacctggggtcaggagttcaagaccagcctggccaacatggcaaaaccgtatctctactaaaaatacaaaaattagttgggcatggtggtgggcaccataatcccagctacttgggaggatgaggcaggagaattgcttgaacctgggcggcggaggttacagtgagcccagattgtgccagtgcactccagcctgggcaaccgagtgagactctgtctcaaaaaaaaaaaaacaaaaacaaaaaagatttcagcag

SEQ ID NO: 54589 - DNA, 601 bp, Human
gtgatacaagtggctgagcagcgagcagagaatcaggtgagcgttggagactatggatgggacgtggctaacttcagatggtgcagctttggagaataggcccagccggagatggcctggcttcagggaaagatcaccttcttcccataccatccctttttcaactccccattctgctgagaaccacttccatcgtgcaatacaatcttctgcatatactacccttcaatctgttcatgtgatctgattattcctggacactggaagagaacctgggtgccaagaggagagggcaggggcwgccaccctgaccctccactgagctggctggcacctggccatccccgaatggccgcgttgaaggagcattgattgtaacacacttggatgctgctgcggggccgcatagagcctgcgcctgccagagaggagcaactggctggttcccgcattcgtttgctctgattcccacactcactcactcgcttgcacactgcctcttgcaaggggtttgagtgtgtggtggccgagtaaacgagccacgctccgagccatgagggggtcaagggaattatccagtctcatctcaatccgacttccc

SEQ ID NO: 54590 - DNA, 601 bp, Human
gtggccgagtaaacgagccacgctccgagccatgagggggtcaagggaattatccagtctcatctcaatccgacttccctcttcactgttttacttttgtaaaacccttgatgaacttcccattgtcaattcagggtctttttagctctcatcctgccagactgttgataacacctctgatttgtgctccacttttggcttctgtgtcatattgattcctgagttttcttccttctcctctattctcttaatctcgttttctggttttctcccatcacctgctggttaagcttaggggttrtttacacttctctccttggtcatctttttactgtatttttccctccacagctatttcatccatttctgaggcctgagatttcatccatttctgaggctatagagaccagtgacttcctctgactcttctgagcttgaaattcctattggtaactgccattggacttaactgcctggttatatctctaactaaagtacttctctcttccagcctgtttatcttattgtgttccattgtgttccttatctctaccaatgctagttccttatgctagaaatctcattcattgccactcaatca

SEQ ID NO: 54591 - DNA, 601 bp, Human
gtggtgttctatttgtaattcggttgtcagggtcggtgtgtactgttgaggatcatatccatactcactcaccttgggaatggacccacaagtttataaacagctttaagagattgctttcatgagtttctttctttctgtgatctccatgtggtttcttgggcttcccttttccattcctgcagccaaaagtggactttatcttcctaaagtcagggccaaaatgtgggaggagagagagaaataaagcaagggctatttgccccactctctcgggactgacattcttccagtcagagtraggattccctccctctgaattttaggcttctgccacccacattaccatcaccacaggattgtgtgaggactgggcatacgagaatggagaaaagcggaaaagaatgccgggtgtggtggctcacgcctgtaatcctaacactttgggaggccaaggcgggcagattgcctgagctcatgagtttatgaccagcctgggcaacacagtgaaaacctgtctctactaaaatacaaaaaattagccaggcatggtggtgggcacctgtagttccagttactcaggaggctgaggcaggagtat

SEQ ID NO: 54592 - DNA, 601 bp, Human
gtagagatgagggttccccatgttgcccaggctggtctcgaacttctgacctcaggtgatccactggtttcggcctcccaaagtgctgggactacaggcctgagccaccacgcccagccttatccttcattttagacagtttaagaggtttgtattcagccagatctccacatttacttgttcatttgtgttgtgatgttttttaatgttcaagtcttagcacacacaaacaattatatagaaacaagttgtttactttgacacccagtataactaaaaggatcttttgagtcagagattsagtaacttgccagagcctgtttggaaataaaccctgaggatttttcatatcagtggttggttatgcaatgtctgtggcaagccctagaaactaaaagaccaaaccttaaaatgttaaaaacaggaaaggcagttaattattatacataatttgttataaaaggaactataacttattaaagtcagatgatttctggccttgatagtttagggtttagagaagatactgttgtgtactataaaacagcagggctgttttctttcataccctttagcacaggaaagctgaactagggatttt

SEQ ID NO: 54593 - DNA, 601 bp, Human
tccactggtttcggcctcccaaagtgctgggactacaggcctgagccaccacgcccagccttatccttcattttagacagtttaagaggtttgtattcagccagatctccacatttacttgttcatttgtgttgtgatgttttttaatgttcaagtcttagcacacacaaacaattatatagaaacaagttgtttactttgacacccagtataactaaaaggatcttttgagtcagagattgagtaacttgccagagcctgtttggaaataaaccctgaggatttttcatatcagtggttrgttatgcaatgtctgtggcaagccctagaaactaaaagaccaaaccttaaaatgttaaaaacaggaaaggcagttaattattatacataatttgttataaaaggaactataacttattaaagtcagatgatttctggccttgatagtttagggtttagagaagatactgttgtgtactataaaacagcagggctgttttctttcataccctttagcacaggaaagctgaactagggatttttgcaagatgagaaaggcctgttgaaatgtgtgtgtataacatagtaataaaagaaatgc

SEQ ID NO: 54594 - DNA, 601 bp, Human
ttaaaaatcatagtttcagctgggcgtggtggctcacgcatgtaatcccagcactttaggaggctgaggtgggcggatcacctgaggtcagaagatcgagaccagcctgaccaacatggagaaatcctgtctctactaaaaatacaaaaaaattagctgggcgtggtggcgagtgcctgtaatcccagctactcaggaggctgaggcaggagaatcgcttgaatctggggagtggaggttgcggtgagattgcgccattgccctccagcctgggcaacaagagcaaaactccatctcaaartcaatcaatcaatcagtcaatcaatcatagtttcacgccaggtgcagtggcacggacctgtagacccagttacttgggaccctgagacgagatgattgcttgagcccaggttttccagtctagcctgggaaacatagtgagaccccagtctcttaaaaaaaaatcatattttcaaataatatttggtggcatgagaatatgtttgtaataaaagattacatttgtgaaagcagaatgtaaacagtacactagttgattctcactgttaaggtctttacacacgcctatacgtgcagatag

SEQ ID NO: 54595 - DNA, 601 bp, Human
tttttgtggaagaacaccagaaacaactttgttgtatctggatataatttagaatattcaaatgttggctaggtgcggtggcaacctgtaatcctagcactttgggaggccaaggcaggtggatcacctcaggtcgggagttcgagaccagcctgaccaacatggagaaactgtgtctctactaaaaatacagaattagccaggtgtggtggcacatgtctgtaatcccagctacttggggggctgaggcaggagaattgcttgaaccctggaggcggaggttgcggtgagccgagattgygccattgcactccattctgggcaacaagagcgaaactccgtctcagaaaaaaaaaaagaatattcaaatgtccaaggagtaccaatatctaggtaaagccattctgttggcctttgccaaattgtactattttataaagttgttttaaagagagatgtgggccgggcatagtggtgcacatctgtaatctcagcactttgggagtctgaggcgggcggatcacttgaggtcaggaatttgagaccagcctgggcaacatggcgaaaccctgtctctactaaaaatacaaaaattagccta

SEQ ID NO: 54596 - DNA, 601 bp, Human; identical to SEQ ID NO: 17624

SEQ ID NO: 54597 - DNA, 601 bp, Human; identical to SEQ ID NO: 17625

SEQ ID NO: 54598 - DNA, 601 bp, Human; identical to SEQ ID NO: 17626

SEQ ID NO: 54599 - DNA, 601 bp, Human; identical to SEQ ID NO: 17627

SEQ ID NO: 54600 - DNA, 601 bp, Human; identical to SEQ ID NO: 17628

SEQ ID NO: 54601 - DNA, 601 bp, Human; identical to SEQ ID NO: 17629

SEQ ID NO: 54602 - DNA, 601 bp, Human; identical to SEQ ID NO: 17630

SEQ ID NO: 54603 - DNA, 601 bp, Human; identical to SEQ ID NO: 17631

SEQ ID NO: 54604 - DNA, 601 bp, Human; identical to SEQ ID NO: 17632

SEQ ID NO: 54605 - DNA, 601 bp, Human; identical to SEQ ID NO: 17633

SEQ ID NO: 54606 - DNA, 601 bp, Human; identical to SEQ ID NO: 17634

SEQ ID NO: 54607 - DNA, 601 bp, Human; identical to SEQ ID NO: 17635

SEQ ID NO: 54608 - DNA, 601 bp, Human; identical to SEQ ID NO: 17636

SEQ ID NO: 54609 - DNA, 601 bp, Human; identical to SEQ ID NO: 17637

SEQ ID NO: 54610 - DNA, 601 bp, Human; identical to SEQ ID NO: 17638

SEQ ID NO: 54611 - DNA, 601 bp, Human; identical to SEQ ID NO: 54579

SEQ ID NO: 54612 - DNA, 601 bp, Human; identical to SEQ ID NO: 54580

SEQ ID NO: 54613 - DNA, 601 bp, Human; identical to SEQ ID NO: 54581

SEQ ID NO: 54614 - DNA, 601 bp, Human; identical to SEQ ID NO: 54582

SEQ ID NO: 54615 - DNA, 601 bp, Human; identical to SEQ ID NO: 54583

SEQ ID NO: 54616 - DNA, 601 bp, Human; identical to SEQ ID NO: 54584

SEQ ID NO: 54617 - DNA, 601 bp, Human; identical to SEQ ID NO: 54585

SEQ ID NO: 54618 - DNA, 601 bp, Human; identical to SEQ ID NO: 54586

SEQ ID NO: 54619 - DNA, 601 bp, Human; identical to SEQ ID NO: 54587

SEQ ID NO: 54620 - DNA, 601 bp, Human; identical to SEQ ID NO: 54588

SEQ ID NO: 54621 - DNA, 601 bp, Human; identical to SEQ ID NO: 54589

SEQ ID NO: 54622 - DNA, 601 bp, Human; identical to SEQ ID NO: 54590

SEQ ID NO: 54623 - DNA, 601 bp, Human; identical to SEQ ID NO: 54591

SEQ ID NO: 54624 - DNA, 601 bp, Human; identical to SEQ ID NO: 54592

SEQ ID NO: 54625 - DNA, 601 bp, Human; identical to SEQ ID NO: 54593

SEQ ID NO: 54626 - DNA, 601 bp, Human; identical to SEQ ID NO: 54594

SEQ ID NO: 54627 - DNA, 601 bp, Human; identical to SEQ ID NO: 54595

SEQ ID NO: 54628 - DNA, 601 bp, Human; identical to SEQ ID NO: 17624

SEQ ID NO: 54629 - DNA, 601 bp, Human; identical to SEQ ID NO: 17625

SEQ ID NO: 54630 - DNA, 601 bp, Human; identical to SEQ ID NO: 17626

SEQ ID NO: 54631 - DNA, 601 bp, Human; identical to SEQ ID NO: 17627

SEQ ID NO: 54632 - DNA, 601 bp, Human; identical to SEQ ID NO: 17628

SEQ ID NO: 54633 - DNA, 601 bp, Human; identical to SEQ ID NO: 17629

SEQ ID NO: 54634 - DNA, 601 bp, Human; identical to SEQ ID NO: 17630

SEQ ID NO: 54635 - DNA, 601 bp, Human; identical to SEQ ID NO: 17631

SEQ ID NO: 54636 - DNA, 601 bp, Human; identical to SEQ ID NO: 17632

SEQ ID NO: 54637 - DNA, 601 bp, Human; identical to SEQ ID NO: 17633

SEQ ID NO: 54638 - DNA, 601 bp, Human; identical to SEQ ID NO: 17634

SEQ ID NO: 54639 - DNA, 601 bp, Human; identical to SEQ ID NO: 17635

SEQ ID NO: 54640 - DNA, 601 bp, Human; identical to SEQ ID NO: 17636

SEQ ID NO: 54641 - DNA, 601 bp, Human; identical to SEQ ID NO: 17637

SEQ ID NO: 54642 - DNA, 601 bp, Human; identical to SEQ ID NO: 17638

SEQ ID NO: 54643 - DNA, 601 bp, Human; identical to SEQ ID NO: 54579

SEQ ID NO: 54644 - DNA, 601 bp, Human; identical to SEQ ID NO: 54580

SEQ ID NO: 54645 - DNA, 601 bp, Human; identical to SEQ ID NO: 54581

SEQ ID NO: 54646 - DNA, 601 bp, Human; identical to SEQ ID NO: 54582

SEQ ID NO: 54647 - DNA, 601 bp, Human; identical to SEQ ID NO: 54583

SEQ ID NO: 54648 - DNA, 601 bp, Human; identical to SEQ ID NO: 54584

SEQ ID NO: 54649 - DNA, 601 bp, Human; identical to SEQ ID NO: 54585

SEQ ID NO: 54650 - DNA, 601 bp, Human; identical to SEQ ID NO: 54586

SEQ ID NO: 54651 - DNA, 601 bp, Human; identical to SEQ ID NO: 54587

SEQ ID NO: 54652 - DNA, 601 bp, Human; identical to SEQ ID NO: 54588

SEQ ID NO: 54653 - DNA, 601 bp, Human; identical to SEQ ID NO: 54589

SEQ ID NO: 54654 - DNA, 601 bp, Human; identical to SEQ ID NO: 54590

SEQ ID NO: 54655 - DNA, 601 bp, Human; identical to SEQ ID NO: 54591

SEQ ID NO: 54656 - DNA, 601 bp, Human; identical to SEQ ID NO: 54592

SEQ ID NO: 54657 - DNA, 601 bp, Human; identical to SEQ ID NO: 54593

SEQ ID NO: 54658 - DNA, 601 bp, Human; identical to SEQ ID NO: 54594

SEQ ID NO: 54659 - DNA, 601 bp, Human; identical to SEQ ID NO: 54595

SEQ ID NO: 54660 - DNA, 601 bp, Human; identical to SEQ ID NO: 17624

SEQ ID NO: 54661 - DNA, 601 bp, Human; identical to SEQ ID NO: 17625

SEQ ID NO: 54662 - DNA, 601 bp, Human; identical to SEQ ID NO: 17626

SEQ ID NO: 54663 - DNA, 601 bp, Human; identical to SEQ ID NO: 17627

SEQ ID NO: 54664 - DNA, 601 bp, Human; identical to SEQ ID NO: 17628

SEQ ID NO: 54665 - DNA, 601 bp, Human; identical to SEQ ID NO: 17629

SEQ ID NO: 54666 - DNA, 601 bp, Human; identical to SEQ ID NO: 17630

SEQ ID NO: 54667 - DNA, 601 bp, Human; identical to SEQ ID NO: 17631

SEQ ID NO: 54668 - DNA, 601 bp, Human; identical to SEQ ID NO: 17632

SEQ ID NO: 54669 - DNA, 601 bp, Human; identical to SEQ ID NO: 17633

SEQ ID NO: 54670 - DNA, 601 bp, Human; identical to SEQ ID NO: 17634

SEQ ID NO: 54671 - DNA, 601 bp, Human; identical to SEQ ID NO: 17635

SEQ ID NO: 54672 - DNA, 601 bp, Human; identical to SEQ ID NO: 17636

SEQ ID NO: 54673 - DNA, 601 bp, Human; identical to SEQ ID NO: 17637

SEQ ID NO: 54674 - DNA, 601 bp, Human; identical to SEQ ID NO: 17638

SEQ ID NO: 54675 - DNA, 601 bp, Human; identical to SEQ ID NO: 21205

SEQ ID NO: 54676 - DNA, 601 bp, Human; identical to SEQ ID NO: 21206

SEQ ID NO: 54677 - DNA, 601 bp, Human; identical to SEQ ID NO: 21207

SEQ ID NO: 54678 - DNA, 601 bp, Human; identical to SEQ ID NO: 21208

SEQ ID NO: 54679 - DNA, 601 bp, Human; identical to SEQ ID NO: 21209

SEQ ID NO: 54680 - DNA, 601 bp, Human; identical to SEQ ID NO: 21210

SEQ ID NO: 54681 - DNA, 601 bp, Human; identical to SEQ ID NO: 21211

SEQ ID NO: 54682 - DNA, 601 bp, Human; identical to SEQ ID NO: 21212

SEQ ID NO: 54683 - DNA, 601 bp, Human; identical to SEQ ID NO: 21213

SEQ ID NO: 54684 - DNA, 601 bp, Human; identical to SEQ ID NO: 21214

SEQ ID NO: 54685 - DNA, 601 bp, Human; identical to SEQ ID NO: 21215

SEQ ID NO: 54686 - DNA, 601 bp, Human; identical to SEQ ID NO: 21216

SEQ ID NO: 54687 - DNA, 601 bp, Human; identical to SEQ ID NO: 21217

SEQ ID NO: 54688 - DNA, 601 bp, Human; identical to SEQ ID NO: 21218

SEQ ID NO: 54689 - DNA, 601 bp, Human; identical to SEQ ID NO: 21219

SEQ ID NO: 54690 - DNA, 601 bp, Human; identical to SEQ ID NO: 21220

SEQ ID NO: 54691 - DNA, 601 bp, Human; identical to SEQ ID NO: 21221

SEQ ID NO: 54692 - DNA, 601 bp, Human; identical to SEQ ID NO: 21222

SEQ ID NO: 54693 - DNA, 601 bp, Human; identical to SEQ ID NO: 21223

SEQ ID NO: 54694 - DNA, 601 bp, Human; identical to SEQ ID NO: 21224

SEQ ID NO: 54695 - DNA, 601 bp, Human; identical to SEQ ID NO: 21225

SEQ ID NO: 54696 - DNA, 601 bp, Human; identical to SEQ ID NO: 21226

SEQ ID NO: 54697 - DNA, 601 bp, Human
agctgggactacaggcgcaccccactaggcccagacaatctttttttttttatttttttgagagggagtctcgctctgccgcccagggtcgctcggcctcccgggttcacgccattctcctgcctcagcctcccgagtagctgggactacaggcgcccgccaccatgcccggctaattttttgtatttttaatagagatggggtttcaccatgctggccaggctcgtctcgaactcctgacctcaggtgatccgccctcctcagcctcccaaagtgctggtattacagacgtgagccaccrtgcccggccccagcctgtatctcacaaatgttaacacacacattagtgggagaccaatcattacaatccattatgatagaggggacttccccaaaatgaagattaacagtacatacaggcctggcgcgttggctcatgcctgtaatcccagcactttgggaggcccaggtgggaagatcacctgaggtcaggagttcaagaccagccaggccaatatggtgagaccctgcctctactaaaaaaaatacaaaaattagccgggcttggggcgcgagtctgtaatcccagcttctagggagg

SEQ ID NO: 54698 - DNA, 601 bp, Human
actcctgggatcaagcgatcctcccacctcagcctcccaaagtgctgggggctacaggtgtgagccaccacacctggcgtgtatttgtgtttattaatattaaaattttttgagatggagtctcactctgtcacccaggctggagtgcagtggcacaatcttggctcactgcaacctccgcctgccgggttcaagcgattctcctgcctctgcctcctgagtagctgggactacaggcgcaccccactaggcccagacaatctttttttttttatttttttgagagggagtctcgctctgycgcccagggtcgctcggcctcccgggttcacgccattctcctgcctcagcctcccgagtagctgggactacaggcgcccgccaccatgcccggctaattttttgtatttttaatagagatggggtttcaccatgctggccaggctcgtctcgaactcctgacctcaggtgatccgccctcctcagcctcccaaagtgctggtattacagacgtgagccaccatgcccggccccagcctgtatctcacaaatgttaacacacacattagtgggagaccaatcattacaatccattatgata

SEQ ID NO: 54699 - DNA, 601 bp, Human
ccaggctggtcttgaactcctgggatcaagcgatcctcccacctcagcctcccaaagtgctgggggctacaggtgtgagccaccacacctggcgtgtatttgtgtttattaatattaaaattttttgagatggagtctcactctgtcacccaggctggagtgcagtggcacaatcttggctcactgcaacctccgcctgccgggttcaagcgattctcctgcctctgcctcctgagtagctgggactacaggcgcaccccactaggcccagacaatctttttttttttatttttttgagasggagtctcgctctgccgcccagggtcgctcggcctcccgggttcacgccattctcctgcctcagcctcccgagtagctgggactacaggcgcccgccaccatgcccggctaattttttgtatttttaatagagatggggtttcaccatgctggccaggctcgtctcgaactcctgacctcaggtgatccgccctcctcagcctcccaaagtgctggtattacagacgtgagccaccatgcccggccccagcctgtatctcacaaatgttaacacacacattagtgggagaccaatcatta

SEQ ID NO: 54700 - DNA, 601 bp, Human
aaaacttttttttttgagaccgagtttcactcttgttgcccaggctggagtacaatggcatgatctcggcttgctgcaacctctgggttcaagcgattctcctgtctcaggctcccaagttgctgagattacaggcatgcaccacctcgcccggctaattttgaattttagtagagacagggtttctccatgttggtcaggctggtctcaaactcccaacctcaggtgatctcaaactcccaacctcaggtgatctgcccgcctcggcctcccaaagtgctgggattacaggcgtgagccsgccaggaaaaaattttattgctcatctcagaagattcataagacagtgagtgtgctttagtaagagaattttcctagcacagtacttcagaaaaaaaaggacttagttctctaaactatgtgcaaattaaaactgcagccttaaacttccttctctgaaaaatctatcggcaatatgattactaaatgcaaggattctgatttgttagttataggcttataaactgctactatattcccctgagagtcttttgcatgacaaaattcttaatacctacagacttgaaggtatggcacttaa

SEQ ID NO: 54701 - DNA, 601 bp, Human
aatccagacctagatgtgtgggaaatcactgaccttgcttaaaagatcagctccacaaatttgggagtatggagaggggtcatggtaatggtgtctacaagtttagtttgaagtctcactgaacttattctatctggaattttaagtcatttaactagccgggctcacgcctgtaatcccagcactttgggaggccaatccgggtggatcacgaggtcaggagttcaagaccagcctgaccaacatggtgaaacctggtctctactaaaaatacaaaaattagccaggcgtggtggcgggygcctgcaatcctagctactcaggaggctgatggaggagaatcacttgaacctgggaggtggaggttgcagcaagccaagatcacgcctgggtgacagagcaagactctgtctcaaaaaaaaaaaaaaagtcatttaactaaatacagtaatcaaaaccggtgtttataaatgctacaagtttggcctctaaaggtgaaccctgattcggacctggattatctgcctttagcactctgctgcacccttggctaccagatttgaccagaccagcacagcctagagcaaactgcgctaattct

SEQ ID NO: 54702 - DNA, 601 bp, Human
cctaatccagacctagatgtgtgggaaatcactgaccttgcttaaaagatcagctccacaaatttgggagtatggagaggggtcatggtaatggtgtctacaagtttagtttgaagtctcactgaacttattctatctggaattttaagtcatttaactagccgggctcacgcctgtaatcccagcactttgggaggccaatccgggtggatcacgaggtcaggagttcaagaccagcctgaccaacatggtgaaacctggtctctactaaaaatacaaaaattagccaggcgtggtggcrggtgcctgcaatcctagctactcaggaggctgatggaggagaatcacttgaacctgggaggtggaggttgcagcaagccaagatcacgcctgggtgacagagcaagactctgtctcaaaaaaaaaaaaaaagtcatttaactaaatacagtaatcaaaaccggtgtttataaatgctacaagtttggcctctaaaggtgaaccctgattcggacctggattatctgcctttagcactctgctgcacccttggctaccagatttgaccagaccagcacagcctagagcaaactgcgctaat

SEQ ID NO: 54703 - DNA, 601 bp, Human
catggtacttacaatatcttgagccttgaaatacttggggtacctaatccagacctagatgtgtgggaaatcactgaccttgcttaaaagatcagctccacaaatttgggagtatggagaggggtcatggtaatggtgtctacaagtttagtttgaagtctcactgaacttattctatctggaattttaagtcatttaactagccgggctcacgcctgtaatcccagcactttgggaggccaatccgggtggatcacgaggtcaggagttcaagaccagcctgaccaacatggtgaaaccyggtctctactaaaaatacaaaaattagccaggcgtggtggcgggtgcctgcaatcctagctactcaggaggctgatggaggagaatcacttgaacctgggaggtggaggttgcagcaagccaagatcacgcctgggtgacagagcaagactctgtctcaaaaaaaaaaaaaaagtcatttaactaaatacagtaatcaaaaccggtgtttataaatgctacaagtttggcctctaaaggtgaaccctgattcggacctggattatctgcctttagcactctgctgcacccttggctacca

SEQ ID NO: 54704 - DNA, 601 bp, Human
tacagggatcttgtcttttatgccagtgtgaacccagaacatggaacaaccaccaccataggagatgctcaaaaaaatttgtgaatgaatgcaaatctgttgggagtttcaagacttctaaggaatacaaggtatcccaggtactttttagggtttaacaatctgtaaacaatccccatagcagcttctccatataacacaagatatcataaatcttaagtatacataggtgtaccaaaacgaattaagaaagcactactgggtggggagctaggggagggatagcattaggagaaatacstaatgtagatgatgggttgatgggtgcagcaaaccaccatggcacgcgtatcactatgtaacaaacctgtgcacattctgcacatgtatctcagaacttaaagtataatgaaacaaaaaaaagaaagaaaagaaaacactactgcctgggtatggtggctcatgcctgtaatcccaagaccctgggaggccaaggtgggtagatctcctgaggttgggagtttgagaccagcctggccaagatggagaaaccccatctctactaaaaatacaaaaaattagccaggcgtggtggtgcatg

SEQ ID NO: 54705 - DNA, 601 bp, Human
ggcttccgaatggggcttggggaataatccaacttagactcataaatgaagtatcatctcttgtggcagatataaaatatacccaagtaaaaatccaaccgacacagctcatcaaactcactggttgtgggatgcaatggtagcttcatttcctaagggagtgatgaaatccaaaaaggaaaaaaaagctaaaaattgacgtaggatctttaggtcattaattcattttgtttattaattatcccactaaaaggtaagcaccactgagtacagggatcttgtcttttatgccagtgtgaasccagaacatggaacaaccaccaccataggagatgctcaaaaaaatttgtgaatgaatgcaaatctgttgggagtttcaagacttctaaggaatacaaggtatcccaggtactttttagggtttaacaatctgtaaacaatccccatagcagcttctccatataacacaagatatcataaatcttaagtatacataggtgtaccaaaacgaattaagaaagcactactgggtggggagctaggggagggatagcattaggagaaatacctaatgtagatgatgggttgatgggtgcagcaa

SEQ ID NO: 54706 - DNA, 601 bp, Human
aggcttccgaatggggcttggggaataatccaacttagactcataaatgaagtatcatctcttgtggcagatataaaatatacccaagtaaaaatccaaccgacacagctcatcaaactcactggttgtgggatgcaatggtagcttcatttcctaagggagtgatgaaatccaaaaaggaaaaaaaagctaaaaattgacgtaggatctttaggtcattaattcattttgtttattaattatcccactaaaaggtaagcaccactgagtacagggatcttgtcttttatgccagtgtgawcccagaacatggaacaaccaccaccataggagatgctcaaaaaaatttgtgaatgaatgcaaatctgttgggagtttcaagacttctaaggaatacaaggtatcccaggtactttttagggtttaacaatctgtaaacaatccccatagcagcttctccatataacacaagatatcataaatcttaagtatacataggtgtaccaaaacgaattaagaaagcactactgggtggggagctaggggagggatagcattaggagaaatacctaatgtagatgatgggttgatgggtgcagca

SEQ ID NO: 54707 - DNA, 601 bp, Human
gaaggcttccgaatggggcttggggaataatccaacttagactcataaatgaagtatcatctcttgtggcagatataaaatatacccaagtaaaaatccaaccgacacagctcatcaaactcactggttgtgggatgcaatggtagcttcatttcctaagggagtgatgaaatccaaaaaggaaaaaaaagctaaaaattgacgtaggatctttaggtcattaattcattttgtttattaattatcccactaaaaggtaagcaccactgagtacagggatcttgtcttttatgccagtgtkaacccagaacatggaacaaccaccaccataggagatgctcaaaaaaatttgtgaatgaatgcaaatctgttgggagtttcaagacttctaaggaatacaaggtatcccaggtactttttagggtttaacaatctgtaaacaatccccatagcagcttctccatataacacaagatatcataaatcttaagtatacataggtgtaccaaaacgaattaagaaagcactactgggtggggagctaggggagggatagcattaggagaaatacctaatgtagatgatgggttgatgggtgcag

SEQ ID NO: 54708 - DNA, 601 bp, Human
atgaaggcttccgaatggggcttggggaataatccaacttagactcataaatgaagtatcatctcttgtggcagatataaaatatacccaagtaaaaatccaaccgacacagctcatcaaactcactggttgtgggatgcaatggtagcttcatttcctaagggagtgatgaaatccaaaaaggaaaaaaaagctaaaaattgacgtaggatctttaggtcattaattcattttgtttattaattatcccactaaaaggtaagcaccactgagtacagggatcttgtcttttatgccagtktgaacccagaacatggaacaaccaccaccataggagatgctcaaaaaaatttgtgaatgaatgcaaatctgttgggagtttcaagacttctaaggaatacaaggtatcccaggtactttttagggtttaacaatctgtaaacaatccccatagcagcttctccatataacacaagatatcataaatcttaagtatacataggtgtaccaaaacgaattaagaaagcactactgggtggggagctaggggagggatagcattaggagaaatacctaatgtagatgatgggttgatgggtgc

SEQ ID NO: 54709 - DNA, 601 bp, Human
aatgaaggcttccgaatggggcttggggaataatccaacttagactcataaatgaagtatcatctcttgtggcagatataaaatatacccaagtaaaaatccaaccgacacagctcatcaaactcactggttgtgggatgcaatggtagcttcatttcctaagggagtgatgaaatccaaaaaggaaaaaaaagctaaaaattgacgtaggatctttaggtcattaattcattttgtttattaattatcccactaaaaggtaagcaccactgagtacagggatcttgtcttttatgccagtgtgaacccagaacatggaacaaccaccaccataggagatgctcaaaaaaatttgtgaatgaatgcaaatctgttgggagtttcaagacttctaaggaatacaaggtatcccaggtactttttagggtttaacaatctgtaaacaatccccatagcagcttctccatataacacaagatatcataaatcttaagtatacataggtgtaccaaaacgaattaagaaagcactactgggtggggagctaggggagggatagcattaggagaaatacctaatgtagatgatgggttgatgggtg

SEQ ID NO: 54710 - DNA, 601 bp, Human
ccgaagtgctgggatttcaggtgtgagtcaccgtactcagcccactgcttacctttcaagcatcatatgaaacaacaaacccttcactactcaccatcttcagactcttagttcctaccatactaaacttatttcagttccttgagctcaccattctttctcatctccaagatttcaaacatgctgttccttccatttggaacattcttccttctaactttttgggcctcagcttgtataactatcacctccttagggaaatctttcctgtacctagagtactttgtacttcctctatcayggcacctaaacttgtaattgttgcttatttgtccctatcctcaactgaactatgaggctaggaacttgttaaaggttcctagatcaccggctacaattggagaataaagtccaatgaaggcttccgaatggggcttggggaataatccaacttagactcataaatgaagtatcatctcttgtggcagatataaaatatacccaagtaaaaatccaaccgacacagctcatcaaactcactggttgtgggatgcaatggtagcttcatttcctaagggagtgatgaaatccaaaaaggaaa

SEQ ID NO: 54711 - DNA, 601 bp, Human
caaaaaattagccggcgtggtggcgggcgcctgtagttccagctacttgggaggctgaggcaggagaatggcgtgaacccgggaggcgaagcttgcagtgagccgagatcgcgccactgcacaccagcctgggcgacagagcgagactctgtctcaaaaaaaaaaatagttctttaccttgcccacctcgctccatcatcggagggactaccatagtccttgccatcatctcctctcagctaaactactacaacagcttccaaatttgtcttcctgccgctattcttgttgtttctaatcsactctacattgccaccagagagatgctttcaaaatgcctatcttatcatgtaacactctacccccgcttaagataaagattttagaaggtacaggatcttatcactgcttatctgtctttttttgagacagggtctctgtctcccaggctagagtgcaatggcacaatcccgcctcattttgacctccgccttctacagctcaagcgatccccccgtagctgggaccataggtgcgtgtcaccacgtccagcttaattttgtattttttgtagagaggggttttgccatgttgcccaggc

SEQ ID NO: 54712 - DNA, 601 bp, Human
ggctcacgcctgtaatcccagaactttgggaggccgaggcgggcggatcacgaggtcaggagatccagaccatcctggctaacagggtgaaaccccatctctactaaaaatacaaaaaattagccggcgtggtggcgggcgcctgtagttccagctacttgggaggctgaggcaggagaatggcgtgaacccgggaggcgaagcttgcagtgagccgagatcgcgccactgcacaccagcctgggcgacagagcgagactctgtctcaaaaaaaaaaatagttctttaccttgcccacctygctccatcatcggagggactaccatagtccttgccatcatctcctctcagctaaactactacaacagcttccaaatttgtcttcctgccgctattcttgttgtttctaatcgactctacattgccaccagagagatgctttcaaaatgcctatcttatcatgtaacactctacccccgcttaagataaagattttagaaggtacaggatcttatcactgcttatctgtctttttttgagacagggtctctgtctcccaggctagagtgcaatggcacaatcccgcctcattttgacctcc

SEQ ID NO: 54713 - DNA, 601 bp, Human
gctgagatcaggccactgcactgcagtcccagtgacgaagcgagactgtctcaaaatgaaagaaggggccaggcactgtggctcatacctgtaatcccagcacttggggaggacgaggtaggcggatcacaaggtcaagagattgagaccatcctggccaacacggtgaaaccccgtctctactaaaaatacaaatattagctgggtttggtggcacatgcctgtaatctcagctactcgggaggctgaggtaggagaatcacttgaacctgggaggcggagtttgcagtgagccgagatsgcgccattgcacttcagcctgggcgacaagagtgaaactcggtctccaaaaaaaaaaaaatgaaggaaggaaggaggggaaggagggaaggaagagacatttttatcagtccgatgcaatctgttgttaagcagttttactaacaatattatttagcaaagcaaaacaatatggaaaccttgataacttcttaaaactagaaaatgaatctcacctttgcatctatttcttctgctttctcattggcttcttgttcaatgaaagccatcatatgctttatctataaggaaaaaaagtttt

SEQ ID NO: 54714 - DNA, 601 bp, Human
agcgggtggatcatctgaggtcaggagttcaagaccagcctggccaacatggtgaaaccctgtctctactaaaaatacaaaaattagacaggtgtgacggtgcctgcctgtagtcccagctacttgggaggctgaggcaggagaatcacttgaacccgggaggcagaggttgcagtgagctgagatcaggccactgcactgcagtcccagtgacgaagcgagactgtctcaaaatgaaagaaggggccaggcactgtggctcatacctgtaatcccagcacttggggaggacgaggtaggyggatcacaaggtcaagagattgagaccatcctggccaacacggtgaaaccccgtctctactaaaaatacaaatattagctgggtttggtggcacatgcctgtaatctcagctactcgggaggctgaggtaggagaatcacttgaacctgggaggcggagtttgcagtgagccgagatcgcgccattgcacttcagcctgggcgacaagagtgaaactcggtctccaaaaaaaaaaaaatgaaggaaggaaggaggggaaggagggaaggaagagacatttttatcagtccgatgcaatct

SEQ ID NO: 54715 - DNA, 601 bp, Human
cctttgtaatgggtggggttttcattttataccctatatacttccaaactttttattttttattttttaattttttgagacaaggtctcactctgtcgtccaggctggagtgcagtggcacgatctctgctgactgcaacctctgcattctgggatcaagcgattctcccgcctcagcctcccgaggagctgggatgacaggcacacaccaccatgcccagctaatttttgtatttttagtagacacggggtttcaccatgttggccaggctggtcttgaactcctgacctcaggtgatcygcctgccttggcctcccaaagtgctgggattacaggcgtgagccaccaatcccagcccaaactttacttttttgcaatgagcacagattaacaaaaaagctaaacaatgaaacactacaaccttctctagtcacctatcacagttcgccacggttgttaaatatctgaattttggtttccatgagaaaatgaatcatacattacttttctaccctctaacataaaatttcaggacacttattggcatcacaaccattagaaaggaaaatttattttttaatgttaaagatacagacattt

SEQ ID NO: 54716 - DNA, 601 bp, Human
gcctcagcctcctgagtagctgagactgcaggcgtgcaccaccacacccaaccaatttttgtattttttgtagagatggggtttcaacatgttggccaggctggtcttgaactcctgacctcaggtgatccacttgtgtcggcctcccaaagtgctgggattacaggtgtgagccaccgccccggccatattttggtaatatttttaaggcaagctttaaaaaatgcgtgttatgattataccttgggaaaagaacattttgacatactgttaaggaatataaattggcataagcaatgtrcaactggaaatatatataaaacttctaaatgctgatggaaggtcacctttgtaatgggtggggttttcattttataccctatatacttccaaactttttattttttattttttaattttttgagacaaggtctcactctgtcgtccaggctggagtgcagtggcacgatctctgctgactgcaacctctgcattctgggatcaagcgattctcccgcctcagcctcccgaggagctgggatgacaggcacacaccaccatgcccagctaatttttgtatttttagtagacacggggtttc

SEQ ID NO: 54717 - DNA, 601 bp, Human
ctgcaacctccacctcccgggttcaagtgattctcctgcctcagcctcctgagtagctgagactgcaggcgtgcaccaccacacccaaccaatttttgtattttttgtagagatggggtttcaacatgttggccaggctggtcttgaactcctgacctcaggtgatccacttgtgtcggcctcccaaagtgctgggattacaggtgtgagccaccgccccggccatattttggtaatatttttaaggcaagctttaaaaaatgcgtgttatgattataccttgggaaaagaacattttgayatactgttaaggaatataaattggcataagcaatgtacaactggaaatatatataaaacttctaaatgctgatggaaggtcacctttgtaatgggtggggttttcattttataccctatatacttccaaactttttattttttattttttaattttttgagacaaggtctcactctgtcgtccaggctggagtgcagtggcacgatctctgctgactgcaacctctgcattctgggatcaagcgattctcccgcctcagcctcccgaggagctgggatgacaggcacacaccaccatgcc

SEQ ID NO: 54718 - DNA, 601 bp, Human
cacaaggtcgggagttcaagaccagcctggccaacatagtgaaaccccatctctactaaaaatacaaaaattagccaggcgtggtggcgggcgcctgtagttcaagatacttgggaggctgaggcaggagaattgcttgaagccaggaggcagagattacagtgagccgagatcatgccactgcactctagcctgggtgacagagcaagactccatccaaaaaaaatattaatttttttatacataaattttattatacattattttattatacgtaaacaggccaggtagagtggctcasgcctataatcccagcactttgggaggccgaggtaggcggatcacttgaggtcaggagttccaagacgagcctggccaacatggtgaaagcccgtctctactaaaaacacaaaaattacctgggcctgggtaggcgcctgtaatcccagctacccagaagctaaggcaggagaatcgcttgaacccaggaggcagaggttagagtgagcagagattacactgctgcactccagcctgggcgatagaggtggctcacgcctgcaatcccagcactttgaaaggccaaggcgggtggatcatg

SEQ ID NO: 54719 - DNA, 601 bp, Human
gggtaagtgtcgcatatatttaaaaatataaattatgggctgggcgccatggctcacgcctataatctcagcagtttcggaggctgaggcaggcggatcacaaggtcgggagttcaagaccagcctggccaacatagtgaaaccccatctctactaaaaatacaaaaattagccaggcgtggtggcgggcgcctgtagttcaagatacttgggaggctgaggcaggagaattgcttgaagccaggaggcagagattacagtgagccgagatcatgccactgcactctagcctgggtgacasagcaagactccatccaaaaaaaatattaatttttttatacataaattttattatacattattttattatacgtaaacaggccaggtagagtggctcaggcctataatcccagcactttgggaggccgaggtaggcggatcacttgaggtcaggagttccaagacgagcctggccaacatggtgaaagcccgtctctactaaaaacacaaaaattacctgggcctgggtaggcgcctgtaatcccagctacccagaagctaaggcaggagaatcgcttgaacccaggaggcagaggttaga

SEQ ID NO: 54720 - DNA, 601 bp, Human
cgggaggctgaggcaggagaatggcatgaacccgggaggcggaacttgcagtgaaccgagatcgcgcctgggcagcagagcgagacaccgtttcaaaaaaaaaaaaaattttttttccctcatgggtaagtgtcgcatatatttaaaaatataaattatgggctgggcgccatggctcacgcctataatctcagcagtttcggaggctgaggcaggcggatcacaaggtcgggagttcaagaccagcctggccaacatagtgaaaccccatctctactaaaaatacaaaaattagccaggsgtggtggcgggcgcctgtagttcaagatacttgggaggctgaggcaggagaattgcttgaagccaggaggcagagattacagtgagccgagatcatgccactgcactctagcctgggtgacagagcaagactccatccaaaaaaaatattaatttttttatacataaattttattatacattattttattatacgtaaacaggccaggtagagtggctcaggcctataatcccagcactttgggaggccgaggtaggcggatcacttgaggtcaggagttccaagacgagcctggccaac

SEQ ID NO: 54721 - DNA, 601 bp, Human
cgaggtcaggagatcgagatcatcctggctaacacggtgaaaccctgtctctactaaaaatacaaaaaattagccaggcgcggtggcaggcgcctgtagtcccagctactcaggaggctgaggcaggacaatggcgtgaacccgggaggcagagcttgcagcgagtggagatcgtgccactgcactctagcctgggcgacagagcagaactctgtctcaaaaaaaaacaaagatccagattactgcccataaaatgtggtcgagtaacctcaggcttagtgtcctctcttgtaaaatgaasttaaaaaaattaaaaagttggctgggcgcagtggctcacgcctgtaatcccagcactttgggaggccaaggcagacagatcacctaaggtcaggagtttgagatcggcctgatcaacatagagaaacctcgtctctactaaaaatataaaactggccaggcgtggcggcgcatgcctgtaatcccagctagtcggaaggctgagggaggagaatcgcttgaacctgggaggcggaggttgcagtgagccgagatcgtgccactgcactctagcttagggaagaagagggaaactccatct

SEQ ID NO: 54722 - DNA, 601 bp, Human
aaaatttcgtcaagggtaacagtaaccgacaagttactaaaggatataattgggtagaatattctgctcatgaaaaaaattaccacacgttcgaaacttaatccattagcttactggtgggccaataaatatgacacagaacttgaaagtttagaagatcctggccgggtgcggtggctcacgcctataatcccaatactttgggaggccgaggcgggtggatcacgaggtcaggagatcgagatcatcctggctaacacggtgaaaccctgtctctactaaaaatacaaaaaattagccrggcgcggtggcaggcgcctgtagtcccagctactcaggaggctgaggcaggacaatggcgtgaacccgggaggcagagcttgcagcgagtggagatcgtgccactgcactctagcctgggcgacagagcagaactctgtctcaaaaaaaaacaaagatccagattactgcccataaaatgtggtcgagtaacctcaggcttagtgtcctctcttgtaaaatgaacttaaaaaaattaaaaagttggctgggcgcagtggctcacgcctgtaatcccagcactttgggaggccaaggcaga

SEQ ID NO: 54723 - DNA, 601 bp, Human
ttcttctgcctagagggaaattagtcaatattaattcattacatcaagttttgattaacagttttaaacagctggtgacctgcgttacttgcttatgaacactaatttcatatataaaacagaaaatttattgtgattcattttcaaggattctaatttattcaaaaggaaagatcagcaattttcattataaatgacgtactaggaaactaaaaatttcgtcaagggtaacagtaaccgacaagttactaaaggatataattgggtagaatattctgctcatgaaaaaaattaccacacrttcgaaacttaatccattagcttactggtgggccaataaatatgacacagaacttgaaagtttagaagatcctggccgggtgcggtggctcacgcctataatcccaatactttgggaggccgaggcgggtggatcacgaggtcaggagatcgagatcatcctggctaacacggtgaaaccctgtctctactaaaaatacaaaaaattagccaggcgcggtggcaggcgcctgtagtcccagctactcaggaggctgaggcaggacaatggcgtgaacccgggaggcagagcttgcagcga

SEQ ID NO: 54724 - DNA, 601 bp, Human
ggcatccctgtttggcttatgaatataatccaaatagctctacactttctcaatgaagtggtatgcttctgaaggtttctgccctcttccttagaggactataatactttccatatggttttcttttttccagcctcttccctgttaaatttagcctgcacgcttatatcatgagccttatttatgatattctccacaaaataatacaaaagtttccacagctttctgttgaaaacaggtgaagctcttcagcctcacactcatggcctctgtattaaccatcctatggttctggtctcaytggtccctgtaccctcatgtactactgtgcggtccacccatagtgtgtgctataatccaggagagtcttacatgctctttagatcagaaggtccttcaatacaggccttggctcttattcacttttgtatttattataataattggaatgttttctctctaaagattattcaatcaactccttaattaatgttaactagtaatttacaacagggaaatgaataaacatgtaataattttataactaataggggctaattactcactgtgataaggtcatctcttgctctgaggactttga

SEQ ID NO: 54725 - DNA, 601 bp, Human
ttatattttctgcttgaataaccgtatctgcaaagatggtaatttcgtttcttctatcccaatatttatgtaactctcatttctccaactcataaggaatctagggcctccacagtcacaatgagtaacagtggaaacagcaggcatccctgtttggcttatgaatataatccaaatagctctacactttctcaatgaagtggtatgcttctgaaggtttctgccctcttccttagaggactataatactttccatatggttttcttttttccagcctcttccctgttaaatttagcctgyacgcttatatcatgagccttatttatgatattctccacaaaataatacaaaagtttccacagctttctgttgaaaacaggtgaagctcttcagcctcacactcatggcctctgtattaaccatcctatggttctggtctcactggtccctgtaccctcatgtactactgtgcggtccacccatagtgtgtgctataatccaggagagtcttacatgctctttagatcagaaggtccttcaatacaggccttggctcttattcacttttgtatttattataataattggaatgttttctct

SEQ ID NO: 54726 - DNA, 601 bp, Human
gggttatcactggtggagacggagatggggttggagaaagggaactaacattttttaaacacgatatgacaaatgttacatgccagaggacttaaatgtgttctctcattcgattctcataagcactctgaaccaaacatcataatgaatatacataacatagataatgaatacaagagaaaaccgagggtcagaaacagtaatttagacaaacgaatatggcagagttgacatttaaactcatagctgactgactcttaagccccaagcccttctacaacaaactaccttccctaagacattattattgtaaaagcctgttataaattaattcagtcaatccaagttgctaaaggaatttgaatcccctggaaggaaatcaactcctgattattgacactttagtgaagacgcaaaataacagttgtcctgagctagtaacattttgcaggcaacatttccccaggaaactcttgactctttcttttgtattttaaaggggatgaactaatcccatgtggcaagataaactggcaacagattttgtattttcccacattcctggagtttcaaagcagataaagcacttaaatttggggca

SEQ ID NO: 54727 - DNA, 601 bp, Human
aaataaaaaacctaattataaagcctattaactagctaagactataatcttttgctataaccttgtgtgttatagcccttgctacttatatttaggaatgctgccaagacattaacattacatgcctctaaacttttttgaattgtacaaataataatatctatgcagtagatgtcacagttgtcattttttactttgggcataaataatgaaaagactatagtcaagaggctttctgggcattagcacccaataagctaagaatattttatctacacaggcctattattagaaggaaggkttatcactggtggagacggagatggggttggagaaagggaactaacattttttaaacacgatatgacaaatgttacatgccagaggacttaaatgtgttctctcattcgattctcataagcactctgaaccaaacatcataatgaatatacataacatagataatgaatacaagagaaaaccgagggtcagaaacagtaatttagacaaacgaatatggcagagttgacatttaaactcatagctgactgactcttaagccccaagcccttctacaacaaactaccttccctaagacatt

SEQ ID NO: 54728 - DNA, 601 bp, Human
aaaaaacaaaccaaataaaaaacctaattataaagcctattaactagctaagactataatcttttgctataaccttgtgtgttatagcccttgctacttatatttaggaatgctgccaagacattaacattacatgcctctaaacttttttgaattgtacaaataataatatctatgcagtagatgtcacagttgtcattttttactttgggcataaataatgaaaagactatagtcaagaggctttctgggcattagcacccaataagctaagaatattttatctacacaggcctattaytagaaggaagggttatcactggtggagacggagatggggttggagaaagggaactaacattttttaaacacgatatgacaaatgttacatgccagaggacttaaatgtgttctctcattcgattctcataagcactctgaaccaaacatcataatgaatatacataacatagataatgaatacaagagaaaaccgagggtcagaaacagtaatttagacaaacgaatatggcagagttgacatttaaactcatagctgactgactcttaagccccaagcccttctacaacaaactacctt

SEQ ID NO: 54729 - DNA, 601 bp, Human
gaaaaaataactaataaaatataaacaagtggattaaaaaattaaagcaaagagaaaataagggcaataaataacaagttaaaattacaagtcaagtcaaatccactagacctatgggttgtttacatccagttatgaaaggtcggtataccatctaaggcaggacagcatcagagaatgtatcatcaaaaccatttctataatatgttagatgatctttctcagaatcttttccactcttaatattattaaccttcaaaaaggtggcataaaaaacaaaccaaataaaaaacctaattayaaagcctattaactagctaagactataatcttttgctataaccttgtgtgttatagcccttgctacttatatttaggaatgctgccaagacattaacattacatgcctctaaacttttttgaattgtacaaataataatatctatgcagtagatgtcacagttgtcattttttactttgggcataaataatgaaaagactatagtcaagaggctttctgggcattagcacccaataagctaagaatattttatctacacaggcctattattagaaggaagggttatcactggtggagacg

SEQ ID NO: 54730 - DNA, 601 bp, Human
cgttaattacgttttttaaaaagcaaattagaaaaaataactaataaaatataaacaagtggattaaaaaattaaagcaaagagaaaataagggcaataaataacaagttaaaattacaagtcaagtcaaatccactagacctatgggttgtttacatccagttatgaaaggtcggtataccatctaaggcaggacagcatcagagaatgtatcatcaaaaccatttctataatatgttagatgatctttctcagaatcttttccactcttaatattattaaccttcaaaaaggtggcataaaaaacaaaccaaataaaaaacctaattataaagcctattaactagctaagactataatcttttgctataaccttgtgtgttatagcccttgctacttatatttaggaatgctgccaagacattaacattacatgcctctaaacttttttgaattgtacaaataataatatctatgcagtagatgtcacagttgtcattttttactttgggcataaataatgaaaagactatagtcaagaggctttctgggcattagcacccaataagctaagaatattttatctacacaggcctattat

SEQ ID NO: 54731 - DNA, 601 bp, Human
tgggaaggactgcttgagcccaggagtttgtgagctatgactgcaccattgcattccagcctgggcaacatagccagaccatgcctcttaaaaaaaaattccttctaaaagccaactagtaattatttatatattctaatagatttaaggcagcttacagaagtatatctaatgaaaacgttaattacgttttttaaaaagcaaattagaaaaaataactaataaaatataaacaagtggattaaaaaattaaagcaaagagaaaataagggcaataaataacaagttaaaattacaagtmaagtcaaatccactagacctatgggttgtttacatccagttatgaaaggtcggtataccatctaaggcaggacagcatcagagaatgtatcatcaaaaccatttctataatatgttagatgatctttctcagaatcttttccactcttaatattattaaccttcaaaaaggtggcataaaaaacaaaccaaataaaaaacctaattataaagcctattaactagctaagactataatcttttgctataaccttgtgtgttatagcccttgctacttatatttaggaatgctgccaagaca

SEQ ID NO: 54732 - DNA, 601 bp, Human
agagatgttactaaaatgtaaaataactgtatgaatattccagagagaagggaaaaaagttgagaagcaccgatattgaagtatttgataaatgaatgaatgatctgaattttaggtgtcaagttttcttatctatgccacttcaaattttccctctgaggccaggcatggtggctcttgcctgttatcccagctacataggaggctgaggtgggaaggactgcttgagcccaggagtttgtgagctatgactgcaccattgcattccagcctgggcaacatagccagaccatgcctcttaaaaaaaaattccttctaaaagccaactagtaattatttatatattctaatagatttaaggcagcttacagaagtatatctaatgaaaacgttaattacgttttttaaaaagcaaattagaaaaaataactaataaaatataaacaagtggattaaaaaattaaagcaaagagaaaataagggcaataaataacaagttaaaattacaagtcaagtcaaatccactagacctatgggttgtttacatccagttatgaaaggtcggtataccatctaaggcaggacagcatcagagaatgta

SEQ ID NO: 54733 - DNA, 601 bp, Human
acaggtctgagccaccacgcccagccccacactttcttttaatatcctccacctcaaaatttgaaaaccactgtgtgtcatgagagatgttactaaaatgtaaaataactgtatgaatattccagagagaagggaaaaaagttgagaagcaccgatattgaagtatttgataaatgaatgaatgatctgaattttaggtgtcaagttttcttatctatgccacttcaaattttccctctgaggccaggcatggtggctcttgcctgttatcccagctacataggaggctgaggtgggaagkactgcttgagcccaggagtttgtgagctatgactgcaccattgcattccagcctgggcaacatagccagaccatgcctcttaaaaaaaaattccttctaaaagccaactagtaattatttatatattctaatagatttaaggcagcttacagaagtatatctaatgaaaacgttaattacgttttttaaaaagcaaattagaaaaaataactaataaaatataaacaagtggattaaaaaattaaagcaaagagaaaataagggcaataaataacaagttaaaattacaagtcaagtcaa

SEQ ID NO: 54734 - DNA, 601 bp, Human
ccgcccgcctcggcctcccaaagtgctgggattacaggtctgagccaccacgcccagccccacactttcttttaatatcctccacctcaaaatttgaaaaccactgtgtgtcatgagagatgttactaaaatgtaaaataactgtatgaatattccagagagaagggaaaaaagttgagaagcaccgatattgaagtatttgataaatgaatgaatgatctgaattttaggtgtcaagttttcttatctatgccacttcaaattttccctctgaggccaggcatggtggctcttgcctgtwatcccagctacataggaggctgaggtgggaaggactgcttgagcccaggagtttgtgagctatgactgcaccattgcattccagcctgggcaacatagccagaccatgcctcttaaaaaaaaattccttctaaaagccaactagtaattatttatatattctaatagatttaaggcagcttacagaagtatatctaatgaaaacgttaattacgttttttaaaaagcaaattagaaaaaataactaataaaatataaacaagtggattaaaaaattaaagcaaagagaaaataagggcaa

SEQ ID NO: 54735 - DNA, 601 bp, Human
ctcagcctcccgagtagctgggactacaggcgcccaccaccacgcccggctaattttttgtatttttagtggagacgtggtttcaccgttgttagccaggatggtctcaatctcctgacctcgtgatccgcccgcctcggcctcccaaagtgctgggattacaggtctgagccaccacgcccagccccacactttcttttaatatcctccacctcaaaatttgaaaaccactgtgtgtcatgagagatgttactaaaatgtaaaataactgtatgaatattccagagagaagggaaaaaarttgagaagcaccgatattgaagtatttgataaatgaatgaatgatctgaattttaggtgtcaagttttcttatctatgccacttcaaattttccctctgaggccaggcatggtggctcttgcctgttatcccagctacataggaggctgaggtgggaaggactgcttgagcccaggagtttgtgagctatgactgcaccattgcattccagcctgggcaacatagccagaccatgcctcttaaaaaaaaattccttctaaaagccaactagtaattatttatatattctaatagatttaa

SEQ ID NO: 54736 - DNA, 601 bp, Human
aagtcagcagacaaactcagagtgactaaatccgggaaagacatgtggtatgaactgaatgactgctttgtctttcaaggtcataaaaagaattatttttctctagcccatttctttttgtttctattatttattatttttagagacagggtctccctgtgtcatttatgctggaatgcagtggcataatcacagctcactggagcctcaaactcttgggctcaagtgattctcccatctcagcctccagagtagctgggaccacaggcatgcgctaccacaccttgctaatttttaaaacttttttgtacagacagggtctccctatatttatcagactggtctcaaactcttggcctcaagccacactcccaccttggcctcataaagtgctgtgaccacaggcatgagccatggcacctggctagcccatctctgaaagaatatgatggattactgtattttggaaaactatcctaagttgaaattaaaacacattcattggccgggagcagtggctcacgcctgtaatcccagcactttgggaggccgaggcgggcagatcacgaggtcaggaaatcgagaccatcctggctaacac

SEQ ID NO: 54737 - DNA, 601 bp, Human
acaattttaaagtcagcagacaaactcagagtgactaaatccgggaaagacatgtggtatgaactgaatgactgctttgtctttcaaggtcataaaaagaattatttttctctagcccatttctttttgtttctattatttattatttttagagacagggtctccctgtgtcatttatgctggaatgcagtggcataatcacagctcactggagcctcaaactcttgggctcaagtgattctcccatctcagcctccagagtagctgggaccacaggcatgcgctaccacaccttgctaatttttaaaaattttttgtacagacagggtctccctatatttatcagactggtctcaaactcttggcctcaagccacactcccaccttggcctcataaagtgctgtgaccacaggcatgagccatggcacctggctagcccatctctgaaagaatatgatggattactgtattttggaaaactatcctaagttgaaattaaaacacattcattggccgggagcagtggctcacgcctgtaatcccagcactttgggaggccgaggcgggcagatcacgaggtcaggaaatcgagaccatcct

SEQ ID NO: 54738 - DNA, 601 bp, Human
ctcacactgctctctccattctgtatcctatcccatgactaatacttcaagtcatgctcaaacagctgtagtggagatgtattatcttgtccaggtcctattagactgcagactcctagaggggccagcacgatacaggacacatgggataaatgtactgttaaattcaaacagcttagtgcctcaagggaacccaactgagttatgacatgaaaacagaagagtgacaactgagggataacatgagtaccaaaaccagaattttgtttgcaacaattttaaagtcagcagacaaactcakagtgactaaatccgggaaagacatgtggtatgaactgaatgactgctttgtctttcaaggtcataaaaagaattatttttctctagcccatttctttttgtttctattatttattatttttagagacagggtctccctgtgtcatttatgctggaatgcagtggcataatcacagctcactggagcctcaaactcttgggctcaagtgattctcccatctcagcctccagagtagctgggaccacaggcatgcgctaccacaccttgctaatttttaaaaattttttgtacagacagggt

SEQ ID NO: 54739 - DNA, 601 bp, Human
aggatgaagtccatattcttcagcagacactcaaggcccttctaattagaccctaatatgtggcctgttctctgcccactccccactctgccagactacctctgtttcccgcacatgtcaaattcaggtctcggtttttcactcacactgctctctccattctgtatcctatcccatgactaatacttcaagtcatgctcaaacagctgtagtggagatgtattatcttgtccaggtcctattagactgcagactcctagaggggccagcacgatacaggacacatgggataaatgtactrttaaattcaaacagcttagtgcctcaagggaacccaactgagttatgacatgaaaacagaagagtgacaactgagggataacatgagtaccaaaaccagaattttgtttgcaacaattttaaagtcagcagacaaactcagagtgactaaatccgggaaagacatgtggtatgaactgaatgactgctttgtctttcaaggtcataaaaagaattatttttctctagcccatttctttttgtttctattatttattatttttagagacagggtctccctgtgtcatttatgctggaatgc

SEQ ID NO: 54740 - DNA, 601 bp, Human
gacatcttgactgccaaatccaaagaccaccatgctcttcccactgtcattctctcaaacattgaacactgtattagagaccattttgagtttgccgttcccttggcttctctgtattctccaacataactgctttcccccacatttccttagcaatttattttctattaaatctgatgcttctcagtttttttggcccgcttctcttctaattctccatccaaaaccacagctccagcagggacttctgtgttgtctccacataagctcctcttctctcctaacagactcatagagcttyacctggaatcctaaggcaattcaaacacaatgatttttttcaccattctttacctgttcttcctatatttctttttttttttatttttgacatgaagtctcactctgtcgccaggctggagtgcagtggcgtgatcctggctcactgcaacgtctgactccctggttcaagcaattctcctgcctcagcctcccaagtagctgggattacaggcaccccccaccaggcccagctaatttttgtatttttattagagatggggtttcaccatgtttgccaggatgatctcgatctcctgac

SEQ ID NO: 54741 - DNA, 601 bp, Human
aaactgctctggcaaatgtgaaaaacgacatcttgactgccaaatccaaagaccaccatgctcttcccactgtcattctctcaaacattgaacactgtattagagaccattttgagtttgccgttcccttggcttctctgtattctccaacataactgctttcccccacatttccttagcaatttattttctattaaatctgatgcttctcagtttttttggcccgcttctcttctaattctccatccaaaaccacagctccagcagggacttctgtgttgtctccacataagctcctctyctctcctaacagactcatagagctttacctggaatcctaaggcaattcaaacacaatgatttttttcaccattctttacctgttcttcctatatttctttttttttttatttttgacatgaagtctcactctgtcgccaggctggagtgcagtggcgtgatcctggctcactgcaacgtctgactccctggttcaagcaattctcctgcctcagcctcccaagtagctgggattacaggcaccccccaccaggcccagctaatttttgtatttttattagagatggggtttcaccatgtt

SEQ ID NO: 54742 - DNA, 601 bp, Human
gaggctactccagtaaattaagtaatgtcaacttgtggagcgtgctactagccatttgcataaggaatctactatggaaaacagggaaacggtaattaaggagttttaaaaggccaattcgttgagtctaaataaactaaactctagctaagcaggctagaacctaattgacataaactgtgttatcccttgtctgaagcatgcctgtccactatgtcaccacgggagagaaaggtaaattatgatcaataattaccatccgtgtgataagctcctaacatcccagtgacaccctctggtrtgactctaacttcaattaactttctggttataatctggctcctcatgtagcttttccacagcaacatgtgtctctcactgtaaactactgcagttcacatgtgggcttatttgtattttatgagtttggaagggaaaatctgcccaactgaacctaactgccctgaggattctgaaaatatttcctgctcctcaaaagcaggaaaccaaaacctgattatgatgtcaacatcaaaaccatatctccctggccctgcctagtctgaagagtcagtgggcatttatttctttgttttctctt

SEQ ID NO: 54743 - DNA, 601 bp, Human
gggaggctgaggtgcaagaatcccttgagtccaggagtttgaggctgtcgtgaatgataatcataccactgcactccaacctgggaaactgtgtttttaaggctcaagagaaagcacagcctcagccatgtgcagtggctcacacctctgatcccagcactttgagagaccaaggcgggctgattacttaaacccagagtttgaggccagcctgggcaacagagtgaaactccatctctactaaaaatgaatttcgtatttaggcttgggtcccatctccaaaatatcttattatgtgtakgcaaatattccaaaatccaaaaaatctgaaatccaaaaaacttctggtcccaaacatttcagataagggatacacaccctgtctataagacatctggctgaaagaactcttagctcctccccaccaaaagagccctctaacatttttcctctctgtgctggaatcaccctatccacactggtcacacagacagggatagacagcctgagtatggagacgaggctactccagtaaattaagtaatgtcaacttgtggagcgtgctactagccatttgcataaggaatctactatggaaaac

SEQ ID NO: 54744 - DNA, 601 bp, Human
agacttaaagaaactttaaaatgcagtctttaatgggaggcataggtggcaggactgcttgagcccagcagtttgagaccagccggggcaacagagtgagacctcgtctctgtaaaattaaaaaaaaaaatcaggtggtgagcacctgtagtcccaggtactagggaggctgaggtgcaagaatcccttgagtccaggagtttgaggctgtcgtgaatgataatcataccactgcactccaacctgggaaactgtgtttttaaggctcaagagaaagcacagcctcagccatgtgcagtgsctcacacctctgatcccagcactttgagagaccaaggcgggctgattacttaaacccagagtttgaggccagcctgggcaacagagtgaaactccatctctactaaaaatgaatttcgtatttaggcttgggtcccatctccaaaatatcttattatgtgtaggcaaatattccaaaatccaaaaaatctgaaatccaaaaaacttctggtcccaaacatttcagataagggatacacaccctgtctataagacatctggctgaaagaactcttagctcctccccaccaaaagagccctc

SEQ ID NO: 54745 - DNA, 601 bp, Human
gtccctaaaacaaacaagatttaatgccattcattggtcaatgaatcatactttcactcatttataattgtaaataaagttaaacagagcacaccacttgttaaatggagaaaaagtaatcatactgtatgatagttattttaaagaaacattattattattattttgaagacggagtctcgctctgttgcccaggctggagtgcagtggcctgatcttaactcactgcaacctccacctcccgggttcaagcgattctcccacctcagcctcctgagtgttacaggcgtgcgccacctcrcccagctaatttttgtatttttagtagagacggagtttcaccatgttggccgggctggtcttgaactcctgacctcaagtgatctgcctgcctcggcctcccaaagtgctgggattacaggtgtgagccaccatgcccagacttaaagaaactttaaaatgcagtctttaatgggaggcataggtggcaggactgcttgagcccagcagtttgagaccagccggggcaacagagtgagacctcgtctctgtaaaattaaaaaaaaaaatcaggtggtgagcacctgtagtcccaggtact

SEQ ID NO: 54746 - DNA, 601 bp, Human
tgtccctaaaacaaacaagatttaatgccattcattggtcaatgaatcatactttcactcatttataattgtaaataaagttaaacagagcacaccacttgttaaatggagaaaaagtaatcatactgtatgatagttattttaaagaaacattattattattattttgaagacggagtctcgctctgttgcccaggctggagtgcagtggcctgatcttaactcactgcaacctccacctcccgggttcaagcgattctcccacctcagcctcctgagtgttacaggcgtgcgccacctyacccagctaatttttgtatttttagtagagacggagtttcaccatgttggccgggctggtcttgaactcctgacctcaagtgatctgcctgcctcggcctcccaaagtgctgggattacaggtgtgagccaccatgcccagacttaaagaaactttaaaatgcagtctttaatgggaggcataggtggcaggactgcttgagcccagcagtttgagaccagccggggcaacagagtgagacctcgtctctgtaaaattaaaaaaaaaaatcaggtggtgagcacctgtagtcccaggtac

SEQ ID NO: 54747 - DNA, 601 bp, Human
ttagccaggatggtctcaatctcctaacctcgtgatccgcctgcctcagcctcccaaagtgctgggattacaggcgtgagccaccacgcctggccatttgactttcttaagctccaaatgcaaagattccaaataccaagtgataaatatagtttctgtctttagaaacttttaacacttaaacattatttatttattctaagattttggtttataatacatactctgtccctaaaacaaacaagatttaatgccattcattggtcaatgaatcatactttcactcatttataattgtaartaaagttaaacagagcacaccacttgttaaatggagaaaaagtaatcatactgtatgatagttattttaaagaaacattattattattattttgaagacggagtctcgctctgttgcccaggctggagtgcagtggcctgatcttaactcactgcaacctccacctcccgggttcaagcgattctcccacctcagcctcctgagtgttacaggcgtgcgccacctcacccagctaatttttgtatttttagtagagacggagtttcaccatgttggccgggctggtcttgaactcctgac

SEQ ID NO: 54748 - DNA, 601 bp, Human
gagatggagtcttgctatattacccaggctgctcttgaactcctggcctcaagcaatcttcccacctcgatctcccaaagtgctgggattacaggagtgtgccaacatatccagcctcaattttcttggttagtttgtattttctaatctgtctccaataaacactggcttctataataaaaataactaaaataggaatactatcaggaaacaaatctcatatggctgagaacacactggatatcatttgttaagtaataaggcttaagggctaaaagaaaactcaaggcttttttttttytttgagacagtctcgctctgttgcccaggctggagtgcagtggcacgatctcagctcactgtaacctctgcctcccgggttcaagcaattcttctgcctcagcctcccaagtggctgggactacaggcgcacgccaccacacccagttaatttttttgtatttttagtagagatggggttgcaccgtgttagccaggatggtctcaatctcctaacctcgtgatccgcctgcctcagcctcccaaagtgctgggattacaggcgtgagccaccacgcctggccatttgactttcttaagc

SEQ ID NO: 54749 - DNA, 601 bp, Human
attttttatagagatggagtcttgctatattacccaggctgctcttgaactcctggcctcaagcaatcttcccacctcgatctcccaaagtgctgggattacaggagtgtgccaacatatccagcctcaattttcttggttagtttgtattttctaatctgtctccaataaacactggcttctataataaaaataactaaaataggaatactatcaggaaacaaatctcatatggctgagaacacactggatatcatttgttaagtaataaggcttaagggctaaaagaaaactcaaggcttttttttttctttgagacagtctcgctctgttgcccaggctggagtgcagtggcacgatctcagctcactgtaacctctgcctcccgggttcaagcaattcttctgcctcagcctcccaagtggctgggactacaggcgcacgccaccacacccagttaatttttttgtatttttagtagagatggggttgcaccgtgttagccaggatggtctcaatctcctaacctcgtgatccgcctgcctcagcctcccaaagtgctgggattacaggcgtgagccaccacgcctggccatttgac

SEQ ID NO: 54750 - DNA, 601 bp, Human
ttattttttatagagatggagtcttgctatattacccaggctgctcttgaactcctggcctcaagcaatcttcccacctcgatctcccaaagtgctgggattacaggagtgtgccaacatatccagcctcaattttcttggttagtttgtattttctaatctgtctccaataaacactggcttctataataaaaataactaaaataggaatactatcaggaaacaaatctcatatggctgagaacacactggatatcatttgttaagtaataaggcttaagggctaaaagaaaactcaagkcttttttttttctttgagacagtctcgctctgttgcccaggctggagtgcagtggcacgatctcagctcactgtaacctctgcctcccgggttcaagcaattcttctgcctcagcctcccaagtggctgggactacaggcgcacgccaccacacccagttaatttttttgtatttttagtagagatggggttgcaccgtgttagccaggatggtctcaatctcctaacctcgtgatccgcctgcctcagcctcccaaagtgctgggattacaggcgtgagccaccacgcctggccatttg

SEQ ID NO: 54751 - DNA, 601 bp, Human
cgtgtaccactatacccagctcatattattttattttttatagagatggagtcttgctatattacccaggctgctcttgaactcctggcctcaagcaatcttcccacctcgatctcccaaagtgctgggattacaggagtgtgccaacatatccagcctcaattttcttggttagtttgtattttctaatctgtctccaataaacactggcttctataataaaaataactaaaataggaatactatcaggaaacaaatctcatatggctgagaacacactggatatcatttgttaagtaayaaggcttaagggctaaaagaaaactcaaggcttttttttttctttgagacagtctcgctctgttgcccaggctggagtgcagtggcacgatctcagctcactgtaacctctgcctcccgggttcaagcaattcttctgcctcagcctcccaagtggctgggactacaggcgcacgccaccacacccagttaatttttttgtatttttagtagagatggggttgcaccgtgttagccaggatggtctcaatctcctaacctcgtgatccgcctgcctcagcctcccaaagtgctgggatta

SEQ ID NO: 54752 - DNA, 601 bp, Human
ttgtttgtttttgagacagggtcttgctctgttgcccaggctgcagtgcagtgatacaatcatggctctctacagccttgaccatccaggctcaagtgatcttcccgcttcaacctcctcaatatctgggaccacaggcgtgtaccactatacccagctcatattattttattttttatagagatggagtcttgctatattacccaggctgctcttgaactcctggcctcaagcaatcttcccacctcgatctcccaaagtgctgggattacaggagtgtgccaacatatccagcctcaaytttcttggttagtttgtattttctaatctgtctccaataaacactggcttctataataaaaataactaaaataggaatactatcaggaaacaaatctcatatggctgagaacacactggatatcatttgttaagtaataaggcttaagggctaaaagaaaactcaaggcttttttttttctttgagacagtctcgctctgttgcccaggctggagtgcagtggcacgatctcagctcactgtaacctctgcctcccgggttcaagcaattcttctgcctcagcctcccaagtggctggga

SEQ ID NO: 54753 - DNA, 601 bp, Human
ctaattcttgtatttttagtagagacaaggtttcaccatgttggccaggctcgtctctaactcctgacctcaggtgatccgcctgccttggcctcccaaagtgctgggattacaggcatgagccaccgccctcagccctctttgtttgtttttgagacagggtcttgctctgttgcccaggctgcagtgcagtgatacaatcatggctctctacagccttgaccatccaggctcaagtgatcttcccgcttcaacctcctcaatatctgggaccacaggcgtgtaccactatacccagctmatattattttattttttatagagatggagtcttgctatattacccaggctgctcttgaactcctggcctcaagcaatcttcccacctcgatctcccaaagtgctgggattacaggagtgtgccaacatatccagcctcaattttcttggttagtttgtattttctaatctgtctccaataaacactggcttctataataaaaataactaaaataggaatactatcaggaaacaaatctcatatggctgagaacacactggatatcatttgttaagtaataaggcttaagggctaaaagaa

SEQ ID NO: 54754 - DNA, 601 bp, Human
ttgtttgtttttgagatggagtttcactcttctaacccaggctggagtgcaatggtgcaatctcggctcactgcaacctccacccatgggttcaagcaattctcctgcctcagcctcctgagtagatgagactacaggcgcccaccaccacgcccagctaattcttgtatttttagtagagacaaggtttcaccatgttggccaggctcgtctctaactcctgacctcaggtgatccgcctgccttggcctcccaaagtgctgggattacaggcatgagccaccgccctcagccctctttgtttgtttttgagacagggtcttgctctgttgcccaggctgcagtgcagtgatacaatcatggctctctacagccttgaccatccaggctcaagtgatcttcccgcttcaacctcctcaatatctgggaccacaggcgtgtaccactatacccagctcatattattttattttttatagagatggagtcttgctatattacccaggctgctcttgaactcctggcctcaagcaatcttcccacctcgatctcccaaagtgctgggattacaggagtgtgccaacatatccagcctcaattt

SEQ ID NO: 54755 - DNA, 601 bp, Human
ataatttcaattttgtttgtttgtttttgagatggagtttcactcttctaacccaggctggagtgcaatggtgcaatctcggctcactgcaacctccacccatgggttcaagcaattctcctgcctcagcctcctgagtagatgagactacaggcgcccaccaccacgcccagctaattcttgtatttttagtagagacaaggtttcaccatgttggccaggctcgtctctaactcctgacctcaggtgatccgcctgccttggcctcccaaagtgctgggattacaggcatgagccaccrccctcagccctctttgtttgtttttgagacagggtcttgctctgttgcccaggctgcagtgcagtgatacaatcatggctctctacagccttgaccatccaggctcaagtgatcttcccgcttcaacctcctcaatatctgggaccacaggcgtgtaccactatacccagctcatattattttattttttatagagatggagtcttgctatattacccaggctgctcttgaactcctggcctcaagcaatcttcccacctcgatctcccaaagtgctgggattacaggagtgtgccaaca

SEQ ID NO: 54756 - DNA, 601 bp, Human
gcccagctgcctcacattttattgctggattttcattcaacacacattccctgagatctgagataaagcaggggctgtgctgggtacaaggaagcatgtaacaccgtctctgctcccagggagtccacggcctagcagagaatagctcaggtaaccatcagttcagaaaccgacacaagtgactgacatggaaagatgcgcgcgatgtaactttgaaaagcaagctattaaacggttatacaagattaccccattttttttaaggaaaaaaaacagatgtctggctatggatcgaaatacsaacagtctacctttggaaggccagattacgaataatttcaattttgtttgtttgtttttgagatggagtttcactcttctaacccaggctggagtgcaatggtgcaatctcggctcactgcaacctccacccatgggttcaagcaattctcctgcctcagcctcctgagtagatgagactacaggcgcccaccaccacgcccagctaattcttgtatttttagtagagacaaggtttcaccatgttggccaggctcgtctctaactcctgacctcaggtgatccgcctgccttggcctcc

SEQ ID NO: 54757 - DNA, 601 bp, Human
aaagggtgaaaggaaaaaaactagagaaatgagaaagcaggaaaaaatagagctggtctctaataggcattctaaattttctcagaactgtggctatcaacagtagatctggtctatgagggtacctggagaaccagtccatccagcagcacttggtacctggttgtatcttttaccaccttgctgagtctctgttttgcttcatttagtaggtcctacaaagattagaaaagataaaagttatctacacatctgggcagtcggctcagaacccactgtgaggctgatcctggctcatgcycagctgcctcacattttattgctggattttcattcaacacacattccctgagatctgagataaagcaggggctgtgctgggtacaaggaagcatgtaacaccgtctctgctcccagggagtccacggcctagcagagaatagctcaggtaaccatcagttcagaaaccgacacaagtgactgacatggaaagatgcgcgcgatgtaactttgaaaagcaagctattaaacggttatacaagattaccccattttttttaaggaaaaaaaacagatgtctggctatggatcgaaatacgaa

SEQ ID NO: 54758 - DNA, 601 bp, Human
gaaggccaaggcgggcggattgcctgagctcagaagttcgagaccagcctaggcaacaaggcaaaaccccatctctactaaaaatacaaaaaattagcctggaatgatggtatgtgcctataatcccagattactcaggaggctgaggcaagagaatggcttgaacccaggagacggaggttgaagtaaacagagatgatgtcaatgcactcctgcctggctgacagagtgagactctgtctccaaaaataaaaataaaataaaataaagcaacagtaaaataagatgcttctacagttcyttcatttaggttggaaaaatttcccctggtaagttccactaacagatggcatatatcacataagaccatggaaagatctatctatcccaaaccagataaatgaacccaaacctttggtgatagaaacaaaattcatgcagacatcttatattacatcaaccaagctgaggacaaatattattgtaattaacataagtaaaataaggattcacagctcagcagtaaacaattaaaacatatacagtgtttggtctgaatcctaaatctaaagcaagtattttagtggcaaaatcaaattaa

SEQ ID NO: 54759 - DNA, 601 bp, Human
agaaatagtagatacagtcagtagaaaatgcaaactataaaataaagaaacaggtcgggcacagtggctcaggtctgtaatcctaacactttggaaggccaaggcgggcggattgcctgagctcagaagttcgagaccagcctaggcaacaaggcaaaaccccatctctactaaaaatacaaaaaattagcctggaatgatggtatgtgcctataatcccagattactcaggaggctgaggcaagagaatggcttgaacccaggagacggaggttgaagtaaacagagatgatgtcaatgyactcctgcctggctgacagagtgagactctgtctccaaaaataaaaataaaataaaataaagcaacagtaaaataagatgcttctacagttctttcatttaggttggaaaaatttcccctggtaagttccactaacagatggcatatatcacataagaccatggaaagatctatctatcccaaaccagataaatgaacccaaacctttggtgatagaaacaaaattcatgcagacatcttatattacatcaaccaagctgaggacaaatattattgtaattaacataagtaaaataagga

SEQ ID NO: 54760 - DNA, 601 bp, Human
ctacagggaccttgaaggcattatgctaagtgaaatgaaacagtcacaaaaagacaaatactgaatgtttccacttatatgaggtgaatgggggagaagagaagagaagagaaataatggagagttagtgtttaatgagcacaaagtttcagtacgggaaaatggaaaagttctgaagatggatggtggtgatggctgcacaatattgtaaatgtacttaatggcacaatgtatggttaaaatggtatgtgtattttaccaccattaaaaaaaaaaaagaaaggcagggcacggtggctcrcacctgtaatcccaacactttgggaggctgagacaggcaggtcacaaggtcaggagtttgagaccagcctggccaacacggtgaaaccctgtctctactaaagatacaaaaaattagccaggcatggtggtgcatgcctgtaatcccagctacttgggaggctgaggcaggagaattgcttgaacccgggggggcagaggttgcagtgagccgagatcgcaccattgcactccagcctgggaaatgagagcgaaactccatctcaaaaaaaaaaaaaaaaaggaaactagatccctggaa

SEQ ID NO: 54761 - DNA, 601 bp, Human
cagcctggaagtatagaacacaatgagaggtgtcactaggaactatgaagcaagtatccaaaaactcaacagactatacaagcaaggatacctccatttatcccaggtaaaagaacagaggcaccgctggtgggaatgtaaaacggcacggccactgaggagaaatgacagtctgcacacaggagggaagagatgcgaatggtttctgtcaagatttaacagggcttggcaggtgattaaacacaccagaggcagttattacatttgaaacatggatcagcaggaggaagatacattattcccccagctgagagtgttagaagctgggggtaggtaaggagagaagggagggaagagaagtttggctgctggcatgagcttcaactggcagttgcagatgagggggagacagcaggcaccagaaacagcagtgccatgccatacccataaggatggttcttatcaaagtaacagtataataggtcctcaaaaaatgaagtacacaattaccacatgatccagcaattctacttctgggtatacagacaaacggatagaaagcaggacagatatccgtatacccatgtttgcagcagcatta

SEQ ID NO: 54762 - DNA, 601 bp, Human
aagagtgcgtttaaatggtgaaaataccatttaaaaaaggcctggtataaaggccactctcccagggagagaaggtagctgttagcagcaggaatactccttacatgtcttcaggcaggtaggactcctggtcaatttggacatcaacatcgtttttggtggcaattttgtacataggaattgccttctgcactgcagcctggaagtatagaacacaatgagaggtgtcactaggaactatgaagcaagtatccaaaaactcaacagactatacaagcaaggatacctccatttatcccakgtaaaagaacagaggcaccgctggtgggaatgtaaaacggcacggccactgaggagaaatgacagtctgcacacaggagggaagagatgcgaatggtttctgtcaagatttaacagggcttggcaggtgattaaacacaccagaggcagttattacatttgaaacatggatcagcaggaggaagatacattattcccccagctgagagtgttagaagctgggggtaggtaaggagagaagggagggaagagaagtttggctgctggcatgagcttcaactggcagttgcagatgaggggg

SEQ ID NO: 54763 - DNA, 601 bp, Human
acagctctagccttgtgtctaagagtgcgtttaaatggtgaaaataccatttaaaaaaggcctggtataaaggccactctcccagggagagaaggtagctgttagcagcaggaatactccttacatgtcttcaggcaggtaggactcctggtcaatttggacatcaacatcgtttttggtggcaattttgtacataggaattgccttctgcactgcagcctggaagtatagaacacaatgagaggtgtcactaggaactatgaagcaagtatccaaaaactcaacagactatacaagcaargatacctccatttatcccaggtaaaagaacagaggcaccgctggtgggaatgtaaaacggcacggccactgaggagaaatgacagtctgcacacaggagggaagagatgcgaatggtttctgtcaagatttaacagggcttggcaggtgattaaacacaccagaggcagttattacatttgaaacatggatcagcaggaggaagatacattattcccccagctgagagtgttagaagctgggggtaggtaaggagagaagggagggaagagaagtttggctgctggcatgagcttcaact

SEQ ID NO: 54764 - DNA, 601 bp, Human
ctttattttacgatctccattatagatctcaactccaccagctctgcaaaaaaaaaagcacaggaaataatcattttcaaagacttgagaaagatacatggtaccctttactcccgcagaggaatgcccttgtcttggtgtgtagactgcgcaacctaagcaacaggcttgaaaggaactgaaaaagcttctgaagatgtaacgcacagttggtttcaggaaaccccagtccccgcctagatgtccattatatgaaacagcgtagtatttgcatacaaccatcacacatcctcccctataytgcaaatcatgtctacagcacttaaaatagctaatacgatgtaaatggttgttataccgtagtgtttagggagtgaaaagaaaaagttggttgaattcacaggtgtggaccccaaagatacagagaactgactgtattcatctcaataactgtcatttaccaagtgacactatgtgtcaatttgttttgttttttttgagactcgctctgttgcccaggcaggagtgcaatggtgcgatcttggctcactgcaacctctgcctcccgagttcaagcaattctcctgcgtcagcctcccca

SEQ ID NO: 54765 - DNA, 601 bp, Human
ggagaacttaaccctggacttccaaggctcggctgtccaacagggcagtcctagctacagatggttattgtgtgctgagaaactgaatttttcggtttaattaaatatccgtaagtgagtagtggctatgatactggatgggacagtggctactaggaaacaatgttctgaggtttaagttaccagaatatgaaaaaatcaaggtgaaagtgctttagttataagacaagtatctgcataaacagtaaactgcatatctaggtcagggaataactaggttggcagccacagcaatagactmccactagaagtctagaagatgcccagcattttagaacaaatggaattttcctggcttgtttcctagagttcctgtgtacaaatctggaaacatctgaaaagccagcagctttatgataattcctttaaataagtatttgtgtctgagcacggtggctcacacctgtaatcccagcactttgggaggccaaggcgggtggatcacctgaggtcaggaatttgataacagcctggccaacatggtgaaaccccgtctctactaaaaatacaaaattagccgggtgtggtggcaggtgcctgt

SEQ ID NO: 54766 - DNA, 601 bp, Human
gtataattagcgattatatacatcatctaagttcaataattaccaacttctgacctgtctcacttcatttattccctccctccataattttgaagcaaatgctaggctgcatactctagaattgatatttaatatttataatatctagcaggtagctagtgttttaggattttccaagtgcttcccttgcatgctttaatttggatctgaatgccattgtggtacagagtggagcccagaggatgtttacaggggcgtgtcgaggatcttaacccagccctgtgcacaagcttgaatgtgkgatccacagacgtgtttctgacaatgcctggtaaatcaacaattcaaacagcaaaactttattttgaacgtgcttaagaatttgggtgtttagctgaaaacctatggttaaatattttgaaatgcgaccacctttcatttattttgaaacactcaattttgtctagtaggttctatctagaacatttaacttgtgtgcgttgcactgtcttgatggctaatattttttgttgaacattttacactcacagaaacttttaaaatatcatttggctcatttgtaaaaggctaaaatgacaca

SEQ ID NO: 54767 - DNA, 601 bp, Human
ggaactcagactatgacaccttttttgggaagtggtatggagaatcctggccaggtgccctaagccaagcccatgccaatgataccagggcacagagaagttttctgtggtttatggggaggtgggaacatctgcaacacggcttctttaactccattccgttaggactggagagcacgaaggagcccgtctccctgcaaaaatgggcagttagagggttctgggggccaaatggacacccttctgcctgcagccttctgcagtctccccatgtagacaggcatggccaagctctgtggakttgataggtgtattctgacctcagagcactgtgtgggctcccaggggctgcaggtcactgctgcctcctcctcccctcccatcacaaaaggcaggtttcccgagaagcactgggcgcatgcctccgagtgaggggccttggctcacagggcagcggctggggcagagctgctggattggtgagtccattgggagcccccagccttgggtcaggcccatacagagcttggggtgggggttaatgccactgttgaatgtgctttctcctagtgaccttcaaagggagatgaaagttaaaaat

SEQ ID NO: 54768 - DNA, 601 bp, Human
tggccagagctggcctcctgtgagctctgttgctgccctaactgcagtgcctatcatctgagcccctctcgcgagccaccttcactcgctaaagtgaatttaggccgactttgtttttgctgtgtctggcttgctatctattctttgttatgagtgatctcaaatatgccctatgatcgaagagttctgagcagagagaattcagcagcccttcaggagccacatctgtccttactttaattacccctctgtgacactgtgggcctgcttttcacttgccatccctgacctaggtcctaaratatatgtgatctattatcccagcctgacaactagagataattcggtgtaatcacatgcttcctgacagcaactggggcatgagagcacaggtggtcagggagtgtgggtggtgccaggctttcacagggcacacactgtggtccacgtcggcccctctcccagatgatatgccacttttactgtcttgtgatacttggaaatagtatcacaagacagcctttttaaggcttcaaagtctccttttgccaaggatggtgattagcttatcttagtcctctgagaacaaagcaaaaggaaa

SEQ ID NO: 54769 - DNA, 601 bp, Human
ccatgagccattcgccatttcgctctgcacaagagacatttcctgtttggagttctgctatccgaacttggtcttgcattggcgcagatgtgggcacaccccagggccctgggagttcagagctgcaagtgaggcaggaggccatgtggcctaaaagaaagaagtcaggcccgggtcagcagccctggattctggtccaggctcttttgctgctgcagtgctgtgacatactgaatttgtcccttttcctctctgagctcagcagtttcatctgtaaaataatggagagggaatcatattrggtgatccatgaggctggcccagctctggtatcgtaaatgtttgtagccaatacaacatccctggttatgatagaaggatgcccttgactggcccagctctggtatcctaaatgttcggagccgatataacatccctggttatgatagaaggatgccttttcttagacgtgaggatgcgtcccacgggcttcagcactgggtctgctctgtggaacttccaggccgaaggctggggagggtaatggggcagcatggctgcaggagtcgagctcagtgcctgagccgggagctcgatgcgg

SEQ ID NO: 54770 - DNA, 601 bp, Human
gtaatcccagcactttgggaggctgaggcaggtggatcacgaggtcaggagatcgagaccatcctggctaacatggtgaaaccctgtctgtactaaaagaatacaaaaaattagccgggtgtggtggcgagcgcccgtagtcccagctacctgggaggctgaggcaggagaatggtgtgaacccggcaggcggagcttgcagtgagccgagatcgcaccactgcactccagtctgggcgtcagagtgagactccgtctcaaaaaaaaaaaaaaaaaaagaaagtaaataaaaaaaattaaraaaaaaaaaggctggaccagctgccctgtaggatgtctcaccttctggattgattttgttttctctgatatcactgaacttaattaaccctctgatccctgtgtttcctgtgaagtggaaactgaatctacagggctcagtgatgagggctgagtatttttgagaagaagtcctcactggtggtgtgtgtgtcacattgcgtcccatcaggaggtcctcgatgtcgggttggcccacagttagcgatgctgagattgatcgcggccttaggctggcgaccctggtagttacgtcccccct

SEQ ID NO: 54771 - DNA, 601 bp, Human
ctgctctccatgcccagaatttcttccacgtctccaggagccccacactttgacgtggactctactggcttctgtgcccagccgtgccctctggaggctctgcccctggcttgggttacccggagctggaaaatgccagggcaggtcatgggtaaaaatagaaacccacagacctggcacatgcttcctgctgggctcaggcggctgccccaggcacagtgtcgccttgtgtgggccactgcttccccagggcagggtgtgggtgggaggatgagtctatcacgcctacgtgtgcacgtgaacacacacacacacacactgtctctctccccacccccctttttctttaataatttcaacttttattttagattcagggagtacatatgcagatttcttacatgggtatatattgtgatgccaaggtttggggtacgattaatcctgtcacccaggtaatgagcatagtacccaatagttagttttccaatctttgcccgcttcttccctccccgctccagtagtgcccagtgtctactcttgccatttttctgtccatgagtacccatgtttagctcccacttataagaacatgtggtat

SEQ ID NO: 54772 - DNA, 601 bp, Human
tgcttccccagggcagggtgtgggtgggaggatgagtctatcacgcctacgtgtgcacgtgcacacacacacacacacactgtctctctccccacccccctttttctttaataatttcaacttttattttagattcagggagtacatatgcagatttcttacatgggtatatattgtgatgccaaggtttggggtacgattaatcctgtcacccaggtaatgagcatagtacccaatagttagttttccaatctttgcccgcttcttccctccccgctccagtagtgcccagtgtctactsttgccatttttctgtccatgagtacccatgtttagctcccacttataagaacatgtggtatttggttttctattcctgcattaatttgcttaggataatgacctccagctgcatccatgttgctgcaaaggatatgggttcattcttttttgggggctgcgtagtattccatggtgtatatgaatgacattttctgtatccagtctaccattgctgggcacctggttgattccgtgtctttgctgttgtgaatagtgctgtgatgaacgtgtgagtgcaggtgtctttttggtaggatga

SEQ ID NO: 54773 - DNA, 601 bp, Human
attgttgatacatttgggcacttacaagtgccattacagatgttaagcacattccttcatttaatccttaataattagacttaggaggtgtccttcctgtgctttacagatgaagaaattgagggccagggtggttcaatatcttagcctgggtcacacagctaaaaagtggcagagctggggtttgaactcagttggactacaaagctcttgagttgtaggttgtgtcactttatttatttaagcttccatttgcttatctgtataatggaaaagcttggacctgatcacatgttctttccctgggaggtaagggtgccaaacttttgcatatattcactttttctgtttagaggagggcttgtcagggtcattggcctcaaagctgtctgtggtccccaaaagttcaaatcacacccagtgggaaaatcctgtgattctatgaattctctggtgagagctgacatccgtgcttacaacgtatcaggcccttgctcagcatgttatgctattttatttaattgtcacaataaccttatgaggattttctattgtccccattttcactaagaaggaacagaagtggccaggcatggtggcg

SEQ ID NO: 54774 - DNA, 601 bp, Human
acacagctaaaaagtggcagagctggggtttgaactcagttggactacaaagctcttgagttgtaggttgtgtcactttatttatttaagcttccatttgcttatctgtataatggaaaagcttggacctgatcacatgttctttccctgggaggtaagggtgccaaacttttgcatatattcactttttctgtttagaggagggcttgtcagggtcattggcctcaaagctgtctgtggtccccaaaagttcaaatcacacccagtgggaaaatcctgtgattctatgaattctctggtragagctgacatccgtgcttacaacgtatcaggcccttgctcagcatgttatgctattttatttaattgtcacaataaccttatgaggattttctattgtccccattttcactaagaaggaacagaagtggccaggcatggtggcgcatgcctgtaatcccagcactttgggaggctgaggggggtggatcacggggtcaagagattgagatcatcctggccaacatgttaaaaccccatctttactaaaaatacaaaaaattagctgggcatggtagcatgcgcctgtagtcccagctac

SEQ ID NO: 54775 - DNA, 601 bp, Human
aaaaccccatctttactaaaaatacaaaaaattagctgggcatggtagcatgcgcctgtagtcccagctactcaggaggctgtggcaggagaattgcttgaacccagaaggcggagtttgcagtgaaccaagattgcaccactgcactccagcctggcgacagagcgagactctgtctcaaaaaaaaaaaaaaaaaaaaaggaacagaagtttggagaggttcagtaacttgctcaagttcttacaaccaagaaatggcaaagttgatattagaactcaggctttctggctccatgtaccyttctgaaattggtgccctgagtcaccttccaaggttgggttgaagtgtgtcggcagcagttcccacaaaatcaaatgacaagagcagggaaagtgggcaaggagttggggccctcaaagggcaaagtcaccatccactgtggttctgaaactctcattccctgttcaaccaagttactgggctgaaaccttcatgtacctagaggcgtgtgcccctgcagcttgtcatcctattaaaaaaaatagagacagagacttgctctgtcatccaagccagagtgcagtggtgtgatcatagatt

SEQ ID NO: 54776 - DNA, 601 bp, Human
gctgggcatggtagcatgcgcctgtagtcccagctactcaggaggctgtggcaggagaattgcttgaacccagaaggcggagtttgcagtgaaccaagattgcaccactgcactccagcctggcgacagagcgagactctgtctcaaaaaaaaaaaaaaaaaaaaaggaacagaagtttggagaggttcagtaacttgctcaagttcttacaaccaagaaatggcaaagttgatattagaactcaggctttctggctccatgtacctttctgaaattggtgccctgagtcaccttccaagrttgggttgaagtgtgtcggcagcagttcccacaaaatcaaatgacaagagcagggaaagtgggcaaggagttggggccctcaaagggcaaagtcaccatccactgtggttctgaaactctcattccctgttcaaccaagttactgggctgaaaccttcatgtacctagaggcgtgtgcccctgcagcttgtcatcctattaaaaaaaatagagacagagacttgctctgtcatccaagccagagtgcagtggtgtgatcatagatttctgcagccatgagctcctgggctcaagtgatcc

SEQ ID NO: 54777 - DNA, 601 bp, Human
taacttgctcaagttcttacaaccaagaaatggcaaagttgatattagaactcaggctttctggctccatgtacctttctgaaattggtgccctgagtcaccttccaaggttgggttgaagtgtgtcggcagcagttcccacaaaatcaaatgacaagagcagggaaagtgggcaaggagttggggccctcaaagggcaaagtcaccatccactgtggttctgaaactctcattccctgttcaaccaagttactgggctgaaaccttcatgtacctagaggcgtgtgcccctgcagcttgycatcctattaaaaaaaatagagacagagacttgctctgtcatccaagccagagtgcagtggtgtgatcatagatttctgcagccatgagctcctgggctcaagtgatcctcccacctcagcatcccaagtaactgggactacaggtgtgcatcaccacgcccagttaacttttaaaattttttgtagatgcgaggtctcactatgttgcccatgctggttgtgaactcctggcctcaatggatcctcctgcctcagcttcccaaactgctgggattacaggcattgagtcactgtgcctg

SEQ ID NO: 54778 - DNA, 601 bp, Human
agctttggttgagacacaagtgctgtcaaagttttgtctgtttaggccattttagaaaagtttggtgctattttaaattgattaattggttaatcacctttggttttgtttactgagcaacaagtaatgatttggtattggcccaaatctactcacctgaagtacagtgcttttggtgttcatgatttggttcaatttgcctaacgttagttttgtttttttttttttttttgagacggagtctcactctgtcacccaggctggagtgcagtggcaccatctgggctcactgcaagctccrcctctcaggttcacgccattctcctgcctcagcctcccaagtagctgggactacaggcgcccgccgccacgcccagctaattttttgtatgtttagtagagatggggtttcaccgtgttagccaggatggtctcgatctcctgacctcgtgatccgcccgccttggcctcccaaagtgctgggattacaggcgtgagccactgtgcccggactttttttttttttttttttttgtgaaacggagtgtcgctctgtcaccaaggctggagtgcagtggcgcgatctaggctcactgcaagc

SEQ ID NO: 54779 - DNA, 601 bp, Human
gtttaggccattttagaaaagtttggtgctattttaaattgattaattggttaatcacctttggttttgtttactgagcaacaagtaatgatttggtattggcccaaatctactcacctgaagtacagtgcttttggtgttcatgatttggttcaatttgcctaacgttagttttgtttttttttttttttttgagacggagtctcactctgtcacccaggctggagtgcagtggcaccatctgggctcactgcaagctccacctctcaggttcacgccattctcctgcctcagcctcccmagtagctgggactacaggcgcccgccgccacgcccagctaattttttgtatgtttagtagagatggggtttcaccgtgttagccaggatggtctcgatctcctgacctcgtgatccgcccgccttggcctcccaaagtgctgggattacaggcgtgagccactgtgcccggactttttttttttttttttttttgtgaaacggagtgtcgctctgtcaccaaggctggagtgcagtggcgcgatctaggctcactgcaagctccacctcctgggttcacgccattctcctgcctcagcct

SEQ ID NO: 54780 - DNA, 601 bp, Human
tatcctgcacatcttaatcaatttggagtaataagatacttttatagttgttctatgattgctattttccattgccattaaccaggagtaagcaaaaaccagcaagccgtgtggctggtggtaaccaagtgcccgcagtctggaaaatgccaggctcagagagtcagtggggagatacaaaatagcgagggtagaccctggggccccaggaccaggaatgctgaatggtagaagtcacccctctgagctggaccggcaggcaagcagcctggctgtgcacatgaacagctcagccactccrcccatggtcttttgtcagattctgccatcataacagctaccacattcacattaactactgccctgtagtcaggatttctttttttattttttattgtatttttcccctgagatggagtcttgctctgttgcccgggctggagtgcagtggtgcaatcttggctcactgcaaactttgcctcccgggttcaagtgattctcctgccttagcctcccaggtagctgggattacaggcatgcaccaccacgcctggctaatttttgtatttttagtagagatggggtttcaccatgttggcca

SEQ ID NO: 54781 - DNA, 601 bp, Human
catgctgccagaacttggcaagaccttcaacaaccttcttggattggagaccctgcttttcttctaagaagccccaattcccaaaaacctagagcctggttaacgccaacaccatcccggggcctttcggctctctttatttattgctctggaatatccctgtgacctcttccaacagttttcactcttggcagggaaacttccttaaatttactcgcaacacaactaagaggaacttcagatgaccacttgggagagagtacacttttgaacagctttgaatctagaatgcgtttccctrttacacatacacatgtaccagacacctcccacccgctcctaatgtcgctcgtgactctcatttgcctacttgctgagccccctataccagccctgtcctccttctctagcctttgattgcccagcccttccccatctacttttttttttgttttgcttttaagagacagggtcttgctgtgtccctgccactggagtgcagtggaaccactgtagctcactgcagccttgacctcatgggctcaagtgatccttccacctcagcctccctgagtagctgggactagtaggcatagccacc

SEQ ID NO: 54782 - DNA, 601 bp, Human
ttattgctctggaatatccctgtgacctcttccaacagttttcactcttggcagggaaacttccttaaatttactcgcaacacaactaagaggaacttcagatgaccacttgggagagagtacacttttgaacagctttgaatctagaatgcgtttccctgttacacatacacatgtaccagacacctcccacccgctcctaatgtcgctcgtgactctcatttgcctacttgctgagccccctataccagccctgtcctccttctctagcctttgattgcccagcccttccccatctacttttttttttgttttgcttttaagagacagggtcttgctgtgtccctgccactggagtgcagtggaaccactgtagctcactgcagccttgacctcatgggctcaagtgatccttccacctcagcctccctgagtagctgggactagtaggcatagccaccgggcctggctaattttttttttttttttggtagagatgggtttttgctctgttgccctgcctgcttccactttctcttcagcttctcccttgccacctgctggcttccccagtcccatcccgcctgttgcatcccatagc

SEQ ID NO: 54783 - DNA, 601 bp, Human
atgtaccagacacctcccacccgctcctaatgtcgctcgtgactctcatttgcctacttgctgagccccctataccagccctgtcctccttctctagcctttgattgcccagcccttccccatctacttttttttttgttttgcttttaagagacagggtcttgctgtgtccctgccactggagtgcagtggaaccactgtagctcactgcagccttgacctcatgggctcaagtgatccttccacctcagcctccctgagtagctgggactagtaggcatagccaccgggcctggctaattttttttttttttttggtagagatgggtttttgctctgttgccctgcctgcttccactttctcttcagcttctcccttgccacctgctggcttccccagtcccatcccgcctgttgcatcccatagccccactcccacgcccctgaccatgacttgaagccatgccaagtgaccaagatgtcccatcctgagttatcctctggctgacttgtatcttcttctgtggctcctcctctttctgtgtccctcaggtgggcatcaactaccagcccccgaccgtggtccccgggggagacctgg

SEQ ID NO: 54784 - DNA, 601 bp, Human
cctttgattgcccagcccttccccatctacttttttttttgttttgcttttaagagacagggtcttgctgtgtccctgccactggagtgcagtggaaccactgtagctcactgcagccttgacctcatgggctcaagtgatccttccacctcagcctccctgagtagctgggactagtaggcatagccaccgggcctggctaattttttttttttttttggtagagatgggtttttgctctgttgccctgcctgcttccactttctcttcagcttctcccttgccacctgctggcttcccyagtcccatcccgcctgttgcatcccatagccccactcccacgcccctgaccatgacttgaagccatgccaagtgaccaagatgtcccatcctgagttatcctctggctgacttgtatcttcttctgtggctcctcctctttctgtgtccctcaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaa

SEQ ID NO: 54785 - DNA, 601 bp, Human
acagtctgcattatgaaagggtaattccactagtaaattctctgcaatgagtttcatttggctgaacttttacaggagacaggtttatgggagattgtcttttatagagattccatagatccacccactgaaccaagagatgtactttcaagacctatgtttaaatttcatattgtagggacaacaaatgtattattctaagtggcttgactccagaggaatatcaactacttcacaggtagaatacaaatatcattctcactttaaatctgagtaaatagtcttaaacactttctaaatmctattatatgtacaaactttgcatgcaaaggttgagtcaagtcggcagaggagtataagtaaacacagccttctcccgtaagtacacagtattgaatgaaggagaaaagggctttatactctattccctcaatccctcaatcaaagaccttttagaagaaaaggcagagttaaaataataagcccagttctatgataaggaacttccgtatttgaatttcattgaattatagagttggaaagagcctcccggggatccgtgtaacaccagacctcaccccagatcaccagaccaccttct

SEQ ID NO: 54786 - DNA, 601 bp, Human
gaataagtattactaactattctgtcttagagatgaataaaacactaatatatctaattttaatgctaaatcctaaagcactattattgtaagtctcatcggggaaccacagagagccataattgtttttctagtatcattttactgatttatctttaagctttctcactttctgatggaatagaaattgtttactgataagtttttattaattttaagaaagtacatatatcattcttgaaaagaacagtaagtctttcatttcccacgctgaatacttctttctaatacacattgaatygactaccaatatggtgttttggaaaagcttaccactccaatttcatcacaagtctgtatagaccacattacttacaaaacttaaaatagagtttaaaatttgtttgacttatttcagaactattggacttcatgtctctcataagactgatgagaactaataatggaactagggctttcattataagcccatctttaggggaaagtcactggatagaatatctccaatttctctaattacattagaaaaaactggcaggggtatgtcccttaaggtacaaaaagatttcgattggctgtt

SEQ ID NO: 54787 - DNA, 601 bp, Human
aacttcaacttgcccatcacaaagtctcaagccccagtgggtgcaagataagcccaagcacaagaatattgcaaattatttccttggggatggtgggtggtgaagctctgtagttctccagcatttgccctttcaactacacacttctctcccttcaaatgttcaaaggcccatgcctaggagatctaaggtactgagagctttatcacccaataaatatcattggaatgacttgagcctcccaaaataaaaacaattacattgagtaacattctccttctgaatgcatgttagacacaarccaaagtatggtaagtagagatttaaagagaaaaatacataaactttgccaaatgtactttagatcacattcgtcatttagattaacttgactgacaattggaaagagagacaaaaattgaactggcataatgtccgatggcccatgtttcactggtcagctcacttctttatttcttgcgatttgtcttgagctgaagcaatatttgccagatgtggttctatttggcaatatccccagggaccagctggcaattaaaatatattctattaaagtcataatgcaaagtgtacagtcatg

SEQ ID NO: 54788 - DNA, 601 bp, Human
agagttcatacatctgtgtgtctacctcctcatgcaggtttgcatcttctgagagatccaggaaatgcttttccttgactataacttgttatccaaccatggaacaaggcataaccctttcagttttaagatcatttgagaaagggaggaacaggtattggagtgactttgccatggttttaagacacaatgttactccttatacctacataattattctggaaacaaatgaagttactccatatgactggctttatttacattatgactagtgtgcctagtggtcccaatatttatcacytttttttattaattttttttatttttaatctctgtgggtacacagtaggtgtatgtattatatttatggggtacattatatgttttgatacaggcatgcagtgcataataatcacatcagggaaataacaccttttgaaaaaatactgtataggtatataggatcaaactcctagatgttttttaaagaattataagagacagcaggattttcagaggctcacacttggagaaaacacggatactgttaagctacagtgacggcattgtagctccccataactgcacaacttctcatata

SEQ ID NO: 54789 - DNA, 601 bp, Human
ttattcatatatttatattaaatgtaataataagcattgtattgtgaaatttatcttgtttgaacgttcagtacagtgagtgatttgattcaagatgcctaaggaacaaaaacacaagtttccctcattaatgaaccacaatagtaacataactacattatataaaaaaatgcacggaccagacactgacacccaattgtttctaacctcgctctttctgtaaggaatgcaggtaaaatgaactaagatcaccaaatggttgcagtgagtcacatcactcaccttcggacttgttcactcrccaactacacagacacactcaacattctattgtattttcaatctagagttcatacatctgtgtgtctacctcctcatgcaggtttgcatcttctgagagatccaggaaatgcttttccttgactataacttgttatccaaccatggaacaaggcataaccctttcagttttaagatcatttgagaaagggaggaacaggtattggagtgactttgccatggttttaagacacaatgttactccttatacctacataattattctggaaacaaatgaagttactccatatgactggcttta

SEQ ID NO: 54790 - DNA, 601 bp, Human
ctttacaataaactcaatttcatagccataattacatgaggtaactactgtcctaaccactaatttgtgttaatacagaccacttctctgcaaaattctataatctatttccactcttgaacagatataataacttcatttgcaacactattcctacttattaactaattagtaatcagtaaccattaaaaattaattacaataatatatttttctcagaaaaagctttagaaaaatatgcttcagttcaactacaaattacttggaagctaagtatcagtaattacaacacagtcgattmtaaaaaaaacaagaatcaaaagattttgaaaataattttctatgaattacaacttacattgctcgccagtgtagcagcaagctgattctgcctaaaagaagcactttcaagaggattgtaatgatgtttcttatccttcatttcattatcaaatttttctttgtatttaatctgtcataaaagagaaatagtacatgtaactttacatttaaaagtaacacatatgattttcacgtagataaaataaaagctaccttaaaaatgaatgttgccaagtgtaaattcctggtatccatcgcc

SEQ ID NO: 54791 - DNA, 601 bp, Human
ttagatccaagcaatctgactccaaacctttagctttcagcactatgttccatgttcctttaagtatatttcatctctatttctaagaaagcaacagatcaataatacataatttttatacttgagaaggaaatctaaatattttcaactatagcaaagtaatcaattttttgatgttgctgtttttatactctaattctaacaagaatttaaaacatcatttcttgtaaaatgaattttgatgatttttaaaaacacagaatgaaaacaaatcacataaggaagtacttcacagcatttwcacaagggataaaaaataaattgtgaggcattacagtaaaatttctaaaaatttctttatatgataaattaccatgtaccaggcagtactttacaataaactcaatttcatagccataattacatgaggtaactactgtcctaaccactaatttgtgttaatacagaccacttctctgcaaaattctataatctatttccactcttgaacagatataataacttcatttgcaacactattcctacttattaactaattagtaatcagtaaccattaaaaattaattacaataatatattt

SEQ ID NO: 54792 - DNA, 601 bp, Human
acacagtaattaaggcactcatatcactctttagagtttgggttaaaataaaagtaactctgatgttgctaaagacatctaggggtctttaaaacaatagctactatgacaaatggataattttggcagaatatctcttattgagcaatcttattcaatcttttaatttataaatcaacacaactccaattttttacattaaaatgttaaagtaggctattctttgtttcttcacaaatgctagataaaggaggccattctaatatacaataaagttgagcaaatgtatacagctttatayaatgtacacaactttgtaaggagacacttcaaaaggaacacatttttaagtctttctctcccaggaagtagtcaatcacaatttgtctatggggaaaaagaaatctgtcctctaggcaaaagcaccacctaaatgaagatctaaactttatatatgatacatgaaataagtaacgtatgactttgctgtgttttctctgttgaagagatgatagaaacaatttatattagactgcgatttttttctctgttattataaaataaaggtcaacgttcttgaaaagcaatattgcataggagt

SEQ ID NO: 54793 - DNA, 601 bp, Human
tttaaccagttaaaatctggaaagaaagataataatacagactttataatttgattagaagttatcttgtaatatgtatttataaaataatcatgaatgtaacaagctacaacatagtccattactgagttaaaatccacaacaaatacatataaatatatgtaaaataatgaatatatactgaaaaattcagtaaatattgttcccaacacaattatcgattttagttacaaagaatttcagaaactcctatttaagaaaacaaaacaaaacaaaaaaaaaacgaaggaaaacttaattraattaagatctgcaaaagaacttcgaatgcgtgtctttccttatataacagtctctgctacctcctagtgggagatacacggagtaacacaaaatatatatttcttaatttatgtaaagttgtgaaagaaactcaacactaccagaggtccattttccaggggaaaatgttttccaaaactttaattagaatgattttacacagtaattaaggcactcatatcactctttagagtttgggttaaaataaaagtaactctgatgttgctaaagacatctaggggtctttaaaacaatagct

SEQ ID NO: 54794 - DNA, 601 bp, Human
cttaaaaaaaaaaaaaaagtgttttttttttaaccagttaaaatctggaaagaaagataataatacagactttataatttgattagaagttatcttgtaatatgtatttataaaataatcatgaatgtaacaagctacaacatagtccattactgagttaaaatccacaacaaatacatataaatatatgtaaaataatgaatatatactgaaaaattcagtaaatattgttcccaacacaattatcgattttagttacaaagaatttcagaaactcctatttaagaaaacaaaacaaaamaaaaaaaaaacgaaggaaaacttaattgaattaagatctgcaaaagaacttcgaatgcgtgtctttccttatataacagtctctgctacctcctagtgggagatacacggagtaacacaaaatatatatttcttaatttatgtaaagttgtgaaagaaactcaacactaccagaggtccattttccaggggaaaatgttttccaaaactttaattagaatgattttacacagtaattaaggcactcatatcactctttagagtttgggttaaaataaaagtaactctgatgttgctaaag

SEQ ID NO: 54795 - DNA, 601 bp, Human
aaaatgacaaatcaagacactagaaaaatttaaatcatcatgtggtttgaccatagtttaattaattcctatcttgtaactttttaattatgtgaattaacggttattttacaaaatgcctttagattgaaatatggttcaagctcccctgaccccaatacctacacagcaaatagtgtttgagattttcaaaagtaatgttaatattctcaggatttattcttttctgcaactgtactttctcagttaagacgcacggcagtgagcggcgggcctcaggatggttacgggttgctggcagggagggtaggtaccgtacgggcaagtgcgtacctgactttggaggacggcattgcctttatggtgcagatgttccacagcatctgcatcaaaatgatacattcctttgttttcctcaaagagctttttatattctcgctaaaatacagaatggggaaatcaacttagaatcaaagagactgattagagcaataaatacttagaaatacaaactgcacattacaagccaccaagagctgcaaagctgttgccaagtccccatctgcagttggctggcaggtaggaggtttctgacactgag

SEQ ID NO: 54796 - DNA, 601 bp, Human
caagcattggctttcccttatttttctcatattcttctttatatttcaccttcattggaaaaagaaaagcatatacaaatcgaaagtccttatacaaacagagcaaactaagaaaaaatatatgttctaaactagtcatcttgttgtctaaaatcatattattctggccatttaggttgagcactgggttccctttggttaatgacatacaaggaaagtaaacaggtaatataaaatatcttaagggataaaaataatttagaacaactaactaatgtagttctaggagttgtataaagcwtcttgtcaaatggctggaatatatagatatgtatcgtatatatggggttatacatgtatatgcaaatggcatacacacataggtagcaggtgtgagaaagagagagatccttgaggttgcattgatgtctattggtaaatcaagaacaagaaagaaaacatgggtatgattctctattttttctgtcaaacggaggaggatgtcctccagggatgctgaattttttcatagacactgagtaaaacactcacacagaccttatatgatttatatcaatttcactatgcaatatttaatatc

SEQ ID NO: 54797 - DNA, 601 bp, Human
agaccaatacaatacagtgttctgagccctttcctaccctgatgcatgtattctgaattaataaattaagactcactccaaaacaggaataaaagaaaaaggcaatggcacatagtaaagtcatttatgaatctcaaaatagacttcacattgccatttgtatataagtgattaaaaaaagattctcctttaaaaaattaacataaatagtgtatttttaaatggaagacaacagtagtaggaagttgccattatttgaaattgttttaaaaataattattaaacatttttcttccaaaamgccttatggccaactatttctcttttttccttttatttttagttgacacataattgtacatatttatgggatacagagtgatattttaatatgtgtacacaacatattatgatcccatcagggtaattagcatatccatcacctcaaacatgtatcatttctttgtgttgtgaacactcaaaatcctctcttctagcttattaaaaacatccaatcaattatagttaaccatattcaccttacggtgctgcagaacaccagagctcattcctttgtatcgattaaccaacctctccccat

SEQ ID NO: 54798 - DNA, 601 bp, Human
ttcctttatttaaagaatgtgaatatagctgagattaaggtcatgttttaaacacataaaaatttagaatgttttctataagacactgttaaactacctcaacaaatgggtgaccatgagaggataatcagcacattctactcccccaatcccagacacaatgattatgccaggtgtaagcacaggatagagattaatccaaggagattcaaacctaagactttgattggaactataaaaagggatgttcacttcccattgggattactggccatagatatgagttatccttttattaagwgggttcattgcatggagacagccttccagaagcaaagccaatagtgaagataacagaaccaagagatggaggaagagagacatcatctgaattctaccttgacagtaactcaatcttcggattttctattccatgagtgaagacatctcctttgatgcctaccctagtttgagttgggtttctgtcatttgtaacctaagagtcaccatcaccatcgtcatcgctatcatcatcatcattatcatcagagtttcaaaatatggggacaaggctttaagctctttcactgctaaattcagc

SEQ ID NO: 54799 - DNA, 601 bp, Human
gatctttgatgttactattgagacagacagataggagggggtcactggcaaaactccaactggcctgtgcactgggaagagcatgcgctggggtggagccacagaagttccggcagtttgcaagagggaggagcctggcctctcctattcctgtgtggaacctgggattcaaactgtgaggtgggaagcactctagcagggactctggccttgcagagagtccctgtttcccccttttcttcctttacacccaataaaactctgctttactcacccttcaaactctctgcaagcctaaatwttcatggccatgggacaaggaccctgtctttagctgaaccaagaagaagtcctgcaacactattgtaattgttgggagatgccaccaaatgcacccctataagtcagtgaacttaatcgagaaatgttgtgtgtgttctggctgctccactgatcagccgttcctctatctctttccctctctttgggcttccctattccctaagtcaaaacaatattgaaattgggccgattagtaaccctacaatggcccctagatggtcaagtaaacagaagagacgtgctttaagtcaaaagctag

SEQ ID NO: 54800 - DNA, 601 bp, Human
ccccaaacttaaaataaaagttaaaaaaaaaagtgctgatgcaattcctcttcctcaaaataaaaatatagaagtttagaaatttattaagaatgagtaaatggttagacatattatcagtaaaaacaatcaataaccaggaataaaatcacttcatatgactattttcaccttcaaagtaaaatctgtgtagaagacagacttctttcctgagttaaattttaaaatttagttaataactgtcatttataccgaagaggaaattttgaatttgtaattccaaaaaaataatgaaaaatgwtaatttgtaaaaattatcagtattcttattattttaaagaaataaagataatacacttgacagaaaattcaactaagacagcagaaaacatcagacaatgaggaaaaaagaccatttcttacaaaacaaaatttcaaggtggcaacttaaaagaagtaatggctactcaccgcactaatgttttgttgagttgtcttaattctctgaatttcaggagtatctgctatggtagaatagttagaaagcatcttctctgcttcatctttatactttctctaaaaacataaacagttaatataa

SEQ ID NO: 54801 - DNA, 601 bp, Human
tttcttccaacttgtggagaggtactgaaatgtatcctttctctgcaaaatttaatagagttaaaattctcttcaaagagatgaaatctaaccctaggtttcattaaaatgacctagctcttcttcattgtgatatatcaaaatgaaacactgcttcagagtcaaggggaacaaggatacagtttttgttctgaaagttagatctttgatatatgatgaaatagcatttcaataaagtgaagaataaaaggaaaaaagccatcagttgagtaaagaactaaaaacatttgtctatagtttyggtttgcttttagaaaagataattaatgctgtagagaacttactgaactaatattctgctgatttttcttcactcgttcgatctctgggctatctttcactgcagtgccagctcccacttctttcttataaaatacctttattataagaaaaggaaaagaataactaagcttgtcagaattcaagtcctagatccgcttcttagaaagacaatttctcaggttttataataatatgaatactgcatctatttatgagtgccggaattataggaacaaattaaataatccattcagataat

SEQ ID NO: 54802 - DNA, 601 bp, Human
cagctactcgggaggctgagacagaagaatcacttgaatctgggaggcagttgcggtgagctgagattacgccactgcactccagcctaggcaacaaagcaagactctgtctcaaaaaaaaaaaagaaactcaatgtactaaatatacatgggagaatatcaaattggtaaggagagcaattatccacagcaaatgtcaaacactcaatggaaaaaacaatttatccgtaatattaagcaccttaatgttagaaggacccttccaacagaagaggacccctccccccagtctaaaggttaytggaagctaagttatttcacaatttatagtgaagatgtgtgatttgttttcgtttctgctggaagaagcagaaggtaaaacaggctggaaagaagaaatgggcagaagcgtgtctgataaaaagcttagagatgtgactgacatcggttaaaaatgaactggtactatttgccttttcaaatctaatccttcacttaagctgccaaataaatgttctggggcctttaatcattgtatcagggaaaaatttctttcttccaacttgtggagaggtactgaaatgtatcctttctctgcaaa

SEQ ID NO: 54803 - DNA, 601 bp, Human
tccaaggataaggtgaaaagataagtcagagtaagggatttaaagaacgaatcctttttacttcctcaagaaactaaatgtaacggaaaggcacagtagcttatgcctgtaatcccagcactttgggaggctgaagcgggaggatcacttgaggtcaggtgtttgagaccagcctggccgacatggtgaaaccccatctctactaaaaataaaaacaataaaaataaatggccaggtgtggtggtgtgtgcctgtaatcccagctactcgggaggctgagacagaagaatcacttgaatcygggaggcagttgcggtgagctgagattacgccactgcactccagcctaggcaacaaagcaagactctgtctcaaaaaaaaaaaagaaactcaatgtactaaatatacatgggagaatatcaaattggtaaggagagcaattatccacagcaaatgtcaaacactcaatggaaaaaacaatttatccgtaatattaagcaccttaatgttagaaggacccttccaacagaagaggacccctccccccagtctaaaggttactggaagctaagttatttcacaatttatagtgaagatgtgt

SEQ ID NO: 54804 - DNA, 601 bp, Human
accctagatagtgtacattgtacccaacaatatttcacctctcatcctgctctcaccctcctaccttttggagtctccaatgtctatgattccactctgtatgtctgaataatatgtgtctttaataaataaatgctgacacaaggcattaggctaggtgtcatggagggcatacagatgtgtaaaatgctagctccacttttaaggaaccgatcctctcgcaatgaggttcattgtgatggcatttgacctgtacaggttttatgctgtcattacgtgttgatatacaataaaatttttwaaaaatacttaagaaatatgatcacattgctgatgttcttctggttttctttaactctctttagttctggaggatcagaaatggctgttgcatgtttaatctcttctttgtatttcacctgcataatttataagaatataacgttaactttattctatgcaaggctttaaaatattgagaattcttcaattgtaactattgcataattgaattttattaattccaacattacttttccttcactggggacataattcttaattttatatgatgctttcaggattccttattcctaaggta

SEQ ID NO: 54805 - DNA, 601 bp, Human
atagatagatatctatacctattttcataaatatatatattcatagatatctatacctattttcagaaataggtatagataaaagaaatagaaaatgttcttttttgtgatttgttttgctttgtagactaatatatagatagtccatatgtctatatagataggtagtagtctaactagatatagaaagactatatagagatatatacagactatctaatatagactatatataaactaatatagactatatagagatatacagactatctaatataggctatatatagatatatagagactatagatatatagatatatagagactatagatacgtatatatgtctacaaaacaaaataaatgacaaaacaaaaaagaaaatatcaatatatgtttctgaaaataggtttcattcctttttaattattatagattcaaaggtacaagaacagttgtgttacatagacatattgcatagtggcgatgtctgggcttttagtgtaaccattaccctagatagtgtacattgtacccaacaatatttcacctctcatcctgctctcaccctcctaccttttggagtctccaatgtctatgat

SEQ ID NO: 54806 - DNA, 601 bp, Human
ctatagatagatatctatacctattttcataaatatatatattcatagatatctatacctattttcagaaataggtatagataaaagaaatagaaaatgttcttttttgtgatttgttttgctttgtagactaatatatagatagtccatatgtctatatagataggtagtagtctaactagatatagaaagactatatagagatatatacagactatctaatatagactatatataaactaatatagactatatagagatatacagactatctaatataggctatatatagatatatagagactatagatatatagatatatagagactatagatacgtatatatgtctacaaaacaaaataaatgacaaaacaaaaaagaaaatatcaatatatgtttctgaaaataggtttcattcctttttaattattatagattcaaaggtacaagaacagttgtgttacatagacatattgcatagtggcgatgtctgggcttttagtgtaaccattaccctagatagtgtacattgtacccaacaatatttcacctctcatcctgctctcaccctcctaccttttggagtctccaatgtctatg

SEQ ID NO: 54807 - DNA, 601 bp, Human
ggtctatctatagatagatatctatacctattttcataaatatatatattcatagatatctatacctattttcagaaataggtatagataaaagaaatagaaaatgttcttttttgtgatttgttttgctttgtagactaatatatagatagtccatatgtctatatagataggtagtagtctaactagatatagaaagactatatagagatatatacagactatctaatatagactatatataaactaatatagactatatagagatatacagactatctaatataggctatatatagatatatagagactatagatatatagatatatagagactatagatacgtatatatgtctacaaaacaaaataaatgacaaaacaaaaaagaaaatatcaatatatgtttctgaaaataggtttcattcctttttaattattatagattcaaaggtacaagaacagttgtgttacatagacatattgcatagtggcgatgtctgggcttttagtgtaaccattaccctagatagtgtacattgtacccaacaatatttcacctctcatcctgctctcaccctcctaccttttggagtctccaat

SEQ ID NO: 54808 - DNA, 601 bp, Human
gttatctatctatctatctataggtctatctatagatagatatctatacctattttcataaatatatatattcatagatatctatacctattttcagaaataggtatagataaaagaaatagaaaatgttcttttttgtgatttgttttgctttgtagactaatatatagatagtccatatgtctatatagataggtagtagtctaactagatatagaaagactatatagagatatatacagactatctaatatagactatatataaactaatatagactatatagagatatacagactatctaatataggctatatatagatatatagagactatagatatatagatatatagagactatagatacgtatatatgtctacaaaacaaaataaatgacaaaacaaaaaagaaaatatcaatatatgtttctgaaaataggtttcattcctttttaattattatagattcaaaggtacaagaacagttgtgttacatagacatattgcatagtggcgatgtctgggcttttagtgtaaccattaccctagatagtgtacattgtacccaacaatatttcacctctcatcctgctctcaccct

SEQ ID NO: 54809 - DNA, 601 bp, Human
attacttatgattaaatgagatattgcaatgtaaagtacccaaaatgcatagtaagcacccaacaaataacagttattgtaatggaacttaaacagtgaacatagctatatactcctatctctgtttctcctacaaaccttgaggatgcccacgacccctaatctcagggcatacctctcatctttaaaatcccccaagaacaagaacagagaagacattcaataacacatttcatgtttagttttgtcacttgttttgttttgtagactaatatatatatatgttatctatctatctatmtataggtctatctatagatagatatctatacctattttcataaatatatatattcatagatatctatacctattttcagaaataggtatagataaaagaaatagaaaatgttcttttttgtgatttgttttgctttgtagactaatatatagatagtccatatgtctatatagataggtagtagtctaactagatatagaaagactatatagagatatatacagactatctaatatagactatatataaactaatatagactatatagagatatacagactatctaatataggctatata

SEQ ID NO: 54810 - DNA, 601 bp, Human
gatgacttcatcaccccggcattaagcccagtactcaacagttacttttccggatcctctccctcctcccatcctctcccgtccaacaggctccggtgtctgttattcccctctatgtgtccatgtattctcatcatttagctctcattattatgcagtatttggttttacgttcctgtgttagtttgctaaggataatggccttccaaagggcatatttttaaataaaaatatgttatgtttgagaaaatataaaaggaaacagaaacgacttgccgcactcagctgctcctggtttcgyctcactctctctatctccggggtcatgcttaccggagtggccttgtagttttgctctttatactggagctgagagacaaggtgcaagacagtttgagattatgggaaataaatacgtcccaaaacattgcaacagattttttttaaatgtcacatggctacagaacattcattaataagatcatcatcaggatttcatagtgaaatatgtattgcttatagattttatcttcttggcgatgccagtcttttccttgtcaagtggttttgttgttgttgttgttgttttatttttgagaca

SEQ ID NO: 54811 - DNA, 601 bp, Human
tataaaactatatatatattattaatgagagcttgtaaaaatacatattctcaaatcctggttacttcctaaaatatactaatttaaatataaattaaatttcctatctcttcaacttcagtatgcaataaagtgatatctatttccaggcaatcattcatgaaaatggcattatttaaaatcagtttgaaattttataggtaacaatatataccacttttaatataattacaaaaacttatacttcaaaatatactttttttatgtcctgaaattaggtccaggagatagttgtgtaacygtaaattatactagaaaccattgaattgaacactttaaatgggcaaactttatggtaggtaaattacatctgataatataatttttaaaacacacatttttaaaaacacagctttaaaaacacacttcttttcatatcctttatgacaggcaaacagaccaaattttgtcttagaattaattggaaagaagtctacacaaatatctttcacactatgagtttacagtagtcacgttagaaataaagacacaccagaaaaagtcactgagaaaaatcattttattagactaaatgtttcca

SEQ ID NO: 54812 - DNA, 601 bp, Human
acaacacgtcaaccaagcagaaaaacaattattttgtttttctttttaaagaaaaacaaagtaattgttcaaccattgtgatcactcatatctctgctgcttctttgcttaacaaggaggaacattcttttttttattattattatacttgaagttctagggtacatgtgcacaacatgcaggtttgttacatacgtatacatgtgccacgttggtgtgctgcacccttaactcgtcatttacattaggtgtatctcctaatgctatccctcccccctccccccacctcacaacaggcccyggtgtgtgatacaaggaggaacattcttaaaattagcaaggtattaaagacagagcttccaataatagaaaagacttgagatgataccaggtgaatgccagaaatcccattccacatcgtacaaaaataatactttacctgcggtccattttaaattgggtaccacaaccaacatgtgatgaggagtcagatgactcaagagggtaattctgaagctagagcaagcatgatcttttcgaccacacacaccggccgacaaacgccgtcagcttaccaacaatgattccaggtctcctgtcc

SEQ ID NO: 54813 - DNA, 601 bp, Human
ccctgccttatacttcagtatgatcttttctgatatctcagccaccattcaacaaatatccttctaggatttctcctgactataaggaacagatagcaggaataaaagtttgctctcttaattgcaagactttcagatggctctcaactattccagtccagaaataatatttttaaaatgagctattactattatggagtaccatcagaacgcccatggcgtgtctgtttttgataaaaggacctaaacgcaatatggttatttctgccacttatgcacatgaggtcaacagaacaacacrtcaaccaagcagaaaaacaattattttgtttttctttttaaagaaaaacaaagtaattgttcaaccattgtgatcactcatatctctgctgcttctttgcttaacaaggaggaacattcttttttttattattattatacttgaagttctagggtacatgtgcacaacatgcaggtttgttacatacgtatacatgtgccacgttggtgtgctgcacccttaactcgtcatttacattaggtgtatctcctaatgctatccctcccccctccccccacctcacaacaggccctggtgtgt

SEQ ID NO: 54814 - DNA, 601 bp, Human
attaatattatgtagtgctgaccatatgccaggcactcttctcatttaacacctaattaatttaagtttcatacatattatcctcattttgtagatgaggaaactgaggcacagagaaattgagtagcttggccaaggttacacagctcgtaagaagtagcagagcctccaacaaaaatagaagcagcacaaattggcttaatctgaattactcagaaaatctctaaacgtgtattttcatgcctgatacagaagctggctcattggaaagtttaatgttggccaattatggaaatttcartggaaaacagttcttcccaataagaacaaataaactgacttctggattgccaagtaagtaaataacttagagtcatacatcttatattttataaaacaatcataatttcaacctcaatggttttgagtactgaattctgagagcccacggtctagacagtttcatggtttttagcaacgacctcaccatcattcctgacctctgatgtgtgcagggcctggaagtaagctgtacagactttagcagttccaccctaagtgagataaatcagaacccctgcactatcccttaagatagttc

SEQ ID NO: 54815 - DNA, 601 bp, Human
aaaaaaaaaaaaaaccctctcatatcccaagtattatgcccaatttcttttggcaaggtctaactctgtctgcaagtttatattaatatttaaaatatacacattcattataacctctgaggtaccccaatattactgtaagattgatttttttccttaatggaaatcatataaaaactatgcagaactcaagtttctcctatgactgtgtagtgtgtatatttatcacatataactcctgtgaaacagactcaagcagcaagtctcaagacccttttgtcattacaaatccattgctgcsataatagtgaagtaagacggggggaaaataacatgcaaaaatgcaaattagtagggttttttctttaaaaaaaaaaaaagactattaactttctgaacttaattttaaattctcaaatacagccaggatagatgttcatgcaaaagtgaaaagaattttaaagacactcttgtgacacacttaaaaaatgaatcgattttctttgtaagcagtgaatgtttgatacctccttcatcagacggtcttgttacctcactgcagcatgaaaagctagggtaaatctcggagatttctgacctg

SEQ ID NO: 54816 - DNA, 601 bp, Human
cagtcacattactttttacccaccaaggtgttaagttgctcaacctcaaaatttcctacctttgggatttcaacaatatggcctttgagttgaaagggaaattcagtattgcttttgttctcatatgcttcagtcctttccccctccttgctgtactaaaatataactgcaatgaggtgaggaaacattttagtcttaacctttaaaaacagatttataagtaaaattagtttaataccctaaagaaattcattgaagttctaggcttaatccatcagcctggatacagaaaacagaagayacaggaaaagagtgggtatataaaatagtgacaagattattaacaatcaatagtatttctcatttaaaaaaaaaaaaaaaccctctcatatcccaagtattatgcccaatttcttttggcaaggtctaactctgtctgcaagtttatattaatatttaaaatatacacattcattataacctctgaggtaccccaatattactgtaagattgatttttttccttaatggaaatcatataaaaactatgcagaactcaagtttctcctatgactgtgtagtgtgtatatttatcacatata

SEQ ID NO: 54817 - DNA, 601 bp, Human
aaaaaaaaagtcaactttttcttacaaggcattatttgagtcactgagtcatcgctgctgtccaaaatctccctccatctttgaagaagtatgaaattcctcctttaaaaaaaaatatgattattccctcttacccatccatgtgttactcaaattctagtataaatgcaagaatatttgcctataccttcttccaatgagacattttctcattcaatttggcttaggatagggtcctcttgctagaaataattagaaaagagaaggaatgtgggcttaagaaaaagaggtgattaactarcagcagcaggtttttacagccttggaggagagaatgcaaagagacaagtgacgtgggcatggtctgctgctgcagagggagtagaggcatccaagcagaggccctccgaattcctgatctctacacagattcatttaggacctaaatcatagacttggatggatgatttccaaactgacctcgggtgcggcctcctcttctaaactctaattgtgtgtgtgatgcttccatttgaacatctcaatgttctgccctatccaatgcatgcgtctgtcctatcagaaacatttttctcccaaa

SEQ ID NO: 54818 - DNA, 601 bp, Human
gaaaagtagattgacaagtaaagaaagtccaaaataatcacataggaaaatgaaaatactgaacaatcaaagtaagatgggaaaatatcatggaaaacacataaccaaaatgatgatgaaaacttaaaggagaaggcttatctgttaatgctcatgaaaaccaaatgtgaacgatgaaaaccttgtacttttgccttaacgaaatgagttgattgttcaaccctttgtcctaacaatcagaacttactcgaaagaaggaacgaaaactgtgactctcataactgcccaagtacttcattcrtaaagtaaaacagaccactttcagaacataaacacattcttacacatagaaagaaaagaaagaaaaaaagtttatttagggcacttagctgaggaaatgtaaaatatctgcttcttgttctgcgccattcttatgacagatgcaaaatttaagcctaataaggttaaatgacccctttgataacccggaccaagtcgtgagagcactgggacttaagtccaatgtctcgtcctccagttcagggttccggccaccgcaggacaccactgccacacaccccacctcgaccacaagcaggca

SEQ ID NO: 54819 - DNA, 601 bp, Human
aagcagatacacattgcaggcaatgaactagaggcaaacacaaagatcaaaggaaacctcacagtgaaataagctgaaatcatcaggatccttttcaccaaaggagctgtgtgtcaaataaaatataagttaagcgaatctaataccaaaaggcagtaaagataatttcaagtaatactattcatgaatcaaaacaaaattgggtagaggttaaataaaagcctctgttcttaaatcaaagtaacacagtagagatgtaaaatgcaaaccctttggtaacttaatacattgaaaagtagaytgacaagtaaagaaagtccaaaataatcacataggaaaatgaaaatactgaacaatcaaagtaagatgggaaaatatcatggaaaacacataaccaaaatgatgatgaaaacttaaaggagaaggcttatctgttaatgctcatgaaaaccaaatgtgaacgatgaaaaccttgtacttttgccttaacgaaatgagttgattgttcaaccctttgtcctaacaatcagaacttactcgaaagaaggaacgaaaactgtgactctcataactgcccaagtacttcattcataaagtaaaa

SEQ ID NO: 54820 - DNA, 601 bp, Human
ttgatgcactgccctcttgatatatgctatgaacaataaactgagagttccagaatgtactgaagcatctcttgcaactcttgaatacgtattacatgggatgaaacgccggaagcatagcctggctagggtgggttaaactgctacaaaattcagaaacttactttcagtcagttaaggtagggctaggccatccccataagactctctcacagcaaaatgggaaaggccacgaggttggaaagctgaaaatatttattttgaaaagtgcatctgtttttcattccccatcacactcccrtatccttttacgttttccggaggaaaacagaaacacatagcatacctgaagcaaaactgaatacaagttcaaatcaaggcaggtaaacaccaggtgagattgcaagcacatacgaatactttcaataccagaaaactgcaagttaaggaaaaccaaagaaacacaaagtaataccgggaagcagatacacattgcaggcaatgaactagaggcaaacacaaagatcaaaggaaacctcacagtgaaataagctgaaatcatcaggatccttttcaccaaaggagctgtgtgtcaaataaa

SEQ ID NO: 54821 - DNA, 601 bp, Human
cctcaagtaacctgcttgcctgggcctcccaaagtgctggaattacaggcataagttaccatacctggcctctacttggctatttctaaccctatgcaatacttcatcacaatgctttcctgagcacaatggttttatgcaactggttcacctaacagaatgtgagctctctaaaaacagtacccgtttcttttatttttgtgttcccagtatctcacacatacaagagatactagataaatgtttgatgactgagcagatggagttatgggtaccagtaaaacaccagggcaattggccrcacagttgatgcactgccctcttgatatatgctatgaacaataaactgagagttccagaatgtactgaagcatctcttgcaactcttgaatacgtattacatgggatgaaacgccggaagcatagcctggctagggtgggttaaactgctacaaaattcagaaacttactttcagtcagttaaggtagggctaggccatccccataagactctctcacagcaaaatgggaaaggccacgaggttggaaagctgaaaatatttattttgaaaagtgcatctgtttttcattccccatcaca

SEQ ID NO: 54822 - DNA, 601 bp, Human
agcgtttaagtctcctacaggataaaatccaaggaaagtgtgctgggaccatgttcccttgagccctatctctgcagagattggggttcagcactgcccgtgctctagttccagacttcttcttcagctcatctagacacacagcctcaagatgtgctgaactataccaagttgccaacgtgctatgctctctctcgtctaccctttttctgcctagtacattcctttcccatttctctacttggctatctctctctctctctttaaattttatttatttttatttttattttttattttyttttgaggcagggtcttactctgtcacccaggttggagtgcagtggtgtgatctcagctcagtgcaacctccacctcctgggttcaagcgattctcatgcctcagcctcctgagtagctgggattacaaccagctaatttttgtatttttagtagagaaggttttttgccatgttggccaggctagtctcgaactcctgacctcaagtaacctgcttgcctgggcctcccaaagtgctggaattacaggcataagttaccatacctggcctctacttggctatttctaaccctatgcaat

SEQ ID NO: 54823 - DNA, 601 bp, Human
ttcttcttcttaaataaagctcatgtatatttgaagtttacaacatgatggtatgggatacatatacgtggtaaaatggttactatagtgaagcaaattatcatacctaccatctggcacgtgtgtgtgtgtgtgtgtgtgtgtgagacggagaaagagagagcgcacgcgtgtgagagagcgagcaaagggcagctacaatctacttaacaaaaatctctaacataattttattaactacagtccacatgctatatgttacatctctagatgtgtttatcttacatatctgctactttgyatcatttgagttacaactccccatccccccaccccatcgtaaccattgttttattttctatctctgtaaatttgacctttctttttcagattccacatataagtgggatcatgcaatatttttctttctatgtctggcttatttcacttagtataatgtcctctagttccacccatattatggcaaatggcagggtctcctttttaaaggctaaacaatattccattgtatgtgtatatatacacattttctttacccattcatcctttgatgggcatttaagttgtttccatatcttgg

SEQ ID NO: 54824 - DNA, 601 bp, Human
aaattcagtttgcaaataacactcaaatatagttgggaagtacaactgaaattctgaaattctcttgctgaatgcacattctttacagaagtcaggctagcaaggagttggattggggagtgatcttgaagggtcaccaatcagtagtcagaaaaccgaagcagtggctaaaatagaaacaccagcaagtttattttaaatgaagatacatagttctaaatcaggagtgtattttcttcttcttaaataaagctcatgtatatttgaagtttacaacatgatggtatgggatacatatacrtggtaaaatggttactatagtgaagcaaattatcatacctaccatctggcacgtgtgtgtgtgtgtgtgtgtgtgtgagacggagaaagagagagcgcacgcgtgtgagagagcgagcaaagggcagctacaatctacttaacaaaaatctctaacataattttattaactacagtccacatgctatatgttacatctctagatgtgtttatcttacatatctgctactttgtatcatttgagttacaactccccatccccccaccccatcgtaaccattgttttattttctatctctgt

SEQ ID NO: 54825 - DNA, 601 bp, Human
gcacttttttggacaaatgtaaacacaacagcatttttgggacaaatttaaaccaacttttcaaattcagtttgcaaataacactcaaatatagttgggaagtacaactgaaattctgaaattctcttgctgaatgcacattctttacagaagtcaggctagcaaggagttggattggggagtgatcttgaagggtcaccaatcagtagtcagaaaaccgaagcagtggctaaaatagaaacaccagcaagtttattttaaatgaagatacatagttctaaatcaggagtgtattttcttyttcttaaataaagctcatgtatatttgaagtttacaacatgatggtatgggatacatatacgtggtaaaatggttactatagtgaagcaaattatcatacctaccatctggcacgtgtgtgtgtgtgtgtgtgtgtgtgagacggagaaagagagagcgcacgcgtgtgagagagcgagcaaagggcagctacaatctacttaacaaaaatctctaacataattttattaactacagtccacatgctatatgttacatctctagatgtgtttatcttacatatctgctactttgtatcat

SEQ ID NO: 54826 - DNA, 601 bp, Human
ttttttaaagacttaaaatggcattgcctttggtttttcttgaactaatgtattctaatactgacccttagacaataccatcaatccataaggagttctgatacgtagttttacactagacatcctaagtgacaagccacactaaatatcataaatagacatatcttggtgctgattaaattgctgaatgggcacatatatattttccaacaaatagacatatataaaactgactcgatgtgtccccaacatgatctcaagatacagaaatacgagaaagtaaatgtgaatgattgtctgsgtctcagagggcccaaattctctatgtgggtctgaacaaacaggcaggtatgaagattccctgccaggtagggaggtcaacaggttgactgcacacaatcgtaaggatagttagacaggagcaaggtaagaacttgacagacagaacagtagacaagtttaacacacatgggtcaggtatggcacaagaataagatcaaggaccagaatgaaaaatatagacatggtggttccatgcctgtaatcccagcaactcaggaggctgagatgggagaattacttgaggccaggagttcaaaac

SEQ ID NO: 54827 - DNA, 601 bp, Human
aaattgtcattattccactgcagaggatattctagaaatatgtattggatcaatgcatgtaacattttttaaagacttaaaatggcattgcctttggtttttcttgaactaatgtattctaatactgacccttagacaataccatcaatccataaggagttctgatacgtagttttacactagacatcctaagtgacaagccacactaaatatcataaatagacatatcttggtgctgattaaattgctgaatgggcacatatatattttccaacaaatagacatatataaaactgactcratgtgtccccaacatgatctcaagatacagaaatacgagaaagtaaatgtgaatgattgtctgcgtctcagagggcccaaattctctatgtgggtctgaacaaacaggcaggtatgaagattccctgccaggtagggaggtcaacaggttgactgcacacaatcgtaaggatagttagacaggagcaaggtaagaacttgacagacagaacagtagacaagtttaacacacatgggtcaggtatggcacaagaataagatcaaggaccagaatgaaaaatatagacatggtggttccatg

SEQ ID NO: 54828 - DNA, 601 bp, Human
cggtcatcagctgagaggaaggaggaagtgtacagcctaaaatatctttgcaaaatcaaaaatcctctctcaagccaatgctaggatcctaataatcaattctcctcttctagactctcatattatctttgttttaattttctagttttagctaaatgttatttctattcctataatgtatcctgtttatagtatatactatatcctgcttactgctgaccatactacagtaatacatactacttatagtgataaaacaattatcgccattattactttaagattgcaaatctatttattktggtgaaatatacataccataaatgtatccttttaatcgttaagtgtacagttgtttgacattaagcatattcatattgtgcaacctgcatctttataagaaaatgcaacctacataaaagtatttaagcactcaggtgtatacccctgtgaaagttagtgggggaaagaggtaacataagactctacttccccaggaatactgaatctgcacacaataaaagtttaataatataagtaaaatgcttacaaccccgttagctcaagattttactaatttagctcttaaagttctgctttt

SEQ ID NO: 54829 - DNA, 601 bp, Human
caatatggtgaaaccccaactctactaaaattacaaattagctgggcttggtggcaggtacctgtaatcccagctacttgggaggctgaggcaggagaattgtttgaacctgtgaagaggaggttgcagtgagctgagatcgtgccttttcactccagcctaggtgacaagagcaaaataattctgtctcaaaaaaaaaaaaaacaaaactcctgtctagtccatgagcaaggtggctgtgctgcttggttataacacacggccatggtatggacctttctgctcaaattgcttttacacrtgtcactgagagtttcatgtcaaagcctcaagtcctattcacatctgatcacaagacataagtgggagttaagtccacaaagtttatatgcaatctagaaacaagatgctattttttaatctgaaaggattcttagcactacagaaaccccttttccttccctgcaggatacagaagcaagccagattgcctctagattttagtttgcagattcttaattataagctctgaatagggaagtgccgaagaaacaggcttactgcataataaactaagaatacccagacttcaatataaaaa

SEQ ID NO: 54830 - DNA, 601 bp, Human
acaaccatcaaatatccatgctcctaaggcatgagtaaagagcataatcggctagtaccaatcatgaagtaacaattaggatactgtactggtagattctttgtatgttttattgttttatgtaatgcttattaatgccttcctttctcaacagtttacctctgtaagttttttgcttccttcaaaagagttgtataaatggcaacacatcatcatttatctttaaatgaaaatacccaatattcaattcaactctattccacatgtatttacatgcttgaggggaaatgggaagaccagmtaaggaggaacgtatcaaatggacacttactagatttggtgaatgctgcattgatctcatggatgacacactggtctggtgcatgtagccatagccttgggaatggctttgctgataggctccgggaagaacaggtgctgcatgttaaacatacacacacacaaagattccttaaagttagcctcgaaatacccatcccaaaccctcagagtgatgttatgctctgctagaagcttctgaaacaaaatgccttttcagtgttgtgaaatttaagttgcagtgttataagtgatctctaga

SEQ ID NO: 54831 - DNA, 601 bp, Human
gagtaggagatgccttggtacaaatgagaaataaatagataccagtcagcctagggaacaaggaaatttctctgtttagtagaagtttctagatccctaaggccaccagtcaatataattttaaccagactgtccttctgccactgtttacacttattatattgggcaattttcactaatattggaaattgcctcatgactcaaaagcaaaacgggtttgaaattattggctgcattacagagttaagagaattggcttggggtgattccaaagtgacagctaagaagtttcaaacacacrctacatttaagggacaatcaacttctctattaaagtctacaaaaatacatttcccagaagggttcaatagccaatcaaaggaaaccatgaacacaattagcagcaccaggtgtccagacacaaagatttttgtttgtaggaattactgaaaatgctgctgttttcagcccagaggtcattccttcttcctggtacctgtgtgtctaattgtcaaaggaaggatacatcattgtaaaataatggccaagttgtcttaaaagtatcttctatcttttaaaaagattaggtttgggatacatt

SEQ ID NO: 54832 - DNA, 601 bp, Human
gatgagctggcgactagaggaagaaagggcttttaggtatcagtcaccctttttgcttcaataataggaacgcgcagtgcagctgcctatgttacagaagcttgaatctacatgacatgcaacagggtaaatgctactagggaaattatatcaatgacattataatttgccctttgcagagtagctgtgaagttatttggtcctgacattctgtggaactgagcatagacttgggtccatagaatataaatggagagtaggagatgccttggtacaaatgagaaataaatagataccagtmagcctagggaacaaggaaatttctctgtttagtagaagtttctagatccctaaggccaccagtcaatataattttaaccagactgtccttctgccactgtttacacttattatattgggcaattttcactaatattggaaattgcctcatgactcaaaagcaaaacgggtttgaaattattggctgcattacagagttaagagaattggcttggggtgattccaaagtgacagctaagaagtttcaaacacacactacatttaagggacaatcaacttctctattaaagtctacaaaaat

SEQ ID NO: 54833 - DNA, 601 bp, Human
gcaattcattgcatggacactggagaatgggactgtgatgcagttttctcttttcctttaaagtacatcattcttaacagcaactggattacaaagaagtgatactatgcaaactggataccatgtatcaagcacaaaaaatcctatggcattcccaggaatatactgaagtcatacagacaactgagaaaatttgctcaaagattcttccaagtttatgggttcaagtagtctaagcatcacagaataataaccacagaagcaacatacaatgccttgacttttttgatcaacagttgayagttagttgcgaggaaagggtccaaaaggcatggaatacttcagagacttttattttagcatccttgtcagtttacatagcttcttacttaactaaaagctctcccacctccatatcaccttaaccaaaacaaccacaatctagccacttttagattatcagaagcaaatcgctaaggtataattaatttatgaagtgaagttcatcttgtgtagtgaatccagcctcacaattattctatcttacaataggcattttaaatcccaaatctaaagttaatgtttatatagctcaactcta

SEQ ID NO: 54834 - DNA, 601 bp, Human; identical to SEQ ID NO: 38502

SEQ ID NO: 54835 - DNA, 601 bp, Human; identical to SEQ ID NO: 38503

SEQ ID NO: 54836 - DNA, 601 bp, Human; identical to SEQ ID NO: 38504

SEQ ID NO: 54837 - DNA, 601 bp, Human; identical to SEQ ID NO: 38505

SEQ ID NO: 54838 - DNA, 601 bp, Human; identical to SEQ ID NO: 38506

SEQ ID NO: 54839 - DNA, 601 bp, Human; identical to SEQ ID NO: 38507

SEQ ID NO: 54840 - DNA, 601 bp, Human; identical to SEQ ID NO: 38508

SEQ ID NO: 54841 - DNA, 601 bp, Human; identical to SEQ ID NO: 38509

SEQ ID NO: 54842 - DNA, 601 bp, Human; identical to SEQ ID NO: 38502

SEQ ID NO: 54843 - DNA, 601 bp, Human; identical to SEQ ID NO: 38503

SEQ ID NO: 54844 - DNA, 601 bp, Human; identical to SEQ ID NO: 38504

SEQ ID NO: 54845 - DNA, 601 bp, Human; identical to SEQ ID NO: 38505

SEQ ID NO: 54846 - DNA, 601 bp, Human; identical to SEQ ID NO: 38506

SEQ ID NO: 54847 - DNA, 601 bp, Human; identical to SEQ ID NO: 38507

SEQ ID NO: 54848 - DNA, 601 bp, Human; identical to SEQ ID NO: 38508

SEQ ID NO: 54849 - DNA, 601 bp, Human; identical to SEQ ID NO: 38509

SEQ ID NO: 54850 - DNA, 601 bp, Human; identical to SEQ ID NO: 38502

SEQ ID NO: 54851 - DNA, 601 bp, Human; identical to SEQ ID NO: 38503

SEQ ID NO: 54852 - DNA, 601 bp, Human; identical to SEQ ID NO: 38504

SEQ ID NO: 54853 - DNA, 601 bp, Human; identical to SEQ ID NO: 38505

SEQ ID NO: 54854 - DNA, 601 bp, Human; identical to SEQ ID NO: 38506

SEQ ID NO: 54855 - DNA, 601 bp, Human; identical to SEQ ID NO: 38507

SEQ ID NO: 54856 - DNA, 601 bp, Human; identical to SEQ ID NO: 38508

SEQ ID NO: 54857 - DNA, 601 bp, Human; identical to SEQ ID NO: 38509

SEQ ID NO: 54858 - DNA, 601 bp, Human; identical to SEQ ID NO: 38502

SEQ ID NO: 54859 - DNA, 601 bp, Human; identical to SEQ ID NO: 38503

SEQ ID NO: 54860 - DNA, 601 bp, Human; identical to SEQ ID NO: 38504

SEQ ID NO: 54861 - DNA, 601 bp, Human; identical to SEQ ID NO: 38505

SEQ ID NO: 54862 - DNA, 601 bp, Human; identical to SEQ ID NO: 38506

SEQ ID NO: 54863 - DNA, 601 bp, Human; identical to SEQ ID NO: 38507

SEQ ID NO: 54864 - DNA, 601 bp, Human; identical to SEQ ID NO: 38508

SEQ ID NO: 54865 - DNA, 601 bp, Human; identical to SEQ ID NO: 38509

SEQ ID NO: 54866 - DNA, 601 bp, Human; identical to SEQ ID NO: 38502

SEQ ID NO: 54867 - DNA, 601 bp, Human; identical to SEQ ID NO: 38503

SEQ ID NO: 54868 - DNA, 601 bp, Human; identical to SEQ ID NO: 38504

SEQ ID NO: 54869 - DNA, 601 bp, Human; identical to SEQ ID NO: 38505

SEQ ID NO: 54870 - DNA, 601 bp, Human; identical to SEQ ID NO: 38506

SEQ ID NO: 54871 - DNA, 601 bp, Human; identical to SEQ ID NO: 38507

SEQ ID NO: 54872 - DNA, 601 bp, Human; identical to SEQ ID NO: 38508

SEQ ID NO: 54873 - DNA, 601 bp, Human; identical to SEQ ID NO: 38509

SEQ ID NO: 54874 - DNA, 601 bp, Human
ggtacgccactaatgcacttactctacagtgccacacgctactcctttattttattctcaaaactctcaggtaggtatttttctcatttcacagatgaggaaactatggtcaagaaagggtgccagatttatcctttttttttttttttttttttttgagacagggcctggctctgtcaccctgcctggagtgcagttggctcaccccaacttcctccttccgtgcttaagtgatcctcccactcagcctcctgagtagctgcaactacaggcacatgccaccatgcccagctagtttttwaaattttttgtagagatggggtttcaccatgttgcctaggctagtcttgaattcctggactcaagtgatccacccacctcagcctcccaaagtgctgggattacaggcgtgagccactgtgcctggccagacttatctgaaatcacatgccagtagatagctgaactgggattcaaactcaggtccctctgactccatagctgtactgtttccactgtggcaaaacatcctgtttctgattcctggtcctctccatttccttatgcatgaccttgggaaatgcatccaaattaacgtgtg

SEQ ID NO: 54875 - DNA, 601 bp, Human
gctagttttttaaattttttgtagagatggggtttcaccatgttgcctaggctagtcttgaattcctggactcaagtgatccacccacctcagcctcccaaagtgctgggattacaggcgtgagccactgtgcctggccagacttatctgaaatcacatgccagtagatagctgaactgggattcaaactcaggtccctctgactccatagctgtactgtttccactgtggcaaaacatcctgtttctgattcctggtcctctccatttccttatgcatgaccttgggaaatgcatccaamttaacgtgtgttttaaggaccccatctgcagagcagatacggtatttctctgtctcccaaaaggtagaagactaggatcactgatttcataaggtactaaaagcactttgtaaatctgcagaggtaattctcccactatttgttctgttattgtcatctgtcctttaacatgtttaagcagtattttatacttaaacaatatttaatactcctccagtggcccttttatttttgtcatttaattgtttctttaacatgaggtaaaagatgaagggatatggggggcagtgtggtgctgaa

SEQ ID NO: 54876 - DNA, 601 bp, Human
ttttttttttgagacggagtctcgctctattgccaggctggagtgcagtggcgtgatctcggctcactgcgacctccactgggttcaagcaattctcacgcctcagcctcccgagtagctgggattacaggcacgtgccaccacacccagctaatttttgagtttttagtagagatggggtttcaccatgttggccaggatggtctcgatctcctgacctcatgatccacccgcctcagcctcccaaagtgctgggatgacaggcatgagccaccgcgcccggcctaaatctcagttcttyaaaagcaaatctggaaacaagcaatatggcctgtagcactttcttctctccactgtttgagtttaagcccatctcccacttcctctcccattctttcatcttttcagtccaactccacttccttctggctttccacagtctttctcttttctgttcacactgactgccctacccacctctgccctactccaaacacacagacccctctttggacttcccctccctcccaatggcccttgagctctctctgctctaacaggcagcccagcccagctcattcagctgcttttcttcctccct

SEQ ID NO: 54877 - DNA, 601 bp, Human
tctggaaacaagcaatatggcctgtagcactttcttctctccactgtttgagtttaagcccatctcccacttcctctcccattctttcatcttttcagtccaactccacttccttctggctttccacagtctttctcttttctgttcacactgactgccctacccacctctgccctactccaaacacacagacccctctttggacttcccctccctcccaatggcccttgagctctctctgctctaacaggcagcccagcccagctcattcagctgcttttcttcctccctccacttagaytgactctttctttctggggatcagatatgttcttcaggggagcagttctcagcaggtacactgcaaacaactgagatgtgtattgcatggaatttgttaccactgttggtaaaactgcccaagttttggaaacgatttactttttatataaattgagaagatttgaggtcatctctctaatagcatcactttctcttgcttgcattctaatatgcttccttgagggggagagagagggtggcatgtcagctggtgtgccaggaattatacgtgacatgcagcctaccttatctgtactgc

SEQ ID NO: 54878 - DNA, 601 bp, Human
agaagccagatggttcacaccatccatgagtcatacccttgttcaaagatagggaggttgcagtcaccttggggaagaggtaaaaggctaaaaaggaagaagctgcttcctacaatgtttcagtctctctcctcccttccacccccaaaatgcctttcaaatgaacagtgatgagtgcctgtatctgtatggcgaatcagacacaatccccacttctatcgtgtagtggaggagttagacacatacacagctataatgctaggaaggtgggtaaaggccatacaaaaactaataagttaasatttattgagtgcttgctgcacaccaggcactgtcctaagcactttacctgcattaactcatttaatgctcagaatagctatgtgaaataggttcagattattagcatcaccactttacagatgaacaaacaaggctcagggagcttagctcacttgccctctgttagacagcacccaggcagtgtggctccagagcctgtgtgtgctggcccactctagcagccaaagttccatttcccacataagaggagaaacgagctaatgtttttctagggcctgctgtgtgccacttgacttag

SEQ ID NO: 54879 - DNA, 601 bp, Human
ctattcatttttataattccatataaccctgacagtttctttgtgagtgggtagtattatcctcgttctgtcatcagtaaaactgaggtttagtacagcagtgatgtcctaaaagtcataaaatggcagaggcaggatttaaatctggtttgcttagaagccaaagccccatcccttcctttgtaccctgtagtttacagtgccagagtctaggccacctatagcatgccaggcaaggagcaccttctctgtgtgacaagcaccgagagcagccctcaattccaggcctgttggcatagtragtgatacaggttggacattaagagcactgggctggaggttgaatgcctctgcctctgccactcccttgttatgtgacctatctatgttttgattaacttctcaaagcttaagttttcttatctgcaaaatgaggacaacaagaacactaactctatggctgtggtaagaataaatgtaatagttaagcacaatgcctggctcataggaaatcctcagtaaaccttagctattataattgttatctcccaaggctatccagtgaacaaacatagcacctagagtttgacggagccttgag

SEQ ID NO: 54880 - DNA, 601 bp, Human
cttggggacacacagattgaggcactaccaataaattactgtgctccctcttttggcttgacctgagtttcctgggctctcttctccctgttgacctttcctctggctttctaatcatcctctgatcttcgttttgcctctacagagagattctgaggataagaactgggcccttaaagaacagctcaagtcctggcagcggctccggcatgacttggagcgagctcggctgctcgtggaattgatccgcaagcgggaaaaactcaaaagggagacggtgagtgctcctgggccagccctrttttataaaagaaaaaacaaaaaattagccaggcatggtggcaggcgcctgtagtcccagctactcgggaggctgaggcaggagaatggcgtgaacctgggaggaggggtttgcagtgagccaagatcgtgccactgtactccagcctgggcgacagagcgagactccgtctcaaaaaaaaaaaaaaaaaaagacccaggagaaggaatagcgtgtgtaccccagccagatagcagcagggctgacgctggagtcaggtctcctggtgctcggtgtgcttttagttctgctggaagcaga

SEQ ID NO: 54881 - DNA, 601 bp, Human
aaaactcaaaagggagacggtgagtgctcctgggccagccctattttataaaagaaaaaacaaaaaattagccaggcatggtggcaggcgcctgtagtcccagctactcgggaggctgaggcaggagaatggcgtgaacctgggaggaggggtttgcagtgagccaagatcgtgccactgtactccagcctgggcgacagagcgagactccgtctcaaaaaaaaaaaaaaaaaaagacccaggagaaggaatagcgtgtgtaccccagccagatagcagcagggctgacgctggagtcagrtctcctggtgctcggtgtgcttttagttctgctggaagcagaatgtcacaggagcgtatgaacagaatcctcagttatgtgacataggtagctggtgctggtagttcaagaaagggggaagccagaattgttggtgcaagtttccctgggtggagcctcatagaaggtagacctgtatgagtacacccagctgtgagggtgggaaagaaggcgggttcccaggccagctgggaccatatcctcagacctctttgccactgaactggccgaggcctggctgatcaggcctttttctatgtt

SEQ ID NO: 54882 - DNA, 601 bp, Human
cttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatggtgggtgatatatcacacacacatataagaggccaatgccggggatggacagctttccaaaagtcccctcctgggagcaggcagtgtaggcagaragcagctaggctgagcagtggcaagctatccccaggaatgctccccaagaagccagactgggtgaatggatagcagtgcccgccattccacatcttggtgctgctattttacagctgttcctggtgagaagcccaggggggatgagtgggtttcttgctgcctgcccaggttcaaggggccctgagggctgccctgagtctgacctttcccctccaaccctacccctagcagccgaggaagagcggctggtcttgctggagaaccagaagcacctgccagtggaagaacagctaaagctg

SEQ ID NO: 54883 - DNA, 601 bp, Human; identical to SEQ ID NO: 38503

SEQ ID NO: 54884 - DNA, 601 bp, Human; identical to SEQ ID NO: 38504

SEQ ID NO: 54885 - DNA, 601 bp, Human; identical to SEQ ID NO: 38505

SEQ ID NO: 54886 - DNA, 601 bp, Human; identical to SEQ ID NO: 38506

SEQ ID NO: 54887 - DNA, 601 bp, Human; identical to SEQ ID NO: 38507

SEQ ID NO: 54888 - DNA, 601 bp, Human; identical to SEQ ID NO: 38508

SEQ ID NO: 54889 - DNA, 601 bp, Human; identical to SEQ ID NO: 38509

SEQ ID NO: 54890 - DNA, 601 bp, Human
ttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaatgcagtgaggagtggtagggargcaggtgaggaggggacagggcagagaaactcccggttcagggagggaaggggagcaggctgcccccaagccctcccacgcagaggatcatgacccgaggtccagggccctagagctggtggggcagtgtgggggacagttctgtgcccggctccacgcagcagtctcgacagcaacagccagctgccggccctgcatgggaagacagaacagaggtggccgcaggggcaggccctccactccagcccgggtgcacctttgtggaccacccatgcccttctgcagagcccgctcctcacc

SEQ ID NO: 54891 - DNA, 601 bp, Human
ctccagtctggccaggcttagcacttgcacttcccggaatggctatagacattattccgctatgcctcactaattcctacttaactgacagctctgtcaggtcatcaccacttttatgacctttctcggaccccataggctggatcagatgcctcctgaagaattacagacttcttcctctagacttggaggtgagggaccctctctggaatagagaaggtgttgggagtgtttgttgaatgaaagagtgaatgaatgaagtccttcagtaaggatccctaagcagttactgtgtgcccartgtgatgccaggtgctgtgcaagctgagcctgggtagggatggggaggagtcctggggaggctgggaccagaactagggatatggactcaccttccacttgctcttggcaaagttcttcttgatctgctcactcaccgactggtggatattcttatctagagctgtatctcctgcaatcctaggatggggttatgtggtgggttgcctatgagggcagaagcagacctgagggccccaaatcccgccccagctcacaggttgtgtgaattctcaccatgggtgctgcaaggcctgctcac

SEQ ID NO: 54892 - DNA, 601 bp, Human
cagaggcagggcccaggggaaaaaagcaaagccccaaataccagagtcagagatgtcgtcccagtaaggagagtcaaactcgtactcggccttcaaaatctgttcaaagagtttggcatcattctcgtcatagaagggagggtaaccgcagagcctgggcagggagaaactcatcctcatttccactttcgggtgccgttggctccggggtggagcactggggcagtctcaggggtcaggcaggagccatggaaggagttccccctttataaactctaccagccctgcctgctcactcctsttctagctacattatcctttctgttccttgtatgtgccgccatcttgccctcctcagggcctttgcacttgccattgcttctgcctatgccactctttccccacacctccaatgtctggctccctcaccactcggtcatcacctccacagcgagcccttccctgacctccctactgaaatggcatcaccccgtctccctattcctgcttggtttttctccacagtatttatttttatcacctgacgtcagtttgtagatttatttacttgttgattgtctgtcttccctactagaaagaa

SEQ ID NO: 54893 - DNA, 601 bp, Human
ccccaaataccagagtcagagatgtcgtcccagtaaggagagtcaaactcgtactcggccttcaaaatctgttcaaagagtttggcatcattctcgtcatagaagggagggtaaccgcagagcctgggcagggagaaactcatcctcatttccactttcgggtgccgttggctccggggtggagcactggggcagtctcaggggtcaggcaggagccatggaaggagttccccctttataaactctaccagccctgcctgctcactcctgttctagctacattatcctttctgttccttgwatgtgccgccatcttgccctcctcagggcctttgcacttgccattgcttctgcctatgccactctttccccacacctccaatgtctggctccctcaccactcggtcatcacctccacagcgagcccttccctgacctccctactgaaatggcatcaccccgtctccctattcctgcttggtttttctccacagtatttatttttatcacctgacgtcagtttgtagatttatttacttgttgattgtctgtcttccctactagaaagaaagtcagctccctgagggcaggcactttgtct

SEQ ID NO: 54894 - DNA, 601 bp, Human
gagttccacaggcggtggagagcacactgcccgggtcctccatcttggagaggccaaagtcggagatcatgattttggagtcttcatccaggctgtagtacagcagattctctggcttgaagggcaggagggaagagaaggggcaatcagagatggttagaggctggtagaaccttctgccgctccaagcaccttctgagaaataatggatccccaaaagccactgtggcttcatggctgtcataagaaaatcaaggaagctctcaagaaggccaaaaattccaggaaggacaaggctcargagggtgtgggggggaactgtctctaaacctcaggtgtgcactgtaaagccctaaaggaatgtttgaatgcctattttatgccagaccctggattagtgcttgatttaatgccatcctcactgcttccctgctaggccagtctgtataatctcacctaacagatgaggaaactgatgcctttggaggcaaagtgactcacccaagaacccacagttaggcagtagcagagccagaattcaaaaccaggcatgtcacaccccaagtgcccttctcctagaacggattgagatgtactgcta

SEQ ID NO: 54895 - DNA, 601 bp, Human
gaaccttctgccgctccaagcaccttctgagaaataatggatccccaaaagccactgtggcttcatggctgtcataagaaaatcaaggaagctctcaagaaggccaaaaattccaggaaggacaaggctcaagagggtgtgggggggaactgtctctaaacctcaggtgtgcactgtaaagccctaaaggaatgtttgaatgcctattttatgccagaccctggattagtgcttgatttaatgccatcctcactgcttccctgctaggccagtctgtataatctcacctaacagatgaggwaactgatgcctttggaggcaaagtgactcacccaagaacccacagttaggcagtagcagagccagaattcaaaaccaggcatgtcacaccccaagtgcccttctcctagaacggattgagatgtactgctaaatgtgagccccgtcgctatttccgaggagtaggatttcggggatttctggcttttttctttatgttttgctgtcccatccaagttttctacagaaggggaataggattttttgtttttattttattttttttgacatggagtctcgctctgtcgtccaggctcgctct

SEQ ID NO: 54896 - DNA, 601 bp, Human; identical to SEQ ID NO: 38503

SEQ ID NO: 54897 - DNA, 601 bp, Human; identical to SEQ ID NO: 38504

SEQ ID NO: 54898 - DNA, 601 bp, Human; identical to SEQ ID NO: 38505

SEQ ID NO: 54899 - DNA, 601 bp, Human; identical to SEQ ID NO: 38506

SEQ ID NO: 54900 - DNA, 601 bp, Human; identical to SEQ ID NO: 38507

SEQ ID NO: 54901 - DNA, 601 bp, Human; identical to SEQ ID NO: 38508

SEQ ID NO: 54902 - DNA, 601 bp, Human; identical to SEQ ID NO: 38509

SEQ ID NO: 54903 - DNA, 601 bp, Human; identical to SEQ ID NO: 54890

SEQ ID NO: 54904 - DNA, 601 bp, Human; identical to SEQ ID NO: 54891

SEQ ID NO: 54905 - DNA, 601 bp, Human; identical to SEQ ID NO: 54892

SEQ ID NO: 54906 - DNA, 601 bp, Human; identical to SEQ ID NO: 54893

SEQ ID NO: 54907 - DNA, 601 bp, Human; identical to SEQ ID NO: 54894

SEQ ID NO: 54908 - DNA, 601 bp, Human; identical to SEQ ID NO: 54895

SEQ ID NO: 54909 - DNA, 601 bp, Human; identical to SEQ ID NO: 38503

SEQ ID NO: 54910 - DNA, 601 bp, Human; identical to SEQ ID NO: 38504

SEQ ID NO: 54911 - DNA, 601 bp, Human; identical to SEQ ID NO: 38505

SEQ ID NO: 54912 - DNA, 601 bp, Human; identical to SEQ ID NO: 38506

SEQ ID NO: 54913 - DNA, 601 bp, Human; identical to SEQ ID NO: 38507

SEQ ID NO: 54914 - DNA, 601 bp, Human; identical to SEQ ID NO: 38508

SEQ ID NO: 54915 - DNA, 601 bp, Human; identical to SEQ ID NO: 38509

SEQ ID NO: 54916 - DNA, 601 bp, Human; identical to SEQ ID NO: 54890

SEQ ID NO: 54917 - DNA, 601 bp, Human; identical to SEQ ID NO: 54891

SEQ ID NO: 54918 - DNA, 601 bp, Human; identical to SEQ ID NO: 54892

SEQ ID NO: 54919 - DNA, 601 bp, Human; identical to SEQ ID NO: 54893

SEQ ID NO: 54920 - DNA, 601 bp, Human; identical to SEQ ID NO: 54894

SEQ ID NO: 54921 - DNA, 601 bp, Human; identical to SEQ ID NO: 54895

SEQ ID NO: 54922 - DNA, 601 bp, Human; identical to SEQ ID NO: 38503

SEQ ID NO: 54923 - DNA, 601 bp, Human; identical to SEQ ID NO: 38504

SEQ ID NO: 54924 - DNA, 601 bp, Human; identical to SEQ ID NO: 38505

SEQ ID NO: 54925 - DNA, 601 bp, Human; identical to SEQ ID NO: 38506

SEQ ID NO: 54926 - DNA, 601 bp, Human; identical to SEQ ID NO: 38507

SEQ ID NO: 54927 - DNA, 601 bp, Human; identical to SEQ ID NO: 38508

SEQ ID NO: 54928 - DNA, 601 bp, Human; identical to SEQ ID NO: 38509

SEQ ID NO: 54929 - DNA, 601 bp, Human; identical to SEQ ID NO: 54890

SEQ ID NO: 54930 - DNA, 601 bp, Human; identical to SEQ ID NO: 54891

SEQ ID NO: 54931 - DNA, 601 bp, Human; identical to SEQ ID NO: 54892

SEQ ID NO: 54932 - DNA, 601 bp, Human; identical to SEQ ID NO: 54893

SEQ ID NO: 54933 - DNA, 601 bp, Human; identical to SEQ ID NO: 54894

SEQ ID NO: 54934 - DNA, 601 bp, Human; identical to SEQ ID NO: 54895

SEQ ID NO: 54935 - DNA, 601 bp, Human; identical to SEQ ID NO: 38503

SEQ ID NO: 54936 - DNA, 601 bp, Human; identical to SEQ ID NO: 38504

SEQ ID NO: 54937 - DNA, 601 bp, Human; identical to SEQ ID NO: 38505

SEQ ID NO: 54938 - DNA, 601 bp, Human; identical to SEQ ID NO: 38506

SEQ ID NO: 54939 - DNA, 601 bp, Human; identical to SEQ ID NO: 38507

SEQ ID NO: 54940 - DNA, 601 bp, Human; identical to SEQ ID NO: 38508

SEQ ID NO: 54941 - DNA, 601 bp, Human; identical to SEQ ID NO: 38509

SEQ ID NO: 54942 - DNA, 601 bp, Human; identical to SEQ ID NO: 54890

SEQ ID NO: 54943 - DNA, 601 bp, Human; identical to SEQ ID NO: 54891

SEQ ID NO: 54944 - DNA, 601 bp, Human; identical to SEQ ID NO: 54892

SEQ ID NO: 54945 - DNA, 601 bp, Human; identical to SEQ ID NO: 54893

SEQ ID NO: 54946 - DNA, 601 bp, Human; identical to SEQ ID NO: 54894

SEQ ID NO: 54947 - DNA, 601 bp, Human; identical to SEQ ID NO: 54895

SEQ ID NO: 54948 - DNA, 601 bp, Human; identical to SEQ ID NO: 38503

SEQ ID NO: 54949 - DNA, 601 bp, Human; identical to SEQ ID NO: 38504

SEQ ID NO: 54950 - DNA, 601 bp, Human; identical to SEQ ID NO: 38505

SEQ ID NO: 54951 - DNA, 601 bp, Human; identical to SEQ ID NO: 38506

SEQ ID NO: 54952 - DNA, 601 bp, Human; identical to SEQ ID NO: 38507

SEQ ID NO: 54953 - DNA, 601 bp, Human; identical to SEQ ID NO: 38508

SEQ ID NO: 54954 - DNA, 601 bp, Human; identical to SEQ ID NO: 38509

SEQ ID NO: 54955 - DNA, 601 bp, Human; identical to SEQ ID NO: 54890

SEQ ID NO: 54956 - DNA, 601 bp, Human; identical to SEQ ID NO: 54891

SEQ ID NO: 54957 - DNA, 601 bp, Human; identical to SEQ ID NO: 54892

SEQ ID NO: 54958 - DNA, 601 bp, Human; identical to SEQ ID NO: 54893

SEQ ID NO: 54959 - DNA, 601 bp, Human; identical to SEQ ID NO: 54894

SEQ ID NO: 54960 - DNA, 601 bp, Human; identical to SEQ ID NO: 54895

SEQ ID NO: 54961 - DNA, 601 bp, Human
ctccagaggccctaatgacacctggcctggggcccccagctaagcttgctgagggcaaaggccatcgaatggccttggctggtacttccaatatgaagccagaatgggccccattcagagaacacagcctcccaacccatccacagatgaggccaaaacagagcccagcatgctttgtgacctcagggagagcactttccttctctctttttctctaagggagaatgaggagaaggtgccctgactagggcctctggtgtgagattccactcctggaacaggacctttttcccaggggacyctgcccacccatccaggggcagaatcttctaggaaaggagactcgagtgtaagctctagaggcagagtctgaaacccacatggaggcctaccaaatacaaccctcacagatccacacacatccctgtagcagacatgccacaccaagccccctccacagccctgaactcaaacacctgcctcccagatccagtacgccttgtatccacatcccgtgacacctgatcatacatgtactcccagacatcagcacacatgtccacaccacacagtgccccagacagccctgcacccgaacacc

SEQ ID NO: 54962 - DNA, 601 bp, Human
ttcttcctctctgacaagtgcacacctacccatccttcagtccccagctctaatgccccattctccaggaagttttcccccaggcagaaggcacagctctctctgggctccacaaagccctcaatcccaaccttaattggagcacagcacacaccctgttgtcattttctgtaggtctgtctcttgcacatgtctgggatcaacttgaagggcagagaccaggtttgagttatttctgcattcccagcaccaagaacagagccatctccagcctcagttcccaaacctaggctagaacacytagctcttggcagcaagttaaatggactgactggcaccttcattctctcgacttctttctcttcaagaacccagggctattgggagagcagcccgtgtcccacccactgtcatccagaagtgaaaagctggggacagtttaggccctagatagtgctgccacagggcctgggctgtgggaaacaggaagcattaattgaccagaggaagccccaccctggactcagcctccctcagccatccagcacccaatcctgccctggactcacgtgcccagaacatctcggaagtcgtagatgtc

SEQ ID NO: 54963 - DNA, 601 bp, Human; identical to SEQ ID NO: 54895

SEQ ID NO: 54964 - DNA, 601 bp, Human; identical to SEQ ID NO: 54894

SEQ ID NO: 54965 - DNA, 601 bp, Human; identical to SEQ ID NO: 54893

SEQ ID NO: 54966 - DNA, 601 bp, Human; identical to SEQ ID NO: 54892

SEQ ID NO: 54967 - DNA, 601 bp, Human; identical to SEQ ID NO: 54891

SEQ ID NO: 54968 - DNA, 601 bp, Human; identical to SEQ ID NO: 54890

SEQ ID NO: 54969 - DNA, 601 bp, Human; identical to SEQ ID NO: 54961

SEQ ID NO: 54970 - DNA, 601 bp, Human; identical to SEQ ID NO: 54962

SEQ ID NO: 54971 - DNA, 601 bp, Human; identical to SEQ ID NO: 54895

SEQ ID NO: 54972 - DNA, 601 bp, Human; identical to SEQ ID NO: 54894

SEQ ID NO: 54973 - DNA, 601 bp, Human; identical to SEQ ID NO: 54893

SEQ ID NO: 54974 - DNA, 601 bp, Human; identical to SEQ ID NO: 54892

SEQ ID NO: 54975 - DNA, 601 bp, Human; identical to SEQ ID NO: 54891

SEQ ID NO: 54976 - DNA, 601 bp, Human; identical to SEQ ID NO: 54890

SEQ ID NO: 54977 - DNA, 601 bp, Human
aagcagaggttgcaatgagccaacattgcgacagtgcactccagcctgggtgagaccctgtctcaaaaaataagtaaataggccgggcacagtggctcacgcctgtaatcccagcactttgggaggccgaggcagacagattatgaggtcaagagatcgagagcatcctggccaacatggtgaaaccttgtctctactaaaaatacaaaaataagctgggcatggtggtatgcacctgtagtcccagctactcgggaggctgaggcaggagaattgcttgaacctgggaggcggaggttgyagtgagccaagatcgtgccaccgcactccagcctggcagcagagcaagacttcgtctcaaaaataaaataaaataaaataaaataaaataaaattcattctggtacatacataactgagataatctgggttacaacattaaatgatacgatttaatttttaattttaaaaataactgataaagatgttaggatatgccctgttatactgtgtaacgtacacgatttccagtgggcctttgaaaatggttagcagtttagagacaccacaccacaattaattactattagagatctctagg

SEQ ID NO: 54978 - DNA, 601 bp, Human
gagcctgtgctctttctgctgaagaacacactcactggcccccatcttggagcactcctgcttgtgagtcttctattccttggactctatggtctcatagtgattccaggacctgcgtggggtcactctgactattctatccctctgtagtacaagtactctgtcacattatgttttcaggagtagcaaagagctcctgttacaacctgtgaccatcagcaggaatgagaaggaaaaggttctgattgagggctccatcaactctgtccgggtcagcattgctgtgaaacaggtaagttcrccatggaggaggcccaacgtaaggcctctttcagtcctttcagcctctttcagtccggggtccccatctgagagatcagtgtgccagattccagattcagagtgcaggaaacctagcctctgcttcctttttttttgacacggattctcactcttgtcgcccaggctggagtgcagcagcatgatctcagctcactgcaacctctgcctcccgggttcaagcagttcttctgtctcagtctcccaagtagctgggattacaggcatccgccaccacgcccagttaatttttgtattttta

SEQ ID NO: 54979 - DNA, 601 bp, Human
cattatgttttcaggagtagcaaagagctcctgttacaacctgtgaccatcagcaggaatgagaaggaaaaggttctgattgagggctccatcaactctgtccgggtcagcattgctgtgaaacaggtaagttcaccatggaggaggcccaacgtaaggcctctttcagtcctttcagcctctttcagtccggggtccccatctgagagatcagtgtgccagattccagattcagagtgcaggaaacctagcctctgcttcctttttttttgacacggattctcactcttgtcgcccaggstggagtgcagcagcatgatctcagctcactgcaacctctgcctcccgggttcaagcagttcttctgtctcagtctcccaagtagctgggattacaggcatccgccaccacgcccagttaatttttgtatttttagtagagacagagtttcaccatgtttgccaggatggtctccatctcctgaccgcaggtgatgggcccgcctcaacctcccaaagtactgggattacagtcatgagccaccatgcctggccagtagagggcaactctaaactttcaacaggatgaaaacgaagcactg

SEQ ID NO: 54980 - DNA, 601 bp, Human
gtgagtaggggcctttagctttccttccagaggccagaggatctgggggtcatgttgagaacttagcatctggtgggaaaggggtccaagcagtgtgtttatatctcctgagctctctaggacccctggggcacagcaggtcagtcaggtgctttggagctagaggaccccaagttcatctctgagagctacaaggcattttctatatttgggtgtctggggtggctcttagtctctcgtaggaacttggtcactcatttctacatctcaggatgttcacaaagtccttgcctctatctcstttaaaccccaagtgaggtaagtgaagtctgcatgtgaattttctaggagtataggacaattaatcatgttatgattccacttctcaaatagacttcagtactttccttcagcatgtttctcaggcttaaatcatgattccttcaacctgttttccatcacttgcatggcgtaagtcctccagattcctcttacgttgtttatgtctttctaattgaaagcactttagtcatctgaagaggtagaattgtttacattgatgaactggtgacatcgttcttagttgtttagatattcagaa

SEQ ID NO: 54981 - DNA, 601 bp, Human
ggttcacaacctttggtctctaaaatgtgcagggctgtcctaggcagcatgggggacccttgagggcagaaaacatttcaagggcctggcttggttggaggttcatccagagcttgacacaaaagtaccagaacctgggtccttttccacttggccctctgagtccccaggccccttgcatgagagcccccatgcctaaagaaagcaacctcagttcaccaggcaggacgctggcagggctttctagcagcctccatgccagggcacaagggagctgtggagaagctctcatggctcttamtttttctgccttatctagtgctaggcttagggccggtgcccataggtcacttctgaaagctggctgaattagagcatgaccacaaggtgtcctgggacccaactctgcccctcacagatatgagcacagtggcagctctcaggttcatgcacctccttagagcagtgccaccaggatgcaataataaccaccatgcactgcctcttggttctcttgacagttttaaaccatctggctggatctcgtggccttccccctcagactacccatgtctccacgaaggcgtcctggagtcactcc

SEQ ID NO: 54982 - DNA, 601 bp, Human
agccagaaccagtctattatatcacactttcttatctatgccatcctcttctggtggaggaatgattctgaaagatctgcagagcacaattgtggaagttgacactacatcagatgagccatttctggttcaaatttcttgtcatgtcactccaagacagtaacatgcatatcacatgcgcctcaaccaactaaacaaaaaatgatgcctgaatagagagtggtcagcagactccccaaaatttctttagtttagagagagagaaagtgaaagggagaagtagaaaatgggtggaaaaacrtaataattacaaaaatactcttaagtttttggggttacagatccctttgaaaaatggatgacaactatggactctctgctcagaaaaacatacatgcaaaaattttacaaataacttgagactccaaagtctttctgtgaatcctaagttagcaaccatggattctgagtcagacttctattcaataaaagaagtaacttcagtcagatctgcttctgggatctgatagttctttgtgcctggaagagttcaagcaaaaattaggtgagaaattggcagatgtgttataaaggagattaa

SEQ ID NO: 54983 - DNA, 601 bp, Human
tatgtgtattttgaaccatgtgaacctattacctgaattttaaaaatgtaaacaaaaaaggactaatgtcgctaatggtccatatgatgaaatattatgcagccattaaaaaacatgctttcaaagaataattaatgccctaggaaaataaaaatcagaaaacaaacctatgccaataatacataataataacaactctgtagtttaatcttcatagcaatcttatgaagtccacagcatcagtatcccaattttaaaaataaagtctacagagttcctaagttggctggatcaaacccargaagttgactccacagtgatcccaaattttaaatgcacaaaaaccaaaggaaaataaggtaaaatgttaaacactggttctctgggtggtagaattatggatggttttatttttctcctttatcttattctgaattttaatttttttctaccgtgtacacatattacatttacaatatgccaaaaacagtaaatttttgttaaagtaaaaccagggaaataataaaatgccaaaatcttccattattgtggatggtaagctgtcacagacacaaaaatctaaagggttatgttcaagatc

SEQ ID NO: 54984 - DNA, 601 bp, Human
gcagtgaaagcagaggaagggaaagtggacaacttggaaagagagatgtgtgccaacctggaatgcaatccaaacaggaacggaactactctggcaacctaaaatctttcaaattgtttaaaataaaatattattccattcaacagaaatattttttaaaaggaggaagctctcgacgggaggatcgcttgagtccaggaggcgtaggttgcagtgagcccacatcgcaccactatactccagcctgcatgaccgagtgaaactgtctcaaaaaaaaaaaaaaaaaagaggaagctctccwtcatactgatatgaaaagattgccaagataagtgaaaaaaggaaataaggtatagacagtacatatactatgctacggtttgtttaaaaggaagaggtgagtaagaatgtattctaataggcctagcatggtggctctgtaatcctagcactttgggaggccaaggcaggagaactgcttgagtccaggagtttgagaccagcctggcaaaataacaaaaatccatgtctataaaaaatttaaaaattcgttgggagtagtggcgcatgcctgtagtcccagctactcaggaggctgagg

SEQ ID NO: 54985 - DNA, 601 bp, Human
tggaaagagctggggcagtgaaagcagaggaagggaaagtggacaacttggaaagagagatgtgtgccaacctggaatgcaatccaaacaggaacggaactactctggcaacctaaaatctttcaaattgtttaaaataaaatattattccattcaacagaaatattttttaaaaggaggaagctctcgacgggaggatcgcttgagtccaggaggcgtaggttgcagtgagcccacatcgcaccactatactccagcctgcatgaccgagtgaaactgtctcaaaaaaaaaaaaaaaaaagaggaagctctccatcatactgatatgaaaagattgccaagataagtgaaaaaaggaaataaggtatagacagtacatatactatgctacggtttgtttaaaaggaagaggtgagtaagaatgtattctaataggcctagcatggtggctctgtaatcctagcactttgggaggccaaggcaggagaactgcttgagtccaggagtttgagaccagcctggcaaaataacaaaaatccatgtctataaaaaatttaaaaattcgttgggagtagtggcgcatgcctgtagtcccagctac

SEQ ID NO: 54986 - DNA, 601 bp, Human
ttctaaagtagtaaattctcacccgattttcaagagtcaagcccaagggcatctgcaatgcccgtgctgccgtcactgctaccctcttactatgtcttctccacagaaacttttccaccaaagctactaccaactaaaaccaatttcttaggcctaagttgactgtttttaactttccaagataaatcaacttgaaaatagaggacaagaaagatcatgaacctgaataacccataaactgtatgtctagctcctcaacaatgatagggtaacccctatgcactaaatatcttaaggtacratatttttaaatgcttatatactagactcttaaagagaagtacaaacaaattccaacatgagtctttccagcgtcacatagcagttaaggtataaaactgtctgtaataaagtcagtggtagaattctcccactggggcaatattcttattgttacagatttttaaactttgaaattctatatcaagtactacttggtggaaccacctatctgttatcctgttaaaaacaaaaattctgaaacttaacgtcaaaaaacacttggcaaataaagaaccacttattgtgaccaaaaatttta

SEQ ID NO: 54987 - DNA, 601 bp, Human
aattctcacaaacattttctaaagtagtaaattctcacccgattttcaagagtcaagcccaagggcatctgcaatgcccgtgctgccgtcactgctaccctcttactatgtcttctccacagaaacttttccaccaaagctactaccaactaaaaccaatttcttaggcctaagttgactgtttttaactttccaagataaatcaacttgaaaatagaggacaagaaagatcatgaacctgaataacccataaactgtatgtctagctcctcaacaatgatagggtaacccctatgcactmaatatcttaaggtacgatatttttaaatgcttatatactagactcttaaagagaagtacaaacaaattccaacatgagtctttccagcgtcacatagcagttaaggtataaaactgtctgtaataaagtcagtggtagaattctcccactggggcaatattcttattgttacagatttttaaactttgaaattctatatcaagtactacttggtggaaccacctatctgttatcctgttaaaaacaaaaattctgaaacttaacgtcaaaaaacacttggcaaataaagaaccacttatt

SEQ ID NO: 54988 - DNA, 601 bp, Human
aggagttagacaaacagtttacagattatttaggttcatgctctttcctgttctctattttcaagttgatttatcttggaaagctaaagcaacagtaaacttaggcctaaacaattggttttagtgggcagtagttttggtgaaaaactactaagtttctaagatcaatggaatagaagagtccagaaatagactacagatggctagctgaggtcatactgactgagatggggagaaatttatcagataatgaaaatgttcagtatcttaattgcagtagtaacacagcatacacatttgycaaaattcatgaacacttttataccttaatgtgcacttaaaatggatgtattttattgtatgtaaattacacccaaataaagatgatgttaaaatatattttaaaacaatctccaaaacttatcttggtttttaatgtgaatcttgtctggaagaaaactaacattgttaaggactcataatgtgccggacagtgagttctgcacatttaattctcacaaacattttctaaagtagtaaattctcacccgattttcaagagtcaagcccaagggcatctgcaatgcccgtgctgccgtca

SEQ ID NO: 54989 - DNA, 601 bp, Human
ggttatcctatcattgttcaggagttagacaaacagtttacagattatttaggttcatgctctttcctgttctctattttcaagttgatttatcttggaaagctaaagcaacagtaaacttaggcctaaacaattggttttagtgggcagtagttttggtgaaaaactactaagtttctaagatcaatggaatagaagagtccagaaatagactacagatggctagctgaggtcatactgactgagatggggagaaatttatcagataatgaaaatgttcagtatcttaattgcagtagtwacacagcatacacatttgtcaaaattcatgaacacttttataccttaatgtgcacttaaaatggatgtattttattgtatgtaaattacacccaaataaagatgatgttaaaatatattttaaaacaatctccaaaacttatcttggtttttaatgtgaatcttgtctggaagaaaactaacattgttaaggactcataatgtgccggacagtgagttctgcacatttaattctcacaaacattttctaaagtagtaaattctcacccgattttcaagagtcaagcccaagggcatctgc

SEQ ID NO: 54990 - DNA, 601 bp, Human
cctgtgtaacaaaaagaaacataaaggcatatagatcagaaaggaatgagtaaaactgtctttatccacaaatgacatgattgtgtatgcaaaaatttctaaggaatcaacaaaaaagatgctggaattaaagtgaatttactgcagtcagaagacgaaaggtcaatataagttatatttctttgtgcaaggtctgtgcaatgaaaatcaaacaacactgttgagagaaataaagatagagaagtgtatcatattcatacactgaagactcggcattgttaagatgtcaattctcccaaaytgatctctagattcaatacaattccagtgaacatcccagcaggcttttggtagaaattgacaacctgattttaagttatacatggaaatgcatttaaaatgcaacgatcctaaaaaaaacgaagaaaaaaaagttggaggacttacaatgcctgacttcaagacttactacaaagccacagtaatcaagatagtgtggtactggcacaaggatagacatatatgagtctagcatataagcattttaaaatattgtaccttgaggtatttactgcaataggggttatcctatcattgttca

SEQ ID NO: 54991 - DNA, 601 bp, Human
acaccactttcaacactgtagttgaggtaccagcctgtgtaacaaaaagaaacataaaggcatatagatcagaaaggaatgagtaaaactgtctttatccacaaatgacatgattgtgtatgcaaaaatttctaaggaatcaacaaaaaagatgctggaattaaagtgaatttactgcagtcagaagacgaaaggtcaatataagttatatttctttgtgcaaggtctgtgcaatgaaaatcaaacaacactgttgagagaaataaagatagagaagtgtatcatattcatacactgaagactcggcattgttaagatgtcaattctcccaaattgatctctagattcaatacaattccagtgaacatcccagcaggcttttggtagaaattgacaacctgattttaagttatacatggaaatgcatttaaaatgcaacgatcctaaaaaaaacgaagaaaaaaaagttggaggacttacaatgcctgacttcaagacttactacaaagccacagtaatcaagatagtgtggtactggcacaaggatagacatatatgagtctagcatataagcattttaaaatattgtaccttgaggtat

SEQ ID NO: 54992 - DNA, 601 bp, Human
gaggccctgtctcccaaacaaaacaaaacaaaaacaacgttattagctatgtcacaaaataaaggaagaaaatcatatgagcatctccataactgcagaaaatacttgacaaaattcaacacccattcatgatttaaaaaaaaaaatcctctcgcctaaccaggggtagagaagtgcctcaacttggtaggtttatgaaaacatattaagaatataaaaaaaacttacagctaacatcatacttaatggtaaaagactgaatgctttccccaaaaaattaagagtaaggacaggatgtccmtccacaccactttcaacactgtagttgaggtaccagcctgtgtaacaaaaagaaacataaaggcatatagatcagaaaggaatgagtaaaactgtctttatccacaaatgacatgattgtgtatgcaaaaatttctaaggaatcaacaaaaaagatgctggaattaaagtgaatttactgcagtcagaagacgaaaggtcaatataagttatatttctttgtgcaaggtctgtgcaatgaaaatcaaacaacactgttgagagaaataaagatagagaagtgtatcatattcatacactg

SEQ ID NO: 54993 - DNA, 601 bp, Human
gagagaaagaagggaaacacggtccaatgttctagcttttccaagagctggccagaggactggcttctgtctcaccccactaagcatgaaccctgcatgttctaggtgactggggactgctaagaataaaaaaaagctgggttgcttgctactgatccacaggacccatagagcagacagaggctgatatagctctgcggcttatcttgggaggggaggctgggagagaatagtggagtgtgtgaccaacatttgaacttttcaaaggactgcctaagggaatggtttctgtctcactcarcttggggtgctttggatcagcatactttagatgcttgagggcagctgaaaacaaaaaaagaggctgatggcttacagcaactctggagaacctgcaataccatggacagacacatgagagagaaaaacagcagctaatgaaaaaactgaccaaatctctcggcttggaaatttataatcacaagtccagggaagacacatccacagaaaaggcttacgaagcccctagaatctgcagtcaagctgactagtaaagatctttctctatatggtagtgcccccttatacacaggcgagacat

SEQ ID NO: 54994 - DNA, 601 bp, Human
gacagaaaagggaaccaggttgagggccactgagaacaaaagcaaaggtctggactagtaccacactcactggccagtgtgcctcccccaggctcagcaaggaagagaaacccccaactttctgcctggggagagaaagaagggaaacacggtccaatgttctagcttttccaagagctggccagaggactggcttctgtctcaccccactaagcatgaaccctgcatgttctaggtgactggggactgctaagaataaaaaaaagctgggttgcttgctactgatccacaggacccatasagcagacagaggctgatatagctctgcggcttatcttgggaggggaggctgggagagaatagtggagtgtgtgaccaacatttgaacttttcaaaggactgcctaagggaatggtttctgtctcactcaacttggggtgctttggatcagcatactttagatgcttgagggcagctgaaaacaaaaaaagaggctgatggcttacagcaactctggagaacctgcaataccatggacagacacatgagagagaaaaacagcagctaatgaaaaaactgaccaaatctctcggcttggaaa

SEQ ID NO: 54995 - DNA, 601 bp, Human
atcaccaattctagtcaatccaagatgataccagaacatgacagacctggcttccactacagccctgggggttttgtgtcattaaaacactaaagacccagagcaaattttagacatgacgggacttgtgacaactggtgtttagtagaagaggcctactgaatactgagacttcacaagtgaaaaaaaagtgctcataaaataaaaaatcatcattactgaaacttccctccactgacttcctcttaaagaatggcataagtgacagctataagtcatgaagaagtgagcaaacaacatrtatccctagggagagaaacagaagactagcacttacattgcgggggctacttgagaaactggtttctgagctgcctgaatctatacactgacagaaaagggaaccaggttgagggccactgagaacaaaagcaaaggtctggactagtaccacactcactggccagtgtgcctcccccaggctcagcaaggaagagaaacccccaactttctgcctggggagagaaagaagggaaacacggtccaatgttctagcttttccaagagctggccagaggactggcttctgtctcaccccact

SEQ ID NO: 54996 - DNA, 601 bp, Human
aaacctttgctaattcaagagacaacataagattctattaggcaaataataaacgtgtttatcttcttttatattctcatgaagtagcactgtgaaacaaggcagaggagaagagaaatagctacacacacaaaagggagatataattatgcagagctgcacttctggaaattctgaaatgctagtctttagttggagggatgttattctcttaccaactaactgtcccttaacattagaactggaggcagatgccaaccttttcagctttcttggacctcctgttcttttcacactggtktttgcttttaactggacactttagatgtttctttctaaaaagttccttctttcataaagtccttaagatttcacatgacaaggattcatttaagttttagaaatttcctttttactattaagatgctagactcttttgatgtttgaaagccagccaattgctaaatattttgatcatcttccattatgaagtgagaaaaattatagcaagtgcaaagaaaattggcacttgggcatattagtctattagcaagaccatttctcacttaatggtgttttatgggttggagtaagtctgctc

SEQ ID NO: 54997 - DNA, 601 bp, Human
cacatgtaccttttaaattagtatttataataaggctactgctttctcttctgcataatcttgtatatctttcctcttcttttcttttgaaatgaggagaaccagatatggagtcctaagtagatcaagccctaggcttaatttcactctactagactactaccaaatatgtactggtaagctgcagaccagcataatttattctctagtgggcaactatgacaacccttccattcaaagaagaacagctgaagagttttgaattcatgtattcccagagggcttcatttaaatcacctaygaaatttgtctttccatccaagagagcccaaaaaagatgtgtgggcagagtggaggaaggtacaataacaacaatgaattaaagagtagtttcacagaaatatccaagccttgggagagggggcatctctaatcccaagcaagatcctagataaaataattggcttgtggacactgataaattaccactattttaaagcttggccagcaatcttttttttttttccttttgtggattttgactcaaaaaaaattaatcaaagcttgtgtagaagtaaaaagcaattttatttcatttttt

SEQ ID NO: 54998 - DNA, 601 bp, Human
aaaaatgcacgcttatgaatgcttatgcataagtgaaatgaatgacagcaatggtacaaaagactacaggaaagcatttcttagcttgagctgccataacaaaataccacagactgggcaggttaaacaacagaaattgttttctcatggttctggaggctaaaagtccaagatcaaggtgccaatatggtaagtttatgctgaaagctctctttctggcctatagacaaccacctgctcactgcgtcctcccatgagggggtgaggagtgaccataagctccggtatctcttctcatacrgacactaatcccatcactagggctccactgtcaggacctaatttaaacctaattatctcccaaaggcctcatcttcaaacaccaacacattggggttggggcttcgacataggactttaggggggataaaattcactccaggcattccacctttaacctcccaaattcatgttcttctcaaatgcaaaatacatccatcccatctcaacagccccaaaagtcttaacttattccagtaccaactctaaagtctaaaatctaaagtctcatctaaatatcacctaaatcagatatggatga

SEQ ID NO: 54999 - DNA, 601 bp, Human
taaataagccagagtagtctgttttttttgttttgttttgttttttccccttcaagatggagtctaattctgtcacccaggctggagtacagtggcgcaatctcggctcaatgcaacctccgcctcctgggttcaagtgattctcccgcctcagcctcccgagtagctgggattacaggtgtgcgccaccacaccacacccagctaatttttgtatttttagtagagatggggtttcgccatattggccaggctggtctcaaactcctgaccataggtgaccgcccacctcggcctcccaragggctgggattacaggtctgagccactgcactggcccagagtagtctgttctcaacaaagccctccctcagaagaaactattttacagagcctaatctactggagttttatcagagcccagctgactctggaaaaaggaaatacacaactctagccctctagccatcctgtcccatctaaggaggggaaaactgaggagcgttagtaacattcacagtccaggggcaaagttcgctaaaagacctaatcataggactatagaatgtgtcccctctgcccatacctaaaggcctatttac

SEQ ID NO: 55000 - DNA, 601 bp, Human
agaacaatatatataaaggaaggttcttgacctcaaggagctaataaaatagtgaagcaattacagcataattccgcataatatatcctaacaatttaagcaggaaatgggcacaaactaaattcaccacactcaaggcagtgtaaatgttctcccagtcaaagacaaagcagatgtgactaacagaatggtaccttactaattacctaagctaatttactagtagcccaaattcagctggattctgtttagttgaggaggagacagtacaatttcagtacactgtataaattcaggattygtttagttgaggaggagacagcataatttcaatggtatggatatccaggaaataagcaagtcttgccagcctaagtaagagcaccccaggaggaaaaacaaagaaacatattatgaaaaggataaaacagacaacaggttgagttcttttaggaagcaaagatgaatacaggggaccgattcagcatgtaaggggcttggaagtcaccactctgtcctaacaagtaaaaagctgaacaaactgaaaaaccaacaacttttcgtagatccagcagaaaagcagggtcacagggcaaactgc

SEQ ID NO: 55001 - DNA, 601 bp, Human
aacaataacaacaaactttctagggttttccctgaagctctggtaggggaaagatgtaagggaacagataggccggattaagcccaacagccatgcatatttaccttctgcacaaatacttagacagttctttgcaaatgaataatcataccaccagagtttctaccaaagtgagaaattattaaaaatgagaagccataaaaacatgggtcataagaattaaagagtgctacttcctaaaatacatttaggttttcagaaatcttaacaaaaaaactgaacaaagcccagctcttcttayatgtactttagaggtcctttctgaaaatgtctttcatatagcttaattcagtaactacacatcaccctatatatacacaggcttttacgtatacacaaagcagaaatatttgcagcagtcagtaagttttaaaaaaaggaaacaaaaactcaccacacagcaagttggacactgagttttataggacagaaattttcttatacagagagagcagtctgcaaaacacaaagtgcaacataatgttaattaagctatattaataatacaggaatatgacttctaacaaaatcttaagcccta

SEQ ID NO: 55002 - DNA, 601 bp, Human
agacttaagagccaaatcacaaaatttcttacatagagaaatagttcgaaatgttcagtgacaccctgacaccacatacctaccagagaggcaaaactaaccaaactccttacctagtcctagtgtcggctctgtcagacctcacttgtctcttctttctttattcccacttatgtttaattacccttttagtctacttttccacctgttcccactacttgaaaagtttcagaaacaataacaacaaactttctagggttttccctgaagctctggtaggggaaagatgtaagggaacagrtaggccggattaagcccaacagccatgcatatttaccttctgcacaaatacttagacagttctttgcaaatgaataatcataccaccagagtttctaccaaagtgagaaattattaaaaatgagaagccataaaaacatgggtcataagaattaaagagtgctacttcctaaaatacatttaggttttcagaaatcttaacaaaaaaactgaacaaagcccagctcttcttacatgtactttagaggtcctttctgaaaatgtctttcatatagcttaattcagtaactacacatcaccc

SEQ ID NO: 55003 - DNA, 601 bp, Human
aagtgttcaaggagaattttaaagtaagattggttttcaggaatgcaagagaaaagtgacaaacccagtacttatttggcatgaatggtacacagtttatctcagcgatgagaccatcttgtcaaaagcagtgtaacatatcgtaaagatcttagacttaagagccaaatcacaaaatttcttacatagagaaatagttcgaaatgttcagtgacaccctgacaccacatacctaccagagaggcaaaactaaccaaactccttacctagtcctagtgtcggctctgtcagacctcacttrtctcttctttctttattcccacttatgtttaattacccttttagtctacttttccacctgttcccactacttgaaaagtttcagaaacaataacaacaaactttctagggttttccctgaagctctggtaggggaaagatgtaagggaacagataggccggattaagcccaacagccatgcatatttaccttctgcacaaatacttagacagttctttgcaaatgaataatcataccaccagagtttctaccaaagtgagaaattattaaaaatgagaagccataaaaacatgggtcata

SEQ ID NO: 55004 - DNA, 601 bp, Human
tagaagcaatgacaccccagtagcaacaagcatacccagcaccagatcctggtctctaaatactattctccaagaagaggagctccttggagaaatggctgattctagggcttgggcaggaaaaggagtatcttcagagcacccaaaagtaaggaagtcctcaaatctgcgttttaactcttaattattctatactacaggagaatttctgttaagtaaaggaagaaaatcttactctagtaaattttccatgtgtgaataatgactgttacttcccttctttgactataaaatatgcaaycctgcattccctaatccaaaggtgcacaaagtaaagagagaacacatataaaaggcaaaagtagttagaggttagtcacaaaattaaatcataccgtgcaaaattcaagctttttaccagttcatctaatatgcggttatttttcagatccggctctgtgacagtctagaaaaaacaaacaacagatggaaaaaggtcaaaaacaataatcaacttgtcataatcttgtttttgaaaatgtctgacccatcctcctgaggttctccatcccactaagtcttctaaggcagcctcaaaata

SEQ ID NO: 55005 - DNA, 601 bp, Human
cctaggccttcacattcacttatcactcactcattgactcatcaagagtaactttcagtcctgaaagctccattcatagtaaatgccctataaagatgtaccattttttatcttttataccatattttccctgtactttttctatgtttagatacactaataggtaccattgtgttgcaactgcctaccgtattagctatagtaacatgctgtacaggttttgttaccaaggagcaataggccctgccatatagaataggagtgtagtaggctataccatgttggtttgtgtaagtacacygtatgatgttcacacagcaaccaaattgcctaatgacacatttctcagaacacatccctgttaagcaacacatgattacacttaactacaggggcacctgaccactatctaaaccagtacgtccttcataaaaattcttgcttgacttgcaagattaaaactaaaagtaatccaagatattgaaacatgccttttcatatccctttgggtgaccaaactcactttcacacattcatgcatttgacaggaagtaaagttgcatatctgagctttataaagtacaagcaattacatatttca

SEQ ID NO: 55006 - DNA, 601 bp, Human
ccttattatctattaaagaaacagaagctataatttaaaacttttccacaaagaaaactccaagcccagatggcttcactggtaaattctaccacatatttaaggaagctttgtttatttcttcagtgtggacatggtggcacatacccatagtcctagctaattgggaggcagaggcaggaggatcccttgagcccaagagttcgaggttacagtgaaccatgatcatgccactgcactgcagtctgggcaacagagcaagaagaagagaggaaagggaggaagggaaggaaagggaggraggaatagacgggggagggaggaatagagaggggaaggagaaaggaggagggagggagaaaggaaaggagggaggaagaaaggaaagcagagagggagggagggagggaggaaggaaggaaggaaggaaaagtcttgtccatctgttaactatacaataaccttacctcttcagaatggggctaagaatcaagagtcaaaataggcctttgggtagacatgggcagccattaaatctatgcaatcaattccatggacttctgtaactaaagtcctgcaatgcttgttctgatcagaaaca

SEQ ID NO: 55007 - DNA, 601 bp, Human
gacagaacaaagatgaagagctgataatttaactgcctcttagaacaaaatgtgacatctttcaaaagaagacaattcacagcttctacaacgtttcaaccacaatgttcagcacatattttaaaattattgaacatgcaaagaagcaagaaaaagtagccactaatcaagagataaaatattcaatagaagcagacccagaggtaatccaaagaatagcatctctaggtaaggacttcaaactatgataaacatgttaaagaaaaaaaaaagaaaagggataaaaagatagtgtattatragaaataaaatccataaaaaagaataaaatgaacattctacaactgcaaaataccatatctaaattggatgagtataacaacacacaatacaaacttgaaggcaggtcaatagaaaatatccaaaccaagcacagagagaaaaatgaatgaaaaagacaaacacaaaaaagtatgagatattgggcataattaaaagcccagaaggaacagaaagaaagaatgggaaatcagcaatactagaaaaaccaatggctgagaattttcaaatctgatagaaaaaaaaaatcaacccatagatt

SEQ ID NO: 55008 - DNA, 601 bp, Human
tagcaatgtaagaatggcctaacttgcataaaaaacaactctttgtaggcactggactgaaatcaacacaaggctgcaatccctgaaaaagaagaaaacatgaagtagtccaacatttcccccaagacttactttaccctgggagcattttctaggaatgggtactaaagtgaagtctaaacaggaaacattgatcttacttgttagagaaaataagagatcagagttctgaacaaaactggccaggattgaggggtcagagtgctttgacacgtggtagctactgaaagggaaccccacmagtctgcttagaaattcacatccattcctgctcatttccagggctgcacatgattagacaaaaacacaggagacccactaggaagctgatactggtaaattaaaatcccaaacgtcagtgctggaaagttagttgttcgcattggagcccagccaaagctgagaaatcttggtaagatcatggacattcaagtgacaccccacaaagaccacaccttagaaaaatggaccacactgaagaaatataaacaaagctcaaacagacctaacctaagaaaacattataccaggccttgacaga

SEQ ID NO: 55009 - DNA, 601 bp, Human
aaatttgttaatttagctctcactgatgattccatatataatgttaaaattaaggaacacagtcattctcaaactatttcataaagttgcagggatctgtgggggtatctcggggcctacagaccaccatggataataggcagaaggaggtcaggtggaacagaacaatctgttttatctattttatacgttatggtttatcgtaaaatttcatttgggaaaaaaggttccgctaggggaaaaacagttaaccatcaagctaaaaaatactacaataagaactgtcaattggtaaaaagastaaggatagacatagtagaaaatataagtgaaatttatatatctttaaaagatgtaaacacgttaagtactaataaactaatttcaatctaagtttaatacacactcacatctctgcactacgtgtggtatgggtataccaaagatgtctaagagtttctgcctaaaaggtgctctaaacttcactggaaagaagatacagaaacaaaaagttaaacaagctgacatattcatcaaacagttaagcaaatgggatacaaaacagtccagaaaacaagtgctatagcacttttgtgatgtg

SEQ ID NO: 55010 - DNA, 601 bp, Human
gacaacaggagtgggacagactggttactgggtaatggctaaattgtgggaagtcacaaaattgaagtcctggtcccagagaaagagactgcaaataagcttgaaagttcatttattaaaaatgtttcggttacatcttttctaccaaggtatgaccaaactatagaactcatcttaaattttcccaacccttaggagctatccatgtttagcccagaagcaatagtaacgacttaagtaagacacacctggcccaagggccgagtgaaggaaaggtagtttaataatttattgagttcarttttgtcaatggttacaaatttgttaatttagctctcactgatgattccatatataatgttaaaattaaggaacacagtcattctcaaactatttcataaagttgcagggatctgtgggggtatctcggggcctacagaccaccatggataataggcagaaggaggtcaggtggaacagaacaatctgttttatctattttatacgttatggtttatcgtaaaatttcatttgggaaaaaaggttccgctaggggaaaaacagttaaccatcaagctaaaaaatactacaataagaactg

SEQ ID NO: 55011 - DNA, 601 bp, Human
atggacgagtatgtctttaaacaaactgacagcatcagaaatgatgtatcagaaatgtattcgaactgatggatggatctagaaaaaggggagtccatgcaagataatcagtgcagattccttactcttccaaaagaatatactcagcttctatattcccaactcatgcatttctaaagagaaaagcaggtcatcaaactctcgtggcttatgggaaataatccttaggactattcatttactccaaatcaccactaagcaacctaaaaatctaaattttattctcattaacaaacttacycactaggtgggagtactgtgcatgtaaaactgccccaggtttggactcaagtatgtctaccttaataaagcaccattgtgtcttatatgttagcttttgtaagttgtaacagtatgaatctgaccctcagaatctgcattcactccaaatttactcataaaaattaagtgatgtattttctttaatcacaaaaaataatactatggctctgtcttattaacatggtttttggaaaatactcttcaaagtccttcaaaacagactgaacatagaagcaaatcattctttcatccccacttc

SEQ ID NO: 55012 - DNA, 601 bp, Human
attccccaaataaattatgtcttttatgctgtattaacaaagtctaaaagccagaaataactaattaactgtgaaaagacctgcaaactctcaatagattatatttttctgaaaattgctcttcttacaatgacaacccatctgactctacaaggttgataaaattatggcaaaatgaaatctcagtaggtagcaacagctgaatcattttgtgtttacagaagcacacagggagagatgattcattacgtctgtatctaaaatatttgttttatcaaggacagatgattaaactgtgacygtgaaattccagtgaagaactgtactgttcactggcatttacaataaaaagcaccaccagagatcaacaatttctatcaggaattttaaaacatgaaacctgataaatgtttccccaaacacgaaaatgacattgatttttcttccatgatttagtggaactgagtaatacatttaaggggcctcagaatctgaggcagttctgacatggttttatatagaagggttaagggctgccactcacattcagcagatggcctgtcagaatattgtggaggagacaggaaaactcacagggcct

SEQ ID NO: 55013 - DNA, 601 bp, Human
tccataaacaggaacttcttagtgagttttaattcatttcacctgattatagcaggttctctacctggctcagctttatggcaattagatgcttaacaaaaatgtgctcaaggaggtcattacacttgctatcatttcaaaataagaatagcaaagattcaggtgaaaattaacagaaacttgaaataataggtttatccaaaaaacaagtttttacaaaggatttgcatataactagctcacacaaggctgtcccaaacgttagtgtacctaagaagcacctaaagagtttatttaaaaygcagattctccatccccttctccacaccatccaccaattagggttcaggtctgaagtggagctctaaaatctctattttcaacaaggttctccagagtaaatctgatataaacggtccaataatcaaacagagaaatattacagtcaggtatagactgaaaacaatcaaaaatttctctattaaccaacagagccattccccaaataaattatgtcttttatgctgtattaacaaagtctaaaagccagaaataactaattaactgtgaaaagacctgcaaactctcaatagattatatt

SEQ ID NO: 55014 - DNA, 601 bp, Human
ggcttccttttgtgaacagaactgaaaaggggggaagatacctgatgattattgtgaattatcaaatgcttttcatgtaaaatggcaaataaattctgattcaacacctgggtgaccgggaaaatagtagaaccattagattaaaaaggggagagaaaaatcaagtttgtggataaagttgagtgtctgacatgatgtatctgaggtgctggtaagacattcagacacaggggcctaggtggcaccagaagtgagagacttgcgtctcaaaaagaggtcagacctaaagaggcacacttasaagacatatatgtaacgcttgtggaatatgctgtgaggacttcacttagaatcacacttacatagacctattcaattttccacctctttaaagcatgctagaaattctagtgggctaaaattcaagctacataaaagtaccaatgacttaagcaattccataaacaggaacttcttagtgagttttaattcatttcacctgattatagcaggttctctacctggctcagctttatggcaattagatgcttaacaaaaatgtgctcaaggaggtcattacacttgctatcatttcaaaata

SEQ ID NO: 55015 - DNA, 601 bp, Human
cacgatcagagagcaaattatatacagttttgggcagcggcttccttttgtgaacagaactgaaaaggggggaagatacctgatgattattgtgaattatcaaatgcttttcatgtaaaatggcaaataaattctgattcaacacctgggtgaccgggaaaatagtagaaccattagattaaaaaggggagagaaaaatcaagtttgtggataaagttgagtgtctgacatgatgtatctgaggtgctggtaagacattcagacacaggggcctaggtggcaccagaagtgagagacttgsgtctcaaaaagaggtcagacctaaagaggcacacttagaagacatatatgtaacgcttgtggaatatgctgtgaggacttcacttagaatcacacttacatagacctattcaattttccacctctttaaagcatgctagaaattctagtgggctaaaattcaagctacataaaagtaccaatgacttaagcaattccataaacaggaacttcttagtgagttttaattcatttcacctgattatagcaggttctctacctggctcagctttatggcaattagatgcttaacaaaaatgtg

SEQ ID NO: 55016 - DNA, 601 bp, Human
taatttgtgtgttttaatgtttgcatgttattctccaagtttttaaaaattaggcaattctatatgttaatagaaagaactccaatgtatgtgtgtggtttaatgaaaagaaccaaccactaaatagtgcactacacagaatactatcattttgtaaaaacagtaatgaaaaggatatatgtttgtgtacaataatcataatggcaacatttactgaaagctaactacttgctaaggtactgtgttaggcacttttcatgccttttatcatttatttcactcaacattatgaagtgagtarttattataacccttattttatgaaggagaaaactgaggtacagagatatcaagtaacgtgcccacagtcaccaagccacaaagctgaaaaacgggcactgtaacccaggctctccagatccactcttccccaccacattctccctagataggcacatgagaaactggcaatggggtgcctctgagaagggatctggggattggaaggcaggctgagaggaaggctggcttatcatagcatactctaggtaccttttgaaggaacacatttgcacgtcttatctatcaaaaatgtatttat

SEQ ID NO: 55017 - DNA, 601 bp, Human
cttataatttgtgtgttttaatgtttgcatgttattctccaagtttttaaaaattaggcaattctatatgttaatagaaagaactccaatgtatgtgtgtggtttaatgaaaagaaccaaccactaaatagtgcactacacagaatactatcattttgtaaaaacagtaatgaaaaggatatatgtttgtgtacaataatcataatggcaacatttactgaaagctaactacttgctaaggtactgtgttaggcacttttcatgccttttatcatttatttcactcaacattatgaagtgrgtaattattataacccttattttatgaaggagaaaactgaggtacagagatatcaagtaacgtgcccacagtcaccaagccacaaagctgaaaaacgggcactgtaacccaggctctccagatccactcttccccaccacattctccctagataggcacatgagaaactggcaatggggtgcctctgagaagggatctggggattggaaggcaggctgagaggaaggctggcttatcatagcatactctaggtaccttttgaaggaacacatttgcacgtcttatctatcaaaaatgtat

SEQ ID NO: 55018 - DNA, 601 bp, Human
cataggcaaaatgaacatatggggttagaagtcaagacagtggtcaaatgtgagaatgaaggagtgaatgggagggggcagatagggcttttgggacactggtagtgatctcagtactggctacaatgacatttcactttatgaaatttagtttgtgataattcaccaaacaatacacttataatttgtgtgttttaatgtttgcatgttattctccaagtttttaaaaattaggcaattctatatgttaatagaaagaactccaatgtatgtgtgtggtttaatgaaaagaaccaaccaytaaatagtgcactacacagaatactatcattttgtaaaaacagtaatgaaaaggatatatgtttgtgtacaataatcataatggcaacatttactgaaagctaactacttgctaaggtactgtgttaggcacttttcatgccttttatcatttatttcactcaacattatgaagtgagtaattattataacccttattttatgaaggagaaaactgaggtacagagatatcaagtaacgtgcccacagtcaccaagccacaaagctgaaaaacgggcactgtaacccaggctctccagat

SEQ ID NO: 55019 - DNA, 601 bp, Human
gaggaaaagtgggaacaaaatgaaatgtttattaaacactgaatggataagatgatacgtttatacaatggaataccatatagcaacaaaaatgaaaaaaacatgaccatataaaaaaacatgaatgaatcttataatgttgcacaaatgagggcaggcacaaaagaatacataagctattggccctttatttaaagatcaaacataggcaaaatgaacatatggggttagaagtcaagacagtggtcaaatgtgagaatgaaggagtgaatgggagggggcagatagggcttttgggacrctggtagtgatctcagtactggctacaatgacatttcactttatgaaatttagtttgtgataattcaccaaacaatacacttataatttgtgtgttttaatgtttgcatgttattctccaagtttttaaaaattaggcaattctatatgttaatagaaagaactccaatgtatgtgtgtggtttaatgaaaagaaccaaccactaaatagtgcactacacagaatactatcattttgtaaaaacagtaatgaaaaggatatatgtttgtgtacaataatcataatggcaacatttactga

SEQ ID NO: 55020 - DNA, 601 bp, Human
gaagatccacatgatcttgaagtaggctaaggcaaagcactgatcaaaaggaaaaatgtaatgaattggactattttaggaacttctactcttcaatgatgccattaagagagtgaaaaggtgaaattggaaatgtacatacatccagcaaaagatttttatccaggaaatttcaattactcccacaaataagaataaaaataggcccacagaacagaagaattagacatagatttaaacaggtatttcactacagaggacatccagatggccaacaagcatataaaatttataagtcatyaaggaaatgcaaattaaaataacaaggtactaccatggacccactagaatggctaaaatggagagttaacagtggtgatgttgtcaagggtgcagaacaactgacaccctcacaccctcctgatgaaagtgtacatgactactgaatttggggctgtatccatgaaagctgaatatctgcaaatatataacaccaattccattcctgtatatatatatccaacagcaacatgcacctatgtgcaccacaagatatataaaagattatttgtagcagcattattaatagaggaaaagtggg

SEQ ID NO: 55021 - DNA, 601 bp, Human
tatctcaaaattgatctataaattcaatgtaatcccaatttaaaaacttatatggaaatacaaaaggcctagaaaaaacaagtcaacctcaataaataaaactggaagaactatattaccagacagcaagacctattataaattactcataaagtacttaagacacacattatttatcctgctcaacggtaaataatagcccaatggaacaaaacaatgtccaggcctacacatgtacaattagctgattctcagccaagacttctggcaattcagtgggagaagggatggcatttcaatragtggtgctgcatcaattggttattcatatggaaagaaaacaagacaatcttgtcctctacctcacaacatatgctaaaatcaattccagataaaccgtacatcaaaatttaggagcaagaacaataaagttttaaaagaaaacaagagaagatccacatgatcttgaagtaggctaaggcaaagcactgatcaaaaggaaaaatgtaatgaattggactattttaggaacttctactcttcaatgatgccattaagagagtgaaaaggtgaaattggaaatgtacatacatccagcaaa

SEQ ID NO: 55022 - DNA, 601 bp, Human
gtacaagcaactaataaaaattgacattttagaataaaacatcgtgtaccactgcatcaaaaatatcagagaataactctttaaaaagatgtgtgagaccttcacactgaaaattgcaaaacattactgacaaaaatcaaagacaaaaaaggggataaaccatattcatgaattggaagactcaaatactatacagatatcaactatctcaaaattgatctataaattcaatgtaatcccaatttaaaaacttatatggaaatacaaaaggcctagaaaaaacaagtcaacctcaataaayaaaactggaagaactatattaccagacagcaagacctattataaattactcataaagtacttaagacacacattatttatcctgctcaacggtaaataatagcccaatggaacaaaacaatgtccaggcctacacatgtacaattagctgattctcagccaagacttctggcaattcagtgggagaagggatggcatttcaataagtggtgctgcatcaattggttattcatatggaaagaaaacaagacaatcttgtcctctacctcacaacatatgctaaaatcaattccagataaac

SEQ ID NO: 55023 - DNA, 601 bp, Human
tacatttgcctaaattcatctaactatacactttcaaaggatgtattacatgtgagtaagttacacatcaataaaaagggcacatacaaaaagcgacaagccattgggtataaggaaactatagaaaaaccagttgtatttttctgtacaagcaactaataaaaattgacattttagaataaaacatcgtgtaccactgcatcaaaaatatcagagaataactctttaaaaagatgtgtgagaccttcacactgaaaattgcaaaacattactgacaaaaatcaaagacaaaaaaggggayaaaccatattcatgaattggaagactcaaatactatacagatatcaactatctcaaaattgatctataaattcaatgtaatcccaatttaaaaacttatatggaaatacaaaaggcctagaaaaaacaagtcaacctcaataaataaaactggaagaactatattaccagacagcaagacctattataaattactcataaagtacttaagacacacattatttatcctgctcaacggtaaataatagcccaatggaacaaaacaatgtccaggcctacacatgtacaattagctgattct

SEQ ID NO: 55024 - DNA, 601 bp, Human
tctagaaaaggtaaaattatagggacaaaaaaagagatcagtgtttcctgaggtcttagagtaaaagagagggaatatacagcaaaggggcactggaacttttgctgatgaaggaaatgttctacatttcagttagagcaatggctaaatgacaatatacatttgcctaaattcatctaactatacactttcaaaggatgtattacatgtgagtaagttacacatcaataaaaagggcacatacaaaaagcgacaagccattgggtataaggaaactatagaaaaaccagttgtatttttstgtacaagcaactaataaaaattgacattttagaataaaacatcgtgtaccactgcatcaaaaatatcagagaataactctttaaaaagatgtgtgagaccttcacactgaaaattgcaaaacattactgacaaaaatcaaagacaaaaaaggggataaaccatattcatgaattggaagactcaaatactatacagatatcaactatctcaaaattgatctataaattcaatgtaatcccaatttaaaaacttatatggaaatacaaaaggcctagaaaaaacaagtcaacctcaataa

SEQ ID NO: 55025 - DNA, 601 bp, Human
tactatacaatttgtgtaattccatttatgtgacagtctagaaaaggtaaaattatagggacaaaaaaagagatcagtgtttcctgaggtcttagagtaaaagagagggaatatacagcaaaggggcactggaacttttgctgatgaaggaaatgttctacatttcagttagagcaatggctaaatgacaatatacatttgcctaaattcatctaactatacactttcaaaggatgtattacatgtgagtaagttacacatcaataaaaagggcacatacaaaaagcgacaagccattggrtataaggaaactatagaaaaaccagttgtatttttctgtacaagcaactaataaaaattgacattttagaataaaacatcgtgtaccactgcatcaaaaatatcagagaataactctttaaaaagatgtgtgagaccttcacactgaaaattgcaaaacattactgacaaaaatcaaagacaaaaaaggggataaaccatattcatgaattggaagactcaaatactatacagatatcaactatctcaaaattgatctataaattcaatgtaatcccaatttaaaaacttatatggaaat

SEQ ID NO: 55026 - DNA, 601 bp, Human
aaagtattatgctaagtgacagatgccatatgtaaaatgctacatactatacaatttgtgtaattccatttatgtgacagtctagaaaaggtaaaattatagggacaaaaaaagagatcagtgtttcctgaggtcttagagtaaaagagagggaatatacagcaaaggggcactggaacttttgctgatgaaggaaatgttctacatttcagttagagcaatggctaaatgacaatatacatttgcctaaattcatctaactatacactttcaaaggatgtattacatgtgagtaagttayacatcaataaaaagggcacatacaaaaagcgacaagccattgggtataaggaaactatagaaaaaccagttgtatttttctgtacaagcaactaataaaaattgacattttagaataaaacatcgtgtaccactgcatcaaaaatatcagagaataactctttaaaaagatgtgtgagaccttcacactgaaaattgcaaaacattactgacaaaaatcaaagacaaaaaaggggataaaccatattcatgaattggaagactcaaatactatacagatatcaactatctcaaaattgat

SEQ ID NO: 55027 - DNA, 601 bp, Human
aattagccgggcgtggtggcaggcacctgtagtcccagctactcgggaggctgaggcaggagaatcgcttcaacctgggagacggaggttacagtgagccgagatcgcgccattgcactccagcctggccgacagagagagactctgtctcaaaaataaataaataaataaaataaaataaaataaaaaataaatgcactactggtaaaagcaacaacatggaaaaatctcaaaagtattatgctaagtgacagatgccatatgtaaaatgctacatactatacaatttgtgtaattccayttatgtgacagtctagaaaaggtaaaattatagggacaaaaaaagagatcagtgtttcctgaggtcttagagtaaaagagagggaatatacagcaaaggggcactggaacttttgctgatgaaggaaatgttctacatttcagttagagcaatggctaaatgacaatatacatttgcctaaattcatctaactatacactttcaaaggatgtattacatgtgagtaagttacacatcaataaaaagggcacatacaaaaagcgacaagccattgggtataaggaaactatagaaaaacca

SEQ ID NO: 55028 - DNA, 601 bp, Human
gcctggccaatatggtgaaaccccatctctactaaaaatacaaaaattagccgggcgtggtggcaggcacctgtagtcccagctactcgggaggctgaggcaggagaatcgcttcaacctgggagacggaggttacagtgagccgagatcgcgccattgcactccagcctggccgacagagagagactctgtctcaaaaataaataaataaataaaataaaataaaataaaaaataaatgcactactggtaaaagcaacaacatggaaaaatctcaaaagtattatgctaagtgacagatrccatatgtaaaatgctacatactatacaatttgtgtaattccatttatgtgacagtctagaaaaggtaaaattatagggacaaaaaaagagatcagtgtttcctgaggtcttagagtaaaagagagggaatatacagcaaaggggcactggaacttttgctgatgaaggaaatgttctacatttcagttagagcaatggctaaatgacaatatacatttgcctaaattcatctaactatacactttcaaaggatgtattacatgtgagtaagttacacatcaataaaaagggcacataca

SEQ ID NO: 55029 - DNA, 601 bp, Human
aaagtgggactctctcacaatgcaaaatgattcagtcatttgaaaaactgtatggcaggttcttatagttacatttaccatatgaccagcaattccactccacccaagagaaatgaaaacatatggttacataaagacctgtgaacccatgttcataacagctttactgataataaaaaaactggacacagtccagttgtccatcaacaggtgaagggatatacaaattgtggcatggctataaagcagaacactgcttggcaataaaaaataaatgcactggctgggcacgggggctcaygcctgtaatcccagcattttgggaggcagaggcgggcagatcacaaggtcaggaattcaagactagcctggccaatatggtgaaaccccatctctactaaaaatacaaaaattagccgggcgtggtggcaggcacctgtagtcccagctactcgggaggctgaggcaggagaatcgcttcaacctgggagacggaggttacagtgagccgagatcgcgccattgcactccagcctggccgacagagagagactctgtctcaaaaataaataaataaataaaataaaataaaataaaaaat

SEQ ID NO: 55030 - DNA, 601 bp, Human
atgcaacacaactgtatacataaaaaatcatgaaatgatacacaagaagcataaatcataaaaaaagtaaattaaatttcgtcaaaattaaaactctctgctcttcaaagacatcattaagaaaatgacaaggtaagccacatacaaagataaaatattcacaacacatatattttaaaaattcagtatccagaatatataaataacttacaaatcaataaaaagagttaaggggcagaatatttcaaccaagcctttatcaaagaaaatatacaaatagcaaataaaactatcaaaagayagcagacaccactagtcacaggaaaatgcaaattaaaaccatcatgagataccactactacacattgactagaatggctaaaattaagaagaatgaaaataccaagtgttagcaagggtgtggcaaaagtgggactctctcacaatgcaaaatgattcagtcatttgaaaaactgtatggcaggttcttatagttacatttaccatatgaccagcaattccactccacccaagagaaatgaaaacatatggttacataaagacctgtgaacccatgttcataacagctttactgataata

SEQ ID NO: 55031 - DNA, 601 bp, Human
gccgataggatttgacaatgagggcaaagtaattcaatggggaaaggatagtctttttaacaaatggtgctgaaaaactagatatacatattttttaaataaactttgacatttgacatttaccttccaccatacagaaaaactaaatgaaaatggatcatagatttaaatataaaagctaaaattataaaactcctagaaaataacacaggagaaattttttgtgatcttaggataagcaaatattttgttgacatgcaacacaactgtatacataaaaaatcatgaaatgatacacaagaagcataaatcataaaaaaagtaaattaaatttcgtcaaaattaaaactctctgctcttcaaagacatcattaagaaaatgacaaggtaagccacatacaaagataaaatattcacaacacatatattttaaaaattcagtatccagaatatataaataacttacaaatcaataaaaagagttaaggggcagaatatttcaaccaagcctttatcaaagaaaatatacaaatagcaaataaaactatcaaaagatagcagacaccactagtcacaggaaaatgcaaattaaaaccatcat

SEQ ID NO: 55032 - DNA, 601 bp, Human
tagattctagatagattcacatgctatatacatggccgataggatttgacaatgagggcaaagtaattcaatggggaaaggatagtctttttaacaaatggtgctgaaaaactagatatacatattttttaaataaactttgacatttgacatttaccttccaccatacagaaaaactaaatgaaaatggatcatagatttaaatataaaagctaaaattataaaactcctagaaaataacacaggagaaattttttgtgatcttaggataagcaaatattttgttgacatgcaacacaaytgtatacataaaaaatcatgaaatgatacacaagaagcataaatcataaaaaaagtaaattaaatttcgtcaaaattaaaactctctgctcttcaaagacatcattaagaaaatgacaaggtaagccacatacaaagataaaatattcacaacacatatattttaaaaattcagtatccagaatatataaataacttacaaatcaataaaaagagttaaggggcagaatatttcaaccaagcctttatcaaagaaaatatacaaatagcaaataaaactatcaaaagatagcagacacca

SEQ ID NO: 55033 - DNA, 601 bp, Human
tgataattttaagacttactataaagttacagaaatcaagagtgtgtcatgagtgaaaggacagatatatagatcagtggaacagaatagattctagatagattcacatgctatatacatggccgataggatttgacaatgagggcaaagtaattcaatggggaaaggatagtctttttaacaaatggtgctgaaaaactagatatacatattttttaaataaactttgacatttgacatttaccttccaccatacagaaaaactaaatgaaaatggatcatagatttaaatataaaagckaaaattataaaactcctagaaaataacacaggagaaattttttgtgatcttaggataagcaaatattttgttgacatgcaacacaactgtatacataaaaaatcatgaaatgatacacaagaagcataaatcataaaaaaagtaaattaaatttcgtcaaaattaaaactctctgctcttcaaagacatcattaagaaaatgacaaggtaagccacatacaaagataaaatattcacaacacatatattttaaaaattcagtatccagaatatataaataacttacaaatcaataaaaag

SEQ ID NO: 55034 - DNA, 601 bp, Human
aagtgaaagtggctatttctacactcagttttcagaaaacagtgaacaacaagaatggataatagcctgacatttcttaggggaacaacaacaacaaaactgagtctaacatttatgtgggattgcaaaggacctagaacaattttgagaacacagttgaaggacttatactacctgataattttaagacttactataaagttacagaaatcaagagtgtgtcatgagtgaaaggacagatatatagatcagtggaacagaatagattctagatagattcacatgctatatacatggccgwtaggatttgacaatgagggcaaagtaattcaatggggaaaggatagtctttttaacaaatggtgctgaaaaactagatatacatattttttaaataaactttgacatttgacatttaccttccaccatacagaaaaactaaatgaaaatggatcatagatttaaatataaaagctaaaattataaaactcctagaaaataacacaggagaaattttttgtgatcttaggataagcaaatattttgttgacatgcaacacaactgtatacataaaaaatcatgaaatgatacacaagaagc

SEQ ID NO: 55035 - DNA, 601 bp, Human
aaggatacatttaacaaaatacatggaacacacacacataaaaaagtagacagcactactgagagaaagtaaaggaggcctaaagagccataccacgactgtgcattaaaagtcttaatattgttaagatatcatttctaagctgatctatgtaatctcactcaaaatcccaaaaggtacacactaataaactgactgccctgcagatgctgtcctggacctgccagctgcacagatgcagatgctctgctatgcctgtaacatcggggcgaagtgaaagtggctatttctacactcagtkttcagaaaacagtgaacaacaagaatggataatagcctgacatttcttaggggaacaacaacaacaaaactgagtctaacatttatgtgggattgcaaaggacctagaacaattttgagaacacagttgaaggacttatactacctgataattttaagacttactataaagttacagaaatcaagagtgtgtcatgagtgaaaggacagatatatagatcagtggaacagaatagattctagatagattcacatgctatatacatggccgataggatttgacaatgagggcaaagtaatt

SEQ ID NO: 55036 - DNA, 601 bp, Human
gttggggtattccagaattaaaagaacatatattgatgcaatagtactgtcactcaaatgatttttgaaggcaattattcttccttctggggagacagacccttgaaaaatcagatgaaagtcagagatcctttcttaagaaattcatttaaaaaaaagattggagaaaggaaaggatgtttgcccacaccacttttattccacatcacactggaggttctaaccaatgcaactaaccaagggtagaaagataaataaaaggcatatcgactgaaaaaaataaataaataaaactgtttttattggcatgtaacttgattgtgtatataaaaatcctatgaaatctataaaaaagcaattagaaatgagtttcactagttaatagtatacaagtaaatatacaaaaataaatgtcaaaatgactctttaaaatagtaataaacaatgagaaataaaaattttaaaactactcacaatagcaccaaaagacatgaaatatttaaggatacatttaacaaaatacatggaacacacacacataaaaaagtagacagcactactgagagaaagtaaaggaggcctaaagagccataccacgact

SEQ ID NO: 55037 - DNA, 601 bp, Human
tataagttggggtattccagaattaaaagaacatatattgatgcaatagtactgtcactcaaatgatttttgaaggcaattattcttccttctggggagacagacccttgaaaaatcagatgaaagtcagagatcctttcttaagaaattcatttaaaaaaaagattggagaaaggaaaggatgtttgcccacaccacttttattccacatcacactggaggttctaaccaatgcaactaaccaagggtagaaagataaataaaaggcatatcgactgaaaaaaataaataaataaaactgtttttattggcatgtaacttgattgtgtatataaaaatcctatgaaatctataaaaaagcaattagaaatgagtttcactagttaatagtatacaagtaaatatacaaaaataaatgtcaaaatgactctttaaaatagtaataaacaatgagaaataaaaattttaaaactactcacaatagcaccaaaagacatgaaatatttaaggatacatttaacaaaatacatggaacacacacacataaaaaagtagacagcactactgagagaaagtaaaggaggcctaaagagccatacca

SEQ ID NO: 55038 - DNA, 601 bp, Human
ataataggtttaaagaaaaatgaaataaagtcgttgctatactcatatcagatagatttttgaggcaaggaatattaccagagacaaagacatatatgccataataataaacaggctaactaatcaagaagatacataataatactaagagattcaaaatataacaaaactgaaaatattgacagggaaaatgaaaaatctataaatatagttggatatttcaaaaagcttctcagtaattgatagaatcagtaaacagattatcagcaaggatgctgaagacttgaatatactatcaagyaaatttacatagcatttacagatcactgcacaaaaaagcaaacttttcaagtatttatgcaatattcaccaggaagacctaacacctaagttatgaagcatgtctcagtaaatgtgaaaggtctgaaatgatacagaacaggttctttggccaacattgaattaaattagaaatgaataataaaaaggtatctaagaaataaccaaatctttaaaaattaaacaatacttctatttaacatatgaatcaaagaagaatacacaacaaaaattagaaaatattttaactggatgggaaggt

SEQ ID NO: 55039 - DNA, 601 bp, Human
atatacggcttacaataaaacacagcttaaacataatggtataataggtttaaagaaaaatgaaataaagtcgttgctatactcatatcagatagatttttgaggcaaggaatattaccagagacaaagacatatatgccataataataaacaggctaactaatcaagaagatacataataatactaagagattcaaaatataacaaaactgaaaatattgacagggaaaatgaaaaatctataaatatagttggatatttcaaaaagcttctcagtaattgatagaatcagtaaacagawtatcagcaaggatgctgaagacttgaatatactatcaagcaaatttacatagcatttacagatcactgcacaaaaaagcaaacttttcaagtatttatgcaatattcaccaggaagacctaacacctaagttatgaagcatgtctcagtaaatgtgaaaggtctgaaatgatacagaacaggttctttggccaacattgaattaaattagaaatgaataataaaaaggtatctaagaaataaccaaatctttaaaaattaaacaatacttctatttaacatatgaatcaaagaagaatac

SEQ ID NO: 55040 - DNA, 601 bp, Human
aagaagtatagctcgtaaaatgaagataacataaaaaactaaaaaatactcagttaatccaaaaaaaagcaggaaatgaagaaaaaacaaaagaatgatagaacagcaaacaagcaagatggcagatataaacccaaccaaatagaataaatgaaattaaaatagtttaaaccctacaatttaatggtagagcttgtcaaattaaattataaaataaaatccaaaccatatacggcttacaataaaacacagcttaaacataatggtataataggtttaaagaaaaatgaaataaagtcgytgctatactcatatcagatagatttttgaggcaaggaatattaccagagacaaagacatatatgccataataataaacaggctaactaatcaagaagatacataataatactaagagattcaaaatataacaaaactgaaaatattgacagggaaaatgaaaaatctataaatatagttggatatttcaaaaagcttctcagtaattgatagaatcagtaaacagattatcagcaaggatgctgaagacttgaatatactatcaagcaaatttacatagcatttacagatcactgcacaa

SEQ ID NO: 55041 - DNA, 601 bp, Human
aaaagaagtatagctcgtaaaatgaagataacataaaaaactaaaaaatactcagttaatccaaaaaaaagcaggaaatgaagaaaaaacaaaagaatgatagaacagcaaacaagcaagatggcagatataaacccaaccaaatagaataaatgaaattaaaatagtttaaaccctacaatttaatggtagagcttgtcaaattaaattataaaataaaatccaaaccatatacggcttacaataaaacacagcttaaacataatggtataataggtttaaagaaaaatgaaataaagtmgttgctatactcatatcagatagatttttgaggcaaggaatattaccagagacaaagacatatatgccataataataaacaggctaactaatcaagaagatacataataatactaagagattcaaaatataacaaaactgaaaatattgacagggaaaatgaaaaatctataaatatagttggatatttcaaaaagcttctcagtaattgatagaatcagtaaacagattatcagcaaggatgctgaagacttgaatatactatcaagcaaatttacatagcatttacagatcactgcac

SEQ ID NO: 55042 - DNA, 601 bp, Human
atgaagtagtgtactattcattgaaggtagactgagataagttaaaaatgcatatagtaaactagaacaatcacccctacaaaaaaacaaaaagaagtatagctcgtaaaatgaagataacataaaaaactaaaaaatactcagttaatccaaaaaaaagcaggaaatgaagaaaaaacaaaagaatgatagaacagcaaacaagcaagatggcagatataaacccaaccaaatagaataaatgaaattaaaatagtttaaaccctacaatttaatggtagagcttgtcaaattaaattawaaaataaaatccaaaccatatacggcttacaataaaacacagcttaaacataatggtataataggtttaaagaaaaatgaaataaagtcgttgctatactcatatcagatagatttttgaggcaaggaatattaccagagacaaagacatatatgccataataataaacaggctaactaatcaagaagatacataataatactaagagattcaaaatataacaaaactgaaaatattgacagggaaaatgaaaaatctataaatatagttggatatttcaaaaagcttctcagtaattga

SEQ ID NO: 55043 - DNA, 601 bp, Human
aatgtaaatgacgagttagtgggggcagcacaccaacatggcacatgtatacatatgtaacaaacctgcacgttgtgcacatgtaccctaaaacttaaaaaaaaaaaaaaaaaagaatgaaagtcttaaggtccttccattatacatgaagtagtgtactattcattgaaggtagactgagataagttaaaaatgcatatagtaaactagaacaatcacccctacaaaaaaacaaaaagaagtatagctcgtaaaatgaagataacataaaaaactaaaaaatactcagttaatccaaaaraaagcaggaaatgaagaaaaaacaaaagaatgatagaacagcaaacaagcaagatggcagatataaacccaaccaaatagaataaatgaaattaaaatagtttaaaccctacaatttaatggtagagcttgtcaaattaaattataaaataaaatccaaaccatatacggcttacaataaaacacagcttaaacataatggtataataggtttaaagaaaaatgaaataaagtcgttgctatactcatatcagatagatttttgaggcaaggaatattaccagagacaaagacatatatg

SEQ ID NO: 55044 - DNA, 601 bp, Human
gtggggagggatagcattaggagatatacctaatgtaaatgacgagttagtgggggcagcacaccaacatggcacatgtatacatatgtaacaaacctgcacgttgtgcacatgtaccctaaaacttaaaaaaaaaaaaaaaaaagaatgaaagtcttaaggtccttccattatacatgaagtagtgtactattcattgaaggtagactgagataagttaaaaatgcatatagtaaactagaacaatcacccctacaaaaaaacaaaaagaagtatagctcgtaaaatgaagataacatamaaaactaaaaaatactcagttaatccaaaaaaaagcaggaaatgaagaaaaaacaaaagaatgatagaacagcaaacaagcaagatggcagatataaacccaaccaaatagaataaatgaaattaaaatagtttaaaccctacaatttaatggtagagcttgtcaaattaaattataaaataaaatccaaaccatatacggcttacaataaaacacagcttaaacataatggtataataggtttaaagaaaaatgaaataaagtcgttgctatactcatatcagatagatttttgaggca

SEQ ID NO: 55045 - DNA, 601 bp, Human
tatggacacatacacacattcacagaaaaagagagaaagaggaacagagtaattcataaagcaaatgaggcaaaatgctaacaataggtggatctgtacaaagggtacagtctatgcattcactatgatagtctttcaactttcctataaatttccaaataaaaagttttttaaaagaatccaaaattaagactttttcagacaaacagaagctgagagaatctgtctcaacagcacatctgcactacaagaaatactgaataatccaggcacaatgttcatgcctgtaatccctgcactytggggggctaaagcaggggaatctcttgaggctaggagttcaacatcagcctgggcaacacagtgagaccctgtctctacaaaacaaacaaacaaaaattagctgggcatgcgcttgtagtcctagctacctggcaggctgaaacaggaggattcctggagtccgaggctgcggtgaactatcattgcgccactgcactccaacctgggtgacagagcaagaccctatcttaaaaaaaaaacaagacagaatgaacaaataaagtttttcaggaaatgtccaaacactgtggaaatccag

SEQ ID NO: 55046 - DNA, 601 bp, Human
gtcaaatctactacaagtactaactacagtggcaataaaagagaatctttttttcttaagaaataatacaaggacatatttcggggtaaagggtaaacactatataacttattttcagacagttaaagaagaaaatatgtgtgtaattatatggacacatacacacattcacagaaaaagagagaaagaggaacagagtaattcataaagcaaatgaggcaaaatgctaacaataggtggatctgtacaaagggtacagtctatgcattcactatgatagtctttcaactttcctataaayttccaaataaaaagttttttaaaagaatccaaaattaagactttttcagacaaacagaagctgagagaatctgtctcaacagcacatctgcactacaagaaatactgaataatccaggcacaatgttcatgcctgtaatccctgcactttggggggctaaagcaggggaatctcttgaggctaggagttcaacatcagcctgggcaacacagtgagaccctgtctctacaaaacaaacaaacaaaaattagctgggcatgcgcttgtagtcctagctacctggcaggctgaaacaggagg

SEQ ID NO: 55047 - DNA, 601 bp, Human
gaattattctagattgaaagagactgaaaagatattaccacgaaatgcaatatgtgatccaaaactggatcatgtactgcaggaaaaaaaatctacaaaggttattattgggtccactaacaaaactggatagatgaataaaagtattataacaaagtcaaatctactacaagtactaactacagtggcaataaaagagaatctttttttcttaagaaataatacaaggacatatttcggggtaaagggtaaacactatataacttattttcagacagttaaagaagaaaatatgtgtgtrattatatggacacatacacacattcacagaaaaagagagaaagaggaacagagtaattcataaagcaaatgaggcaaaatgctaacaataggtggatctgtacaaagggtacagtctatgcattcactatgatagtctttcaactttcctataaatttccaaataaaaagttttttaaaagaatccaaaattaagactttttcagacaaacagaagctgagagaatctgtctcaacagcacatctgcactacaagaaatactgaataatccaggcacaatgttcatgcctgtaatccctg

SEQ ID NO: 55048 - DNA, 601 bp, Human
gtcataaaagacaaagaaaggctgaggaattattctagattgaaagagactgaaaagatattaccacgaaatgcaatatgtgatccaaaactggatcatgtactgcaggaaaaaaaatctacaaaggttattattgggtccactaacaaaactggatagatgaataaaagtattataacaaagtcaaatctactacaagtactaactacagtggcaataaaagagaatctttttttcttaagaaataatacaaggacatatttcggggtaaagggtaaacactatataacttattttcagrcagttaaagaagaaaatatgtgtgtaattatatggacacatacacacattcacagaaaaagagagaaagaggaacagagtaattcataaagcaaatgaggcaaaatgctaacaataggtggatctgtacaaagggtacagtctatgcattcactatgatagtctttcaactttcctataaatttccaaataaaaagttttttaaaagaatccaaaattaagactttttcagacaaacagaagctgagagaatctgtctcaacagcacatctgcactacaagaaatactgaataatccagg

SEQ ID NO: 55049 - DNA, 601 bp, Human
acacacaacaaagactgtattcttttaaaaggccagtgtcataaaagacaaagaaaggctgaggaattattctagattgaaagagactgaaaagatattaccacgaaatgcaatatgtgatccaaaactggatcatgtactgcaggaaaaaaaatctacaaaggttattattgggtccactaacaaaactggatagatgaataaaagtattataacaaagtcaaatctactacaagtactaactacagtggcaataaaagagaatctttttttcttaagaaataatacaaggacatatttmggggtaaagggtaaacactatataacttattttcagacagttaaagaagaaaatatgtgtgtaattatatggacacatacacacattcacagaaaaagagagaaagaggaacagagtaattcataaagcaaatgaggcaaaatgctaacaataggtggatctgtacaaagggtacagtctatgcattcactatgatagtctttcaactttcctataaatttccaaataaaaagttttttaaaagaatccaaaattaagactttttcagacaaacagaagctgagagaatctgtctcaaca

SEQ ID NO: 55050 - DNA, 601 bp, Human
tcactttttagtattctggccaggaaggcataatctgaattttctgccagaatgagaagattttacttgaaaaacacacacacacaacaaagactgtattcttttaaaaggccagtgtcataaaagacaaagaaaggctgaggaattattctagattgaaagagactgaaaagatattaccacgaaatgcaatatgtgatccaaaactggatcatgtactgcaggaaaaaaaatctacaaaggttattattgggtccactaacaaaactggatagatgaataaaagtattataacaaagtyaaatctactacaagtactaactacagtggcaataaaagagaatctttttttcttaagaaataatacaaggacatatttcggggtaaagggtaaacactatataacttattttcagacagttaaagaagaaaatatgtgtgtaattatatggacacatacacacattcacagaaaaagagagaaagaggaacagagtaattcataaagcaaatgaggcaaaatgctaacaataggtggatctgtacaaagggtacagtctatgcattcactatgatagtctttcaactttcctataaattt

SEQ ID NO: 55051 - DNA, 601 bp, Human
gcaactgtgaaagcaatgctaaagttgaaaaatcatcattttgcaactatcacagaaaagaatagtttagagaaaaattaccaaaggatgctaaatataggggtgaaatcttaatgaggtatagaatagctacatagtgttgaagtgtctctgcagacttcttattagtagcaaggcagcggatgtaaagtataaaccagagagaaactggccaggtgatcaggcctgatatcacaaatgaggggtacacagatgtcaaatggctctagatgtaatattccgaagacaaaacatcactttwtagtattctggccaggaaggcataatctgaattttctgccagaatgagaagattttacttgaaaaacacacacacacaacaaagactgtattcttttaaaaggccagtgtcataaaagacaaagaaaggctgaggaattattctagattgaaagagactgaaaagatattaccacgaaatgcaatatgtgatccaaaactggatcatgtactgcaggaaaaaaaatctacaaaggttattattgggtccactaacaaaactggatagatgaataaaagtattataacaaagtcaaatcta

SEQ ID NO: 55052 - DNA, 601 bp, Human
tagcaactgtgaaagcaatgctaaagttgaaaaatcatcattttgcaactatcacagaaaagaatagtttagagaaaaattaccaaaggatgctaaatataggggtgaaatcttaatgaggtatagaatagctacatagtgttgaagtgtctctgcagacttcttattagtagcaaggcagcggatgtaaagtataaaccagagagaaactggccaggtgatcaggcctgatatcacaaatgaggggtacacagatgtcaaatggctctagatgtaatattccgaagacaaaacatcactatttagtattctggccaggaaggcataatctgaattttctgccagaatgagaagattttacttgaaaaacacacacacacaacaaagactgtattcttttaaaaggccagtgtcataaaagacaaagaaaggctgaggaattattctagattgaaagagactgaaaagatattaccacgaaatgcaatatgtgatccaaaactggatcatgtactgcaggaaaaaaaatctacaaaggttattattgggtccactaacaaaactggatagatgaataaaagtattataacaaagtcaaatc

SEQ ID NO: 55053 - DNA, 601 bp, Human
aaaaaaaaaaaaaaaaaaaagaaaaagaaaataataataaggcagagggaagggctcttgttttcagaatcatgccaagtatcaattagcaactgtgaaagcaatgctaaagttgaaaaatcatcattttgcaactatcacagaaaagaatagtttagagaaaaattaccaaaggatgctaaatataggggtgaaatcttaatgaggtatagaatagctacatagtgttgaagtgtctctgcagacttcttattagtagcaaggcagcggatgtaaagtataaaccagagagaaactggcmaggtgatcaggcctgatatcacaaatgaggggtacacagatgtcaaatggctctagatgtaatattccgaagacaaaacatcactttttagtattctggccaggaaggcataatctgaattttctgccagaatgagaagattttacttgaaaaacacacacacacaacaaagactgtattcttttaaaaggccagtgtcataaaagacaaagaaaggctgaggaattattctagattgaaagagactgaaaagatattaccacgaaatgcaatatgtgatccaaaactggatcatgtact

SEQ ID NO: 55054 - DNA, 601 bp, Human
gagaccttcctggctaacacggtgaaatgccatctttactaaaaatacaaaacattagccaggcatggcatgcgcctgtagtcccagctactcgggaggctgaggcaggagaatggcgtgaacctgggaggcggagcttgcagtgagccgagatcgtgccactgcactccagcctggacgacagagcgagactccgtctcaaaaaaaaaaaaaaaaaaaagaaaaagaaaataataataaggcagagggaagggctcttgttttcagaatcatgccaagtatcaattagcaactgtgaaascaatgctaaagttgaaaaatcatcattttgcaactatcacagaaaagaatagtttagagaaaaattaccaaaggatgctaaatataggggtgaaatcttaatgaggtatagaatagctacatagtgttgaagtgtctctgcagacttcttattagtagcaaggcagcggatgtaaagtataaaccagagagaaactggccaggtgatcaggcctgatatcacaaatgaggggtacacagatgtcaaatggctctagatgtaatattccgaagacaaaacatcactttttagtattctggc

SEQ ID NO: 55055 - DNA, 601 bp, Human
agataactgtttaatggacaaacaatagcaatgtaatggtttaacagtatatgtaaaaggaattcatgacaataacaatacaaagaattaggagttgggagtatgctgttaaaagtttcttacaagtgaggctgtataattacttgactgtaactaatgaaagatgtacactgcaaaccctagagagaacactaaaattttttgaaaaagaggtaaagtaataagacaataatagaaataaaatataataataaaaatgctcaatccaaaaaacagcaaaaaaagataacaaaaaggagayggaacaaaggaaaaaacagcaagatattaaattcaaagccaactgcaccagtatttacattaaagaaagggttttaaaacaccaattaagagacagaggatgtcagattggataaaaaagcaagaccaaactatatactatcaaaaataacccattttaaataaaaagataggttaaaaataaaagtatggaaagagatgtctcatgtaaacagtcatgaaaagaaacctggaggagctttattaatatgaggcgcaataggctccagaacaatgaatgttatcagggataaagagtgaa

SEQ ID NO: 55056 - DNA, 601 bp, Human
ttttttctcgtttttaactactctaaaagataactgtttaatggacaaacaatagcaatgtaatggtttaacagtatatgtaaaaggaattcatgacaataacaatacaaagaattaggagttgggagtatgctgttaaaagtttcttacaagtgaggctgtataattacttgactgtaactaatgaaagatgtacactgcaaaccctagagagaacactaaaattttttgaaaaagaggtaaagtaataagacaataatagaaataaaatataataataaaaatgctcaatccaaaaaacagcaaaaaaagataacaaaaaggagacggaacaaaggaaaaaacagcaagatattaaattcaaagccaactgcaccagtatttacattaaagaaagggttttaaaacaccaattaagagacagaggatgtcagattggataaaaaagcaagaccaaactatatactatcaaaaataacccattttaaataaaaagataggttaaaaataaaagtatggaaagagatgtctcatgtaaacagtcatgaaaagaaacctggaggagctttattaatatgaggcgcaataggctccagaacaa

SEQ ID NO: 55057 - DNA, 601 bp, Human
agtattaaaacaagttcttcaattagaagaaccagagagaaacttacctaagaagaaatgaaaactggtgaaaatggtaaacatgaagataagtataaaatatacttttttctcgtttttaactactctaaaagataactgtttaatggacaaacaatagcaatgtaatggtttaacagtatatgtaaaaggaattcatgacaataacaatacaaagaattaggagttgggagtatgctgttaaaagtttcttacaagtgaggctgtataattacttgactgtaactaatgaaagatgtayactgcaaaccctagagagaacactaaaattttttgaaaaagaggtaaagtaataagacaataatagaaataaaatataataataaaaatgctcaatccaaaaaacagcaaaaaaagataacaaaaaggagacggaacaaaggaaaaaacagcaagatattaaattcaaagccaactgcaccagtatttacattaaagaaagggttttaaaacaccaattaagagacagaggatgtcagattggataaaaaagcaagaccaaactatatactatcaaaaataacccattttaaataaaaag

SEQ ID NO: 55058 - DNA, 601 bp, Human
catggagagagaccctctctgaggcacaggctcatagggaaaacctaagttgtgagtgatatatagctacattttaaaaaaaagtctggcacctcagactcttacctacactgtctggctttcaatcaaaacttaaacatgaaaaagcagcaaattatgattaagatgatacaggatctagtagaaaagatgaacaacatacatgaacagatggggcatttctgtagaaattacttcaatggaaatacttttttttagaaagaataaaatagaaatgttagatatatagatatagacacawaaaaccaacacagtaacagataacttgactcagctaaggaaagaatcagtgaacctaaaattggattggtattatccaatctgaaacacagagagagaaaaaaaggaaaaagaaaaaaaattgtaacagaacagagcctctaagagctatgggacaatatcaagaaatatacacataatagaaatcacagaagaagaaaaaagggaggagaagaaatcgttgaagaactgtctagaatttgccaaatataagaaagacaccaaaccacaaatgcaagaatttcaaagatcaagcaacaca

SEQ ID NO: 55059 - DNA, 601 bp, Human
ctaggagagaaatgaacatggagagagaccctctctgaggcacaggctcatagggaaaacctaagttgtgagtgatatatagctacattttaaaaaaaagtctggcacctcagactcttacctacactgtctggctttcaatcaaaacttaaacatgaaaaagcagcaaattatgattaagatgatacaggatctagtagaaaagatgaacaacatacatgaacagatggggcatttctgtagaaattacttcaatggaaatacttttttttagaaagaataaaatagaaatgttagatayatagatatagacacaaaaaaccaacacagtaacagataacttgactcagctaaggaaagaatcagtgaacctaaaattggattggtattatccaatctgaaacacagagagagaaaaaaaggaaaaagaaaaaaaattgtaacagaacagagcctctaagagctatgggacaatatcaagaaatatacacataatagaaatcacagaagaagaaaaaagggaggagaagaaatcgttgaagaactgtctagaatttgccaaatataagaaagacaccaaaccacaaatgcaagaatttca

SEQ ID NO: 55060 - DNA, 601 bp, Human
aatctacttctaggagagaaatgaacatggagagagaccctctctgaggcacaggctcatagggaaaacctaagttgtgagtgatatatagctacattttaaaaaaaagtctggcacctcagactcttacctacactgtctggctttcaatcaaaacttaaacatgaaaaagcagcaaattatgattaagatgatacaggatctagtagaaaagatgaacaacatacatgaacagatggggcatttctgtagaaattacttcaatggaaatacttttttttagaaagaataaaatagaaaygttagatatatagatatagacacaaaaaaccaacacagtaacagataacttgactcagctaaggaaagaatcagtgaacctaaaattggattggtattatccaatctgaaacacagagagagaaaaaaaggaaaaagaaaaaaaattgtaacagaacagagcctctaagagctatgggacaatatcaagaaatatacacataatagaaatcacagaagaagaaaaaagggaggagaagaaatcgttgaagaactgtctagaatttgccaaatataagaaagacaccaaaccacaaatgca

SEQ ID NO: 55061 - DNA, 601 bp, Human
tcagctaattttctgtatttttagtagagacagggtttcaccatgttagccaggatggtctcgatctcctgacctcgtgatccacccgcctcggcctcccaaagtgctgggattacaggcgtgagccaccgcacctggccttgcaggctattttctacagacctcagtgggcacccacaagagtcctcagtctctctgtagctcactggggaagggcagcaaattagaaaagatcttcctccagatccattcctggcaaaagagaaccacccccactgcaggatggacatgaagccccaawcacatctttatccctgaagaaaaaaagcattaagccactgacgaaaggtcagcaaaaatgttatccccagagcatcggttgctgagggaagtaaacaaaaacaaacaaaaaaccccctctacccttcaggaggatcaggaaaccattctgggccctgacccatagaggacccctgcccctggcagtgagagaggggcaggatcgctgaaaaagccccagctctgagatgcaggattgaaagacctgcctaagactgaagctaaatcagagtaacagagaaccctccttttctgcctgcca

SEQ ID NO: 55062 - DNA, 601 bp, Human
caatcaactagcctgaaacctaaacaaagatgagtgccttagaagagagagggatcatgagcactggttgacataggacagtacaccagagaaaaattggtaccaccctatctctgggtaagatctcagctaaactttttgatgaactgcaaaagaccaagggtgagctaccatgaaaatataaaaatcctgggtggcttggacacagcgggcatcacatccatttgcaggctattttccttttttttttttttttgagacagagtctcgctctgtcacccaggacggagtgcagtggcgygatctcggctcactgcaagctctgccttccgggttcacgccattctcctgcctcagcctcccgagtagctgggactacaggtgcctgccaccacgctcagctaattttctgtatttttagtagagacagggtttcaccatgttagccaggatggtctcgatctcctgacctcgtgatccacccgcctcggcctcccaaagtgctgggattacaggcgtgagccaccgcacctggccttgcaggctattttctacagacctcagtgggcacccacaagagtcctcagtctctctgtagctc

SEQ ID NO: 55063 - DNA, 601 bp, Human
tcagtaaactcttttctctatttctgtatatgtttgaaataatccccattaaagttttattttttttaaaccacagaccttatgacgatcatttaagaatgcaactgtctcaatacaaagtttacgttttctgagcactgagaggtaccttttgcctccttgatattgtaaaatcagtagaaacaatgtaaaaaatctctctgtgaagatgaccagctagtggttctctcctttccaaactgagtcatggaataacatgaaaaacacagggaccatttgcattctatccaatccattaatmcaagtatcactaaagacagagaacatctggcatgtcctcttgtaagatattaagaaaactaggccaggcgcagtggctcacgcctctaatcccagcactttgagaggccgaagcgggtggatcacgaggtcaggagatcgagaccatcctggctaacacgatgaaaccccgtctccactaaaaataaaaaaaatttttaaaaaattagccgggtgtggtggggggcgcctatagtcccagctacctgggaggctgaggcaggagaatggcgtgaacccgggaggcggagcttgcagtgaa

SEQ ID NO: 55064 - DNA, 601 bp, Human
agtagaaaatgcaacatgattcaattatatattaacaaaataataaattttctattttcaatatttaatatcccacattcattaatacaacaggcaatatttgaaaccagaagactaacgacacttagctattagtaaggctgatcttcttgtctgccttctctcctttccaatctaacttctccaggtcattatagaaaagtagtatgtatagaaaatgcaataatacaaaacacagtaagttaagcctctaggtccactttttaaacctcagacttaaaagatcagaaatctgcttccrtgattcactgcagttcccatcttacagttagcacacaggtaataatagggtcaatgtaaatcccatttttttcctacttatttggttacaaacttactttcttaaggtaaccattgctttctccttacaaacacactacaaatggcctagaaaaaaaaaagtctacttggaagagaccaaaacactttctccagtgtcacaggacacaatgactattttcttcactggtatcctgtcttcaagtttggggcatcaagctagtggaaggcaacagtgaagaattttaggtctctgattccc

SEQ ID NO: 55065 - DNA, 601 bp, Human
aaaatctccccaaaatgacaaaaagggaaatattacaaaccttcaaatctcaaatgtgagtgtttaaaatagaggaaaatgatctctcatctgttttatatagacctaggaagaatcattcctatgtacttcccttaaataccagaaatggtatacattttactcattattttttctcatcagtagaaaatgcaacatgattcaattatatattaacaaaataataaattttctattttcaatatttaatatcccacattcattaatacaacaggcaatatttgaaaccagaagactaacracacttagctattagtaaggctgatcttcttgtctgccttctctcctttccaatctaacttctccaggtcattatagaaaagtagtatgtatagaaaatgcaataatacaaaacacagtaagttaagcctctaggtccactttttaaacctcagacttaaaagatcagaaatctgcttccatgattcactgcagttcccatcttacagttagcacacaggtaataatagggtcaatgtaaatcccatttttttcctacttatttggttacaaacttactttcttaaggtaaccattgctt

SEQ ID NO: 55066 - DNA, 601 bp, Human
aaagttgggaggttgctaacaagcaataaaatgaaaactatttttggcacaaatttgcaagctatagaagcattgaaatcctatacagaagtattgttactgagtggcctgaggacaggatagagtcccgaatgtttccattttaatcccagcttcttttcacagaaatgctttgagagcagctaattaatatttgcaaagtgcttagtgataagctcaaagtagaatgctagtcataaaaatcaaaaagcaggcatataaaatacaaaaaaagtcactaagtaaacacccaattaaaatycaatctcttaagtaatgttaacaaaagtttgaattgaaccttaatataaaacattattctgaaaaattacttaagatgaaaaacagcaactgaagctctttacaaattaaataaagtcgtgcaacttacgatatttactgtggatttcatctatttccttttctgtttggtcctttgtaaaaaccattacctaaaataatcaaaaaaagaccttaataaaaatctccccaaaatgacaaaaagggaaatattacaaaccttcaaatctcaaatgtgagtgtttaaaatagaggaaaatga

SEQ ID NO: 55067 - DNA, 601 bp, Human
caattaaaacataccatgcctgggaatactgattcaatgaacatctattaactatctactgttcgtcaggcacttaaatttaaactaaaatccaaccaccacacaaagagtaacagctatctgacaaaacagtaatgtgttagccctgggaaagatatacacgaagaccatttaaggaaaaggaagtgataaagttgggaggttgctaacaagcaataaaatgaaaactatttttggcacaaatttgcaagctatagaagcattgaaatcctatacagaagtattgttactgagtggcctraggacaggatagagtcccgaatgtttccattttaatcccagcttcttttcacagaaatgctttgagagcagctaattaatatttgcaaagtgcttagtgataagctcaaagtagaatgctagtcataaaaatcaaaaagcaggcatataaaatacaaaaaaagtcactaagtaaacacccaattaaaattcaatctcttaagtaatgttaacaaaagtttgaattgaaccttaatataaaacattattctgaaaaattacttaagatgaaaaacagcaactgaagctctttacaaattaa

SEQ ID NO: 55068 - DNA, 601 bp, Human
agtttaagaaatgaagagagaaaaaaattatcttacctcaattaaaacataccatgcctgggaatactgattcaatgaacatctattaactatctactgttcgtcaggcacttaaatttaaactaaaatccaaccaccacacaaagagtaacagctatctgacaaaacagtaatgtgttagccctgggaaagatatacacgaagaccatttaaggaaaaggaagtgataaagttgggaggttgctaacaagcaataaaatgaaaactatttttggcacaaatttgcaagctatagaagcaytgaaatcctatacagaagtattgttactgagtggcctgaggacaggatagagtcccgaatgtttccattttaatcccagcttcttttcacagaaatgctttgagagcagctaattaatatttgcaaagtgcttagtgataagctcaaagtagaatgctagtcataaaaatcaaaaagcaggcatataaaatacaaaaaaagtcactaagtaaacacccaattaaaattcaatctcttaagtaatgttaacaaaagtttgaattgaaccttaatataaaacattattctgaaaaattactt

SEQ ID NO: 55069 - DNA, 601 bp, Human
taccaccctttcagttatttaaattactttctcccaatgcaagttttctggtttccttattttcacaggccttagtgatccttatttttccaggccaattcactgatcatttgatattctcttttgttctcctttctaaagaaaaatcactctgacatcctacaagttgatcaaagaggttcacatcatacttatctgtccagcaacagaacaatggtgacttttgttgttcagtccataatccaagactcctctaggttccttttcctactctagcaaggcacaggcaatcacacctgcgggcttcatcctccctcccacaatacatcactacagaacctggcccttcagagtttaagaaatgaagagagaaaaaaattatcttacctcaattaaaacataccatgcctgggaatactgattcaatgaacatctattaactatctactgttcgtcaggcacttaaatttaaactaaaatccaaccaccacacaaagagtaacagctatctgacaaaacagtaatgtgttagccctgggaaagatatacacgaagaccatttaaggaaaaggaagtgataaagttgggaggttgctaacaa

SEQ ID NO: 55070 - DNA, 601 bp, Human
gaatatagtccaaatttttcttaatatgggaggattattagataccaccctttcagttatttaaattactttctcccaatgcaagttttctggtttccttattttcacaggccttagtgatccttatttttccaggccaattcactgatcatttgatattctcttttgttctcctttctaaagaaaaatcactctgacatcctacaagttgatcaaagaggttcacatcatacttatctgtccagcaacagaacaatggtgacttttgttgttcagtccataatccaagactcctctaggktccttttcctactctagcaaggcacaggcaatcacacctgcaggcttcatcctccctcccacaatacatcactacagaacctggcccttcagagtttaagaaatgaagagagaaaaaaattatcttacctcaattaaaacataccatgcctgggaatactgattcaatgaacatctattaactatctactgttcgtcaggcacttaaatttaaactaaaatccaaccaccacacaaagagtaacagctatctgacaaaacagtaatgtgttagccctgggaaagatatacacgaagacca

SEQ ID NO: 55071 - DNA, 601 bp, Human
ttgatgaaaggaattataaccatcttatgcaaattgtctggcttgagccataaacaatgtatctaactaaatactgagcttacaaaaacttatgacataatatttaaaggatggaagggaagcaaaggtagggctcaggatatataaatgagctaaatctccatctttcatattagcacatcaatagttaatgtgaaattgaaaaacttcaagaagtagcagaaaaaatacttttttataaattgtaaggtaattaccaaaagtagcaccaaatggcttgatagttgttacctctagggartgggaatagaggcaggttgttggaggatgcaagagactgctcttttatatgataaggctcataaaaagtaaatgattttttaaaaactacatgtaaaacattaataaaatgtttaaagatgaagatatatcaatagtatagttagaacctgacactaaatcaaaatgtatgaataaactaaaaggctaagcatctaagctttgtgaagcacttgacttttgaggtttattttaaggctaaataaattaataccacctatttagtaaagttacactttttagatatctaaatggtgggcaa

SEQ ID NO: 55072 - DNA, 601 bp, Human
ttcctggcaaatgtattctaccaaaacaaggcaagagaagagggagacttggaacttggaagaagtgaaccaacacaggaaggaggagagcagaattcccagaaagttggtgacaagaaattccagaagagcagccaggtattaacagaaggcaaaaaggacaagcatagtagactggaacaggacaacagaggctaggggtggccctaggagagacgttcttgagaaaataatgagttataatcaatgtgtgtaaatgtattggaaagtgatttacacttctgttggaaggtttagagayatattagtactaggtaaatagttaaacaaacaaaagagaattattagttataagaaaaacaaggccgggtgcagtggctcacgcctgtaatcccagcactttgggaggctgaggcgggcggatcacgaggtcaggagagcgagaccatcctggctaacacggtgaaaccccgtctctactaaaaatacaaaaaactagccaggcgtggtggcaggcgcctgtactcaggaggcgccagctactcaggaggctgaggcaggagaatggcgtgaacccaggaggcagagcttgcagtgagcc

SEQ ID NO: 55073 - DNA, 601 bp, Human
tgtcttgggccacacataaaatacactaacactaacaatagctgataagagaaaaaaaattatcataatgtttaataaagtttacaaattcgttttgggctgcattcaaaggccatcctaggccgcagtttagacaagcttgcatacaccgtttctcaggaagtttcctggcaaatgtattctaccaaaacaaggcaagagaagagggagacttggaacttggaagaagtgaaccaacacaggaaggaggagagcagaattcccagaaagttggtgacaagaaattccagaagagcagccrggtattaacagaaggcaaaaaggacaagcatagtagactggaacaggacaacagaggctaggggtggccctaggagagacgttcttgagaaaataatgagttataatcaatgtgtgtaaatgtattggaaagtgatttacacttctgttggaaggtttagagatatattagtactaggtaaatagttaaacaaacaaaagagaattattagttataagaaaaacaaggccgggtgcagtggctcacgcctgtaatcccagcactttgggaggctgaggcgggcggatcacgaggtcagga

SEQ ID NO: 55074 - DNA, 601 bp, Human
gcaggtccagatacaggaaataacagactttacaaactgtagcttaagagaaatcgaaagcccactgaagagttctttacaatggcaggagggcagcaaggcagaaatggcatgatgtgaagactcagcagttttggaagacagttttggcttctgagtattaggaaggggcaagagtagatgggggatgactagagagcaaagtgatacataagaagtgtacggactcgggggatatttagaagatagagactgacagaacttgatggtgaactgaacatgggcagataaaaaaaaaaaagtaacaaatgaaagataaagaatcagaatggcaagctagttattagcaacagtgatggaaagtagaaaacagcggaagaatacctttgaaaatttggagaaaagtatctttttaacctaaagttctacaaacagccaaattatcaatcaataataaacgggttatttcctgttatgtatggaatgttatatatctcaagaaattcctctataccaggggtgtccaatcttttggcttccctgggccacactggaagaagaattgtcttgggccacacataaaatacactaacactaacaa

SEQ ID NO: 55075 - DNA, 601 bp, Human
cttttctaagtgagagagtttttttcctacctcaggactctgcttataatagggaaatgacagaggagccacccctgaggtcattaggatgagccctaatccaatatgactgatatgtttataaaagggggaaatttggacacagagacaacatagagggaagacgatgtcaagagacatagggagaagatggccatctatagccaagaagagagacctagaacagatccttcctgcatggccctgagaagctcgggacaccttgatcttagacttctagcctccagaaccctgctgacaycttgatcttggacttctagcttccagaaccacaagacaataaatttgttatttaagccatgcggtctgcatgcagtattttgttttggcaaccctagcacactaataaaaacacataattagaaattaattagaaataagtaattaattgcacaataaataatgattatgaccattatactcttccttgctttattttttcacttatcacttcctaaaatactagaaagatataaactccaacagagtaggcttcttgtctgtcttgttcattcctatatccccagctccgagcacagtg

SEQ ID NO: 55076 - DNA, 601 bp, Human
tcccacccacaaagggggtcaaggtccagggaactatcccataatacgggggctcatccaggatatgacaaagggtgagttaaaatgtggaattgttggatccgtctcttttccaagaccctgccacctctctctctcctttgggttaaaggaatgttggttctgtttcccttcatggaggtctagctgatctgaattgaggtagacatagagtgattaaaggaacccatttccagagagcaagaggctcttcccccaggcccccaacccccaactattcactttaagcttttttttttttcttttctaagtgagagagtttttttcctacctcaggactctgcttataatagggaaatgacagaggagccacccctgaggtcattaggatgagccctaatccaatatgactgatatgtttataaaagggggaaatttggacacagagacaacatagagggaagacgatgtcaagagacatagggagaagatggccatctatagccaagaagagagacctagaacagatccttcctgcatggccctgagaagctcgggacaccttgatcttagacttctagcctccagaaccctgctgaca

SEQ ID NO: 55077 - DNA, 601 bp, Human
tctactccagttcccacccacaaagggggtcaaggtccagggaactatcccataatacgggggctcatccaggatatgacaaagggtgagttaaaatgtggaattgttggatccgtctcttttccaagaccctgccacctctctctctcctttgggttaaaggaatgttggttctgtttcccttcatggaggtctagctgatctgaattgaggtagacatagagtgattaaaggaacccatttccagagagcaagaggctcttcccccaggcccccaacccccaactattcactttaagcwtttttttttttcttttctaagtgagagagtttttttcctacctcaggactctgcttataatagggaaatgacagaggagccacccctgaggtcattaggatgagccctaatccaatatgactgatatgtttataaaagggggaaatttggacacagagacaacatagagggaagacgatgtcaagagacatagggagaagatggccatctatagccaagaagagagacctagaacagatccttcctgcatggccctgagaagctcgggacaccttgatcttagacttctagcctccagaa

SEQ ID NO: 55078 - DNA, 601 bp, Human
cgctggacaagaacccacatgctgaaagggcaggggctaggacactgctacggggcctgcacagagcctgctcccaccagagaggagcatctggctggttccagcattcgttccctcttgcaaggagtggccagcagtgcgctgagtgaaaggatctactccagttcccacccacaaagggggtcaaggtccagggaactatcccataatacgggggctcatccaggatatgacaaagggtgagttaaaatgtggaattgttggatccgtctcttttccaagaccctgccacctctctctytcctttgggttaaaggaatgttggttctgtttcccttcatggaggtctagctgatctgaattgaggtagacatagagtgattaaaggaacccatttccagagagcaagaggctcttcccccaggcccccaacccccaactattcactttaagcttttttttttttcttttctaagtgagagagtttttttcctacctcaggactctgcttataatagggaaatgacagaggagccacccctgaggtcattaggatgagccctaatccaatatgactgatatgtttataaaagggggaaat

SEQ ID NO: 55079 - DNA, 601 bp, Human
aatgaatactcaaggtgaactctctgcagatcactgggtttctccttccagtactgtgtcctgcaaactctaactcctttggttcctctgatctctcagctctttctccttaacttagagtctccaggctttgcctggaatacccacttgcccatactacagccaggaaactgtattataaggctcatcgcattttttgcttacctctcaaggatccctgtcctttgtggccagtatcttgaaaattgctatttcatatgttttgtacattcattttgcttgttttaggtaggagagtaaatgaagttattccatggctggaaacagacaccctctaagttttaattgataatgtgatacatatcaacagatatgacccacataaacaaaggctctttggtgtccttgagatacagaatggctgggctcctggctaaactccacccttaacctgggaccttggccctaagtgaaaacagctgaccccatctcaccgcccaaatattgcctttttggtctgccatgcccctatcctttgcccataaaaacacttcagctggcagagcaacacaagcggctgatgcaagcggtcagggatgca

SEQ ID NO: 55080 - DNA, 601 bp, Human
acttatgatctatttcccttgttcttaccatgaaacaactgtccttgctataattaaaggctaacctctaacttatgctcaggattccatcatgaagctgtgaacagagagactgtgcctttgaacctagagtgtgaattatgaaaataactcagtaaatccagaccagcatttttttcttaatgaaataataaagagaatagaaagtatcagaatgcgttaaaaatggaaaaggtaaataccattttgtgaagcttttgtttcagtcatgtgtatgtatacagttagtagtaatataaaatttatctctcactgtgggttgtagtcaaaaaggtcagaaagccactgagttaaatatctcccaatttaaataacaaactttaaaaaacaagcaaacaaaaccctcccttgacccaacacccccctccagctatgaccctatttttttgctctccttaacacagtaaaacctcccccgaaaagttgtctaccttaatggtctcatttcctcacctccaatttggtctcaatcaactctaaacacttctgacctctctaataaggctggtcttgtcaaggtttgctgcttccaagctgtgaa

SEQ ID NO: 55081 - DNA, 601 bp, Human
gtgcacttatgatctatttcccttgttcttaccatgaaacaactgtccttgctataattaaaggctaacctctaacttatgctcaggattccatcatgaagctgtgaacagagagactgtgcctttgaacctagagtgtgaattatgaaaataactcagtaaatccagaccagcatttttttcttaatgaaataataaagagaatagaaagtatcagaatgcgttaaaaatggaaaaggtaaataccattttgtgaagcttttgtttcagtcatgtgtatgtatacagttagtagtaatataaaatttatctctcactgtgggttgtagtcaaaaaggtcagaaagccactgagttaaatatctcccaatttaaataacaaactttaaaaaacaagcaaacaaaaccctcccttgacccaacacccccctccagctatgaccctatttttttgctctccttaacacagtaaaacctcccccgaaaagttgtctaccttaatggtctcatttcctcacctccaatttggtctcaatcaactctaaacacttctgacctctctaataaggctggtcttgtcaaggtttgctgcttccaagctg

SEQ ID NO: 55082 - DNA, 601 bp, Human
tctgtgcacttatgatctatttcccttgttcttaccatgaaacaactgtccttgctataattaaaggctaacctctaacttatgctcaggattccatcatgaagctgtgaacagagagactgtgcctttgaacctagagtgtgaattatgaaaataactcagtaaatccagaccagcatttttttcttaatgaaataataaagagaatagaaagtatcagaatgcgttaaaaatggaaaaggtaaataccattttgtgaagcttttgtttcagtcatgtgtatgtatacagttagtagtaatataaaatttatctctcactgtgggttgtagtcaaaaaggtcagaaagccactgagttaaatatctcccaatttaaataacaaactttaaaaaacaagcaaacaaaaccctcccttgacccaacacccccctccagctatgaccctatttttttgctctccttaacacagtaaaacctcccccgaaaagttgtctaccttaatggtctcatttcctcacctccaatttggtctcaatcaactctaaacacttctgacctctctaataaggctggtcttgtcaaggtttgctgcttccaag

SEQ ID NO: 55083 - DNA, 601 bp, Human
ttgtctgtgcacttatgatctatttcccttgttcttaccatgaaacaactgtccttgctataattaaaggctaacctctaacttatgctcaggattccatcatgaagctgtgaacagagagactgtgcctttgaacctagagtgtgaattatgaaaataactcagtaaatccagaccagcatttttttcttaatgaaataataaagagaatagaaagtatcagaatgcgttaaaaatggaaaaggtaaataccattttgtgaagcttttgtttcagtcatgtgtatgtatacagttagtagtaatataaaatttatctctcactgtgggttgtagtcaaaaaggtcagaaagccactgagttaaatatctcccaatttaaataacaaactttaaaaaacaagcaaacaaaaccctcccttgacccaacacccccctccagctatgaccctatttttttgctctccttaacacagtaaaacctcccccgaaaagttgtctaccttaatggtctcatttcctcacctccaatttggtctcaatcaactctaaacacttctgacctctctaataaggctggtcttgtcaaggtttgctgcttcc

SEQ ID NO: 55084 - DNA, 601 bp, Human
ataccttgtctgtgcacttatgatctatttcccttgttcttaccatgaaacaactgtccttgctataattaaaggctaacctctaacttatgctcaggattccatcatgaagctgtgaacagagagactgtgcctttgaacctagagtgtgaattatgaaaataactcagtaaatccagaccagcatttttttcttaatgaaataataaagagaatagaaagtatcagaatgcgttaaaaatggaaaaggtaaataccattttgtgaagcttttgtttcagtcatgtgtatgtatacagttagtagtaatataaaatttatctctcactgtgggttgtagtcaaaaaggtcagaaagccactgagttaaatatctcccaatttaaataacaaactttaaaaaacaagcaaacaaaaccctcccttgacccaacacccccctccagctatgaccctatttttttgctctccttaacacagtaaaacctcccccgaaaagttgtctaccttaatggtctcatttcctcacctccaatttggtctcaatcaactctaaacacttctgacctctctaataaggctggtcttgtcaaggtttgctg

SEQ ID NO: 55085 - DNA, 601 bp, Human
aagcaccagtataccttgtctgtgcacttatgatctatttcccttgttcttaccatgaaacaactgtccttgctataattaaaggctaacctctaacttatgctcaggattccatcatgaagctgtgaacagagagactgtgcctttgaacctagagtgtgaattatgaaaataactcagtaaatccagaccagcatttttttcttaatgaaataataaagagaatagaaagtatcagaatgcgttaaaaatggaaaaggtaaataccattttgtgaagcttttgtttcagtcatgtgtatgtatacagttagtagtaatataaaatttatctctcactgtgggttgtagtcaaaaaggtcagaaagccactgagttaaatatctcccaatttaaataacaaactttaaaaaacaagcaaacaaaaccctcccttgacccaacacccccctccagctatgaccctatttttttgctctccttaacacagtaaaacctcccccgaaaagttgtctaccttaatggtctcatttcctcacctccaatttggtctcaatcaactctaaacacttctgacctctctaataaggctggtcttgtca

SEQ ID NO: 55086 - DNA, 601 bp, Human
ttcatgatcataattctcaaatgggcattcaatactgctataaaactcttgcacctttctctagtaaagtttgctctactattctccaaaatatctatctcacactttcttctcttcattcaaatattcgacactccccatgtggcccctcttagttggcctcacactactttgaaaaatatagaatcattctaacagaaactctgtcatcttccaagcaccagtataccttgtctgtgcacttatgatctatttcccttgttcttaccatgaaacaactgtccttgctataattaaaggmtaacctctaacttatgctcaggattccatcatgaagctgtgaacagagagactgtgcctttgaacctagagtgtgaattatgaaaataactcagtaaatccagaccagcatttttttcttaatgaaataataaagagaatagaaagtatcagaatgcgttaaaaatggaaaaggtaaataccattttgtgaagcttttgtttcagtcatgtgtatgtatacagttagtagtaatataaaatttatctctcactgtgggttgtagtcaaaaaggtcagaaagccactgagttaaatatctc

SEQ ID NO: 55087 - DNA, 601 bp, Human
acagagtttaacagttatggctaatgttcactacaggcttattcatctagccctgaactgactagtgacactttaatttcatgatcataattctcaaatgggcattcaatactgctataaaactcttgcacctttctctagtaaagtttgctctactattctccaaaatatctatctcacactttcttctcttcattcaaatattcgacactccccatgtggcccctcttagttggcctcacactactttgaaaaatatagaatcattctaacagaaactctgtcatcttccaagcaccartataccttgtctgtgcacttatgatctatttcccttgttcttaccatgaaacaactgtccttgctataattaaaggctaacctctaacttatgctcaggattccatcatgaagctgtgaacagagagactgtgcctttgaacctagagtgtgaattatgaaaataactcagtaaatccagaccagcatttttttcttaatgaaataataaagagaatagaaagtatcagaatgcgttaaaaatggaaaaggtaaataccattttgtgaagcttttgtttcagtcatgtgtatgtatacag

SEQ ID NO: 55088 - DNA, 601 bp, Human
aatcacattaacagttaaggagacttaatgacttattatcttctgaagtaataaaatcccagatttaaatctaattaccccacagctaggctggaaaccaaaagtaaatggcagccactactctggctttagccagagaattccaataacccctactcagaaaatgaaaaatgtcaacagatcaagactagtaacattgttcccacttacttctttacttcattttagaagatctgccatttggcaaggaatactgcagagtttaaaatctcagttctggtgggcatgtgtcctggatttwcctcttaaaagttttaagtggctcagctagtcgtgggagtgtccatgactaagtacacgttcaatcaactcattttcttccagattttgaatacctgaatcataccatcctttgtgcctctctaagtttaaatgtaatcttttttagaacgaaatcaagccctttactccctgatcactttaactactcttctttagaccagcccttacagtcagagtgtctctgggtctgcccaagaacccagaacccagtggtacaaaagactaaaaacaggctctctcaagagtagaaaagactcac

SEQ ID NO: 55089 - DNA, 601 bp, Human
ttggcagaacatttcatccaaagtaaacaccagtgttctatcacaaaaataattcactctctttacaggatctccaccaataaattctatacctagaaaacatcctgaagcttaaataacaaagaaatttatgatttatcattaactgaaaggacgatagacaaaaagagattgtttcttcaggacattcttccaaccactttccccatagtaataaatctagtttacaaactgctacatgaagtttgtctaaaaatactttttctcatttcaaagaactaagaactccaaagtaaatttmtttggtttaattttttcatattaaaagtaaataatgaaattcgacatatgtctgtttttaattatagtctcttacccatgcatacagaagatagcttttctgtagattcatcttcttttgttattgttactgttttttgtgacattccagcaattttcttgtatccttttctagcctgatccaccagaagctgaaattcactcttatgttttttacctgaaattcaaaagatcttctcagtaaagctaggactatgaaagttaaccatctacaactgacaaactgaatatcaagaggtgt

SEQ ID NO: 55090 - DNA, 601 bp, Human
acttcttccactcttacatacacttctagaagatatattccctcttgggaacaaacagcattcaataatctgtgggcataaaaaataagttatccttcctacttgcccttagatctcagaatgcaggactccaaaatagagccccgaagagtgaggctcagacatcagagctccccagagacacacaacaaaaacaggctaagttttcacttgagagaatatgcaacttgttcacttacatgagcacttcaatgttctaaagagcaacaattatattggttgtatgatgctatacaaaatscatcttttcagtcagtctgtgtctgtcttcatctctctcacataccttaccctctcagacatctcattcatgcacagcaatctaaaagcagcaatcacctctgaaccccggaaagagtaatattgatgttcataaatacatacaagccatcaatgatattcaagagagtttcaactaattaaaaaaacttttcttaatgggaaatattcagtcagattttctcaagtgctaaactagtttctagaaatatcctttaacaactgcatgaacaagttcgagttgttcaatgaccatgagtta

SEQ ID NO: 55091 - DNA, 601 bp, Human
aagctacatgtgctaataatactacagagctcctttcatgtgtttcctcacagagaaacagagctttcacacatcactcatcaagcacttgtagaggcaagtggtcttcaacaaagcacactaaaaatacaattgtcaaggtttgattatacagagagaatttatggggaaagaacataacaaattcttcaaaaaaccttgccaagttcatacagttaaatttttttcagaaatagttctaagtttttgttacactgagagaacagcatacttcacaagagtgtaattcctaaaaatatgytcctaatgtcatctggctgtcaataaactatcattagcaaaacaaaacagcaccctctaatgtatatctggaaaagggaaaaagaatttagccaggatgaccatcctgaacctctaggaactcctcttgtaaacagataccagaatcacattaagaggagccaatcccccagtcaactcggttcacccagggactatattactcaactagtgaggtgcatgcaagcaagctagcaaaccagggaacaggaattcaacttaaaacaatcttttatttttgcacattgtctgtattcttttc

SEQ ID NO: 55092 - DNA, 601 bp, Human
ttttaaaatatcttttcaaaatgactcattaccaaacttctcatttttaaagtttccccatctattctatttactcagttaaatttttcatttcttaaccctcctatgcgccatgtctttctgatcatttctgttttccaatatagttgtttttatctcctttactcatcgtcttgacaaaaatttcactgtctatcatgctttcttttccaacggtaggaaaagtatctacataaaggctatagagtagagaccaaactcaccctgtgatccctgcactaccttcccaaatcctgccttsttatcactgtgaagaagacccagcagtaaaaggggactgaaatgtaagagtgacacaccatgccatgcctcaaagctacattctaattatttctgcctatctatctacatgtgcatatgaagtagatatttaaaataatcaactactgcatgtttcttacctattgcatgaatctgattctgatgaagaaagaacttcttgaatatcaatacagctagaagaatcctcttctctgtcaggttccaattcctctggggagtccagctttgattgagaaaagtggtttgttactgaggtcat

SEQ ID NO: 55093 - DNA, 601 bp, Human
aggaagagctttaccatagcatcaggtacataagtagaacactgggaaaaatgtagagctctaacagaaactgaagggtctggtaaattatagcgcagagacataacagaatactgtactcattaaaaaataacaattataaacataagctattatgttggtgcaaaagtaactgtggtttcaattacttttgtgccaacctatagaaacgtaacatttatgacataacattaagtgaaagaccggaacaaaaactggtatgtgtgtgtgcatgcgtgtgtgtgtgtgtgtgtgtgtgtggaaaataaaccctatatattttttaaaatatcttttcaaaatgactcattaccaaacttctcatttttaaagtttccccatctattctatttactcagttaaatttttcatttcttaaccctcctatgcgccatgtctttctgatcatttctgttttccaatatagttgtttttatctcctttactcatcgtcttgacaaaaatttcactgtctatcatgctttcttttccaacggtaggaaaagtatctacataaaggctatagagtagagaccaaactcaccctgtgatccctgcacta

SEQ ID NO: 55094 - DNA, 601 bp, Human
ccagccacttgggaagctgaggtaggagaaatgcttgaacctgggaggtggaggttgcagtgagccgaaatcgcaccaccacactccaggctgggcaacagagtgagactccgtctcaaaaaaatgaaaaaaaaagtatacaatagaaacaaaggaagagctttaccatagcatcaggtacataagtagaacactgggaaaaatgtagagctctaacagaaactgaagggtctggtaaattatagcgcagagacataacagaatactgtactcattaaaaaataacaattataaacataarctattatgttggtgcaaaagtaactgtggtttcaattacttttgtgccaacctatagaaacgtaacatttatgacataacattaagtgaaagaccggaacaaaaactggtatgtgtgtgtgcatgcgtgtgtgtgtgtgtgtgtgtgtgtgtaaaataaaccctatatattttttaaaatatcttttcaaaatgactcattaccaaacttctcatttttaaagtttccccatctattctatttactcagttaaatttttcatttcttaaccctcctatgcgccatgtctttctgatcatt

SEQ ID NO: 55095 - DNA, 601 bp, Human
ggtggctcatgcctgtaattccagcactttgggaggccgaggtgggtggatcacttgaggtcaggagtttgagaccagcctggccaacacggtgaaaccctgtctctactaaatgtacaaaaaaaaaaattagccaggcgtggtggcacaggcctgtaatcccagccacttgggaagctgaggtaggagaaatgcttgaacctgggaggtggaggttgcagtgagccgaaatcgcaccaccacactccaggctgggcaacagagtgagactccgtctcaaaaaaatgaaaaaaaaagtatwcaatagaaacaaaggaagagctttaccatagcatcaggtacataagtagaacactgggaaaaatgtagagctctaacagaaactgaagggtctggtaaattatagcgcagagacataacagaatactgtactcattaaaaaataacaattataaacataagctattatgttggtgcaaaagtaactgtggtttcaattacttttgtgccaacctatagaaacgtaacatttatgacataacattaagtgaaagaccggaacaaaaactggtatgtgtgtgtgcatgcgtgtgtgtgtgtg

SEQ ID NO: 55096 - DNA, 601 bp, Human
caattcattcagagggcaatgcctacatatcagaataataaagataagtggccaggtacggtggctcatgcctgtaattccagcactttgggaggccgaggtgggtggatcacttgaggtcaggagtttgagaccagcctggccaacacggtgaaaccctgtctctactaaatgtacaaaaaaaaaaattagccaggcgtggtggcacaggcctgtaatcccagccacttgggaagctgaggtaggagaaatgcttgaacctgggaggtggaggttgcagtgagccgaaatcgcaccaccrcactccaggctgggcaacagagtgagactccgtctcaaaaaaatgaaaaaaaaagtatacaatagaaacaaaggaagagctttaccatagcatcaggtacataagtagaacactgggaaaaatgtagagctctaacagaaactgaagggtctggtaaattatagcgcagagacataacagaatactgtactcattaaaaaataacaattataaacataagctattatgttggtgcaaaagtaactgtggtttcaattacttttgtgccaacctatagaaacgtaacatttatgacataac

SEQ ID NO: 55097 - DNA, 601 bp, Human
tttattctttcaactgtcagcagtataaatgactgatacaaataaaaatcaaataataaaatatagggggataatagaaatcgcttacaacactgaaccccacaaggaaaaatgaagtgaaagacaaggaacatccccaaaatgaaaatttcctctaccacttaagcttcaatttgattacaagcgtccttgataacagaatctgaggggttgagtatgaagctggtgacaagactggcatgtcttcagcacagcaaggccaaatctatgtaatatactcattaaccccaccctgagaacrcccagttggaccagataaataaataccacatagtatgatgctactaaaggaatttggtcttgactggtagtcccttctaagtttgaatcttttcctgatttctatggtatcagttaccagaatcaaatgggtgtctctcttgactaagtttcagcgtcattaaataacactggcaataagcaatgattctgataggtaggcattttaaatcagtacaattcattcagagggcaatgcctacatatcagaataataaagataagtggccaggtacggtggctcatgcctgtaattccagca

SEQ ID NO: 55098 - DNA, 601 bp, Human
gtgctgtatttttttaaggaaaaaaaaaataagaacattaggttagttccaaatattggagttctcatggatgtctacaaaaattcaagttcaaaagagaattaaacatttgtgcttacatttaacttacaagcttaagaaacaaaagattatcctctctgagagtctaatgcaaaggaaattcttttttttaattagcaaaatatccactgctacaactagacactaaaccaaactctgaagttaaatgggcagggaaacaaaataaggatgcttcattctgtttttattctttcaactstcagcagtataaatgactgatacaaataaaaatcaaataataaaatatagggggataatagaaatcgcttacaacactgaaccccacaaggaaaaatgaagtgaaagacaaggaacatccccaaaatgaaaatttcctctaccacttaagcttcaatttgattacaagcgtccttgataacagaatctgaggggttgagtatgaagctggtgacaagactggcatgtcttcagcacagcaaggccaaatctatgtaatatactcattaaccccaccctgagaacacccagttggaccaga

SEQ ID NO: 55099 - DNA, 601 bp, Human
tgccttacctgccccaaaacaggggcgcttcaaatgctcttgctgtcctttctaccacagaagcaccatgagcctatttgtccatgtatgtcccacctattcaactgttcaacggtgtattcatataataaaagctaagcttcctatttggtgtgttctctccctcacccacggggtagttgtacactaggcattaatccctagcccacagtgagacgcagggtggctgaaacccatggcggcatcatctctttatcctggcatgccacagaaatactatcatttgctatgtgtgctgaaraaaagggttaggaaacattgtattaaagatagaagaaaaagagagagaaagaatacattccttttagtcaatcactttaaattcttataaaaagtaaagtgctgtatttttttaaggaaaaaaaaaataagaacattaggttagttccaaatattggagttctcatggatgtctacaaaaattcaagttcaaaagagaattaaacatttgtgcttacatttaacttacaagcttaagaaacaaaagattatcctctctgagagtctaatgcaaaggaaattcttttttttaattagcaaa

SEQ ID NO: 55100 - DNA, 601 bp, Human
cacagttcctgtaccctcacatctttcacgtgcaaatcaagtgaactaacccaagcccatctgggcatgctgtcttctggatcctaaaacccccagaaccagggttttctgtccaggagacattcaggactcttattttcagaagaacaaattctaaatctgaaaaacttgtatttaatatgtacactgataatttttaactttaaaaacatgatagattctactctgaaaaacagcattggactgaatctgtcttccattatcctctaaggttctggagctacatgaaaacagtggagtrgggaaactcataaacctgtaactttaatatgtcacctgttcatttaacttttaatctggcttcagtgccttctgagatttggagaacagcaaaaaaaagcagaagaaagcattatatctgaattcagaaaactggctttaccattcattaggatcatgagattaagtcacttaatttctttttcgactgactcaatcattgccttacctgccccaaaacaggggcgcttcaaatgctcttgctgtcctttctaccacagaagcaccatgagcctatttgtccatgtatgtcccacctatt

SEQ ID NO: 55101 - DNA, 601 bp, Human
agaaagataaaatgaagagagcttaagagaaaataataaaaataacttactaatatatgcaaaatccttaacaagagatgaaaccaagcaacaataagtttacattctatttacaaagcattcacaatatatgatcatctaatttgctttgtagactcatccagggaagttagagggacaaacaaacaaaaaaagctattattccatttttttcaatgaggaaactgaaactctgggagattaatttaaaattccatgtgccaggcacctttccagagtcataaagccaatggctgagctracctcccacaatgaaacaaggaagactgactgctaggtacatggatctcaaggagtcatacacatttcaaggacttgatgtcacagtatcttggacaaagatacattcccctaaaacaaatgttccattcatccaaaagatggtctgcctcatgcaccacacccagtttaagcgctttttttttttttttttttgagatggagtctcgctttgtcacccaggctggagtgcagtggcgcgatatcggctcacagcaacctccgcctcccacgttcaagcaattctgctgcctcagcctcc

SEQ ID NO: 55102 - DNA, 601 bp, Human
ggaatgcaaaactcatcttgttttgccacattgtgctgcttcaatagtggtagcagaaaaatcaaatgctattgattttaccagagttaagaatacgctctcctgcctacttatcaataaggtttttgtcgcacaaacatcaacacagttctggaaaaaacaaggctaagagtttcactgctctccactagaactaaagaaagataaaatgaagagagcttaagagaaaataataaaaataacttactaatatatgcaaaatccttaacaagagatgaaaccaagcaacaataagtttacrttctatttacaaagcattcacaatatatgatcatctaatttgctttgtagactcatccagggaagttagagggacaaacaaacaaaaaaagctattattccatttttttcaatgaggaaactgaaactctgggagattaatttaaaattccatgtgccaggcacctttccagagtcataaagccaatggctgagctgacctcccacaatgaaacaaggaagactgactgctaggtacatggatctcaaggagtcatacacatttcaaggacttgatgtcacagtatcttggacaaagata

SEQ ID NO: 55103 - DNA, 601 bp, Human
caccacatccagccttcacattagctttaattcacagaagcaccctaagttttctccccacttgacaaaggctgagagaaattaaagtaagtagaaaaacaggaatgggaatgcaaaactcatcttgttttgccacattgtgctgcttcaatagtggtagcagaaaaatcaaatgctattgattttaccagagttaagaatacgctctcctgcctacttatcaataaggtttttgtcgcacaaacatcaacacagttctggaaaaaacaaggctaagagtttcactgctctccactagaaytaaagaaagataaaatgaagagagcttaagagaaaataataaaaataacttactaatatatgcaaaatccttaacaagagatgaaaccaagcaacaataagtttacattctatttacaaagcattcacaatatatgatcatctaatttgctttgtagactcatccagggaagttagagggacaaacaaacaaaaaaagctattattccatttttttcaatgaggaaactgaaactctgggagattaatttaaaattccatgtgccaggcacctttccagagtcataaagccaatggctga

SEQ ID NO: 55104 - DNA, 601 bp, Human
ggattccatttcttagcagaaatatatagaaacaagtagtaaactgaaaatctttaccttgcatgaggattactacttctttaaaccagaaagcacaaatataattttgtttgaaaatcagctgcatagaagtataatttctcaggtcaaagtgcatgcttatttcatgattatgagaactcacttatgtgatgcttcccaggcttcctcttcttctaaaagatctcttatgatgtctgaactggaactaaaaggatatgtacatcagtattgacagacaacaagaagactgtatcgtccyatttatataaaattctagaaaaaaacaaatgagtctatagtgacagaaagcaaaccagtggttaccagtaagaggaaggagggagagtgggggtgggcaaggaaagagagagccaaatgtagtttccattaggagaggaggagcaaaggccaaaggcgctgaagaacactgaggcagattttaccatctttagtattttccactagccagggaggctgagattccctgccacccctacttcaacagaagttgttctaaacccttctattcacaagaccccagctcctgctactccttacc

SEQ ID NO: 55105 - DNA, 601 bp, Human
agaaagagatccaatcatttaggaccttttaggcatattaaagagtcccttcttgaacctaaaaggaacaagaagccattcaagatttttagagcagagggatgagtaacagtgatcagatttgcattttgaaaagatcgctctagctgcattatggcaattacgtaagattataataccatgtttttactgtaccttttctaggtttagatacactaacaggtaccattgtgttacaaatgcctaactgtaaaatgctgtacaggtttgtagcctagcagcaatatgctataccctagarcccagctgtgtggtgggctataccatctaggtaagtatactctgatgttcccacaacaatgaaatcacatttctcaggacgtatccccattgttaagtgatgcatgactgtattaattgcccataagaacaatttatccatacagaaataacatctgatacataactacagttattacataggattccatttcttagcagaaatatatagaaacaagtagtaaactgaaaatctttaccttgcatgaggattactacttctttaaaccagaaagcacaaatataattttgtttgaaaatc

SEQ ID NO: 55106 - DNA, 601 bp, Human
ggctctgtggtgggagagagcttttcatgcaggaggacctaagacatctatatgatgaagcagagagaatatgaagtaaataataagagatgagtctggagaaagagatccaatcatttaggaccttttaggcatattaaagagtcccttcttgaacctaaaaggaacaagaagccattcaagatttttagagcagagggatgagtaacagtgatcagatttgcattttgaaaagatcgctctagctgcattatggcaattacgtaagattataataccatgtttttactgtaccttttcyaggtttagatacactaacaggtaccattgtgttacaaatgcctaactgtaaaatgctgtacaggtttgtagcctagcagcaatatgctataccctagaacccagctgtgtggtgggctataccatctaggtaagtatactctgatgttcccacaacaatgaaatcacatttctcaggacgtatccccattgttaagtgatgcatgactgtattaattgcccataagaacaatttatccatacagaaataacatctgatacataactacagttattacataggattccatttcttagcaga

SEQ ID NO: 55107 - DNA, 601 bp, Human
cctgtgacatgcaaactaaccaatccagagtcacaactcctctatctggccccaacaccctaaaaggcaatagccctctgccttaatcatgccagggccaggttctaggtaactagggaccactcctatagcttggagccactgaaattattcaaactagccagtcctgcactgttcaccccaccctgccttgcctttcctgagaaaaccccaatcagggttctagcctaaagcacttcccttgttcctgtcttctgcctcctgaccacgctagtgtctttcccttgtggacctgcacggkgtgccatgccctgtctctaggacctgtgagtataatgaaacaagttttcctgagcctctcctgtgtctcgtggccacactgactaatcatctcataaaagaatacaaaatgtagatagaagaccccaagaccagtctgcagaaaataagtttcctgctgcttacaaaaaccctgctttatatggagccatgtgttgctaacgaaacctctaaatcatttgtggaattaagagaatgtgtcggaactgatatggtatgttctaagactaacatctcaaatatgccacttgtggtactacaa

SEQ ID NO: 55108 - DNA, 601 bp, Human
cagcaacgggcccagccaggagtatgcctgtgacatgcaaactaaccaatccagagtcacaactcctctatctggccccaacaccctaaaaggcaatagccctctgccttaatcatgccagggccaggttctaggtaactagggaccactcctatagcttggagccactgaaattattcaaactagccagtcctgcactgttcaccccaccctgccttgcctttcctgagaaaaccccaatcagggttctagcctaaagcacttcccttgttcctgtcttctgcctcctgaccacgctagygtctttcccttgtggacctgcacggtgtgccatgccctgtctctaggacctgtgagtataatgaaacaagttttcctgagcctctcctgtgtctcgtggccacactgactaatcatctcataaaagaatacaaaatgtagatagaagaccccaagaccagtctgcagaaaataagtttcctgctgcttacaaaaaccctgctttatatggagccatgtgttgctaacgaaacctctaaatcatttgtggaattaagagaatgtgtcggaactgatatggtatgttctaagactaacatct

SEQ ID NO: 55109 - DNA, 601 bp, Human
gggatttaaaatccagtgtacttactcactagaaagggtgagagtgctgctggagcaaaatcaggggcttctgaacagagtatgaagaaaggaatgtcaactgctatctagatgaataaaggggaaagggcaatttggacagaagcagcggcgtgtgcaaaggccagaggcaaggcggtgtaactcatgaggcaactgtgagtggtgcagcttggcagcttggccaaagccacagttgtggggtagggaagtgagggaataaaattccatgagccagccaggtaggctggggccagaacaygaaaagccttggatggtggagagctactttaaagtctaagggggaaaatacctgtatgttacgtttcactggcaaaatgaactggtaacagaccaaggcagagagacagctagacagtggttgctgcaagctggaaagtaaagggcctgcaggagtaagcagtggcacaaagggattgagacagtacagaagctgccccagctatacctaggagcttgttaaaatgccaatcattaagccccttcctaaagctactgaatcagaatctctaggggtggagttcactaatctgtagtctaa

SEQ ID NO: 55110 - DNA, 601 bp, Human
ttgcagttttgttattgcttttatggagcagagaatttccaccatttttgctatcactcttatcatttttacttttttttcatgttttagtttatgttcttaaaatctctcaactttcaccatgtcaaattttttatcttaatgttttatcatctttacttatttgacttctgactctttttaaggcttaagttttagtgggatgttcctccttacttttaacttctattttatcactctctattctcataccttgtttttaataatcctttaacaattttcagtaatattttctttccawgtttcccctctttgatttgcctttatgatagctggcaacagacacagctattgaggtagtgcaagaagtcatctatacttcttccacttccttagcaggggagttcctggcaaggatctcagcggttctcccagaacaattctctaaaacacctcatcccctaagatgcaagaatcctaatagaataacccagcccacatttttttccatgcatgtaacacattgacttactggaataacacttcataagatctcacaggtacagcaggtttttaaattcttggtctccagcaggtatta

SEQ ID NO: 55111 - DNA, 601 bp, Human
ttctgacaatttttgcagttttgttattgcttttatggagcagagaatttccaccatttttgctatcactcttatcatttttacttttttttcatgttttagtttatgttcttaaaatctctcaactttcaccatgtcaaattttttatcttaatgttttatcatctttacttatttgacttctgactctttttaaggcttaagttttagtgggatgttcctccttacttttaacttctattttatcactctctattctcataccttgtttttaataatcctttaacaattttcagtaatattttctttccaagtttcccctctttgatttgcctttatgatagctggcaacagacacagctattgaggtagtgcaagaagtcatctatacttcttccacttccttagcaggggagttcctggcaaggatctcagcggttctcccagaacaattctctaaaacacctcatcccctaagatgcaagaatcctaatagaataacccagcccacatttttttccatgcatgtaacacattgacttactggaataacacttcataagatctcacaggtacagcaggtttttaaattcttggtctc

SEQ ID NO: 55112 - DNA, 601 bp, Human
gcacccctcaggatttcatgcaaatgaaattattatgacaaatttttctatagccatttctaacacagggaactcataaagaaatcaaatgtctgcacttcactgtgaaaacactaaactctcagccataatgagactccacacattatcagaaaccccaaggcataccaaaaagacaaggtcaacggagacagtctttggaaggggaggtcataaatgttgaatctggcaaatcataaatttcttgtcttaacattgccgcatttactatcatctcatttgaaagctgatgtgtttgggytgggtgatggcagaggggtgggagttgggggatgctggctctgaaatgccagagaggcattaagaactctggaagcatctggctactggtagacattttacacagatagcaatttctgaccaatccatttcaatgatttctaacccatactcaactatccagaggatactgttttaagaacattattgtaaactgatactctctattcatttacaaaattcattcattgcatactttttgtttaatagcttggattcagtgttacagatttgattgacccaagtgaaaaaatactgacac

SEQ ID NO: 55113 - DNA, 601 bp, Human
caccaacttgctttctgactactcttagctatagctgagccaggcatattgttctaggtagcatctacacattctatccctgcagaaaaccaactattgatgccattcttccctccaaatgtcctaagtttatttgtaagaataagaaagatttgcagagctgggcacagtggctcacgcctgtaatcccagcactttgggaggctggggtgggcatatcgcttgaggccaggagttcgagaccagcctgagcaacatagcaagatcccatctcttatgggagcagccagacatagtggtrcatacctgtagtcccaccgattccagaggctgaggcaggaggatctcttgggcccaggagtttgagacttcagtgagctataatcatgctactgcactccagcctgggcaacaaggtgagacctcatcttaaaaaataaataaataaataaataaaaagtttgcagagctaattttcagcatattattgtttctgtgaacctagcagccagaggctttgctggttctaaaatagtttcagaaatcaatagccttatctatctctgaccagatttaagtctgttcccttcacatgacaaag

SEQ ID NO: 55114 - DNA, 601 bp, Human
ttcctgttctggttaggaatctagctggccctggagttgttctgggaaatatctgcaaacactttccagtttgttgaatgatgagagctgttttcatgtaagctgtgtttggctttttccccctccaagtaataaaataccaaaaacttgtatttatcaaatatttctctcagcaccttacttggatattttcacattttttccatcatgtctaattagggccaaatcttgtttgcttcattttgatgtccacaaattaaatacagaaactggacactttgcccacacattttacccattytgcttgttggctgcctcagcagcatggtgacctttccccttccaggatccccaaaaatcagcatgcatagcaacaggtaccatgggaaccaactcacaggtgcccctggttatatctgattgtacaaaccttcatataaatcagtaggagatcttattttgtgaccctttctaaactatagcctatacttcctaaatttagatattcaacaaagctgtaaaatgcattagcaatccacaccttctgcatgtgtctgataacttgatatctgagccacgatgaagttcacatccctggttg

SEQ ID NO: 55115 - DNA, 601 bp, Human
ttccaggatccccaaaaatcagcatgcatagcaacaggtaccatgggaaccaactcacaggtgcccctggttatatctgattgtacaaaccttcatataaatcagtaggagatcttattttgtgaccctttctaaactatagcctatacttcctaaatttagatattcaacaaagctgtaaaatgcattagcaatccacaccttctgcatgtgtctgataacttgatatctgagccacgatgaagttcacatccctggttgttaaaatctctttgggatttaactaggcccatctacttcrggcaactaataattaatttctgttttctacacagaaaaagaggaaggttctctcttctattcagttttagtaggaaggacaagtagcaggttagccagtcactagtagccttaaaaaccttccgtagttcatggccagaggtgaaccctcactctgtttgtataaattagaccaagaaaatcattctttgtgctgttctctgaatgcatttcaacttttcatattatccatgaaatcagctgttgagagcaccaataaaagggtttatgaacatgttcataaaatataaaaatgcagtcc

SEQ ID NO: 55116 - DNA, 601 bp, Human
tagaccaagaaaatcattctttgtgctgttctctgaatgcatttcaacttttcatattatccatgaaatcagctgttgagagcaccaataaaagggtttatgaacatgttcataaaatataaaaatgcagtccaattttttgcccttcatagaaccaaagaccataaacctgatgtaaagttcatgctgcctaaaccagacaaagctttttacttacaagcattagaaagataagacgttgagttgtctaaccattgctagtaaacagttctccagatttcacgttaaaaactggaaatamtcatctggaaataaaattatccttccacaatatagtaaaaatgagtaatccatcatctttatataaacaaccctaattttaagtgagttgagggtttgaagtatttaatattcattcatttatttaacaaaagatcttaataagcacctgctgtgtgccacacagtcttctagtcctggaaacaaaacatgtacatgaacaaaatccctgccctgtggaacttacatcttagtgggaagagacagacataaagtttaaagtttataagagaaaaaaatagaaccgaataaggggaactga

SEQ ID NO: 55117 - DNA, 601 bp, Human
gctgttgagagcaccaataaaagggtttatgaacatgttcataaaatataaaaatgcagtccaattttttgcccttcatagaaccaaagaccataaacctgatgtaaagttcatgctgcctaaaccagacaaagctttttacttacaagcattagaaagataagacgttgagttgtctaaccattgctagtaaacagttctccagatttcacgttaaaaactggaaataatcatctggaaataaaattatccttccacaatatagtaaaaatgagtaatccatcatctttatataaacaamcctaattttaagtgagttgagggtttgaagtatttaatattcattcatttatttaacaaaagatcttaataagcacctgctgtgtgccacacagtcttctagtcctggaaacaaaacatgtacatgaacaaaatccctgccctgtggaacttacatcttagtgggaagagacagacataaagtttaaagtttataagagaaaaaaatagaaccgaataaggggaactgagaaaacaggtggggagtacagttttggatagagtggtcagggtctgcccagctatgaaggtgacgtttgag

SEQ ID NO: 55118 - DNA, 601 bp, Human
aggtcagggaaggcgagtctcattggtgcccttgacaagagcagtctctgtggaatggtagaggcagaaacatgactgaaatggattagaaagagaataggaagagaaaaattgttcggttgactttttagaccactctttaaaagattttgctataaagaagtgagacaggctgggcgcagtgactcatgcctgtaatcgtaacactttgggaggccgaggtgggtggatcacttgaaaccaggtgtttgaaaccagcctgggcaatgtagcagcaccccgtctctacaaaaaatacaamaattaactgggcatggtggtatgcacctgtagtcccagctacttgggaggctgaggtgggacaatggcttgagcctgggaggtcaaggctgcagtgagccaagatcacgccactgcatcccagcctgaatggcagagtgagacgctgtcaaaaaaaaaaaaaaaaaaaaaaaggaagtgagataatgagtaggtagaatttcggagtaggactaggtttgttttggttttagaatgagagaaacaacagcatgtttgcatgtggctgggaatgatcccacactgggagaattcctggctc

SEQ ID NO: 55119 - DNA, 601 bp, Human
gtagtcagctcaggaaaagaaactgagcaggaaagcagggtcaggaaaaatagagagggcaggggagaagagtgagaagagaaaaattccagcgtgggagcagtcagcagtcaggaagaccacatcagaaggaaatgaatcatgggttggaaaattcaggaaattagaacaggtgagtgtagggaatttgctccagcctgggagacagaaagaggaagtctccgtggggaaatttggatgctgagagcagattaacttcagtaagtacagttccaggcaggagctagggtcagacatagcrgccaacaagagcagatcgcatattcccaagcaccagggtgcaaaattcacgagttagattttcaatgaagcattaaaattgttaaagccagtattatacatataatatgaaatatgtgtatatatacatatttcatatgtatatatataaatgttgagctatgctcagagagctaaacaccttaattgatctagctgtatatagcttctatctggaattcctagcagagtaaattgtgtacatgtacaagagcaaagtacatatgcaggtacatcacttcctataggactctgagtaaag

SEQ ID NO: 55120 - DNA, 601 bp, Human
acccatcagttgcacctccaaactgttttctttgtgtacccacctccctcaagcccactgcggccgcccctccctaggccagagcagtcccctcctgctgatccctggcagctccttggcctccctccactctgttttctactctgcagccaaagtgatcccatctgggacaagaaggtaaaatatataggagttctgggaattaaagactatgtaaaattttaaattgctccttatcttacatttgtttgtattttttgaaacaggacctagttatactgatgaatttttaacatgacakaactatgactcacagacattcattttaggacaaagaggaaaaataaatatgaaagttttttttgtatttatgtaatttaatgttaaacagtccagactgaagctgagatctgagctttaagttctattaccccaatttaacagaatgttatggaaaggattgattagaaaaagaagagaaatggggaaaaggaagagagtaacttatgggaatatagcaacaatttacagactgaggaataatgatgaaagttttaaagagaaaaattgagaagctaaatagcaagggggctggaagaga

SEQ ID NO: 55121 - DNA, 601 bp, Human
tctgttttctactctgcagccaaagtgatcccatctgggacaagaaggtaaaatatataggagttctgggaattaaagactatgtaaaattttaaattgctccttatcttacatttgtttgtattttttgaaacaggacctagttatactgatgaatttttaacatgacagaactatgactcacagacattcattttaggacaaagaggaaaaataaatatgaaagttttttttgtatttatgtaatttaatgttaaacagtccagactgaagctgagatctgagctttaagttctattaycccaatttaacagaatgttatggaaaggattgattagaaaaagaagagaaatggggaaaaggaagagagtaacttatgggaatatagcaacaatttacagactgaggaataatgatgaaagttttaaagagaaaaattgagaagctaaatagcaagggggctggaagagaaacctgtatacaaaataaaaataatagtcataatggtcatagaaaacagtcaaaaggaatatgagaagactcaagaagcttttataaaagttgaaatgtacagtgagaccctctgcacactaggttcatt

SEQ ID NO: 55122 - DNA, 601 bp, Human
agaatgaggcgcaactgttgaggaccaaagctgcaacttcggatccctgcgctgggttgtctcagtgcctcacatcagcgccaggtcctgccctgacccattacttagcaggacaggccgagtgcccggtgggcgcggggccggcctgccccgccatcattccccacgctgttgtctgcaggtgttcttcaacggtgccaacgtccggcaggtggacgtgcccacgctgaccggagccttcggcatcctggcggcccacgtgcccacgctgcaggtcctgcggccggggctggtcgtggtscatgcagaggacggcaccacctccaaatactttggtgagtccggtggagggctgcagggccaggccaggctggggctccacatcccaggtcagtctccgtctcagttgaggctgcgagaaaaaatagttttaggccgggcacggtggctcaagcctgtaatcccagcactttgggaggccgaggcaggtggatcacctgaggtcagaagttcggagaccagcctggccaacatgatgtaaccccgtctcttctaaaaatacagaaaactggccgggtgcggtggctcccgcctgtaatcc

SEQ ID NO: 55123 - DNA, 601 bp, Human
tgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccggkccagtcacggtgctgatggttctgtcttccttccttctctcctccctccctcccttacttcctcttaacaccctgagctggacccgtctggcgcctgtgtcctccgtgccagggagagcgtggttgggggcctgcgttacggactttcactcaggcaaggccagttgtcgcagcggggcgtgcgtttgcatgggctcttggactccagttaaaatgccctggtagcgaaaccctcctgagaagggagcggcccccaatcccctaagactagccccttggctcccccagctgtccaaggag

SEQ ID NO: 55124 - DNA, 601 bp, Human
acacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccgggccagtcacggtgctgatggttctgtcttccttccttctctcytccctccctcccttacttcctcttaacaccctgagctggacccgtctggcgcctgtgtcctccgtgccagggagagcgtggttgggggcctgcgttacggactttcactcaggcaaggccagttgtcgcagcggggcgtgcgtttgcatgggctcttggactccagttaaaatgccctggtagcgaaaccctcctgagaagggagcggcccccaatcccctaagactagccccttggctcccccagctgtccaaggagcagaggcgcccagtggaatcagcctgtgtttgtttgggcccc

SEQ ID NO: 55125 - DNA, 601 bp, Human
agggatgtgacgctggaagcatccctggcccccggggctggaagccctgcccgagggggactgtgcctccctcccgaattgcatccggaagaccttacttttccaactgacttcttcaggcacggggctgccgctgggcatcccggacgcctctgcatctgtgcgcggagaagctcctacctagggcagcactggccggcctgagcctctcccagctggtgggggtggccgggggtgtccctgccttatcgcagccagacacgctgcacctgccgccgcctggcgggccctgcccaggccstgctcctttcccagccctcttaactttcaaaactttgcctcctgtttccaagaaaggaccttatctgctgggctaggcctcgagggactggcaaggacaccctgcgcagggcaccatgaccttggaaggaggtccggggaggggctgctgcggtgtctgctctcaccttcctcctgctcaggggccctggggctcctgccgtgtctgctctcacctctctcctgctcaggggctctggggctcacgtacatttttttttttttttttttgagacggagtctcgctctgttccccaggctg

SEQ ID NO: 55126 - DNA, 601 bp, Human
agcatccctggcccccggggctggaagccctgcccgagggggactgtgcctccctcccgaattgcatccggaagaccttacttttccaactgacttcttcaggcacggggctgccgctgggcatcccggacgcctctgcatctgtgcgcggagaagctcctacctagggcagcactggccggcctgagcctctcccagctggtgggggtggccgggggtgtccctgccttatcgcagccagacacgctgcacctgccgccgcctggcgggccctgcccaggccgtgctcctttcccagccytcttaactttcaaaactttgcctcctgtttccaagaaaggaccttatctgctgggctaggcctcgagggactggcaaggacaccctgcgcagggcaccatgaccttggaaggaggtccggggaggggctgctgcggtgtctgctctcaccttcctcctgctcaggggccctggggctcctgccgtgtctgctctcacctctctcctgctcaggggctctggggctcacgtacatttttttttttttttttttgagacggagtctcgctctgttccccaggctggagtgcagtggcgcgaa

SEQ ID NO: 55127 - DNA, 601 bp, Human
tctactaaaaatacaaaagttagccgagtgtggtggcgtgtgcctgtaatcccagctactcgggaggctgaggcagaacattgctggagcctgggaggcggagcttgcggtgacccgagatcgcaccattgcgctccagcctgggcgacacagcgagactctgtctcaaaaataaataaataaataaataaataaataaataaataaataaatctggcttgagttttgacaaatgtatatgcagggtcaatgggaagacagacgctggagggtggaagcctgactgtgagagtgagccccstgctttcctgaacagtcagtggaggaggtcctgggagctcaggtgagcacctgaacggtagggcagagcctgagggtcttggtggagacaggcaagaaggttgcaggaacctagtctggcccagtgcctgggagaacgggagggaacacggaggcagggaggcagaggggttggcaggacctggactggactgtgcgtcgcagctacccacagcttgaccccactgccttgaagtgagtgatgcaccctcactagtgttcagcgtccaatttcatcctggccctgagtgtgtaacggctt

SEQ ID NO: 55128 - DNA, 601 bp, Human
ccaggctgggcaagcctaggagagaagagcgaaattgtgtctcaaaaaaacaattaattaaaataaaatcagtgccataggctgtttctggtaggcagtgggttcctagggtggagcagggaagggctggaaagggtcgcctgtgcccagcccgactccccgtgcttctcgggggacagcacggctagctgctgctgcggagcccacagtggggttctgggggggggggtgcaggcagaaggccgccatgcctccctccccctttccaccccagtgagagtgggctcgaaggcagggagtstgcccgccttgtggagcctccgcagaggcacccagggctgccgtgagcgcacagcctggcggtgtcccacggccctgccctttcctgtcacttccacctgttgcaaaacactgtgctttcgtatcttttctttctacctgtttggaaatgtgaaaatcactgctgccgtaggaaacgggcccagatccgggctgtggctctcccatccgcaccgcccccgcggtgtccagccaggaggtgggaggtgggcggcactcagtgtgcctggttgcggcgatgattggcagatgcttggaccta

SEQ ID NO: 55129 - DNA, 601 bp, Human
ggtagctgggactgcagatgtgcaccaccacacccgactagttttttgtagagatggggtttcgccatgttgtccaggctggtctcaaactcctagactcaagctatccgcctgcctgggcctcccagagtgctgggattacaggtatgagccactgcttcgccacgttcacctttatttacttatttatttatttttgagacggagtctcgctctgtcccccaggctggagtgctgtggcacgatcttggctcactgcaagctccgcttcagcctcccaagtaagctggaactacaggtkcctgccaccaagcctggctaattttgtttttgtatttttagtagagacggggtttcaccgtgttagccagtatggtctcgatctcctgaccttgtgatccgcccgcctcggcctcccaaagtcctgggattacaggcttgagtcactgtgcccggcccacctttttattttttattttatagagacaagggcttgctgtgttgcccaggctggtcttgaacccctgaccttaagtaatcctctctggcctcccaaagtgctgggattacaggtgtaagccatagtactgggcctaaagtt

SEQ ID NO: 55130 - DNA, 601 bp, Human
ttgagtcactgtgcccggcccacctttttattttttattttatagagacaagggcttgctgtgttgcccaggctggtcttgaacccctgaccttaagtaatcctctctggcctcccaaagtgctgggattacaggtgtaagccatagtactgggcctaaagttcaccttttttttttttttttttttttttgagatggagtctcgctctgtcacccaggctggagtgcagtggcgtgatcttggctcactgcaagctctgcctcccgggttcacaccattctcctgcctcagcctcccgartagctgggactacaggcgcctgccaccatgcccggctaatttttttgtatttttagtagagatggggtttcactgtgttagccaggatggtctcgatctcctgacctcgtgatctgcctgcctcggcctcccaaagtgctggggttacaggtgtgagccaccgcacccggcaaagttcacctttttaaagtgtgtaattcagtggcatatagtacattgacagagttgcacaactatcacctctatcagcttccagaacattcttgttaccccagaaggaaaccccgtctctgtcagcca

SEQ ID NO: 55131 - DNA, 601 bp, Human
tgcaagaggcagccctgagctgggggtggggaaggctgggtcgtgggatacccctgacaccccaagttttttttttgagatggagtcttgctctgtcacccaggctggagtgcagtggtgagatctcgactctctgcaacctccgcctcccaggttcaagcgattctcctgcctcagcctcctgagtagctgggattacaggcgcccatcaccacgcccggctaatttttgtatttttagtagagacaaggtttcaccatgttggccaggctggtttcgaactcctgacctcaggtgatctacctcggcctcccatagtgtcgggattacaggcgtgagtcaccgcgcctggccccccagctgttttttatgctccatgcttgggcttcctgttaagaattaaaaaagaaaaaaaaaactatggagatggaatttacatactgtacaactcattcgttcacagtgtacaattcagtggcattaagtacattcacacggctgtgcaaccactacttctaattccagaacgttcggtcaccccaaaagcaagccccattcccattgtgtcactctccatcccctccaccagctcctggccact

SEQ ID NO: 55132 - DNA, 601 bp, Human
ggcctggcgacagagtgagactccgtctccaaaaaaaaaaaaacaagaaatgggatcctgtcatcccagcgttttccgaggccgaggtgggcagatgacttgagcctagtagttcaaacgagaccagcctgggcagcacggtgaaactgtctctactaaaatacaaaaattagctgggcatggtagcacacgtctgtagtcccagctacttgcggggctgagatgggaggatcgcttgagcctgggaggtgcactccagcctgggcgacagggaaaccctgtctcaaaaaaaaaaaaaaaagtgcatcacacactgtgtgtcctttagtgtctcactgtgacatcctcaaggtgcagctaggctgtggctcgagtcagagcctcactggtttttgtggctgagtcttgttgagtgcgtggatgggctgtgctgatcctcgtctgtggaagggcccctgggtggttccacatctcggctgctgtgcgtcctgctgctgtgagcatctcgtgctccgtttctgcgtggcgtgtactgttcctcagggtgtgtacctgggagtggagctgctggctcacagggtaacagacctttggagaagct

SEQ ID NO: 55133 - DNA, 601 bp, Human
ggatcacaaggtcaggagatcgagaccatcctggccaacatggtgaaaccctgtctgtactaaaatacaaaaaaattagccggctgtggtgacacgtgcctgtagtcccagctactcgggaggctgaggcagggaaatcacttgaacctgggaggcagaggttgcagtgagctgagatcgggccaccgtgctccagcctagggacagagcaagactctgtctcagaaaaaaaaaaaagtgtcctaactgtgtcctccaaagccctcgccggccgatgacagactagagggcgctgtgctcycaccccctaccgccctgagcctggacgcgtggcccctgcagggccctttcccacagcactgtgaactcacagcttctctctagggaagggaggaggtacgccacttccacagggagatggggaggccgactccagggatccaggccatcatcctgacgttgggtcggctgatacacccctgtcctctctgtcccagggaaattcaactactgaggaggttacggcacaaaaatgtcatccagctggtggatgtgttatacaacgaagagaagcagaaaatatatcctttccggtgttggg

SEQ ID NO: 55134 - DNA, 601 bp, Human
cccctaccgccctgagcctggacgcgtggcccctgcagggccctttcccacagcactgtgaactcacagcttctctctagggaagggaggaggtacgccacttccacagggagatggggaggccgactccagggatccaggccatcatcctgacgttgggtcggctgatacacccctgtcctctctgtcccagggaaattcaactactgaggaggttacggcacaaaaatgtcatccagctggtggatgtgttatacaacgaagagaagcagaaaatatatcctttccggtgttgggacckcggggcctccgtgggaggggctggggccctgggtccgcctgcctcgaggcctgctcctcttcccgtctccttgaaggagactggcacacgagggccgtggccttccctggttccccggaagtcagccattgtggcaatggctgcgcagcttgctgaaaggggccctgagccctggcccctgtgtcttgggcccgtggggtgtcaagtcccttttttctcagagtctcctcccaggctaaccaggggtgtagccacggtctgcctgagacaggccacgcgggctgaccgttgtgggccatt

SEQ ID NO: 55135 - DNA, 601 bp, Human
cgtggctgggcgtgtcctcgtgtcatctgtggacacccccatgggtcttacgggcacagcctccctacggggactttgcttcctaaggccctgtgcccagagcaagagccagaagtggtcctgaggctggggctgtgttccctgagccacgcggtcaggggccctgggaccgtcctgcatgggcccgagcctgcttgggggggcgtccaggaggcaccatcccccgcccatgggcagggtgggggacgtgagccccgcaggaacgctgccccaagagtcagccctgtcctccccttccccrtaggctccttcctcctgggacgctggggcccctgggccttttcagaggggtggctgagggcagggtgggccctggtcccgaggaggggcaaggtgggtgcagagggtccctccagagccccttttctggcccccgtgctccctgggcctgtgagtggggccgccccctgagctgtgtgtccttagcgccccacgtatatggtgatggagtactgcgtgtgtggcatgcaggaaatgctggacagcgtgccggagaagcgtttcccagtgtgccaggcccacgggtgcgtgcgcggggcag

SEQ ID NO: 55136 - DNA, 601 bp, Human
gccacgcggtcaggggccctgggaccgtcctgcatgggcccgagcctgcttgggggggcgtccaggaggcaccatcccccgcccatgggcagggtgggggacgtgagccccgcaggaacgctgccccaagagtcagccctgtcctccccttccccgtaggctccttcctcctgggacgctggggcccctgggccttttcagaggggtggctgagggcagggtgggccctggtcccgaggaggggcaaggtgggtgcagagggtccctccagagccccttttctggcccccgtgctccctgrgcctgtgagtggggccgccccctgagctgtgtgtccttagcgccccacgtatatggtgatggagtactgcgtgtgtggcatgcaggaaatgctggacagcgtgccggagaagcgtttcccagtgtgccaggcccacgggtgcgtgcgcggggcaggggccagggtggggcgggggccgggggccaggcagggcaggctcctttccgtgaggccacactgcttgtcctgatattcattgacatgaaggcccaagtttttttgtttttttgtttttttgtgttttttttcgagatggagtct

SEQ ID NO: 55137 - DNA, 601 bp, Human
ttctggcccccgtgctccctgggcctgtgagtggggccgccccctgagctgtgtgtccttagcgccccacgtatatggtgatggagtactgcgtgtgtggcatgcaggaaatgctggacagcgtgccggagaagcgtttcccagtgtgccaggcccacgggtgcgtgcgcggggcaggggccagggtggggcgggggccgggggccaggcagggcaggctcctttccgtgaggccacactgcttgtcctgatattcattgacatgaaggcccaagtttttttgtttttttgtttttttgtkttttttttcgagatggagtctcactctgtcgcccaggctggagtgcaatggtgcgatctcggctcactgcaagctccgcctccgaggttcacgccattcttctgcctcagcttcccgagtagctgggattacaggcgcccgccaccacgcccggctaattttttgtatttttagtagagacggggtttcaccgtgttagccaggatggtctcaaactcctgacctcgtgatccgcctgcctcagcctcccaaagtgctgggattacaggcatgagctaccacgcccggccttgtaaaggc

SEQ ID NO: 55138 - DNA, 601 bp, Human
tttcccagtgtgccaggcccacgggtgcgtgcgcggggcaggggccagggtggggcgggggccgggggccaggcagggcaggctcctttccgtgaggccacactgcttgtcctgatattcattgacatgaaggcccaagtttttttgtttttttgtttttttgtgttttttttcgagatggagtctcactctgtcgcccaggctggagtgcaatggtgcgatctcggctcactgcaagctccgcctccgaggttcacgccattcttctgcctcagcttcccgagtagctgggattacaggygcccgccaccacgcccggctaattttttgtatttttagtagagacggggtttcaccgtgttagccaggatggtctcaaactcctgacctcgtgatccgcctgcctcagcctcccaaagtgctgggattacaggcatgagctaccacgcccggccttgtaaaggcccaagtttttaaaaacagttttggggtcccccatgtgtggcatccacaggcagggctgctgccaacctcccgcctccatctttgctgggcctgctgcctgaggccagtggcctgcttccagcccatcgctggcagc

SEQ ID NO: 55139 - DNA, 601 bp, Human
caggcccacgggtgcgtgcgcggggcaggggccagggtggggcgggggccgggggccaggcagggcaggctcctttccgtgaggccacactgcttgtcctgatattcattgacatgaaggcccaagtttttttgtttttttgtttttttgtgttttttttcgagatggagtctcactctgtcgcccaggctggagtgcaatggtgcgatctcggctcactgcaagctccgcctccgaggttcacgccattcttctgcctcagcttcccgagtagctgggattacaggcgcccgccaccacrcccggctaattttttgtatttttagtagagacggggtttcaccgtgttagccaggatggtctcaaactcctgacctcgtgatccgcctgcctcagcctcccaaagtgctgggattacaggcatgagctaccacgcccggccttgtaaaggcccaagtttttaaaaacagttttggggtcccccatgtgtggcatccacaggcagggctgctgccaacctcccgcctccatctttgctgggcctgctgcctgaggccagtggcctgcttccagcccatcgctggcagccgcctgccctgac

SEQ ID NO: 55140 - DNA, 601 bp, Human
ccggctaattttttgtatttttagtagagacggggtttcaccgtgttagccaggatggtctcaaactcctgacctcgtgatccgcctgcctcagcctcccaaagtgctgggattacaggcatgagctaccacgcccggccttgtaaaggcccaagtttttaaaaacagttttggggtcccccatgtgtggcatccacaggcagggctgctgccaacctcccgcctccatctttgctgggcctgctgcctgaggccagtggcctgcttccagcccatcgctggcagccgcctgccctgaccrgatctcctggatgcaggtctgtggcctcagagtcagggccccttgctgctgcaggaccacaggggcagggaggggcctgctgttccagcaagactttggggtgcagccggcctgtggcccacaggaaaatgagacctgtggacatccggggccctgccagacgtggctcggccggacgagggtggccactgcaggcgcaggtgtggctccctgctggacctagcctttcctctgtcctgtgtgcctggacttctgtgacttcccagctgggcctgtggtgtttgggaggctcccaggcag

SEQ ID NO: 55141 - DNA, 601 bp, Human
aggggacaacatctacaagttgtttgagaacatcgggaaggggagctacgccatcccgggcgactgtggccccccgctctctgacctgctgaaaggtgggagcctcatccctctgcccgcagccccagggaggcggggcttttgtgcagaaatgtagggttgggggtgtcaggtggggggctattggccccgagaccccagcaggcattgagaggactgagtggagaggccgacctccccgcagggcctggtttgccaggtccctcagctccaccctgcttctgggccctgttcaccctcygaactcccaccccagagggcagtgctgccctgcgcctcccccagccccaccctcgggggctccctggcttgcagggtctgtcagggttgtcctgctgcacttcctacgcatggcagcaggtggcactggccgtccgtccatctgcccagtggccttgggagaacggaaccgccctggccgtccagcccagccctgtctccctgccagccgcgcacaggctgtccccggcatgtcccaggagtggagtggcctctgtcagggagaccgcctgtgcgcggggtcccccttaggagcgtccag

SEQ ID NO: 55142 - DNA, 601 bp, Human
gtgtggctgggatccagcccagggcccccagctccatgacagggaagacagagcagcggacggggtcagcaggccccacagtgccgcctccctcacttcgtgggctctgctcctctgcaccagcccctggaggcccttgagccgtctgctggagcccctccgagccccgaggccacccactgagaccggctctgggagtgggagtgtccggacccctgaggcgctggtgctgattgtgccttgggggtctctgcacagctcgggtcatctgggcgcctggcggggactggggctgccccccgatagcctcctgggctgggatgtgctcagggccccccagacccccttctggcctttgctggctttgcagccagcatccatctggtgggtgctggcttctgagtgccacctgggacacaggcctcagggtggaggggacatctgtcaggcttggagtcaggtcagcctgcctgctcctagaggacatggctgagcttctgtggtcacagccaccccttgcacggcctggtcccagctcctgagtgtgtggcaggtaccctgggcccagaggagctgggtcggaaaactggaccgccctggt

SEQ ID NO: 55143 - DNA, 601 bp, Human
caggaggatgcagcatgtgggggccccccaggagggtacagcgtgtgtggggcccccaggatcacagggtctcagctcctgggctcttggatttgcagcaccacgaccatcgcgtctggtctgttggaacgggaggtgctgctgggtaccctggtcactagggtgtgctgggaggtgggggcccctcatggtgcccatccttggggcctggctgcaatttgaccccaggcccagggtcttctgcctttcagagccctggtgccctgagacgggcagccaggcaaatcccaggcaggagggycagttagggcagggccagcccaggcaggttgcgagagtccctactgggacgtggaccacacgctgacccccacggccgcccctgcaggccaggatccctgagccaggacccggcactggcttccctcctggggaccctcaggcctgtgtgagacctgggctgccctggggtgaggtgcctgggaggagagcaggggctgggccacctttttcatgaccctgctaagcccactgtgggtggtgaggaggagtacccagcagggggaagggccgccagaccactcggcatggctgaggcctc

SEQ ID NO: 55144 - DNA, 601 bp, Human
ctggcttccctcctggggaccctcaggcctgtgtgagacctgggctgccctggggtgaggtgcctgggaggagagcaggggctgggccacctttttcatgaccctgctaagcccactgtgggtggtgaggaggagtacccagcagggggaagggccgccagaccactcggcatggctgaggcctcagtactcagtactgggtactcaggtggacgcccctcccactgctcagatgctggggacaggctcaacttcaggcttcagcgtgagccccgtccctgacctgcagagcccccttgcrttggggcaggacagcccggcgccctcgggtcaggccatcctctgcgctctgccggggctgctgcatcggcctctgcgtgcctccactttggcctcacgtgtccctacccaggatgcgggtcctgctgccaacacccagatcccagggaaggggcttgggctagatcctgggcaccagtgcagacaggagtgtggggtggggcaagggcccagtggcggctgtgcccgctgatgcagagctggggcaccttgtccacagggtctgccccaccagagacgggctgggcccaagctcagacct

SEQ ID NO: 55145 - DNA, 601 bp, Human
tggcttccctcctggggaccctcaggcctgtgtgagacctgggctgccctggggtgaggtgcctgggaggagagcaggggctgggccacctttttcatgaccctgctaagcccactgtgggtggtgaggaggagtacccagcagggggaagggccgccagaccactcggcatggctgaggcctcagtactcagtactgggtactcaggtggacgcccctcccactgctcagatgctggggacaggctcaacttcaggcttcagcgtgagccccgtccctgacctgcagagcccccttgcgytggggcaggacagcccggcgccctcgggtcaggccatcctctgcgctctgccggggctgctgcatcggcctctgcgtgcctccactttggcctcacgtgtccctacccaggatgcgggtcctgctgccaacacccagatcccagggaaggggcttgggctagatcctgggcaccagtgcagacaggagtgtggggtggggcaagggcccagtggcggctgtgcccgctgatgcagagctggggcaccttgtccacagggtctgccccaccagagacgggctgggcccaagctcagaccta

SEQ ID NO: 55146 - DNA, 601 bp, Human
ttcatgaccctgctaagcccactgtgggtggtgaggaggagtacccagcagggggaagggccgccagaccactcggcatggctgaggcctcagtactcagtactgggtactcaggtggacgcccctcccactgctcagatgctggggacaggctcaacttcaggcttcagcgtgagccccgtccctgacctgcagagcccccttgcgttggggcaggacagcccggcgccctcgggtcaggccatcctctgcgctctgccggggctgctgcatcggcctctgcgtgcctccactttggccycacgtgtccctacccaggatgcgggtcctgctgccaacacccagatcccagggaaggggcttgggctagatcctgggcaccagtgcagacaggagtgtggggtggggcaagggcccagtggcggctgtgcccgctgatgcagagctggggcaccttgtccacagggtctgccccaccagagacgggctgggcccaagctcagacctatgggtgcaattggtgcctcctcaccaaggtcttttttatctttttttttttttggagacagagtcttgctctgtcgcccaggctggagtgctg

SEQ ID NO: 55147 - DNA, 601 bp, Human
ctggggacaggctcaacttcaggcttcagcgtgagccccgtccctgacctgcagagcccccttgcgttggggcaggacagcccggcgccctcgggtcaggccatcctctgcgctctgccggggctgctgcatcggcctctgcgtgcctccactttggcctcacgtgtccctacccaggatgcgggtcctgctgccaacacccagatcccagggaaggggcttgggctagatcctgggcaccagtgcagacaggagtgtggggtggggcaagggcccagtggcggctgtgcccgctgatgcrgagctggggcaccttgtccacagggtctgccccaccagagacgggctgggcccaagctcagacctatgggtgcaattggtgcctcctcaccaaggtcttttttatctttttttttttttggagacagagtcttgctctgtcgcccaggctggagtgctgtggtgcgatctcggctcactgcaacctccacctcccggattcaagcaattctgcctcagcctcctgagtagctgggattacaagtgcgcgccagcatgcccggctaatttttgtatgtttagtagagacgggggtttcacc

SEQ ID NO: 55148 - DNA, 601 bp, Human
cccggggcggcctcccactgacttcgcccgggaggggcctcggggatggctcggcagccagtgtgttcgcggagtcctcgccaaccaccacggctcctcgcagggacagtacgtgggcagcttcctgcactttcccctgccattgtgagaacagtgtccacctgggcagggtgggcagccccaggcctgtgggtttcaccagggtgctggtgatggttggtggctagcagggactgggggcagctgggggccctggcaggctgagctctgctccccgcgtggttctgtgctggcatttcgmgtgcctggcctgagcctggcccgagcctggccctcctgtgtcctcacagatgagcatgtggcggctcctgggcctctagaaccaaccatgggccagggtgccccaggggagcacgggagggtcctgccttgtcagcttgcctcctactcgtgaggttcctgcagtcagtacctgggtggggtcccacctgcggccatggcaggtgcaacagacgtggtggaggggacactcctgcccaggccatctgcgggaggctcagccccggggggtgcctcccagagctgctggggggcagcattt

SEQ ID NO: 55149 - DNA, 601 bp, Human
ttttgacaccaatgagcagtcgctggagcaggtcttctcaaagtacggacagatctctgaaggtgaggctgctgctgggcccgcggccctgggcgggggggcttgtgctcctcctacctggaagtacagctgggtgctgactgcagacctctctcccctgcacagtggtggttgtgaaagacagggagacccagagatctcggggatttgggtttgtcacctttgagaacattgacgacgctaaggatgccatgatggccatgaatgggaaggtgaggatcagggtgctgagcaggagtcycgtctcgaggatggggcacccacctgctaacccgtcccgccctctgtctccagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggtgagtgccatgagtgggtcccttggggatgctgtgaggtactgctggtgggagctggtacttactttttcctgtatgtgcaggaggaggggaccgaggctatggggg

SEQ ID NO: 55150 - DNA, 601 bp, Human; identical to SEQ ID NO: 24048

SEQ ID NO: 55151 - DNA, 601 bp, Human; identical to SEQ ID NO: 24049

SEQ ID NO: 55152 - DNA, 601 bp, Human; identical to SEQ ID NO: 29854

SEQ ID NO: 55153 - DNA, 601 bp, Human; identical to SEQ ID NO: 29855

SEQ ID NO: 55154 - DNA, 601 bp, Human; identical to SEQ ID NO: 29856

SEQ ID NO: 55155 - DNA, 601 bp, Human; identical to SEQ ID NO: 29857

SEQ ID NO: 55156 - DNA, 601 bp, Human; identical to SEQ ID NO: 29858

SEQ ID NO: 55157 - DNA, 601 bp, Human; identical to SEQ ID NO: 29859

SEQ ID NO: 55158 - DNA, 601 bp, Human; identical to SEQ ID NO: 29860

SEQ ID NO: 55159 - DNA, 601 bp, Human; identical to SEQ ID NO: 29861

SEQ ID NO: 55160 - DNA, 601 bp, Human; identical to SEQ ID NO: 29862

SEQ ID NO: 55161 - DNA, 601 bp, Human; identical to SEQ ID NO: 29863

SEQ ID NO: 55162 - DNA, 601 bp, Human; identical to SEQ ID NO: 29864

SEQ ID NO: 55163 - DNA, 601 bp, Human; identical to SEQ ID NO: 29865

SEQ ID NO: 55164 - DNA, 601 bp, Human; identical to SEQ ID NO: 29866

SEQ ID NO: 55165 - DNA, 601 bp, Human; identical to SEQ ID NO: 29867

SEQ ID NO: 55166 - DNA, 601 bp, Human; identical to SEQ ID NO: 29868

SEQ ID NO: 55167 - DNA, 601 bp, Human; identical to SEQ ID NO: 29869

SEQ ID NO: 55168 - DNA, 601 bp, Human; identical to SEQ ID NO: 29870

SEQ ID NO: 55169 - DNA, 601 bp, Human; identical to SEQ ID NO: 29871

SEQ ID NO: 55170 - DNA, 601 bp, Human; identical to SEQ ID NO: 29872

SEQ ID NO: 55171 - DNA, 601 bp, Human; identical to SEQ ID NO: 29873

SEQ ID NO: 55172 - DNA, 601 bp, Human; identical to SEQ ID NO: 25850

SEQ ID NO: 55173 - DNA, 601 bp, Human; identical to SEQ ID NO: 25851

SEQ ID NO: 55174 - DNA, 601 bp, Human; identical to SEQ ID NO: 25852

SEQ ID NO: 55175 - DNA, 601 bp, Human; identical to SEQ ID NO: 25853

SEQ ID NO: 55176 - DNA, 601 bp, Human; identical to SEQ ID NO: 38959

SEQ ID NO: 55177 - DNA, 601 bp, Human; identical to SEQ ID NO: 38960

SEQ ID NO: 55178 - DNA, 601 bp, Human; identical to SEQ ID NO: 38961

SEQ ID NO: 55179 - DNA, 601 bp, Human; identical to SEQ ID NO: 38962

SEQ ID NO: 55180 - DNA, 601 bp, Human; identical to SEQ ID NO: 38963

SEQ ID NO: 55181 - DNA, 601 bp, Human; identical to SEQ ID NO: 38964

SEQ ID NO: 55182 - DNA, 601 bp, Human; identical to SEQ ID NO: 38965

SEQ ID NO: 55183 - DNA, 601 bp, Human; identical to SEQ ID NO: 38966

SEQ ID NO: 55184 - DNA, 601 bp, Human; identical to SEQ ID NO: 38967

SEQ ID NO: 55185 - DNA, 601 bp, Human; identical to SEQ ID NO: 38968

SEQ ID NO: 55186 - DNA, 601 bp, Human; identical to SEQ ID NO: 38969

SEQ ID NO: 55187 - DNA, 601 bp, Human
aggcccccttgttttgaaccaggtccgggccaggcacaacgtgggggacaggagaagcccccgttggtcagagcaaaaaaagtttgccggggcctggccatggcctggacgtgggtagaaccctctgaaccatcccagggtctccaagacaggagcaggctgcagcttccctgggggtcccgtgggagccggggctttgggggtcctggggctcgggagggagtcagccccagcactcagggtgtcaccgtcttcctaaggcacacggagctgcacatcgggggctgaggcggcccccccmcactcttctgctactggtcactttctctccgttttccagccgcttcctgtgccgaccgagccgccctctggagcccgccacccctccttgtcccctctgtctcctgctgtcctcggtccccgggaggaaagttgcatgaaggggtctctttgaggcgggctcggggacaagggcggcccgtgttccgccgtgggggtggggaacacgcacaggcccaccccccaccctggtcaacggcctcgggtcgggccctgggggctgagggcagggaccccgggccgctgggggacggctggccca

SEQ ID NO: 55188 - DNA, 601 bp, Human
ggcccccttgttttgaaccaggtccgggccaggcacaacgtgggggacaggagaagcccccgttggtcagagcaaaaaaagtttgccggggcctggccatggcctggacgtgggtagaaccctctgaaccatcccagggtctccaagacaggagcaggctgcagcttccctgggggtcccgtgggagccggggctttgggggtcctggggctcgggagggagtcagccccagcactcagggtgtcaccgtcttcctaaggcacacggagctgcacatcgggggctgaggcggccccccccsactcttctgctactggtcactttctctccgttttccagccgcttcctgtgccgaccgagccgccctctggagcccgccacccctccttgtcccctctgtctcctgctgtcctcggtccccgggaggaaagttgcatgaaggggtctctttgaggcgggctcggggacaagggcggcccgtgttccgccgtgggggtggggaacacgcacaggcccaccccccaccctggtcaacggcctcgggtcgggccctgggggctgagggcagggaccccgggccgctgggggacggctggcccac

SEQ ID NO: 55189 - DNA, 601 bp, Human
gacagccgcgatggggggcagacagcagcgtgggcaccaggggaccgtgtgctcgatggggcctgcaggcccgggcagtgccgcagcgtcgccggccgccccttccgcccattggcctggcacctgtgcccaggcgatgactgtgtggtctgtctccacatcacaccctctctgctgtgagaggcgatgcctgcacccaggggaccccgcacccacctccttgggccgctataaggtggggccccgttgggtggtctggctggccggccccgccactcccaccggtgactgcacagcgtcygtccaacccactccccaacctgggctgggtacccctgagctggccgccaggagtctctgggcctgttcccagccgacccgcatcgggctggggcgtccagggcttggacctggccggctgccctcacctgtcctgttggacctggccagctgccctcacctgtcctggccacaacaccgcgtgtgcattcccacggctgctcatgtgtgtttgcgtgcagcggtggggaagggtggcgtgcaggtgtgcctggagtcgcatccggctgcaggttacatgtgtctgtgtgtggcaggaggc

SEQ ID NO: 55190 - DNA, 601 bp, Human
tctgtctccacatcacaccctctctgctgtgagaggcgatgcctgcacccaggggaccccgcacccacctccttgggccgctataaggtggggccccgttgggtggtctggctggccggccccgccactcccaccggtgactgcacagcgtccgtccaacccactccccaacctgggctgggtacccctgagctggccgccaggagtctctgggcctgttcccagccgacccgcatcgggctggggcgtccagggcttggacctggccggctgccctcacctgtcctgttggacctggccrgctgccctcacctgtcctggccacaacaccgcgtgtgcattcccacggctgctcatgtgtgtttgcgtgcagcggtggggaagggtggcgtgcaggtgtgcctggagtcgcatccggctgcaggttacatgtgtctgtgtgtggcaggaggctgcgtgaatccacagggcacagctctggcgtgtttgcacatgtgtctgcgtgattgcatatgaggtgcatgtgtgtgcatgagtgtgtctgtgcgtggcacccgcgtttgcatgtgcgtgcccttgcacgggatgtctgcagtgtccg

SEQ ID NO: 55191 - DNA, 601 bp, Human
gtgcccttgcacgggatgtctgcagtgtccgaggtccctgtgcgtgtctgcctgtggcatgcatgcgttttgtctgtgcgtggagtgcaggtgtgtgtgcgtgtctgcgtgtggggtgcatgtaagtgtgtctccctgggggcagtgctggctggctgagggcctgcaatgtgggggcagtggtggccccagcacggtccacaatggcaaccccgctgttggccctccctctcctcctcccctggggacgggaccagggcccgtgtgcagacggccatcaagcctcagagcagggtggacrcaggggcctgtggtccccgggagtccccaccttctgattggaaatctgcagccttgggggcactgggtgggcgcttgcccacactgggcatctctgggcttcggccaccctcccggggttccccacggacccagtggccctcgggtgtgggcagcagccgggttcccctcaaacactggatggaaaatggtgacctatgcaagggctcactccccgagggaggagccgtcccccagcagagggcagaggtgaacggggtgtctcgctccccgtggctccgctggcgtccctcggcctctc

SEQ ID NO: 55192 - DNA, 601 bp, Human
tgtggcatgcatgcgttttgtctgtgcgtggagtgcaggtgtgtgtgcgtgtctgcgtgtggggtgcatgtaagtgtgtctccctgggggcagtgctggctggctgagggcctgcaatgtgggggcagtggtggccccagcacggtccacaatggcaaccccgctgttggccctccctctcctcctcccctggggacgggaccagggcccgtgtgcagacggccatcaagcctcagagcagggtggacgcaggggcctgtggtccccgggagtccccaccttctgattggaaatctgcagmcttgggggcactgggtgggcgcttgcccacactgggcatctctgggcttcggccaccctcccggggttccccacggacccagtggccctcgggtgtgggcagcagccgggttcccctcaaacactggatggaaaatggtgacctatgcaagggctcactccccgagggaggagccgtcccccagcagagggcagaggtgaacggggtgtctcgctccccgtggctccgctggcgtccctcggcctctcggggagccggctttgaagggggtgatgccgtgttctgctgcataagggtttt

SEQ ID NO: 55193 - DNA, 601 bp, Human
ggcattgggggcgctaggagagccgggcggtgggcctgggggattcggggcctgagggtggggtcctggaggccgtggggtacctggactcagactcgggagtctgggagacctgggcatgacgtcaggcaggtggcttagcagcctggaacccccaggcctgctctgcgaagtgggggtgacggagccctgcggtgggtgcggctcggccgatagggcctggtgtggatgggcaaaggcctgagggtggtcccaggggttagtgtcccctccccagaagggaaaccgaggcagctcctgyggtggggaggatgcttctgccgaggcaccatggtctctgtgtctcacggtctctttgggtctctgtcttccccatctctgggcatcctggggtgccatgggtggcccaggccttccgcctccactgcaggcctccctgggcggcctcagtttgcagagaagggaacagaggttccgtggcggggggccgtgaacgcagtgggatttgaccttcccccgtctctgggctgacgtctccgcaggtctgcaggggactggccctacgtgggtccctcggggtcacggcggaggcagtgggttg

SEQ ID NO: 55194 - DNA, 601 bp, Human
ttccccatctctgggcatcctggggtgccatgggtggcccaggccttccgcctccactgcaggcctccctgggcggcctcagtttgcagagaagggaacagaggttccgtggcggggggccgtgaacgcagtgggatttgaccttcccccgtctctgggctgacgtctccgcaggtctgcaggggactggccctacgtgggtccctcggggtcacggcggaggcagtgggttgtgcattcatgggggtccgggtggtagcgtttctgtggagccggtggtctccttgtcatccatgagggkcctgccccggtggccgtgtgttccccgggacacggcttctctcctccccaggaaccgggatgcagccaggccttgcccctcagtcctgtgtgtgggaccagcctctcctgcagatgggtcctcagggagagctgggctttgtaccttgctgggggaagggctgagctgctcccgtccctgtgcccaccgtcccgtcgccccagacacgcggctggagcctgcggaggagcagacgagccggcggggtttttgctttaacctcaagcaggcgtttgaactctgtggccgagtcggtcctgg

SEQ ID NO: 55195 - DNA, 601 bp, Human
tctgggcatcctggggtgccatgggtggcccaggccttccgcctccactgcaggcctccctgggcggcctcagtttgcagagaagggaacagaggttccgtggcggggggccgtgaacgcagtgggatttgaccttcccccgtctctgggctgacgtctccgcaggtctgcaggggactggccctacgtgggtccctcggggtcacggcggaggcagtgggttgtgcattcatgggggtccgggtggtagcgtttctgtggagccggtggtctccttgtcatccatgagggtcctgccccrgtggccgtgtgttccccgggacacggcttctctcctccccaggaaccgggatgcagccaggccttgcccctcagtcctgtgtgtgggaccagcctctcctgcagatgggtcctcagggagagctgggctttgtaccttgctgggggaagggctgagctgctcccgtccctgtgcccaccgtcccgtcgccccagacacgcggctggagcctgcggaggagcagacgagccggcggggtttttgctttaacctcaagcaggcgtttgaactctgtggccgagtcggtcctggtggggggct

SEQ ID NO: 55196 - DNA, 601 bp, Human
tttcccttcaggtcccacccaggtcctgagcaggaggaaaagctccagtcctcagtcaggggggacatctcttccgtccctggaaaagccaggtgtgggtgctgtcaccccagcaggtcttgctgggggtggcaggaggggacgggcggcctcagccccacgctgggcttcaggacccgggctgcctgctcatccggccagcctgggcctccccgggagcttctccaccctggaagagagatgcagacgggtgcaggcgtccacctgcccacccacggggtcctggctgccggccacaccrctgcctcagtttccagtcctggaaggcagcccagcccacccccaccccagttttgggtgagattcctaattagtcgcttagctattagcgtctaataacttgacaattgcccgattggagctaattagctccaggccgcttgctggaagcgggtgacagccaggaggcccgggtgggcaggaggggagccctgctgggtgaggctctgcctggggcctggagggctgcctggaggcgtggactttggcacccgcaggttgagtgagtgtggggggaaggtgtggcccggcagagggaacc

SEQ ID NO: 55197 - DNA, 601 bp, Human
tcagccccacgctgggcttcaggacccgggctgcctgctcatccggccagcctgggcctccccgggagcttctccaccctggaagagagatgcagacgggtgcaggcgtccacctgcccacccacggggtcctggctgccggccacaccgctgcctcagtttccagtcctggaaggcagcccagcccacccccaccccagttttgggtgagattcctaattagtcgcttagctattagcgtctaataacttgacaattgcccgattggagctaattagctccaggccgcttgctggaagckggtgacagccaggaggcccgggtgggcaggaggggagccctgctgggtgaggctctgcctggggcctggagggctgcctggaggcgtggactttggcacccgcaggttgagtgagtgtggggggaaggtgtggcccggcagagggaacccggaggagtaaaagctgccaccgctgctctgtctgggaaaaatcccaaatcagtcattaaccccttagtgagaatttcagtctctctgccgctccggggaggatttgcatatcgaggcttcatcactaatggaggaagcgaaggctttgtc

SEQ ID NO: 55198 - DNA, 601 bp, Human
tgggcctccccgggagcttctccaccctggaagagagatgcagacgggtgcaggcgtccacctgcccacccacggggtcctggctgccggccacaccgctgcctcagtttccagtcctggaaggcagcccagcccacccccaccccagttttgggtgagattcctaattagtcgcttagctattagcgtctaataacttgacaattgcccgattggagctaattagctccaggccgcttgctggaagcgggtgacagccaggaggcccgggtgggcaggaggggagccctgctgggtgagsctctgcctggggcctggagggctgcctggaggcgtggactttggcacccgcaggttgagtgagtgtggggggaaggtgtggcccggcagagggaacccggaggagtaaaagctgccaccgctgctctgtctgggaaaaatcccaaatcagtcattaaccccttagtgagaatttcagtctctctgccgctccggggaggatttgcatatcgaggcttcatcactaatggaggaagcgaaggctttgtctgcctctccccaggtgcggttttggggtgggggccccctcccccctgcaggc

SEQ ID NO: 55199 - DNA, 601 bp, Human
aacagccgggaggaccatccatccccttgcacggaggggaaagggagcctctgagaggaggccggacctcgagacccaagggttcaaatccagacgcaagcccagaactgcaagattccgaagccccggaagggcccctgccctccaggcctggtgcccgggggagatttccctgcaacacgccctcccactgtcccctgtgctgggctcacaggggtgatgaaggaggcctgggaagctctctgtccctggacgaatccaaccaggtagggaagggctggagggtgacttcaccgcctcygccgccctgccttgaaattctttgctctggagatcttcatgccggatccctagtggggaaactgaggcgcaagtgagcacacctgtctgccccttctcacccctggagacccaggaacccccggccccgcctggcgtggcatctcagggtggcggggggccgggctgatgccatctgataatcccaccaccctctctctcgagctgctgtgccaattagtgcccccagtgtggggcctgcggcgggctcacccctgcaggccggggtggcggtggctgtgccgggctagaggcagtgcca

SEQ ID NO: 55200 - DNA, 601 bp, Human
tcgagacccaagggttcaaatccagacgcaagcccagaactgcaagattccgaagccccggaagggcccctgccctccaggcctggtgcccgggggagatttccctgcaacacgccctcccactgtcccctgtgctgggctcacaggggtgatgaaggaggcctgggaagctctctgtccctggacgaatccaaccaggtagggaagggctggagggtgacttcaccgcctccgccgccctgccttgaaattctttgctctggagatcttcatgccggatccctagtggggaaactgaggygcaagtgagcacacctgtctgccccttctcacccctggagacccaggaacccccggccccgcctggcgtggcatctcagggtggcggggggccgggctgatgccatctgataatcccaccaccctctctctcgagctgctgtgccaattagtgcccccagtgtggggcctgcggcgggctcacccctgcaggccggggtggcggtggctgtgccgggctagaggcagtgccagggccgggatcgtagcagcctgcacccatgtgctgccaacactggtggggcctcagtttcccctgcct

SEQ ID NO: 55201 - DNA, 601 bp, Human
tcagggtggcggggggccgggctgatgccatctgataatcccaccaccctctctctcgagctgctgtgccaattagtgcccccagtgtggggcctgcggcgggctcacccctgcaggccggggtggcggtggctgtgccgggctagaggcagtgccagggccgggatcgtagcagcctgcacccatgtgctgccaacactggtggggcctcagtttcccctgcctgtgcatggagggaggaggcaggagcggtgtgggggaccccccattcctccctgttcaggtcttttatgtgctaatwagcccctctcagggcccccctcgtgccccgcttggtccaggccgccggttacatgacaggggccctggggaccacagccgggagatctaagggctcctgccgccatcgcccgaggcagtgagggaaggggagccgccggtcccttcctcggctgatctctatcctcacagacgaggctgggtcagggggctccctggaggaaggggcctgtgggttgcgtctgggggacctcagggcaaaggcctggaggcagggctgggggctgaggtgtcaggagtgcaggcacccaagagggagacc

SEQ ID NO: 55202 - DNA, 601 bp, Human
gggctcggggctcgggaggtttctgggttccagatgtgagagggtggtatggggctcgcagggtcacacaggaaggcaggggtggggctgggagtggagcccaggatgtctccgagctgggcggcaggtggaactcggcaggctgagagagagggggcggtgggcggaactctgggggtgctgagaggagggtggagggattcttcacgccaagctccgttctctttggggaaactgaggccagggtgggggcagagcttgccccagagcgagctggaatgcccgacctgtgtcccccacrctgccccggtccttctcaacaggtgggagtgcagaatgaaagcagggctgggggctgcctggaggaggcggcacagatgttaagcatgttaggtagatgcgaagtttctggagagggaattcttgtggagggacagctcgtgcagaggcccggagtcaggaaccccccgccggccctttgcacacaggggtccagatgtcacccacctggacacccacctcgctgctggccctgccgtggggctgttggggacactgaggcaggaggtggggggcagtgccaggcaagagatcgtgggct

SEQ ID NO: 55203 - DNA, 601 bp, Human
tgggcggggccgcggtgtggggccaggggggagtgggcggggccgcggaatggggccaggggggagtgggcggggccgcggagtggggccagggccggtgctggccactgacccacccaggtcactgaccccctccagatgtcaagtgcatgatggacgtgccattctcccaaccatcccgggaggccaggactttcctcgtccttcgttgcatatggggaaactgaggcttggagggggactgaggctgcactattgtgatctcgggcctccagctcagaccacttggtggttgggccartagacctggctcagccccccgatagcgagaccagggtgcccgagccccagcacactgatgagggaaactgaggcatccggagcccagcaggggaggggagcttggtggaagccacagctaggctgagtgctggggcttactcctgcaatcccagcactttgggatgccgaggcgggaggatcacttgaggccagcgtggacaacgtagggagaccttctctctacaaaaacataaaaacaattagccaggtgtggtggcatgggcctgtggtcccagctgtgcagggggctgaggtggga

SEQ ID NO: 55204 - DNA, 601 bp, Human
cactttgggatgccgaggcgggaggatcacttgaggccagcgtggacaacgtagggagaccttctctctacaaaaacataaaaacaattagccaggtgtggtggcatgggcctgtggtcccagctgtgcagggggctgaggtgggagggctgcttggagtgcatgagctctggtcgctccactgcactccagcctgggtggcagagcgagaccctgtctttaaaagaagaaaaaaaccccacagggcccctgccgcaccagccgcacccagactgggtaggggtctccaggtcctccctgycccgcacccacccccgcatctccccgggacccatgccaggctcggagactccctgaggaccgtggggtcttcatctgaaggttgggtggcggcagccttggggatagtcacatctgcaggaccccatggtgggccaggctgggtgggccaggctgagggaggctgccagtccctgctgcttatcggaggtccgaagctggcctttttgtccctacgaaaggccaacggcaggtggggaacacagcagcgccagccggagtcccagtcctgcttggccatgatatctgtgaccttggcggg

SEQ ID NO: 55205 - DNA, 601 bp, Human
ggcatgggcctgtggtcccagctgtgcagggggctgaggtgggagggctgcttggagtgcatgagctctggtcgctccactgcactccagcctgggtggcagagcgagaccctgtctttaaaagaagaaaaaaaccccacagggcccctgccgcaccagccgcacccagactgggtaggggtctccaggtcctccctgccccgcacccacccccgcatctccccgggacccatgccaggctcggagactccctgaggaccgtggggtcttcatctgaaggttgggtggcggcagccttggsgatagtcacatctgcaggaccccatggtgggccaggctgggtgggccaggctgagggaggctgccagtccctgctgcttatcggaggtccgaagctggcctttttgtccctacgaaaggccaacggcaggtggggaacacagcagcgccagccggagtcccagtcctgcttggccatgatatctgtgaccttggcgggggaatgaggggccaggcactgcccacctgagatggggatgatggcatcacactcgtggcttccgccgtggcgctgagactgagggattctcgtggagtgggg

SEQ ID NO: 55206 - DNA, 601 bp, Human
ccgggacccatgccaggctcggagactccctgaggaccgtggggtcttcatctgaaggttgggtggcggcagccttggggatagtcacatctgcaggaccccatggtgggccaggctgggtgggccaggctgagggaggctgccagtccctgctgcttatcggaggtccgaagctggcctttttgtccctacgaaaggccaacggcaggtggggaacacagcagcgccagccggagtcccagtcctgcttggccatgatatctgtgaccttggcgggggaatgaggggccaggcactgccsacctgagatggggatgatggcatcacactcgtggcttccgccgtggcgctgagactgagggattctcgtggagtggggaccccggcttctcagcatctcggggcctgagggatggggagtcagggatctggggtctgtgcccccaggctgcaggggggccagtgcctggacacccagctcctgctgtgtgaaattaaactttacaaggccccattgcctcctttctctgctctagttggatttttcccttttaattcagggaagaagcgggtgggggacgggggaaggtgtttaaattaa

SEQ ID NO: 55207 - DNA, 601 bp, Human
gcaggggggccagtgcctggacacccagctcctgctgtgtgaaattaaactttacaaggccccattgcctcctttctctgctctagttggatttttcccttttaattcagggaagaagcgggtgggggacgggggaaggtgtttaaattaagtccccataatatgagaaaaattacatttttctttctgagacggcagtttcataaagataattattgtaattattcgtcctacctctgtgatgaatgttatttttattacatgctttttatcttcatcttccagtgtgaggggtttctarggggcgggcagaggtggtggccatgagagccaggccatcaggggcccagggcccggcagagacagcaagaccacatccatgtgtgcgtgcacatggacccacccctgttcgattgtccacacgtgtgcacaccccagcggccccggcttcaggcgtccttttcctcctctcttgatccttgcagacgcccccactgcactccaggatgcttctgggggcccgaaagcaggggcggtgatgctggaattttgggcgtaagaaccagttggaaataatctttcccagccaggcgtggcggtg

SEQ ID NO: 55208 - DNA, 601 bp, Human
gttctttctttcctcattgtagtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataaggtaggagcagaattttattttttgagcagaggaagcaggagcacttgccccaaatcacaaataaattccaaaattatcaaatatatatttagggkgaattttaaaaatcaccttttcttaggtattaccctatcttcaaaacaatagaaatataattggtttgtataaagcaacacatttgtagtctgtattttattacagtgatacatatataactttcagttagctcactggtatttttaattgtatcagtaagactaagcaccaactcctctggagtactggagtatatttttaaaattacggtagatcctctcaaactgtaagattgggatcctagttgtgacctcttcataaaacttgaagtctgttatatgaatacttgatctgataga

SEQ ID NO: 55209 - DNA, 601 bp, Human
ggctgggggctacgacaccatcttctccctgtgcgacgactacgaccccggcaagcgcgagttctactttgacagggacccggacgccttcaagtgtgtcatcgaggtgtactatttcggggaggtccacatgaagaagggcatctgccccatctgcttcaagaacgagatggacttctggaaggtggacctcaagttcctggacgactgttgcaagagccacctgagcgagaagcgcgaggagctggaggagatcgcgcgccgcgtgcagctcatcctggacgacctgggcgtggacgcrgccgagggccgctggcgccgctgccagaagtgcgtctggaagttcctggagaagcccgagtcgtcgtgcccggcgcgggtggtggccgtgctctccttcctgctcatcctcgtctcgtccgtggtcatgtgcatgggcaccatccccgagctgcaggtgctggacgccgagggcaaccgcgtggagcacccgacgctggagaacgtggagacggcgtgcattggctggttcaccctggagtacctgctgcgcctcttctcgtcacccaacaagctgcacttcgcgctgtccttcatgaac

SEQ ID NO: 55210 - DNA, 601 bp, Human
catcgcgcgcatcttcaagctggcccgccactcctcgggcctgcagaccctcacctatgccctcaagcgcagcttcaaggaactggggctgctgctcatgtacctggcagtgggtatcttcgtcttctctgccctgggctacaccatggagcagagccatccagagaccctgtttaagagcatcccccagtccttctggtgggccatcatcaccatgaccaccgtcggctacggcgacatctaccccaagaccacgctgggcaagctcaacgcggccatcagcttcttgtgtggtgtcatygccatcgccctgcccatccaccccatcatcaacaactttgtcaggtactacaacaagcagcgcgtcctggagaccgcggccaagcacgagctggagctgatggaactcaactccagcagcgggggcgagggcaagaccgggggctcccgcagtgacctggacaacctccctccagagcctgcggggaaggaggcgccgagctgcagcagccggctgaagctctcccacagcgacaccttcatccccctcctgaccgaggagaagcaccacaggacccggctccagagttgcaagtgacag

SEQ ID NO: 55211 - DNA, 601 bp, Human
attcttttgagggcacacaggaaaaaccttaagtcatgagtccagagaatgacagacttcattaggcaagtgtaagaatcagaaataaatttatcagtagaatacatttaattcatttcaaaataatttgaaaaaaatagaatttggctgacgatggacagatagtttctcaaacaagtagttatcagcagaggaagcactgcacttccattttcatgagtctgtcttcagcttaatccctaaataaaacagcgtggatagcagtatctgtgcgtgctggaagatgagagatggaagggcmgtcttctgaaatattacaaatcagtcccataatttagtggcctgaaatccaactgaatgtcaaggaaagtctattttctatacaaatgcaagtattttccccaatcacaattatgtgattcaaacgtgtttggaagccacactcacctgtttaatgcccagtcctttctcatgcatatatcccagattaaacatagcttgtgcactgtgttgctgctcagaagccagacggtaatgaataaatgcagtttcataatctacatcggtgccaaacccatagaaatggtagtctccgagctta

SEQ ID NO: 55212 - DNA, 601 bp, Human
aaccaggcatggtggcgggtgcatgtaatcccagctattctggaggctgaggcacaagaattgcctgaacccaggaggtggaggttgcggtgagccgagactgtgccactgcactccagcctgggcgacagagcaagactctgtctcaggaaagaaaaaagaaaaaaacagtggtgagccaaggggagaaattagtatcttggcacagcgaacctactggcagtgacagcacaccagctggaaagctctgttccatgacagtggggccatttcacaattcccatgtaattgaaaatagcakgaattcaaacatttaatagctgaatgaataatgcttctcaattaggatttaactaaaacacaaaatatttaacatctgaattgaaacctgaaagttatgttcttagcctataatattttaattgttttagtatcactgatactttctgacttttattatacttacccattaagaaagtaaacatggggtataattttatataaaattacatttgaaagatctctataacacgtttgtaggtacaggtgctaaatttttctggaaaaaaaatgacaagaaaccactaattgtgttctctgg

SEQ ID NO: 55213 - DNA, 601 bp, Human
gcgtcagagtgataaaccaaatatgggcacctgtcctgcatccactgtgccataacagcccttgcccacctaatcttccaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacaggtctgctgcgattctgggggcctgggccacttggagacattacagtggggtgggctgagcctagayggaagggtgtctgggatggcactaggcatcctggaagggctcctttttagctctgctttgtagaaagaccccaggcaaacctgcctctctttaaagcttcagtcatgtttacagttgcattaagcaattcttaggactcttctggctgggtattctaggattccatataggtgacagcttataggaaggggcatgggagctttcaaatgtggcatttgaatcctgactctgcccccaaataggtaactgtggctttcggcaggatactggtccttagccgtgcccagttttccatctgta

SEQ ID NO: 55214 - DNA, 601 bp, Human
tggtagtggtcatgaaaccttgtgggttcccctgttttctccccaagttctgtggtccgaggcagtgagagtcacaagatgatcgacttgtccgggaatccggtgcttcggatctactacacctcgagggtaagcatttcctgcacaccccacccctcaggctcttggctgtgggaagccctgggctgaatcctggtcctagcctaggagaaggcgagggcgcagagcagggcctgcccagtcactccaggaggagggcccgtaagctgaggcgtggaggaggaggattggtggggaaggyctgtgtgaattactccagggaacaagtgggaatgaggcctgcaaagagaagggactgaaagcgggaagggagataagccagagaggtctgcagggctggagtgtggacttgattccaggaacacaggcagcctctggaaggatttttaaaaagataatggctgggcatggtggctcatgcctgtaatcccagcgctttgggaggctgaggtgggaggattgcttgaggccaggagtttgagaccagcctgggcaacaaagtgagactctgtttccacacacacacaaaatcttgaattag

SEQ ID NO: 55215 - DNA, 601 bp, Human
aagacataagagcaaagatataaaaaacaataaccatagaaaatgaaactggaaaaggcaaaaatgaaagaaagaatggaaaatggcaaaagagaaaaggaacaataaagaaagctatatccacagttccttttttttttttttttttgagacagggtctcagtctgttaccccggctgcagtgcagtggtgcaatcatagctcactgcagccttgacctcctgggctcaagcgatcctcctactcctgcctcagcctcctgagtagctgggattataggcgcatgtgccaccatgcacarctcttaaatacccattgattcttgatcaaattaaatgggcactgtgatagtgttattcttacctcagagtggggtcaccggttgaaggacctgttgaccaagatatgattatgtcaaacaacactcaaatatcaaatgagttgctaagaaaaagtgctctattattccaaacctccaaatcatctcagaaaatggaatttgaagattctctcatggattaattgtattggaccagctcattgtacccaagaaaagcaagatttttaaggactctgccaaaatctcttttcccagatgccc

SEQ ID NO: 55216 - DNA, 601 bp, Human
agacattataaaacgaagatgaagttaaagtgacaaatgagtttcccaggtatttcactaatggctataaaagcatgcgatttaaaaaaagaagagaaattgtaagacaataacagataagcaagctagaaaatcatttatttaaagagatcaaaagacataagagcaaagatataaaaaacaataaccatagaaaatgaaactggaaaaggcaaaaatgaaagaaagaatggaaaatggcaaaagagaaaaggaacaataaagaaagctatatccacagttccttttttttttttttttttgagacagggtctcagtctgttaccccggctgcagtgcagtggtgcaatcatagctcactgcagccttgacctcctgggctcaagcgatcctcctactcctgcctcagcctcctgagtagctgggattataggcgcatgtgccaccatgcacaactcttaaatacccattgattcttgatcaaattaaatgggcactgtgatagtgttattcttacctcagagtggggtcaccggttgaaggacctgttgaccaagatatgattatgtcaaacaacactcaaatatcaaatgagttgcta

SEQ ID NO: 55217 - DNA, 601 bp, Human
aatccttatcttttctattcctcaatggactctaaccagattttctcaagtgttgacgcctcaaattgccaacaagattgtattgtcaagaacagacaaaagagcaatttagcctcaagattcttccacattaggattctatatactaactcctataagaaagaaattctacttgctctcagtggtgtctttagatttaacactctctatgtctgaaagctgtaactcaagggaaactcagaattgaactgcagactcttctttgcaatatggttaagtcacaagcttattacatcctaayagttcccactcatccctaaagtatcacattcatttactacatagatcaatccttccacctatcaagagataatatattccttaacatgacttccctgtcctatgtctgaaaaatgggcagacattataaaacgaagatgaagttaaagtgacaaatgagtttcccaggtatttcactaatggctataaaagcatgcgatttaaaaaaagaagagaaattgtaagacaataacagataagcaagctagaaaatcatttatttaaagagatcaaaagacataagagcaaagatataaaaaac

SEQ ID NO: 55218 - DNA, 601 bp, Human
tcaagcaatcctcccatcttggccttccaaagtgcttggattacaggcatgagccactgtacccagctgtgttttagaaacaggatcttgttataccacgcaggctggagcatattggcgtgatcatagctcactgcagcttgcaacgcctagactcaagcttcctgcgtagctgggactacaagtgtgcaccaccatacctggctctgagattttcttaagaggagctagctagttaaataactaaatctcaatataaatgtcaaaaagaagatatgagtcaaattttctcaggaaagamctttgaagaaggatgcttctttttgcatcaacatttgtgtccctaaagtgacttactagaattatgcagtgcagctccagtgcgtacaacatcatccacagaggtgggtattgtggccagtgagcttcatccccaggtgggtagttgacaaaattcctccagcagtgataatactctaaggaaacacaaatcttggctcattcaacaagcacaatggtaaattacttaagaagatccccaacctagcttcccgtatagaaagcctgtagtctctagtctagttgctgctggacattagac

SEQ ID NO: 55219 - DNA, 601 bp, Human; identical to SEQ ID NO: 55215

SEQ ID NO: 55220 - DNA, 601 bp, Human; identical to SEQ ID NO: 55216

SEQ ID NO: 55221 - DNA, 601 bp, Human; identical to SEQ ID NO: 55217

SEQ ID NO: 55222 - DNA, 601 bp, Human; identical to SEQ ID NO: 55218

SEQ ID NO: 55223 - DNA, 601 bp, Human; identical to SEQ ID NO: 35628

SEQ ID NO: 55224 - DNA, 601 bp, Human; identical to SEQ ID NO: 35629

SEQ ID NO: 55225 - DNA, 601 bp, Human; identical to SEQ ID NO: 32242

SEQ ID NO: 55226 - DNA, 601 bp, Human; identical to SEQ ID NO: 32243

SEQ ID NO: 55227 - DNA, 601 bp, Human; identical to SEQ ID NO: 32244

SEQ ID NO: 55228 - DNA, 601 bp, Human; identical to SEQ ID NO: 32245

SEQ ID NO: 55229 - DNA, 601 bp, Human; identical to SEQ ID NO: 32246

SEQ ID NO: 55230 - DNA, 601 bp, Human; identical to SEQ ID NO: 32247

SEQ ID NO: 55231 - DNA, 601 bp, Human; identical to SEQ ID NO: 32248

SEQ ID NO: 55232 - DNA, 601 bp, Human; identical to SEQ ID NO: 32249

SEQ ID NO: 55233 - DNA, 601 bp, Human; identical to SEQ ID NO: 32250

SEQ ID NO: 55234 - DNA, 601 bp, Human; identical to SEQ ID NO: 32251

SEQ ID NO: 55235 - DNA, 601 bp, Human; identical to SEQ ID NO: 32252

SEQ ID NO: 55236 - DNA, 601 bp, Human; identical to SEQ ID NO: 32253

SEQ ID NO: 55237 - DNA, 601 bp, Human; identical to SEQ ID NO: 32254

SEQ ID NO: 55238 - DNA, 601 bp, Human
cgcttgttttccaggtgaaaatggtctgggtctgtgaggcaaacccaagatagagagaatttccctttgtatttcccgtctttcgtggttccgtagtcttctataaataaaactggagtgaacatgattgtctcccaaacctccttttgcataacccactagaacccagcagctccagaggaaacccacaatacccttaagtaaaaatacagtcagatgcatttttgtccaaaagcaaaagttgatatttttagtccttcttgtcctcttaaaaaaaaaaaaaacctaaggttctaggaggtacagtttcccagtagctgaaaaaacaaatttacctatttttcatgacagtgacatttctgagcacaacatcctcaccgattttcctgtcctattttaaatattttggaatatgtcaagagtagttatttctaagaaagctgaaactcagatttccaattatccacagttgttaagagtttttgctgcattgatgtagcagaagacggctaatattatttgatcagatgacctatgcattcctatatgaatttatgataatcaggcctttggtatttgaattagcaaaagttgatcttct

SEQ ID NO: 55239 - DNA, 601 bp, Human
ccatgtgttattaagatttgttgataatctgacttttcaaagaatatttcctttgagatgttacatgaggaagtttttaattaagtgtttaataaaacatgttaattttaagtcaaagcagattgcatttttaaaacaaagttctaaaagctataacatcataaagttctcaattcttcccagtggattaaatttgttgatagagtttttaatcttcaaacataaaatatattcgatgttattttcctttgactgccagagatagtaaatttcaccttcaatttttactaaaacatttaargaaaacaacagcccttataaaataatttgaaattggtaatccataatattattgtgagagggaatattgggaactaaattatcatttgacattatcagtatttaaaaaccaccatgaagtaccagctacaactaaaacataattttaaaattttctcattaatattgttgtggtttacagaaaatttcaaatattttatctcatatagaaggaaaattttgtatagataaagaccactaaagcatgttttacatttttcttgcctgtgaaaaaaatcaagtagctataacatactttact

SEQ ID NO: 55240 - DNA, 601 bp, Human
tatccttcatgctaggattgctaagagcaaatgagcagagtatattaagcaacatatattataaaagcatccatgtgttattaagatttgttgataatctgacttttcaaagaatatttcctttgagatgttacatgaggaagtttttaattaagtgtttaataaaacatgttaattttaagtcaaagcagattgcatttttaaaacaaagttctaaaagctataacatcataaagttctcaattcttcccagtggattaaatttgttgatagagtttttaatcttcaaacataaaatatattcgatgttattttcctttgactgccagagatagtaaatttcaccttcaatttttactaaaacatttaaagaaaacaacagcccttataaaataatttgaaattggtaatccataatattattgtgagagggaatattgggaactaaattatcatttgacattatcagtatttaaaaaccaccatgaagtaccagctacaactaaaacataattttaaaattttctcattaatattgttgtggtttacagaaaatttcaaatattttatctcatatagaaggaaaattttgtatagataa

SEQ ID NO: 55241 - DNA, 601 bp, Human
tctaataattcgttttctaagaacagactctaaaaaactggtcaggaatgtttaagaacatatgagtaaaaatagctattgcaacacagcacacaatagtaaaaactaaaaaaattgcatgcccaataataaaatactgtttatgcaaatatgacaatgaattgtctagctgatattattcagtcatcaaaaatatattcataaggagaaaatgaacaaatgagaaaactcaaaaacttaaaaatcaagaattaagtaagggtacaaccttacataaacagttcaactatacaaaaaggtrtatttttaaagtataagaggaaatgtacaaaaacatcaacaataattggctctagataatggaattgtaacttttttcctgctcctttttaatttgacataaaagtgactacaatgtcaacaaattaaagtatcataacgttctgtttgctgtatttccagaatggcttttataaacagtccttctccataaaggaaagtttcttccaaataccaatgatcaatcatgttaaacactgtaacttatatcctccttgcagagattcataatgctcattagcataataaacacactgaggaa

SEQ ID NO: 55242 - DNA, 601 bp, Human
atgcaattactactcaattgaaaaataatgtatacatttatttagtaatccttctctgcaatcccaaaatgacagctttatttatttatttttggtttttttgagacagagtttcacttttcttgtccaggctggagtacaatggtgagatctcggctcactgcaacctccacctcccaggctcaagcgattctcctgcctcagcctcccaagagctgggattacaggcatgcgccaccaggcctggctaatttttgtattttcagtagagacagggtttcaccatgctggccaggctggktttgaatgcctgacctcaggtgatccacccacctcggcctcccaaagtgctgggatgacaggcatgcaccaccacacttggccaacaccttttaaacagtgttataaatgaggtattacatctctgccatccaaattattctttgctcatatatacttgagcgttttataattaagttatagaaggttatttgaacatcaagttatttagaccaaatctatttgctcacctcatttaattctaaaactctaactccttgaatattataaacacctcattcttctcaattttttttcagca

SEQ ID NO: 55243 - DNA, 601 bp, Human
tccagagccagttctcccatggaggcaggtggtagtacctctggaagaagtgtggaaagctggcttccaccccagggaatattactagaacatttctggagagaggaataggcagtagaaccactgaactgcaaaggaatctgtggacttggaaaataaagtgaacttctgtttttcttaacaaaactttatagcatgatttaggccatgtgcaagtataacttcggtaaaaataaaaatcaacttaagaggattaagtattacaaaagtacttttaaattttaaacacttgtcatggccmcagtgttaatactctgattagatgtcatagaaagcacctgataataaaaaaaatctacattccctctagtaaatcacagaaaagattccttaaaaggtatgaaaagcatccttttaagtatgggccatgtcagatgttgggaagtttattttattgcaaaggtatcttgagtgaatgactctgcaagaaagttgaagatccttctcatttttcagtaaatttagaaggaaattgtattagcccaaattttcatgcctcctattctatccccccaaagtattgtttttatatgccaagcac

SEQ ID NO: 55244 - DNA, 601 bp, Human
ttgaaaaatctggattcaaatctcaggtgtcatctacaagttgcacaacctttaccaagttacttgacttttagcttttattcatctgtaaaatagggattaatcatagtatttatattgtaattttgttgttgaggattatatgagctaatacatataaatcgcttagacatgcctggcaaatgtcaagtagaacataaatatttacctgatagaaaagtttatgtgtgtatttatagataggtagttaggtaagtaggtagatagatagatagatagatagatagatagatagatagaacgatagatatagatagatagatagattagaggtagatagatagatccctacctaggatatatttaatatccttaatcagggatgctgggccccagtgatatatacataccttatatattcacaccactgctcaagttattactttatcccacaaagttcctctgtcacaaattttatccagtgtaagccttactttgtgcacattttctaccttctgcctcctcacagtaatcctttcctcttctggcaaagcattcacagtaatgcttatttgataaaggcactgccattcatcataag

SEQ ID NO: 55245 - DNA, 601 bp, Human
ctcccataaatataaattgttcattcttcagttgctaataataatgaagagtttttacaagaatgtacatgaaaataccagtaattcagtgaatgttcaacttggagagcaaagcataagtggagccaagacattgtcttgaaatgtacaactcaaatactacatgcagataggaaataaaatagaaagggaaatataaatattgatttgataattttcatttggttaatattttatttggtgttattgaagacacatggtagttgttcaggatggttctcacttacattattagagagaratgccacccaaagtagtttagaaaagatggcaacctgaagtgctcgtggtagcgttacttaataccctcatttgaaaaactataatagtctctcattttctcaacttctctagtagaccatttctcttgtcatgtacttcttcttcaattaaacttgcactcatattcacacacaaattagtatcctctttcatgtgcaacagacccagtttcttatttatccagacactaatttatatgctcaaatctccctgaatgtctgctctttcattttgatgtatttcttgaatggaatgggtt

SEQ ID NO: 55246 - DNA, 601 bp, Human
tcttgttctcttgaagtcactttagggtagactttactaacagaaacttcctttcctcgctcctttaatcctgcttttcattacccctagttatattctgagaaaagaattcaataataaaagtaaatattactaatattatctgcattcgattgataagcaaaactagatattcatgtatgtaacatgccttgcctcttatctctgacatagaaggccatatttattgtttctgaggattctgaactgactcaaagggaaccttgcactcagctgctttcatgtttgtttgtttgtttgtcttttcaggccaatatacattcatttagattatggctataaaaatttaactatcattttattaaactttttcatatggcagatactatactagctgtcaagggaatacacgccatcctttcccccaaaaaagtaaaactcataatttacaaaccctcattgacttaactataaaaataaataaaataacatgtttaaatggacagaaacagattctatatgtgcttacataccaaacaaataacataaaattccatatggaggccaggtgcagcggctcacgcctgtaatcccagcactt

SEQ ID NO: 55247 - DNA, 601 bp, Human
tattacagtatgctataacctactgcagtggtaaatgacttgggaaggttaaaagatacacaagtaaatgagaagaaaaaaaaacagagaagtgtatactattattggctttgagattcatgtatttggcccttttaattcattccttaatgtatattttacatcaaccaaataccatgaatttccagaatctttaccagtatttccagtaaaatctgttttatcagatatagatacacaagactccataaaagccctaaacacattccctctttggtggtgaaaaagcatctcttaattrccatataaaaacaaataaaacaagacaaacaaaaaggcagaaggtttggctcatttaagccagacccagacttgttaaaggggatagaaggacacagagtaaagacacactgagatcaggggttaatgctttttttcctagtaccatcccttatctcagaccaaaaatgacatttctctcgtgtgagaatagaaagagtgtttagtaacaaacacttgtgtcaatcaatttgcttctaataattgtatttaaaaggagaccacagcagcctgttcaaattcttacatgtgctgacctgtc

SEQ ID NO: 55248 - DNA, 601 bp, Human
gaagaaccagaagttaactgacatgaagtgatttaaagtctctttttatcccagtttctataaatatttattgctttgctgcagaaattgtcatgtgttggcctaggtggcactgtcccagaccctgcttgacaaatactatacttcatgatatatgcaccaaccagccatttgaaaatatattttctccattctgaaggtcaatattcataattctaagtgataacaaccattattcattttttcattaatattaaattgtatatttaaaattttaaccaaaaagcaacaagtatagtcytaaaaataaaggctaagacatgagtttgctaggatccaacctaaagtgtgcacctgcttaatgcagatgagtattgaattcatgttatgtaatctaccgttctggaatcccctgtgagatgttagtgtaataaagtagaaagctagaatttcagccattattataaaatttcagttttctaatccaagctatttaacttaaacccttaaggggactcattttcaaagagtttaataaaattttatattaaatataccacacagaacgaagttgcattgcagacttgtctggtgattcaaa

SEQ ID NO: 55249 - DNA, 601 bp, Human
aacatagacctaaaatcttgtatttacaagtccaaaatccaaaacattctgaaaactacgagtttgttttcaagctcttttgacagaagaaccagaagttaactgacatgaagtgatttaaagtctctttttatcccagtttctataaatatttattgctttgctgcagaaattgtcatgtgttggcctaggtggcactgtcccagaccctgcttgacaaatactatacttcatgatatatgcaccaaccagccatttgaaaatatattttctccattctgaaggtcaatattcataattytaagtgataacaaccattattcattttttcattaatattaaattgtatatttaaaattttaaccaaaaagcaacaagtatagtcctaaaaataaaggctaagacatgagtttgctaggatccaacctaaagtgtgcacctgcttaatgcagatgagtattgaattcatgttatgtaatctaccgttctggaatcccctgtgagatgttagtgtaataaagtagaaagctagaatttcagccattattataaaatttcagttttctaatccaagctatttaacttaaacccttaaggggac

SEQ ID NO: 55250 - DNA, 601 bp, Human
ttgtcctattttgttaacatagacctaaaatcttgtatttacaagtccaaaatccaaaacattctgaaaactacgagtttgttttcaagctcttttgacagaagaaccagaagttaactgacatgaagtgatttaaagtctctttttatcccagtttctataaatatttattgctttgctgcagaaattgtcatgtgttggcctaggtggcactgtcccagaccctgcttgacaaatactatacttcatgatatatgcaccaaccagccatttgaaaatatattttctccattctgaaggwcaatattcataattctaagtgataacaaccattattcattttttcattaatattaaattgtatatttaaaattttaaccaaaaagcaacaagtatagtcctaaaaataaaggctaagacatgagtttgctaggatccaacctaaagtgtgcacctgcttaatgcagatgagtattgaattcatgttatgtaatctaccgttctggaatcccctgtgagatgttagtgtaataaagtagaaagctagaatttcagccattattataaaatttcagttttctaatccaagctatttaactta

SEQ ID NO: 55251 - DNA, 601 bp, Human
aaagcattttttataaattcttacccctggtccagtacaaagtctctcaaaaacctctgtcattattcagaattgagaggggaacatattttccctctttagtaaccttccaaacaaatgaagtcaaagaactgttccttttgggaatattaagaaatgctgaagaatttaggacagtaagtatcagacatattattatataatctggctgtgtaagatagtgtattgtacaagtggtattaattgattcacaaagctcaaaaattggaaatctttagaagattaattaaaatttataacmctgctatacatatatgaaacttaggatcctaagctagaagcattaagattatggaagggaaaagatgataatgaccatcaggaatgatgctgcggagacaaggctgctagaacatcatgttctaaggccagatgggtggccacatttgaagctcctgacaaaggaacccacaatgctttgccttcatcctccataataatctctggtttattttccccagaaaagtggaaggtggttcaggagagagcaagaagctgatcctcacctccatctcagaatctaaagcaggcatacagaaaa

SEQ ID NO: 55252 - DNA, 601 bp, Human
ggtcaggagttcaagaccaccagcctgatcaacatggtgaaatcccctctctactaaaaatacaaaaattagccaggtgtggtggtgggtgcctgtagtcccagctactcaggagtctgaggcaggagtatcgcttgaaacctgaaggcagaggttgcagtgggctgagatagtgccattgcactccagcttgggcaacaagagtgaaactccatctcaaaaaaaaaaaaaaaaaaagaattgaattacgaagtatgagtctctgtgaatatttcaggattgaaaaaataattagtaaaamattccaaatacattagcaaaaacaaatatcacagaggacaataaatatactataaccctagaagataaagtaacaatcataattcagtaacactactcaatagcagatgttcaaaaatgtgaacttggtagaactgaattaagattgaattgaatttttaaaaatactatttggcaaattaaatagaaacctatcaaatctatatcatcccagagtttaaaatggcagtggaagaggatgccaggtaaagatatacatgcactttagattttacaaattaagtcaaaggaattaggaaaa

SEQ ID NO: 55253 - DNA, 601 bp, Human
ggctcacgcctgtaatcccaacactttgggaggctgaggcgggtggatcacctgaggtcaggagttcaagaccaccagcctgatcaacatggtgaaatcccctctctactaaaaatacaaaaattagccaggtgtggtggtgggtgcctgtagtcccagctactcaggagtctgaggcaggagtatcgcttgaaacctgaaggcagaggttgcagtgggctgagatagtgccattgcactccagcttgggcaacaagagtgaaactccatctcaaaaaaaaaaaaaaaaaaagaattgaawtacgaagtatgagtctctgtgaatatttcaggattgaaaaaataattagtaaaacattccaaatacattagcaaaaacaaatatcacagaggacaataaatatactataaccctagaagataaagtaacaatcataattcagtaacactactcaatagcagatgttcaaaaatgtgaacttggtagaactgaattaagattgaattgaatttttaaaaatactatttggcaaattaaatagaaacctatcaaatctatatcatcccagagtttaaaatggcagtggaagaggatgccagg

SEQ ID NO: 55254 - DNA, 601 bp, Human
ttgcccattcagtatgaattggctgtgggtttgtcataaatagctcttattattttgagattttttcatcaatacctaatttattgagagtttttaacatgaagggatgttgaactttatcaaaggcctgcatctattgggatgaccatgtgatttttgtcattggttctgtttatgtgatggattacatttattgatttgcatatgttgaaccagccttgcatcccagggatcaagtcaacttgatcgtggtggataagcttttggatgtgctgctggaatcggtttgccagtattttaytgaggattttcacatcgatgttcattagggatattggcctgaagttttctttcttcgttgtgtctctggaaggttttggtatcaggatgatgctggccccataaaaggaaggaaggactcatcccttttcaattgtttgaaatagtagctaaaggaatggtaccagctcctctttgtacttctggtagaatccggctgttaatcgatctggtcctggttttttttcggttggtaggctatttattactggctcaatttcagaactgttattggtctattcaaggattcaaattcttcctg

SEQ ID NO: 55255 - DNA, 601 bp, Human
ctgaatctataagttactttgggcagtatggccattttcattatattgattcttcctatccacaagaatagaatgtttttccatttgtttgtgttctgtcttatttccttgagtagtagtttgtagttttccttgaagaggtccttcacatcccttgttagctgtattcctaggcattttattctctttgtagcaattgtgaatgggagttcattcatgatttggctctctgcttgtctattattggtgtataggaatgcttgtgatttttgcacattgattttgtatcctgagacttttyggaagttgcttatcaacttaaggagtttgggggctgagacaatggggttttctaaatgtagaatcatgccatctgcaaacagagacaatttgacctcctctcttcctatctgaataccctttatttctttctcttgcctgattgccctggccagaacttccaatactatgttgaataggaatggtgagagggggcatccttatcttgtgtcggtttttaaagggaatgcttccagcttttgcccattcagtatgaattggctgtgggtttgtcataaatagctcttattattttgagatt

SEQ ID NO: 55256 - DNA, 601 bp, Human
agattctgacataaaacagctcttcagacacatgttgatgttataaggataagtggttccaaatatgatcattgagtttccctctaggatacacagtttgaaaaacattcatttgaggatttatcagagtctaaacgttgatatcactttgagatgttagcatacattccagttcgtttttttctcctctaaacccacggtaattgactgcttaacccaaaacacctgtgatggaacttgtgcacaaattatcttttcttcatttcaaaaatggctcttgcagtatccgttatggactccwtagcagtagtcaaatcagtgtattatctcccatccacacatctatctgatcttcacttattttcaacctgtgattaactttgattctggtactgtgaaattatggattatatgactctaaattatactagaattctaccctttttagaaactgatcatttaaaacgtacagaattcaccacccagcatacagaataaatcatttttatatgagattttaaggaatgtgaggaagatagaatcttgtctacttaaattctatatatacttaaatttactataatcttaaattaagtatatt

SEQ ID NO: 55257 - DNA, 601 bp, Human
ttattgacatagatattgtctttttgtatttacaaaaacaaaacaaaacaaaaaacaaacaaaaatattaaatatttgctcgtgaaaagttttttaagaaatatttataccttgtccatcttattttctcctcaaaattattgtaccagaatcataaagaaacaatttgagcagcaaatatatgggtatattattttacagttttattaactcagtgaacaaagataggattggactgatatcttctaagaaattattattctattcataaagagatcaagaaggatgtagatgaggctgsagcgctgaactactaaattttgtcataattggggctggagattcaatccttctagatctgctactctaacccaaatgacttcatataagtactgaggttagtgtattgtggtcacatttgcctaagaacacaactgaaactatttcaaatttatagtcacagggaaggtagactggcaaaccaaagctctatcccagactcaccggttttgtatttcagaccactccttttggaaaatatgattttcaaaatgtttatttctttcaaaacagagttattaaaggagattctgacataaaa

SEQ ID NO: 55258 - DNA, 601 bp, Human
taaaaactgaaaagatgtgtgtatgttacaaatacgggtttcttgggttttacaaaggtggatattgtatttgaagcaaagtaccctccaaaccaatgtgaactccctttaaaataacttttaatattattaagtttcctcttggtttcctttttacttcagcaatggagtgactattaagattccacaagttaatgcttgctcagttacccttggtcttgagctacaccatagatgcattaactatttgacctagtatttcagaaacaatacacttatattgattatgttgactaaaccktttcaaagactgaatagttattttagtagaagtactgagagaaacccagactacaccgtatgtattaaaaaaaaagtaaattctttataaaactttatttgaactttttaaatgatattattaaacatacagtatgttttagatattgcaaatatataactgaagaagcctacctaaagcattttgatttagaaacacattacctttacatgtgtgtatcaacatggatttaattttcaaagctgattcttgttttagagtagtttctagtttaaaaacatacataaagatgaagcattg

SEQ ID NO: 55259 - DNA, 601 bp, Human
aattggaagatttgactactcattcgcctggaaatgtccacattaaataacaatttaaaaaaatattagctatgggctcttcggcactaaatgccctgtaattttcctttaagttataaaagccgaatacttggcagggtgtttctactttctccagcctattcgaagcctttcaagtgttaattagtggtgatagcctttccaccttcacttctggccagtgcccagcaacctttactaagctgcactacacttaaagttcttcacaagtcattctggaagcctagtctggggatggagrtctgctttaagccgcagttattaaaagtagtggcaaaaactgcaattacctttgcaccaacctgataattatcaatatgaagtattgtgaaataaacatagaaattttggaattcctccccttctgagttttgacacacctaaatgtttactgaaaggaattcagaagaggcaaaccaagcctggagactctcagaaagaagaataaacaatccaagtgagcttcaagactcaaatttgcctataaactagcctgtgtctcagacccttatgtgttctttgatgtggttatatatcagtg

SEQ ID NO: 55260 - DNA, 601 bp, Human
gaagatttaatgtaccatccgaaggtatacatagagggtaaatttattgtggctacttgatttgcagcatacgaccccataactctctgtgcataactgctgctcgggtttattcttacctccaacactggacattctggaggagtcctgatgagagctggatttattgcggttttgattttttcgtttgttggctgctctcacggatcgaagaagtacctcactcgccttgaagaaggccaccatgaatggttgttttgactgaggtccctgtcttcccacaagaccagcagattttacrttgatactgcgtcctagaacgtaatacaaaagcacttggtttatgaaaaagaaagaacaattacctgatgtgaatgaattctgagggtactttgaaaaggggaaaagttttaaaacattatcagaatgccttccttacaggccaagattcttataaatattgaggcttactattacagacaattatccatctatggtgttacatcttgcatcattcttccaccacagaataccctccagctgctttcactcactgagagcttctcagaccttgaagtcaagaatactataaattggaaga

SEQ ID NO: 55261 - DNA, 601 bp, Human
agctaaatatgatgatatgctgctgtttcaaagcaaaagaggagatgttagtgttttcactcttatttcccaaagagaaagagggaaaaaggaagttgatacctaaagcatcagaagaccttaatttatttataaaaatttaaaatgataaatgaatgaaggtacaagagttgaaaaagcaggaatggtgctaccataatgtggattttgatatgaccttgggggtagaaaaattcaggataagcccaaaaataaataacaatcctacccaaagataaggggctttaaaatgctattgttrttctagcttaatcattattttctatacccagtgaattattcacttgcatttacacacaagccagtaatacgtactgttgtttattttgtagatatattaacacaattttgtgtttgtgtaggtaccaatgtgtgacgcaagacaccacaaaataactctgtaatgtgtttgcataactctgctcagcaaagtatccatgtggatcatgtaattaacatcgtcactttagagctccttgatataaaaatctatccacaaacctgaatttgctagacacctctaaaggacagttccctgacg

SEQ ID NO: 55262 - DNA, 601 bp, Human
ggtcaatttctagatattgtataaatttaatctttagttcgattttctttagtttgattctttttgtcttagaataaaatcatgaaaaacaaaataaatacgtggaggtaaaagttggtaaaacacaaaaattcctgaatatgataagaagaacactagtacactgttggtggaaatgtaaattaatacaacctcttttttgaggttcctcccaaaagtaaaagtagagctaccatatcatcaagcaatctcaccactgggtatatatccaaaacaaaggaaatcaataagttgaagatayatctgcactcccatattgattgcagcactattcacaagatacagaagcaacataagtgtccatcagtgtatgaatggataaagaaaatgtggtacatatacacaacagcttattattcagccataaaaagaatgaaattggcctggcgtggtgtctcacacctgtaatcccagcactttgggaggccaaggagggcggatcacgaggtcagaagatcgacaccattctggctaacacggtgaaaccccgtctctactaaaaatacgaaaaattagccaggcgtagtggcggacgcctgta

SEQ ID NO: 55263 - DNA, 601 bp, Human
ttgaattctatgtatataaaaaataaagaaaataaaactttaaagtcaaaatatatctgttccatatatatgtctttttatgcaggctaagtgatgtatataatgtaacatcacataaatgtaacaagcaatgaaatgtataacagaatctggttccaagagtctgatttcatagagcattaggaccatatgcttattctgtcagaaataaaaattaatggatagtgagtgaagtaaatgttgtacccaaactagaaaagcctgcagttaggtttactctaaatgcttggcagaataagcygtaggaggaagggcaaggaagttagatttatgtcttttaaaatactgatgggcagcctttaggagattagtatgaaatggatataattctactgttaatgagcctgcctacaaatgaagagtcatggcaaaaattattaaaatgttctacaatcaacactagaaaaagtaaaccaacatgtcttatccatagtgcaagtgttatcaataatatttctctgttttgtctcttaatagtaataatattaggaagcccatgccaaaatagtaaacatattgctaaatactttatgcaaatttc

SEQ ID NO: 55264 - DNA, 601 bp, Human
cattgtagccaatagcacatacatgtttatatgaaaagccataaactacaaatatgattatttgaattctatgtatataaaaaataaagaaaataaaactttaaagtcaaaatatatctgttccatatatatgtctttttatgcaggctaagtgatgtatataatgtaacatcacataaatgtaacaagcaatgaaatgtataacagaatctggttccaagagtctgatttcatagagcattaggaccatatgcttattctgtcagaaataaaaattaatggatagtgagtgaagtaaatkttgtacccaaactagaaaagcctgcagttaggtttactctaaatgcttggcagaataagctgtaggaggaagggcaaggaagttagatttatgtcttttaaaatactgatgggcagcctttaggagattagtatgaaatggatataattctactgttaatgagcctgcctacaaatgaagagtcatggcaaaaattattaaaatgttctacaatcaacactagaaaaagtaaaccaacatgtcttatccatagtgcaagtgttatcaataatatttctctgttttgtctcttaatagtaa

SEQ ID NO: 55265 - DNA, 601 bp, Human
tgctgctgtagtataaaagcaaccgtagacaatatgtaaatgaatgggtgtggctatattccagtaaaactacctatggatactaaaatttgaatttcatatgattcccacatgctgcaaaatattgtccttcttttccacgcaaacattttcaaatgtaaagaccactcttagtaggtcatacaaaaacaaatgataggcttaatttggttattaggccttactttttcaaactctgcattaggtaataatgggaatatttatctattcatctttgtcttaattaaaaatattaaatatraataacaacattgtagccaatagcacatacatgtttatatgaaaagccataaactacaaatatgattatttgaattctatgtatataaaaaataaagaaaataaaactttaaagtcaaaatatatctgttccatatatatgtctttttatgcaggctaagtgatgtatataatgtaacatcacataaatgtaacaagcaatgaaatgtataacagaatctggttccaagagtctgatttcatagagcattaggaccatatgcttattctgtcagaaataaaaattaatggatagtgagtg

SEQ ID NO: 55266 - DNA, 601 bp, Human
acttttttttaaagaaactgatagtaaatatgttgggctaagtggtctccttgcaactactcgattttgctgctgtagtataaaagcaaccgtagacaatatgtaaatgaatgggtgtggctatattccagtaaaactacctatggatactaaaatttgaatttcatatgattcccacatgctgcaaaatattgtccttcttttccacgcaaacattttcaaatgtaaagaccactcttagtaggtcatacaaaaacaaatgataggcttaatttggttattaggccttactttttcaaaytctgcattaggtaataatgggaatatttatctattcatctttgtcttaattaaaaatattaaatatgaataacaacattgtagccaatagcacatacatgtttatatgaaaagccataaactacaaatatgattatttgaattctatgtatataaaaaataaagaaaataaaactttaaagtcaaaatatatctgttccatatatatgtctttttatgcaggctaagtgatgtatataatgtaacatcacataaatgtaacaagcaatgaaatgtataacagaatctggttccaagagtc

SEQ ID NO: 55267 - DNA, 601 bp, Human
atcattacatattttggaatgtaatctgaaatacccataactttttataattgttttaaattattaaatataaatgtagaatttcaatcttgcatctggaataaagtaaaatactgaagaaacacagagatttatggaacatttttcattcttgtcttgtgttgggtttgctcacattttgtacaaataacattcgaaaaactagtccactttgattatttctaaaataaaatattaaagaaataaaattaaaaaataatttgttttacagtttttgttaaagtgtcaccttcctgtttarttactctcaacctctaatgaaagtgtaggcaagttagagatcaaaggagcccatcatagagggccttgcttctcatggttacttcaagtaattatttgtttaatgttaatctaaaaaacaagctaatgattaaattttgaaatcaaggtatttttcttctaggttatttattcctactatgcaattaacttcattaaaacagattaaataagtagataatgggaaatgggggagagaggatttatttcagactctacattctggttcttcttcagggaaatatctcccttgcagctaact

SEQ ID NO: 55268 - DNA, 601 bp, Human
ccataagtgatttgaggcaagtgaaatactatcattacatattttggaatgtaatctgaaatacccataactttttataattgttttaaattattaaatataaatgtagaatttcaatcttgcatctggaataaagtaaaatactgaagaaacacagagatttatggaacatttttcattcttgtcttgtgttgggtttgctcacattttgtacaaataacattcgaaaaactagtccactttgattatttctaaaataaaatattaaagaaataaaattaaaaaataatttgttttacastttttgttaaagtgtcaccttcctgtttaattactctcaacctctaatgaaagtgtaggcaagttagagatcaaaggagcccatcatagagggccttgcttctcatggttacttcaagtaattatttgtttaatgttaatctaaaaaacaagctaatgattaaattttgaaatcaaggtatttttcttctaggttatttattcctactatgcaattaacttcattaaaacagattaaataagtagataatgggaaatgggggagagaggatttatttcagactctacattctggttcttc

SEQ ID NO: 55269 - DNA, 601 bp, Human
cagagtggttacaaggctctttacattttggtcttattacccctctgactcatttgatcctattacccctctgactctcacttcttctccttcaccttgctccagccaccatacctccttgctgtttcactcacagtcaaccttgctcccactttagagccttttctctcactagtccctctccctggatagctacatggctaattcccgcatcttcatgtccttgcttaagcaacatctcaacaagaccttcactacccttttaatattgcaactctcaccctgatacacctgatttctstcactttgttctgatttttttccatctcaattatcacttttagaaatgctatgtcatttcctcatttatttatgtgtggcttcttgtctgtttcctcccactaaaatataagcgtcataggggcaagaatctcgtttggctctgttttgctcactgatgtatccctagtgccaggaacagtgcctggcataaaataaacattcaaaaaagtatctgaggagttaatggacaaatttctcatagtgttccataagtgatttgaggcaagtgaaatactatcattacatattttggaatgta

SEQ ID NO: 55270 - DNA, 601 bp, Human
agtcaagtggaccttttaacaagtaaacttaattacatcacttccctgccagtccctctatggtcttcatatcattaagagtgaaatattctcagagtggttacaaggctctttacattttggtcttattacccctctgactcatttgatcctattacccctctgactctcacttcttctccttcaccttgctccagccaccatacctccttgctgtttcactcacagtcaaccttgctcccactttagagccttttctctcactagtccctctccctggatagctacatggctaattccygcatcttcatgtccttgcttaagcaacatctcaacaagaccttcactacccttttaatattgcaactctcaccctgatacacctgatttctgtcactttgttctgatttttttccatctcaattatcacttttagaaatgctatgtcatttcctcatttatttatgtgtggcttcttgtctgtttcctcccactaaaatataagcgtcataggggcaagaatctcgtttggctctgttttgctcactgatgtatccctagtgccaggaacagtgcctggcataaaataaacattcaaaaa

SEQ ID NO: 55271 - DNA, 601 bp, Human
agcttctaatcatcccccaaaatcctgtccacctgtagacttcattcttgactaatggtagttgcctgggttaaaaaataaaaaccaaaacaaaacaacaagaatcaaaatagttctttttttttctttcatttacacatccaatctgtcaggaaatctcacacactatcttcaataagtccaaaatgcacctgctctcacgcccttcataattggtcttggtccaagacaccatcatctctggcatgaattactgcaatatcctcattgctagtctccctgcttctgcccttgctcctcyatagcaaactagtcaagtggaccttttaacaagtaaacttaattacatcacttccctgccagtccctctatggtcttcatatcattaagagtgaaatattctcagagtggttacaaggctctttacattttggtcttattacccctctgactcatttgatcctattacccctctgactctcacttcttctccttcaccttgctccagccaccatacctccttgctgtttcactcacagtcaaccttgctcccactttagagccttttctctcactagtccctctccctggatagctacat

SEQ ID NO: 55272 - DNA, 601 bp, Human
tatttgtgcaataacttgtaacatcttccatgaggcagatactgggatcttacttagctgattttattttaataaatatcttaacctcaggataccacaagttgagcttctaatcatcccccaaaatcctgtccacctgtagacttcattcttgactaatggtagttgcctgggttaaaaaataaaaaccaaaacaaaacaacaagaatcaaaatagttctttttttttctttcatttacacatccaatctgtcaggaaatctcacacactatcttcaataagtccaaaatgcacctgctstcacgcccttcataattggtcttggtccaagacaccatcatctctggcatgaattactgcaatatcctcattgctagtctccctgcttctgcccttgctcctctatagcaaactagtcaagtggaccttttaacaagtaaacttaattacatcacttccctgccagtccctctatggtcttcatatcattaagagtgaaatattctcagagtggttacaaggctctttacattttggtcttattacccctctgactcatttgatcctattacccctctgactctcacttcttctccttca

SEQ ID NO: 55273 - DNA, 601 bp, Human
aactgtcaccacatagagccattaaaaaattactttggtgaaattttcctcctcatcctgtttctaaaggctacccaaaagatagcaatacatttttaagtgcaagaaaaaaaaatgtctgtcatcttccccatgacagggacattccaatagttggagaccctcagaggcttagtggagttacttatactaatatgaacaaatcttctatttacaataaaattaaaagtttggaatacttaaacaacggcactcttttttttcttcctaaatatcttagtgttctatgtctcattcagcrtagtttttttgtttgactgtgatacctactaatcatgtttcaatggtaaaaggttaattgagaaatgaaaataaagtgaataagccatattctaaatggtcatgtcaaaaatcattgggtattatattggaaaattactgccaaagactatgacttattaaggatttatgataattcagaaaagaagcaccaaagttgactgaaaattcctacctgccatcccagatcccggaagctcacatagagttcgtgcttcttacaggcttgtttttgctcacttgtgttataatctgaagataa

SEQ ID NO: 55274 - DNA, 601 bp, Human
taatatccatttactttttttctcccttgcctgccccctagacaagtgccaaaaagcaggctaagctaaatcagaagcaaagggcctagagactttacaaatgaacatccacctccccaaaagcctaaaaaggtgtctgtacatgaaaagtgaaatgcttaagtaaagggttgataataattttgatcagactggcagtctgcctatgatttgaaataattgagaaaagagccagaacacagttcccccatttcccacccacctattctggcccttccccctgaggagtttatgggaaatyccactgatgagtcttacgggatccacaaaaagcaaatacagcctcttacagttttggctgtacaacgtcctggctgaaatgatataggggccttgcatgtggacagaaacagcaggaaaaatgaggtgatctgacatgaacttgaaatttcctaaggcctcacaaaactaaaagttggatagtttctacaaatttctgatgctgcttatgtccttcatcagctttatcttccataacccacacatacatgattgataatcctgctgtttcaatggccttggcagcctaacggaaaaaaaa

SEQ ID NO: 55275 - DNA, 601 bp, Human
aagactgcaacaccccaacaggaccaggaagtacacgacaagctccgaggatggcttaagtccaacgtctctgatgcggtggctcagagcacccgtatcatttatggaggctctgtgactggggcaacctgcaaggagctggccagccagcctggcgtggatggcttccttgtgggtggtgcttccctcaagcccgaattcgtggacatcatcaatgccaaacaatgagccccatccatcttccctacccttcctgccaagccagggactaagcagcccagaagcccagtaactgcccttyccctgcacatgcttctgatggtgtcatctgctccttcctgtggcctcatccaaactgtaccttcctttactgtttatatcttcaccctgtaatggttgggaccaggccaatcccttctccacttactataatggttggaactaaatgtcaccaaggtggcttctccttggctgagagatggaaggggtgggatttgctcctgggttccctaggccctagtgagggcagaagagaaaccatcctctcccttcttacactgtgaggccaagatcccctcagaaggcaggagtgctgccctct

SEQ ID NO: 55276 - DNA, 601 bp, Human
tccaacgtctctgatgcggtggctcagagcacccgtatcatttatggaggctctgtgactggggcaacctgcaaggagctggccagccagcctggcgtggatggcttccttgtgggtggtgcttccctcaagcccgaattcgtggacatcatcaatgccaaacaatgagccccatccatcttccctacccttcctgccaagccagggactaagcagcccagaagcccagtaactgcccttcccctgcacatgcttctgatggtgtcatctgctccttcctgtggcctcatccaaactgtaycttcctttactgtttatatcttcaccctgtaatggttgggaccaggccaatcccttctccacttactataatggttggaactaaatgtcaccaaggtggcttctccttggctgagagatggaaggggtgggatttgctcctgggttccctaggccctagtgagggcagaagagaaaccatcctctcccttcttacactgtgaggccaagatcccctcagaaggcaggagtgctgccctctcccatggtgcccgtgcctctgtgctgtgtatgtgaaccacccacgtgagggaataaacct

SEQ ID NO: 55277 - DNA, 601 bp, Human
ccagcctggcgtggatggcttccttgtgggtggtgcttccctcaagcccgaattcgtggacatcatcaatgccaaacaatgagccccatccatcttccctacccttcctgccaagccagggactaagcagcccagaagcccagtaactgcccttcccctgcacatgcttctgatggtgtcatctgctccttcctgtggcctcatccaaactgtaccttcctttactgtttatatcttcaccctgtaatggttgggaccaggccaatcccttctccacttactataatggttggaactaaaygtcaccaaggtggcttctccttggctgagagatggaaggggtgggatttgctcctgggttccctaggccctagtgagggcagaagagaaaccatcctctcccttcttacactgtgaggccaagatcccctcagaaggcaggagtgctgccctctcccatggtgcccgtgcctctgtgctgtgtatgtgaaccacccacgtgagggaataaacctggcactaggtcttgtgaaaaaaaaaaaaaaaaagagagagctattgtacaacttggtgaaaataataactttaaaaacaatatatt

SEQ ID NO: 55278 - DNA, 601 bp, Human
cctcaagcccgaattcgtggacatcatcaatgccaaacaatgagccccatccatcttccctacccttcctgccaagccagggactaagcagcccagaagcccagtaactgcccttcccctgcacatgcttctgatggtgtcatctgctccttcctgtggcctcatccaaactgtaccttcctttactgtttatatcttcaccctgtaatggttgggaccaggccaatcccttctccacttactataatggttggaactaaatgtcaccaaggtggcttctccttggctgagagatggaagcggtgggatttgctcctgggttccctaggccctagtgagggcagaagagaaaccatcctctcccttcttacactgtgaggccaagatcccctcagaaggcaggagtgctgccctctcccatggtgcccgtgcctctgtgctgtgtatgtgaaccacccacgtgagggaataaacctggcactaggtcttgtgaaaaaaaaaaaaaaaaagagagagctattgtacaacttggtgaaaataataactttaaaaacaatatattatattcttgaaagtcacaaagaaaatagattttaactgt

SEQ ID NO: 55279 - DNA, 601 bp, Human
ctcaagcccgaattcgtggacatcatcaatgccaaacaatgagccccatccatcttccctacccttcctgccaagccagggactaagcagcccagaagcccagtaactgcccttcccctgcacatgcttctgatggtgtcatctgctccttcctgtggcctcatccaaactgtaccttcctttactgtttatatcttcaccctgtaatggttgggaccaggccaatcccttctccacttactataatggttggaactaaatgtcaccaaggtggcttctccttggctgagagatggaaggtgtgggatttgctcctgggttccctaggccctagtgagggcagaagagaaaccatcctctcccttcttacactgtgaggccaagatcccctcagaaggcaggagtgctgccctctcccatggtgcccgtgcctctgtgctgtgtatgtgaaccacccacgtgagggaataaacctggcactaggtcttgtgaaaaaaaaaaaaaaaaagagagagctattgtacaacttggtgaaaataataactttaaaaacaatatattatattcttgaaagtcacaaagaaaatagattttaactgtt

SEQ ID NO: 55280 - DNA, 601 bp, Human
cctcatccaaactgtaccttcctttactgtttatatcttcaccctgtaatggttgggaccaggccaatcccttctccacttactataatggttggaactaaatgtcaccaaggtggcttctccttggctgagagatggaaggggtgggatttgctcctgggttccctaggccctagtgagggcagaagagaaaccatcctctcccttcttacactgtgaggccaagatcccctcagaaggcaggagtgctgccctctcccatggtgcccgtgcctctgtgctgtgtatgtgaaccacccaygtgagggaataaacctggcactaggtcttgtgaaaaaaaaaaaaaaaaagagagagctattgtacaacttggtgaaaataataactttaaaaacaatatattatattcttgaaagtcacaaagaaaatagattttaactgttcttatgaaaaaaatgataaaatgtaaggtaatgtgtatgtgaattagctggatttaaccatttcacgatgtatacatatttcaaaacatcatgttttatatgataactgtatatatatgtttttgtcaatgaagaaaataaatttaaaagaggaaaat

SEQ ID NO: 55281 - DNA, 601 bp, Human; identical to SEQ ID NO: 27372

SEQ ID NO: 55282 - DNA, 601 bp, Human; identical to SEQ ID NO: 27373

SEQ ID NO: 55283 - DNA, 601 bp, Human; identical to SEQ ID NO: 27374

SEQ ID NO: 55284 - DNA, 601 bp, Human; identical to SEQ ID NO: 27375

SEQ ID NO: 55285 - DNA, 601 bp, Human; identical to SEQ ID NO: 27376

SEQ ID NO: 55286 - DNA, 601 bp, Human; identical to SEQ ID NO: 27377

SEQ ID NO: 55287 - DNA, 601 bp, Human
ttgtccagcttgccatatagatttggcctgaaattcaggtgattttgacaaatttgcaattaaaaatcgaaggtcataacttttttgagttacctttagcagcataaattttaaagatgtagtacggagtcagcttaaaaaatattaagggtctgataacttgactagaattaagattgtttccagtagctgtatgaatagttattgagtacctactatatgccaaatacgtgctcgtatatatcatgtgtattacatgtattgtctcatctaatcctaacaacaaccctagtctgaaccraattctcattttttcccaataaagaagctgagatttagggagttaagtaactagccttagactagtaagtattggagatggaattcaaactttagaaacttgaggttgctttaggaaccaactcctaggcactcagctacactatgctatctctaataatgctagtaacaatttagcctattgcgtcatttaagcactgtggcttagtgattaagaacacaactcatgaccgggtgcagtggcttacgcctgtaatcccagcactttgggaggctgaggcgggtggatcacctgaggaca

SEQ ID NO: 55288 - DNA, 601 bp, Human
ctttcctcaaagccagtcataaggattagtagaatgactggatgaatatagctagcagggtgccatatatgtaaaaggagaataatgcaatttttttttttcccgagacagagtctcgctctgttggccagcctggagtgcagtggcactatctcggctcactgcaacctccgcatcctgggctcaagcaattctcctgcctcagcctcccgagtagctgggattataggaatgcaaatttttaaaaagtattgtgtggagctgttttgccaggaattgctccctatgctttgagccactyttgtagagccaagatgtgaatgaatgttgagcattggtaggatgtgatcataacttcctgttgtatgctaaatagaacttgaatcagcctgacagatggctcactcctgtaatctcagcactttgggagaccaatgtgggaagattgcttgaggtcaggagttcaagaccagcctgggcaacatagctagactgcctctacaaaaaataaaattaaaatatttgttaggcatggtgacatgcacctgtagtcttagctactcaggaggctgagatcggaggattgcttaagcccaggagt

SEQ ID NO: 55289 - DNA, 601 bp, Human
tgacatgcacctgtagtcttagctactcaggaggctgagatcggaggattgcttaagcccaggagtttgaggctgcagtgagctatgattgccccaccgtactctagcctgggcaacagagtgaggtcctatccttaaaaaaaaaaacttgtatcacttaatcatttatttcttaggaaatgaaatacaggttagaattaggtttattctgttggctcatgcaagtcccttttcctaatgtttccagattaatgaaaaaaggtgagtctaacataataaacatactaataataaaaactgycatttatttagtgattagcatgtgccaggaaacatgtagtgaatttgtgcattatctcattttatcttcacaacaattttatgaaccagatatctgtattttattcccattttacagatattgagattgactcttggaaatgtgaagtaacttacctagtgtcatgcagctcataagtggcagatacagaattcacatagagtttgtttgacttcagagcatcttgactatagccacagcactgttctgcttctgtattaaagcaagacatatcatgactaaagaatagaaactaattat

SEQ ID NO: 55290 - DNA, 601 bp, Human
atttattaatactacatttatcatgtagtattcatgtgaaaacaatcttcatctgaaactgtcagtataaataaataaatggaaattaaatttaataacaccacctattagaatataaaatctttttttgagacagggtctctcattctgttgctcaggctggagtgcagtggcacaatctctgctcattgcaacctcctcctccaggattcaagcgattctcctgcctcagcctcctgagtggctgggattgcaggtgtgcaccaccacaccctgctaatttttttttttttttttttttgagacagagtcttgctcttgtcgctcaggctggagtgcaatggcaggatctcggctcactgcaacctccgcctcctggattcaagcaattcttctccttcagcctcccaagtagctgggattacaggtgcctgccaccacgcccagctaattttttgtatttttagtagagatggggtttcaccatgttggccaggctggtctcgatctcctgacctcgtgatctcccgccttggactcccaaagtgctgggattacaggagtgggccaccacgcccagccttttttttgtatttttagt

SEQ ID NO: 55291 - DNA, 601 bp, Human
gtatggatgatgtgtatggaggtaggtgacccctctcatttatattctgtaaacttgtattttacagataataaagtgagccctgaattaatattaacaatgttgccagtatttttgattatttattatagtttacaggtgtgacgggtacctctatgctctctcagacttgggaaaagaggagcataaacacttagggtccatgttctggaactgcttataagagagattatttatttatttatttgtttatttttagataggatctcactctgtcacccgggttggagtggagtggtaygatctcagctcactgcagtctccgcctcctgggttcaaatggttctcatgccctagcctcctgaatagctgggaccccaggcgcatgccaccacacctgactaatttttgtattttttgtagagacggggtttcgttgtgttggtcaggctggtctggaactcctgagctcaagtgatcctccctctccagcctcccaaagttttggaattacgggcgcgagccgcctcacctggccagagattatttactaagaatagtatttaaggtgctagaatgaatacgtagcacttgatcaact

SEQ ID NO: 55292 - DNA, 601 bp, Human
ttttatccctcagaaatttgcacaatgtttcgtattttatcttagtttcttatattagcttgttgagttgaaattatagaaatctgaaacctttagatacttttataatgcaatataaaagtctcatggcaaacataggtataaaatcctgaaaattgttgattttaaagaactttttacattatttttcaattttatattacctagggtcagtctacataccatcaaaagtctagtttctcattaatgacagaatattcttttgttgttgttgttgttattgagtatcaatatcaatttyttctttaagtttttatgtgtaaaaatcaaatctaggtgtatttataaaaaattattttaagtcaaatgatttaccttgtttcactgtaaaaatctggtagtttgatttatattgtctcattttatcgattaaaactttcagaactacataacaaaaagatcaaaaaagtacaaagaatagtaaccaattcttttccattacaaagtatattgaaatttattttgaacctttcattgacattgattcatttagtttagagttgagaactaggtagaaattgtttgaaaagatatgatgttt

SEQ ID NO: 55293 - DNA, 601 bp, Human
tttatcgattaaaactttcagaactacataacaaaaagatcaaaaaagtacaaagaatagtaaccaattcttttccattacaaagtatattgaaatttattttgaacctttcattgacattgattcatttagtttagagttgagaactaggtagaaattgtttgaaaagatatgatgtttcaggaagcatgtcacttagtggagattggatgttttgaaaaacattatttgcttcatgctacttttggatctcaagtgtgttttatttgactcttgagcctttagagaacaaaccttattwttctttactatatcagatagccgaactatttaaccaaactagaattgcttttagttgcattttccttggtgactgagagttccatatattttgtaagtgtttatacatagaaggaatgaatgtttcttaatgcaatgttcttttcattttatctgattcccttctgtctcaggtacaaacaggtacttcaggcaagtggcatctgaatttggattaaagatttcttttgttgattgttccaaaatcaaattactagaggcagcaattacaccagaaaccaaggtaactcagctcattttc

SEQ ID NO: 55294 - DNA, 601 bp, Human
aacagaagtcatcacagagattggactatagaaaaagaagcctgccaaacccccaaactcgaagcacagtggctttgccgggctgtaagggatgctgcccagatactagttagatgtggagaataggccacaagcaatctttagcttccatcctgggaaatttgtatgccaccggaaggtgttttgtgtctgagtgaatggcatatgtgatattctttcttgggaccttatttaaattctgtgtggataaaagaaggaccagtgtcttttataagtcagctgtttacaactttttgctaaygattaaaaggttagaattgtacccaagattatgttgcaatgaatgctaaaaaataaatatcttttcatgtacaaataattactttgcacattaacatggttgagcttttggtaattaaggtttgtttccagaagaacttgttttttatcttgcttgggagaaaagtcacattaaaatagctggtctgagtcttttttttttttttttttttgagacggagtctcaccctgtcacccaggctgtagtgcaatggcgcaatcccagctcactgcaagctctgcctcttgggttcaaatgatt

SEQ ID NO: 55295 - DNA, 601 bp, Human
ttcaagatttttgtagaatatgtattatttaaccatcttatcttttccagagtaaaactctaaagtcagaagagtttaaaccagatctcttgcccatttaaataacaggtaataaaaaaagaatcagctgggcacagtggctcatgcctgtaataccagcactttgggaggctgaggcaggaggatcacttgaaccaggagttcaagatatatagcgagaccctttctctgcaaaaaaaaaaaaataataataataattggccgagcatggtggcacatgcctgtagttccaactactggrgaggctgaggtaggaggatcacttgggcctgaaaggtcgaagctgccgttagctgtgatcatgccactgcactctagcctgggcaacaaagtgagaccctgctgcttaaaaaaaaaaaaagaaagtaattcagtacaatggcatttcgttcaacaaatagaattcttttctttggtctttttgataactatcaagcatctaccatgtgtctgaattgtggtaggttttgagatataaaggtcattgttactttttaagtaggcggtaaccacgttttctgttgtgggtgtcacttttctt

SEQ ID NO: 55296 - DNA, 601 bp, Human
gaatcagctgggcacagtggctcatgcctgtaataccagcactttgggaggctgaggcaggaggatcacttgaaccaggagttcaagatatatagcgagaccctttctctgcaaaaaaaaaaaaataataataataattggccgagcatggtggcacatgcctgtagttccaactactggggaggctgaggtaggaggatcacttgggcctgaaaggtcgaagctgccgttagctgtgatcatgccactgcactctagcctgggcaacaaagtgagaccctgctgcttaaaaaaaaaaaaagaaagtaattcagtacaatggcatttcgttcaacaaatagaattcttttctttggtctttttgataactatcaagcatctaccatgtgtctgaattgtggtaggttttgagatataaaggtcattgttactttttaagtaggcggtaaccacgttttctgttgtgggtgtcacttttcttctttagtctaaagcccatgctcttcaagacttagatacttattctatagtttctagagtttctggcattaagttcatattaaatatatttttggcatcatagggataattctctttcatt

SEQ ID NO: 55297 - DNA, 601 bp, Human
ctgaaaggtcgaagctgccgttagctgtgatcatgccactgcactctagcctgggcaacaaagtgagaccctgctgcttaaaaaaaaaaaaagaaagtaattcagtacaatggcatttcgttcaacaaatagaattcttttctttggtctttttgataactatcaagcatctaccatgtgtctgaattgtggtaggttttgagatataaaggtcattgttactttttaagtaggcggtaaccacgttttctgttgtgggtgtcacttttcttctttagtctaaagcccatgctcttcaagwcttagatacttattctatagtttctagagtttctggcattaagttcatattaaatatatttttggcatcatagggataattctctttcattaaaattctaggatgtattcttacacaatctatgttattcatctctgagacaaaatttccagacactgagctgtctttggaatacactttcttttttaagaaaagtacaataattaactttagtacttttctgtttacatgtacgttatctcacttgatctttacaaaaaattctgtaagataggtattaccaacccaattatacagatc

SEQ ID NO: 55298 - DNA, 601 bp, Human
cttagatacttattctatagtttctagagtttctggcattaagttcatattaaatatatttttggcatcatagggataattctctttcattaaaattctaggatgtattcttacacaatctatgttattcatctctgagacaaaatttccagacactgagctgtctttggaatacactttcttttttaagaaaagtacaataattaactttagtacttttctgtttacatgtacgttatctcacttgatctttacaaaaaattctgtaagataggtattaccaacccaattatacagatcrataggatacattacatacctacggcttcagaaatttgcaggtaaggctgggattcagatttgaacctcccaacatcatcatccatgtgtttccattatacaatgtagcttcccagattgttacaatatatgagatgtatgtttgtaaagtatatttttacaaactactgttatttgctgaattattttagcttgtttggatcgaaacccccacaaaccccacccagaaggtgattgacattgaaggctgtgcacatattgtccataagcatggagacattattttggtcgtggataacac

SEQ ID NO: 55299 - DNA, 601 bp, Human
tatacatattatttctcttcttctagtttttattccttcagcactccatatactatgcctagatctctttaacttattattattttgaacttttactttatttattttacattatagctgtaagtatttatagtgctcttatgttagtctctttgggtggccataacagaatactataaactgggtggcttacaaacagcaatttatttctcacagttctgaaggctgggaagtcctcaatcaaagtgccagcagattcagtaccggtgagggcccactttctggtccatagatggagccktctcgctgtgtcctcacatggtagaagagacaaggcagttatctggggcctcttttatcagggcactgtattagtccattctcacactgctataaagaaataatccgagactgcgtaatttataaagaaagaggtttaattggctcacagttctgcaggctgtacagaaagcatgatgctggcatctgcttggcttctggggaggcctcagaaaacttacaataatggcagaaggcaaaggggagcaggcacaacacatgaccagagtaggagcaagagagagaacgagggggaaggtgc

SEQ ID NO: 55300 - DNA, 601 bp, Human
gatttcttgtaatacctaatacaatgtacatgctttataaatggttgttacactatattgtttaggaactaatgacaagaaaaaagtctgtacatgttcaatacagacacaactgttcatctatttttccaagtatttttttacccatggttggttgaatccatggatgtgaaacccacacataggaagggctgagtaattaggaatcaagatcatgacaaaccccaaatgtaaataatcacagcatacgtcatgaggttttaatgattaaaaatctaagcagatgagtttatacttactstacataaaaattgctgaatgttcatttcaactattttatgtgtttaatgagtcataaaatactagagtctctactgtaggtaataaatttagagtcctgtcagcaattgctataaagaaacaggttcaagagaccagttgacctgggcttatctgcgctttccaagaaacttttgccttcagattcaatactggattcaatactttacatttttctttggtgggagggaggcaaaggagaaataatatcagagatcctggaaaattttaagatgcacatacttttgcaaagttagtattg

SEQ ID NO: 55301 - DNA, 601 bp, Human
ttatagcatagcaaggctttatgatatgatataagaaatgagtttttttattttcatgtccatcttaattataatcataatttgataaagccctagtgaatttttagtttcaagacttaatggtttttttttcttttttaaaattacatttgaaatgagggctttcatatactataccttttatatcacgaatgatggttaattttaaatagcacttacagtataaacttacatttttcaatagatgtctaaacaccatttcctatttacattgcttagtttatctccagtatagttaaakattaagccattgtaacttgacaggtaaaatataaacatgattaggaataaaaatgtcctccacaagggaaactgaaacttattgcttgataagtgtcctttggtttataaaaagtagaaatgaagtatatatcctggaggcatgtgaaatcattgaccgctttgcacaaaggctaaatagaatattagtagaatattcagtaataataggacttgaactgctgtttttctctgtatgttaaaataatttttcaaagaaatacaaggttaggctatgaacaatttatgattttattaaaat

SEQ ID NO: 55302 - DNA, 601 bp, Human
cctgaggttctctctctctcttttttttttttttttttttgagacggagtttcactcttgcccaggctggagtgcaatgatgcaatttcagctcactgcaacctctgcctcccgggttcaagtgattctcttgcctcagcctcccgagtagctgggattacaggtgcccgccaccacgcccagctattttttgtatttttagtaaagacggggtttcaccatgttggccagtctggtctcgaactcctgacctcaggtgatctgcctgccttggcctctcaaagtgctgggattacaggcrtgagccactacgcccagccccctgaggttctctcctgtatttctctcctgtatttttattccttcacctcttccagcatctagaaagtcttctgtggagttggctgacttacatcttactttttgaatttatttttaccagtcttttaagctgtggtggtcctaagtagttcttttctttttagatccttttgagggttctagcatctagaatatatagaaaaattaagactggaatttcactaggaaattcacaaggaatttagagaaaccaaagcgaaatacatatgaaactaaatgc

SEQ ID NO: 55303 - DNA, 601 bp, Human
taacagaaagctgccagattagtcaaagtgttcctggtgtcaccttaatttaatacatttaccaaagtaacttttaaaacatttgtaaagttttatgacactatcacactcaacataaaaacagtggttttttttttttcccctattccagcagggatttaaaggatgtatttcataagtgatatatattaacaaggaagtatgtataacttgggaagcatttagagatttttttatttaagtggtaaccacagagcaaagtctcaaatgcaataatttttttttttttttttttttttttaggcagagtttcactcttttgcccagactggagttcagtggcatgatctcggctcactgcaacctccacctcctgggttgaagtgatactcctgcttcagccttccaggtagctgggattacaggtgcgtgccaccatgctcagctaatttttgtatttttagtagagatggggtttcactagttggccaggctggtctcgaactcctgacctcggtgatccgcctgacttggcctcccaaagtgctgggattacaggcatgagccactgtgcctggcctaaaaacatttatttttagat

SEQ ID NO: 55304 - DNA, 601 bp, Human
cacaggaacgtgttcgcagcttcactcttggatttgcatcagaaacagtgaggggaggtaaaaggtgcttggatctagatttgagatctgcttccaccaattagttaacctttaaacttccattttttaacacataaaatgagattaataattaatgattttcggcctggtgcaatggctgacgcctgcaattccagtactttgggaggccgaggtgggccacttgaggtcaggagttcaagaccagcctggccaacatggtgaaaccctgtctctcctaaaaaaaaaaaaaattatccgrgtgtggtggtgtacacctataatcccagttacttgggtggctaaggcacgagaatcgcttgaacccaagtgatggaggttgcagtgagccgaggttgcagcaagccaagatcgcaccactgcactccagcctgggtgatgcagcgagactctgtctcaaaaaagaaccaaaacaacaacaaaaaattaatgattatcatttattgattacctgtccccccaagcattcctgatatatatattacctttattatatgctactatgaccatatgttgtaattactgcagggttaagtcaaca

SEQ ID NO: 55305 - DNA, 601 bp, Human
tatagactattttgttttgtgaattgtcatcgcttttacctcctgctttgttatttaggttaaagaaaatatctcattcttcttggtttcccaatttttactgcagtgcttgacatattatgggtggttttcctttacatctgttgatgatggtaatgggctgctagatcgtttgaaaaatccttccaggcctctatgccaggagttatattgtggaattctgaatgcttactggttgctactagtgattcttggtcatctttctccgatgtgcctcagaaggtctagctctggattgatycagaggaaactaattatgacaggctcttggtccaagagacctcttataagtagcaatccagtaggttggtcatggagtacatgatttctggccaaacttcatttaggcaggtattaaaatatacacgttggggaggctatgccttaccctactgcatgggggtacttgacacacactttcagtatttggattgagcatatcttaccaatggtataaacaggataaaaacaatcttgcttttcatttaaaatcatagctagaagagataagtttcgtaattttctctttttttgcctgtga

SEQ ID NO: 55306 - DNA, 601 bp, Human
ttttcctttacatctgttgatgatggtaatgggctgctagatcgtttgaaaaatccttccaggcctctatgccaggagttatattgtggaattctgaatgcttactggttgctactagtgattcttggtcatctttctccgatgtgcctcagaaggtctagctctggattgatccagaggaaactaattatgacaggctcttggtccaagagacctcttataagtagcaatccagtaggttggtcatggagtacatgatttctggccaaacttcatttaggcaggtattaaaatatacacrttggggaggctatgccttaccctactgcatgggggtacttgacacacactttcagtatttggattgagcatatcttaccaatggtataaacaggataaaaacaatcttgcttttcatttaaaatcatagctagaagagataagtttcgtaattttctctttttttgcctgtgaattataggggtatgcaaaatttgatatttggaccagaaaaatgttgagggtaattgcagtttatgagacagaaacatgcctccactgacacaatatagtgatcaaaaatttgctcatgtcttctttc

SEQ ID NO: 55307 - DNA, 601 bp, Human
gctgcacgaattactattaacagtttatgaactgaggcttttctaaattctaaccctgaattattacatgtagtgtttgaggtaaacaactacttatctctgtaaaatgagaaagttgttccttaggctagcatttagatcccttcttctattgtaagtagaaccagaattatgatttacgatctggtattacaaggctttttttgtagaattttaacttacagtctccctatgcaaactgatgtttctttcctgattaaataactttccaatgttaccatttcttaatcatatgcacttyagactacctagcaagaaatcctaaccattacatagaattggtagtgattaattggtctctggtggtccctgatttcagacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatt

SEQ ID NO: 55308 - DNA, 601 bp, Human
tttccctagataagtaatatatcacatttaacaaatacaccagtttcttacaaatcttttgtatcaactgatcctgaggacaaactcatgaggttgtgaaatagaaactgtttcttccttccccccaaaacatcatgagtttatttacatattttccaccctccaacttttctaggtagcaatgtgttttggccagacgcagggcagggagaggtggttgtgtgagtgactggactaactctacgtttatgtccgtataccacttgccaatgtactggtgtaggcatatacatataacacratttcaaccaatgataaataagaggtgttttcagggtggtgctgtgggactccttagaaagtttccattgctagtaaaaagagatacacatgaatagttcatactctctttctagtgggcattgcagtgtctgcatgtgattcctggaactgcagcagccatcttgagagtatgaggggcactaatattagagggcaagttgataggcagagtatggcagtacagaaaaatggaacaaactctggcccttactagtgtcattatttggctgaattaattaactttggagataatcaacct

SEQ ID NO: 55309 - DNA, 601 bp, Human
agcaattccattccttgatatttatccaaggaaaatgaaagcatttgtctacccaaagacttgtttacaaatattcacagcagaggaagtgggagcaaacgttgaagacacttctttccactctgactcagtactaggtatttttccacacctagccttttccttcttcctcccccaaacccctgggtccctaacactgccagagccttttgtttggggctcccttgtcagtgagaaaacacagacccccgaagcctgtgctggtccaatctaccatggggaaaaatgtaactgggaagtgaggacagtcctcagcactttctccggtttagcttcttgtttatataatcacactaagtgattaaaggcttgactattattttgattttggcttggtgtctgacacctagcagctcggctgagctcctgacaatatgattgtttaaagagatacaaattattttttgatgaaatttaacattcattactttaaaaaagattttcagcaaatagaaatgaaaaaggaccacctcgatctgtaaagtttatggaaaacctacagctgatataatagcaaaatattgagtatcttccttaaaag

SEQ ID NO: 55310 - DNA, 601 bp, Human
caatttccagacttgagccagtttacagactcagaaccccttgaatgaaggggaggctgggtccccttgaggaagcaccccactacattaccaacaatttatgcagtgaatctttttcccatccttccccaaggagacctctgaccttttaccatggtaactatgcattggggagagggaaatggtcagatatttcggggactactggacactggctctgagctgatgttgattccaggggacccaaaatgtcattgtggtcctccagttaaagtaggggcttatgaaagtcaggtaattratggagttttagctcaggtccaacttactgtggttccagagggtccccagactcatcctgtggtcatttccccagttctggaatgcataattggcatagacatacttggcagctggcagaacccccacgttggatccctgactggtaaggtgagggctactatggtggaaaaggccaaatggaagccattagagcagcctctacctagaaaaatagtaagtcaacaacaatatcgtatccgtggagagattgcagagattagtgccaagatcaaggacttgaaatatgcaggggtggtga

SEQ ID NO: 55311 - DNA, 601 bp, Human
gtgagccaccatgcccggccggaatgttgagttttataaaaagccttttctgcattatctattgagatcatcatgtggacttgtctttagttgtgtttacatgatgaatcacatttcttgatttgtgtatgttgaaccaaccttgcatcccagggatgaagcctacttgattgcagtggattagctttttgttgtgctgctagattttgtgtgcaactatattgttgaggatttttgcactgatgttcagggacattggcctgaagttttctttttttttttttcttttttttttttttgktgttgttgttgtgtttctgccaggttttggtatcaggataatgctggcctcatagaatgagttgggaaggagtccctcctcctcaaatttttggaatagtttcagtaggaacagtgtcatcccttctttgtacatctggtagaattcggctgtgaatccacctggtcctgggcttttttttgttggtaggctatttattactgattcaactttggagcttgttattggtttgttcagggaatccatttcttcctggttcagtcttgggagggtgtatgtgaatttatttttatatttctt

SEQ ID NO: 55312 - DNA, 601 bp, Human
gaaggcattgattataatttagttaaaagcttgcttttctttattagatcttctgcataatcttgggatgtgggttggccacaaacttgacttccagacttattataaaggtacagtaattaagacggtgtggtatcatcttaagaatcagcaaataaatcaatgaaacagaatagagatagtgtacttgattttcaacaaaggtgccaaagcaatccaatagggaaaaaacatattccaaaaatggtactggaatactggatatccctattggaaaaaaatgagcctgaatccctacttyattactaagtgcaaaaattatttgagaaagatcatcgattaaaacataaaaggtcatggattagaaacataaaacataaaaacctacaaaacttttacaggaacacagaggaaaaaacctttataaacaaacatataaaaaacaaaacatgacttgagattaagcaggattttttggacagggcaaagacaggaaaaaccacaaaaagtggataaataactcatcaaaatatacaattattaatatgaataagcaagccagagactgaaagaagatattcacaatacatacatctgacaa

SEQ ID NO: 55313 - DNA, 601 bp, Human
tatgccagtgtaaatggttccctggagctgagcagtgcaaaactagtgcagtggtcctgaaagcccaagtttgaccaagagttccaggaaacattacctaatgctaggtctaaatattcctaaggattatgcttcaaattatacaaattattagagcaattttcccaggaaatggtaatgactttaaactgactttaaaatgactttaatggttcagataaacaagctgaaaatgctccaagtgaatcattattcatattataaagatgaaggcattgattataatttagttaaaagcttscttttctttattagatcttctgcataatcttgggatgtgggttggccacaaacttgacttccagacttattataaaggtacagtaattaagacggtgtggtatcatcttaagaatcagcaaataaatcaatgaaacagaatagagatagtgtacttgattttcaacaaaggtgccaaagcaatccaatagggaaaaaacatattccaaaaatggtactggaatactggatatccctattggaaaaaaatgagcctgaatccctacttcattactaagtgcaaaaattatttgagaaagat

SEQ ID NO: 55314 - DNA, 601 bp, Human
attttcaaaaataaaatgaaatatacattctcaagttatattattatatctaacctggcacataaggaattatatacatgggattgatgtgttaagaagcttgagttaaaagcattgcaaacaacaaaaatgatgatgaacatttgtatatttctttgcaatttataaataatatgacatatacttatctggtcctctcagtaataatgctctgatgtatgcaggaatatttacctatgttttcagatatagaaactgaggtttagaaggcttaaatgaatatttagattagaatagcacygtaggctaacacttgaactccatcttttgctttcaaatgccacattccttccattactaactaatttcactggaagaaattatccaagacttccaactaaaaattagtggtcgagaatggtgaagtaaaaaacatgagtaacataataaaatcatcagattttaagctagaatttatttctggatgttatgaaaatgtccagtatcatttagaatgatttacttccagataaatgagttaatcaacagatatagccttactgtaaaaagaaaactgggaaataagatgaaccttaatttt

SEQ ID NO: 55315 - DNA, 601 bp, Human
aagctgaaacaaggccacttcagaatgataaaaggtttggttcccaaggaagatattaaaataaattgaaataaacaaattgaaataaacaaatccacaatcagagtcggagattttaaacagacctctaatggctgattgaacatgtaaagaaaataaactgtaaaaatgtagaaagatttgaacatgactaagaaacgtgttctaatggacatatataatacaatgcctcatgaaatgaaagacacacatttatatcaggcacatccgggatatttataaaaactaaccatatactggrccttaaggcttgtctaaacaaatctcgaaggatggaatttgtacagaacatgatctctaaccataatgtaattaagctagaacaaaaagcattaaacctaaccaaactcttccagaaaacagaagaggagagataaacctagcataaccattatatcaaacctaaacagaactgagtctgaaagaaaaattacaggccaatcttaccaatgaatacagatgcaaaaatattaaataaaatgtgataaagttggatttaacctagggcctagccattattgaaagaaaagaaaaagtttgt

SEQ ID NO: 55316 - DNA, 601 bp, Human
tcttcagtccctgggcagctggcatggtgtgggtgatggcagtagcagtggacggacaattgtctgggtcttgagcagtgtgcactgacgttgatagtagctgcaatgggctgggtaggcccatgtccaggcccatatgtggtgcttgcaggcaggtaccagctgaagtggtagtggttgggagtttaggcccaacctcaggcccccaggaggactggggcccacggtggtggattgggttagataatccccaggacctcaggctatgtgttctctctcagagcagaagctcggctctgcrgcttgtgctcaggaccccaatggtgagtgcaagcaccagctctgttaggtgggggtagggtaatattcagtatccaggtggagtgttcaggtgaggggtggtagcagccatgctgagactctgccactggaaagagtggggctgccttggtagcctcagcttgggctggtgggtaggcaacatgcatctctttcatactgtggcatttaaaatatagaattgaaagaaatacacattggtaatatgatgtaagtgagatagggtgaaagaagttaaagcattcttaaggtctttgtaatt

SEQ ID NO: 55317 - DNA, 601 bp, Human
catggacaaatcatttccatactctttggctgttttctcatttgtaaaatggcatacatagacaatatgatctccttaggtagcttccagatttcactctctgtgattctgtaggatttgccaggtaaaaatgagtggtatagtcaataattgctatcaaagttaagaaaaacagttcccttgagcctgaaagtattgacaaaggctctgtggagaaagtgaatacctggacttcaacttggaaggatagacagaaagctacctagaggaaaaattgccatgctaagcatgattaaaatayaaaattgattggggcaaagaagtaaaatgaacattaagtacctcagtctaaaaggctaagttcatatgaaaaaaactaatttttcgaaatcactgaagatgaaagaagcaagaaaatgatgaaactacagtaatattttaaatttttattgtgggagaaagtaataaatgagtaaggaaagttttgtattatcacacagtaaaacacatcacaacactacaataattaaaatagtatggtattcagttaacaaaaataggaaggccagaaacagatttacacatgcaagcacgtgcacac

SEQ ID NO: 55318 - DNA, 601 bp, Human
aaccatgattgtggatttgtctatttctccctttaattctctcagttttggcttcatgtattttgaatctctgttgttacacttgaaacagtgctttctgttaaataaatagaggaaaagagatataatcctcttatatttacccgcatttacaccatttctattactttccattccttcctataaattcacacatccatctagtgagatttccccttagcctgaagaaatttctttatatttattttaatgcaagcctcttcatgaataattccctatttttattatgagaaaatgtctyaaatctgcctttatttttgaagtatattttaactgtatataataattgtgcttgcaaatttttttttagctctctaacgatgttttcacattgctgtacattatccaatctttttgatgagaagtctgtcatcattcgtataattgttccactatacacggtgtaaatttttctctagcttttttcaagattttctttcaatctctattttttcagtagtttcattatgatgggcctaggtatagttttcttcgtttttactttgcttgaggtttgctggacttcttatatctgtaaatt

SEQ ID NO: 55319 - DNA, 601 bp, Human
caaatagtaggaattttctacaaatattattatttatttcttactcattccattgtaataagagaatatactgatatttttaatcttttggtatttagagggtctcattttgtgacctatcacatagtctacactggtgaaaattccttggctcttgaaaaaaattatattctgtagttgtttgatgttgggctctttttatgtcaataaagcctaagttgttaagagtggaacaactgaaataggagtgttagaatcacaaccatgattgtggatttgtctatttctccctttaattctstcagttttggcttcatgtattttgaatctctgttgttacacttgaaacagtgctttctgttaaataaatagaggaaaagagatataatcctcttatatttacccgcatttacaccatttctattactttccattccttcctataaattcacacatccatctagtgagatttccccttagcctgaagaaatttctttatatttattttaatgcaagcctcttcatgaataattccctatttttattatgagaaaatgtcttaaatctgcctttatttttgaagtatattttaactgtatat

SEQ ID NO: 55320 - DNA, 601 bp, Human
ttttctttttcttgtcttactgtactggcaatgttgaatagaaatggtgagagcagatgttcctgaagttaggagaaaggaactcagtctttctccattgagtacaattttagctttagggatttggcatatgccctttaaggttgaggaaatctcttctactcctagtttactaagagtaatttttattagaaatggatattgaatgtcattaaatgcattctttgttatcgattaagataattattgggggtttatatatttatgctctaaattttgttttggtctttaatatagtgartcacaatttttgattttcaaatgttaaaccaaacatggattcctggcatagatcccacttggtcacaaccaatcatccactttatatgttgttggatttgatttgctaaaattttaataatttctgtatctatgctcatgagggatactagtctgtcgttttctgtttctgtaattttgtcgttgcttggttttggtatcagggctttgcttgcttcacaaaattaattggagggcattcaatatccctctattttctgaataaatttatgcaagattgacactgtcacttgcaaaaatg

SEQ ID NO: 55321 - DNA, 601 bp, Human
tgaggtcttacacgtaagtctttaatccatcttgagttaatttttgtatatggtgaaaggcaggggtctgatttcattcttctacatatggctagtcagttatcacagcaccatttattgaacagggaattatttccccattgctcatacaaccgatttttatttactgatcttagtttgttggttttgtttattctgtgatctttctaaactcacttataagttttaagagtattttagcatatgtcataacattttctacattgaaaaatcatgtcatcatcaaaaaaacaaaaaaaawtatttcttccttttcaatacggatactttttcttttctttttcttgtcttactgtactggcaatgttgaatagaaatggtgagagcagatgttcctgaagttaggagaaaggaactcagtctttctccattgagtacaattttagctttagggatttggcatatgccctttaaggttgaggaaatctcttctactcctagtttactaagagtaatttttattagaaatggatattgaatgtcattaaatgcattctttgttatcgattaagataattattgggggtttatatatttatgc

SEQ ID NO: 55322 - DNA, 601 bp, Human
ataccctcttaacttgagtgacatgaacgtactgcctatcaaaattaactaaatttgattttttagaataaaaaacctttggaaaattgcgagtgtgcatattaaagaatactcctacaagttttttgacttagtatatatgttaacatacacatgtaccagaatacccaatcacataaaaggtataaattcagccatttggggaaacatggagtcatactggatgcagaagtacacaatgcttcaaattcagaatcctgaaagtttagaaagcagtttaccttctctctttttagataaytgaaatgaaatcacaaaaaaagattggactgctttctaaacttaacctgcatacaagcacacctttataaatgatcatgttattgtagaatagtcctagttaatactaaattatttcaaaggaattctaatttaggtaacttattttaatttaatacaaatctttattaaaactaccatctctcagcaagcatggggtgcaagaaactcagtccctaatcccaagtaaactcagatacaagaaatgtaacttttcctgtagcttaacttaatttctcttccaaaacacctatttctataa

SEQ ID NO: 55323 - DNA, 601 bp, Human
tgagggacatggagtatccaagcaatctcaaacacctgcaatggaaactgagaaaatagccaattctttttagtctcaatagtgcttagaatatagaatatagttaatgttaactatagggatattaaaaattatttttattattataaagagctttaatagtatattgatatcaatttttaacagaaaaataaagaattatgtctgctgaaataaactaagggttttaagtttcttccctgcttctccagtaccctatccgtatcagtcacaagatgcacataaggcaagctacatgatrttaagaagtatatagcaaacagaatgtttttaatgtttgtaaaattatgcatctactaaatttctgatgatcaaatggttatctttgtcacacacgtaaacatgctatgtcaccaactatatattttattttcaaattagagagcttcatcaatctatgaacacagtatttcagagctaaaagggaccttggagattgttctctttagctctcttaagttaacaaatgaagaaactgagggtcagaaagctaaatgtgattttttaaaagccagtactattttttaaactacagtttcct

SEQ ID NO: 55324 - DNA, 601 bp, Human
cactcttggagttctagttgagggacatggagtatccaagcaatctcaaacacctgcaatggaaactgagaaaatagccaattctttttagtctcaatagtgcttagaatatagaatatagttaatgttaactatagggatattaaaaattatttttattattataaagagctttaatagtatattgatatcaatttttaacagaaaaataaagaattatgtctgctgaaataaactaagggttttaagtttcttccctgcttctccagtaccctatccgtatcagtcacaagatgcacayaaggcaagctacatgatgttaagaagtatatagcaaacagaatgtttttaatgtttgtaaaattatgcatctactaaatttctgatgatcaaatggttatctttgtcacacacgtaaacatgctatgtcaccaactatatattttattttcaaattagagagcttcatcaatctatgaacacagtatttcagagctaaaagggaccttggagattgttctctttagctctcttaagttaacaaatgaagaaactgagggtcagaaagctaaatgtgattttttaaaagccagtactattt

SEQ ID NO: 55325 - DNA, 601 bp, Human
atttactagctatgtaatcttcaccaagttaattaacttctctggtttatatagaaagaataaagatttttggaccagagttttaaggtatttctagttgtaatattctttgatttttaagattcctatttctagccaactacaaatactctataaagaagataatagaaaaaaaatggtagcactagaatcagtgaaaaaattacttttttttttttttttttttttacatttagccatgtttcttctcataaaactagtcaaggacataaatgtagtgccatttctattagtgacagayattttagatgtgatggacttaactatcatcaataatagctagtaaatctgaattgctttcatgagcttgctcttagaagctaatgaaagacaagttcagataaaacttttatccttgattagtagctacaacagcatgaaaaaaaccacaatattcaatattcaagtgttactctactactggccaagacacaaggatggtctttttcatacttctattctgactctaaacttgttcatagaagccatccatctatatacaaatactatttgacaaaaaatcattttatcggagtatttc

SEQ ID NO: 55326 - DNA, 601 bp, Human
tacttccatgctgaccatggaactaatgtgataaaaagtatacatggattagtaaggatgctataagaacaaggccataaatgcaatctcatttacctggaggtccaggaaggccaggtggaccctgtattccaggaaatcctcgctctcctttttctccaggcaacccaggcaacccaatgtttcctttttctcctatagttataccagtcccaggtctaggaattacctttattaccaaagaaaaaaaaaataaagaaatgcaaagaagaaaagccttgttctcctgaaaacattatgrgagctacatatgattacaatgtcatcattttcacatagtttatgagtcacattttgtatcactcccatcctccaactgattagaaaatgtccaatacaagtaacaacattaccatgttcctgagcccgaagcatataaaactaaaagtatttttgatgtctcttctcctataattcacattcaattcattccaatctcctaagcctgacaattctttacagaaaacgtctctccaatttgctcccttgatttctgctgccacagctatattatcaactcacacttagagtaatagaagca

SEQ ID NO: 55327 - DNA, 601 bp, Human
caagcagaccagattgctagagcagaatgagggaggggaacaaggtcagaaagttgacagtttataacgaatggcatataggcatataagaaatataaaggctgtggtttttactgtgagtgaaatgagaatctagtagaaaattttaaaaagaaaagcaacatgttataacttaagtttttaagggatgactctagctgctatgttaatagcctctaaaggcaatgatggaaacagggtaaccacttaagtggctactgttgcaatgatctaggagagagatggtggtagctcatttcaragtgactgcaatgaaaatgatcagaaccggttagattatagacatatctgaaagtagagccaatgagatgttctcatggatcatatatgaaatacaaaagaagaggggaatcaaggatgactccaaggttttcagcatgagcaactagaaggctaaagtggcctgctttttaagtaagaagctgaagatgtgagtgcagcaactatggggaggaggtggcagaaatcaagacttcaatttgatcaggatgtcaagttcaaaatgttgactaggcaaatggatacacaaatctagaggaaa

SEQ ID NO: 55328 - DNA, 601 bp, Human
atcccagcactttgggagcccgaggcaggcagatagcttgagatgaggagttcaagaccagcctggccaacatggcgaaaccccatctctacagaaaaaataaaaacattagccaggcatggtggtgcatgcctgtacttgccagctacccaggaggctaaagtgggaggattgcttgagccttaggagattgaggctgcagtgagctgtgattgcaccactgcactccagattgggcaacagagcaagaccctgtctaaaaaaattaaatatacattaaatatttaatatgctttaaaakatattatttttataggaaaaaatagaactacataagtggtattgagtatgccagggaagggtggggggttgcaattttaaatagggtagtcaggatagacttgattgagaagttgttatatgataaaacttaaaggacatgacatgtgcataagagtgtagaacatcccaagcagaaagaatagccatgtttggtatatacaaggaacagcaagcagaccagattgctagagcagaatgagggaggggaacaaggtcagaaagttgacagtttataacgaatggcatataggcatataag

SEQ ID NO: 55329 - DNA, 601 bp, Human
caagtgctcctttgaaacctggaagtcctggtggcccaggtggcccaggtaatgcaaatcctggttcacccttgagcatacacatgacaaaacacaacaaaaactcccatgacttttctgtccttattgtttgccacagagaatttaatgccgaaaatacaagacaatacttttccttccatggggggagaggagaagataattaaataaaaagtaattggtatgttggagaaaacatatggaaggattggaaacagggtttagtaaaacaaattagatgatttggactggtttcaggataaaaaaaaaaaactgagagagcatgagattaaagaacagactacccttgtagggaaatatgattataggctgagtattagataatactaaacaattatttttaattttactaagtatgataacaacattgtggtttttgtataaaatgtcaatttatttagagatgagtgctgatgcatttataagtgaaatgatactgtgttgagatttgggtaaaatatttaagcaaagtaaaaaggactagatgaagcaaatgttataaaatcataataattttgaatctgggtgatggatatgtgaa

SEQ ID NO: 55330 - DNA, 601 bp, Human
gatccgcccaccttggcctcccaaagtgctgggattacaggagtgagccaccgtgccgggccatgattttattatctattcaatgaaataaaagacaaaaataatcaatgaaggattgaaaaaaatgtgtagcagtaacagaatggcagcatagggtttccagttaattgggcttatcacccataaactttcccaaaggtgtcaatttctataaaagttaaaagcaagttgagatgcagtgacagcctccataccttttggtccagggagcccatctaagccagtgcgtcctggaggaccyggaggtcctgggaaaccacgatcaccttttggaccaagtgctcctttgaaacctggaagtcctggtggcccaggtggcccaggtaatgcaaatcctggttcacccttgagcatacacatgacaaaacacaacaaaaactcccatgacttttctgtccttattgtttgccacagagaatttaatgccgaaaatacaagacaatacttttccttccatggggggagaggagaagataattaaataaaaagtaattggtatgttggagaaaacatatggaaggattggaaacagggtttagta

SEQ ID NO: 55331 - DNA, 601 bp, Human
aggttagcaaaaatccaagagtttgtcagcatactcacttatcaaggctgtggggaaacacactcatacattgtgggtggagtgtaaatggtgcaaattgagaggaatctgacaatatccagagatgcatttaccctttaattcagaaaatcctttttcatcactttattttactattatacctgaacacatctgaaataatatgcatgaaagattattcactatggcattatttgtaataaatgattggcaaaaatccaatctagcaactagcaactgggatgaactatggtatatccaygcaatttaacactaggcacctattttcaaaaagttaagatctccatctactgatatggagtgatcttcaggatacaaatttcagtaaaaaaataaagtgcaaataaagtcaaaagaaaataccttctcctttaagaacagagaaaataaaacaaattcttggctggtatttatataagaaacaccagaaggatcccaacactttgagaggccgaggcgggcggatcacgaagttaggagttcgagaccagcctggccaacatggtgaaaccctgtctctactaaaaatacaaaaattagc

SEQ ID NO: 55332 - DNA, 601 bp, Human
aacaataaaatgtttaaaaatatacttagaaacctacttacttcatcaggttagcaaaaatccaagagtttgtcagcatactcacttatcaaggctgtggggaaacacactcatacattgtgggtggagtgtaaatggtgcaaattgagaggaatctgacaatatccagagatgcatttaccctttaattcagaaaatcctttttcatcactttattttactattatacctgaacacatctgaaataatatgcatgaaagattattcactatggcattatttgtaataaatgattggcaamaatccaatctagcaactagcaactgggatgaactatggtatatccacgcaatttaacactaggcacctattttcaaaaagttaagatctccatctactgatatggagtgatcttcaggatacaaatttcagtaaaaaaataaagtgcaaataaagtcaaaagaaaataccttctcctttaagaacagagaaaataaaacaaattcttggctggtatttatataagaaacaccagaaggatcccaacactttgagaggccgaggcgggcggatcacgaagttaggagttcgagaccagcct

SEQ ID NO: 55333 - DNA, 601 bp, Human
ttttctccttcatctatgaaaatgacatgaataattcataaacaattcctagggttttgctgttgttgttttgtttgttttgattcacattagtggtgatgaatttttttttcctctttagctgatttagccatatgctttgtcctaagactggacacacactataacacgtttggttctggttatgatatgatctgtgaacatgaaatagagtatatttaactgatctctaaaaaaattcagtaagacagtaattgtacaggtaatggccaaagaaaataacaagaatcaacaacctccrtttctgcctgggttagcaggtcatgagatgaaaaatattttgtttctagtcctttggcaatttttcttttatttccctgctatggaatgggaaactgatattcaatgggaccttatcttataaccgtgttaaactgtatagcctggtttagaaaagagaaaggtaaatagtaaaagcttaattaaataatagaaaactggagttcaaaggaaagcctaaaaagcataatgtaaacattctacagtagagagataacagtatagaatattttgcatttttcctatcgcaaaatgaaataca

SEQ ID NO: 55334 - DNA, 601 bp, Human
ttattattagtagtagtaataacagacattatactatacttcctcccatagcatagattttttccatgaatactgtcaggaatacacatcctggtaagatccaggatgaagaagtcaatataaatcccaaagttccgctaaatttccccacaataacaagaattgtatggatatgtctacagatgtgatatagggatatactgatgttctaaatttattggcagccgaatggaaccagtttataaaaaaaggaaaatttcaaaaacatgtattattcgtgagaactttccatacacacacmtacacacaccctccccctacccaagggttttgtagcctcctgaagtgttagaaaactattttctccttcatctatgaaaatgacatgaataattcataaacaattcctagggttttgctgttgttgttttgtttgttttgattcacattagtggtgatgaatttttttttcctctttagctgatttagccatatgctttgtcctaagactggacacacactataacacgtttggttctggttatgatatgatctgtgaacatgaaatagagtatatttaactgatctctaaaaaaattca

SEQ ID NO: 55335 - DNA, 601 bp, Human
ttaatatttgttaccaaaatttgatgcatttaagtgcctttgttggtgaattctgtattataagtcacttttcatgctatttaaaaattaaacttcagatatatcaggaaaaatattcataaataaattcattcactcacctggtaagccaggttcccccttctctccttttgagcccagaagatttggatccattggtccaggagggcctggaaggccaggctctcctttactacctttttctcctgtagggccaggaagtcctggctgaccctgcaagccatcatcacctaaaatcaaygtgtgtgaaaacacaatatatcaattttatccatcaaagattaatgcatataaagattattgatatgtttcatagttgagtaggccactggccactcaaaacatttatgcaccttggatgtactctatgaattacttgagtgcatacacatttttatactcagataacaatccctccatctggaattccttgacaacgatagaggccgactataaaaaaattaatgcttaatccagacgggcacggtggctcaagcctgtaatcccagcactttgggaggctgaggtgggcagatcacga

SEQ ID NO: 55336 - DNA, 601 bp, Human
acctatttcaaaatataacaatttccagaaattcctatcatcaagtcttgctttacttttcatcatgagatttatcacattctaacataatacagacttatttattttgtttattgtatgactccttgactaaatataagctccttgaaggcagtaaaagtttgtctgttttgttcaggctgtatctccagcacctaaaacagtacctggtaaatcatacatactcaacagatattttgtgaatgaataaataaatgagtacataatttgcctatgtaaaaatttcaaacatctacataaygaaatgcacagtaaacatgctataagacaaacaactgactgggagaaaatatttgcaacaaatataacagacagtggatgcatcttcacatttataatgtacttttacaaatcagtatgaaatacataaccaagtcctctcgtaaaacagtgaggcaaagagtataaatagacaatttacgaaagagttaaaaacatctgaaaccccacttgtaatcaggaaaattcaaatataaacaataatgatacactacttttcacccattagattggtaaaattttttaaattgataacacccaa

SEQ ID NO: 55337 - DNA, 601 bp, Human
caatatctccttattttcccctcccccaaccctgagcaattaccattctaccttctgtctctatgaaattgactgttctaggtaccttatgtaactggggtcatgtaatatttgtctttttataactggcttatttcacttagcataacggcttcaaagttaatccatattgtagtatgtatcagaatattattccattttaaggtcaaaaaatatctattgtgtgtgcataccacattttattacacattcctctatcaatggacatttgggatgcttccaccttgtgacttgtgaatamtgttgctagaagcatggctacaaaaacatctctttgaggtcccatttttgttttcaattatgttagatgtgtctccagaagtgaaattgctagatcatatgataattctgtgtttacttttgaagaactgccataatgttttccatagtggctgcacaattttacattcctactagcaatacaggagagttccaacttctccacatcctcaccaacacttgttatttactgttttttatataatagccttcttaatgggtatgaagtgttatctcactgtagaattgactgcatttccct

SEQ ID NO: 55338 - DNA, 601 bp, Human
ggggtttttatttttgccttttaacttgtagttttgttttgtaggtcctatgtgatttatgctttaaagaggttctgtttttatgtgtttccaggatttgtttcaagttttagagctcctttcctcagttcttgttgtggtggcttggtagtggcgaattctctcagcatttgtttgtgcgaaaacaactgtatctttccttaatatatgatgcttagtttcactggatacaaaattcttggctgataattgttttgtttgaggaggctgaagatagggccccaatcccttcaagcttgtwgggtttctgctgagaattctgctgttgatctgacaggttttcctttataggttacctggtgcttttgcctcacagctcttaagattctttccttcatcttatctttagataacctgatgacgatgtccctaggcaatgatcgatttgtgatgaatttcccaggtgttctttgtgcttcttgtatttggatgtctaggtctctagcaaggctggggaagttttccttaattattccccaaatatgttttccaaacttttagatttctcttcttcctcagaaacaccgattattcttaggtt

SEQ ID NO: 55339 - DNA, 601 bp, Human
gcagattccttttggatttgatttccagttttattccactgtggtctgagagtgcttgacatgatttcaatgttcttaaatttattgaggcttcttttatggcctatcatatggtctatcttggagaaagttcgtgggcttttgaatagaatgtgtattctgtggttgttggatggaatgttctgtatatatctgttaagtccatttgttccaaggtatagtttaaatctattgtttctttgttgactttctgttttgatgacctgtctagtgctgtcagtagaggattgaagttcctcartattattgtgttgctgtctatctcatttcttaggtctattagtaattgttttataaatttgggaactccagtgttaggtgcatatatatttaggattgtgatattttcctgttggacaaggccctttagcattatagaatgtccctctttgtctcttttaactgttgttgctttaaagtttattttgtctgatagaacaatagctactcttgctcgcttttggtgtctatttgcatgaaaggcttttttccactcctttaagtttatgtgagtccttatgtgttaggtgagtctcctgaa

SEQ ID NO: 55340 - DNA, 601 bp, Human
tagaagtgttccctgatcaccgcatccacaccaagatctcctattttttgatcttttgattatggccattattgcaggagtaaagtggtattgcattgcggttttgatttgcagttccctgatcattagtgatgttgagcattttttttcatatgttttttggccatttgtatatcttcttttgagaattgtctattcatgtccttagcctacttttagatgggattgtttctttgttttttgtttttttttcttactgatttgtttgagttcgttgtagagtctggatattcgtccttcrtcagatgtacagattgtgaagattttctcccagtctgtggattgtctgtttactctgctgactgctccttttgctgtgcaaaagctcgttagtttaattaagtcccaattatttatcttgtttttattgcatttgtgtttgggctcttggtcataaaatctctgcctaagccaatgtctggaaggatttttccaatgatatcttctagattttttatagtttcaggtcttagatttaagtccttaatccgtcttgagttgatttttgtataaggtgagagatgagaatccagtttcattc

SEQ ID NO: 55341 - DNA, 601 bp, Human
tatcagtaatttgtcagttatgttttgcaaatattttctccttgtctgtggctttcctattcattttcctagcggtgttttctgataaaagtagtttaaaaatttaaatctaatctatcaatttttttcttttacagttactgctttttgtatcctaagaaaatctgcctatgccaagtcacggaaatatctatctatgttttcctctaaaagcattatggttttagcttttatgttcagactaagatctaattaaaaacatttttttttctgtatgatgtaatgtatgaattaagttttrttttttccccatacgaatatctagatgtttcagggccatttgttgaaaagaatttgctttctctaaaaaatttatttgatacctttatcaaaagtcaatttattgtatattagtcttttttatcctccaaattctgtttcattgatctatttctcaatccttatcaagtaccacacattttttttctttttgtaatggagtctcactctgttgcccaggctggattgcggtggcgcgatcacggctcactgcaacctccacctcccgggttcaagcaattctcttgcctcagcctcccga

SEQ ID NO: 55342 - DNA, 601 bp, Human
agcatctattgggtgatcactaaaatgatttctgtgatgacatgctgagaagctcacatttaaaaatgcagatggcattttgctgacaggttaacagtatagttttaccttttagtaacaagactaataaaactaccatttcctttattcctccaaattgttttacttcctctatataaatgataaaatgcattactaaagcaaattattagaaccatggaaatagatggagttagctatgaaccaagctatttacttgtaagaagttatatcacaaattttaaagtcttttttttaacaycctccaatgcaccggaaaaattctaaagtcttaaagactgaataacctgccagcaaaacgaaatacatggactaataaatagaccattctcctaccactcacggacatacctggtctcccaggaggaccttggggcccagggttgcctttaggtccttccagagctggacccggagaaccaggagggcctgggggaccctgcacaccagggaaaccgtgaaagcctggttcgccctttggacctggaaggccaggatttcctggaatcccaggtaatcctccatcacccttttggcctat

SEQ ID NO: 55343 - DNA, 601 bp, Human
tcaaagtaaggttcaacagtgagctcattactcattcattactagtaagaacgaataaccacagtgatgattaaaatataaaaaagataatagtttggtttatttgaattactgcatgcaaaaccaagcaagatacttgcttcagttctttacattacatgcaagagagttaacatggctgaggagattttcactggttttcttcagtagtatacaaacataaaaccttaaacaatactttccatcagattatgtcagatcagataaaatttggttttgaaaatgatcctctgaacacagkatgtgatcccatttaattcatgtgtttagaacatcttattaaaatgaattccaatcactttagattttactgtaatataaataacatttttcattttgaaatgcacttatataatgtcagagactttcaaagaataaaaggacatttacttccaagttttcagtgaccagaaatataaaatttgaatatcaagtctcaaaatctgttcataacctatcaccagtgactaggctcagtgacattaatcaaggatgaaaacgagcatttccaaaattagtaaaatgaaatgacacagcacag

SEQ ID NO: 55344 - DNA, 601 bp, Human
atgttagcagagagaataaattgtgctagagcaatgaatcctaggagttggaagacctaggatctatttttgactctgctacttaataactatatgactttgggcaattcaatctttctgagtatggttttttacctgtaaaatgggaatactggtatctgccctaacctccctcacaggaatgttttaaagatcaaattcaagttgtaaaatactggcctaatgtctgccatgtgcaaggtgctacaggaaacacaaagatgagcaagactcaaactctgcccttaagatgcttacaataaaagtacattatatgatgtaaattgtggcatgtcatataaatagaaaacattatcattatctcctaataaaactttcaaagcatttgatactttgaaattcagaaagctaaatattggcttctgtttatttaaattgtttctaaatcacagacagcaaattaactcaagacaatacttagagcagagtctggccacaaaattagttaaataaattagaattcccaactaagacaactcaaggtttgagtaaagacattttatatatgtgtttgatatagagggaccaataacaagaactc

SEQ ID NO: 55345 - DNA, 601 bp, Human
attgcactccagcctgggcgacagagcgaggctccgtatcaaaaaaaaaaacaacacaacaacaacaacaacaacaaaatgcagccccaggtaagacaatgggacttcaacatccaaagtcagaattccaggaaaagaattcatggggatggaagagtccttgagagtgatttagtcccctcatcccatcaacctagctgtccaccccagtatagagaagatacatgggaacaccttaaatgaactggattttgtacagaaatgtcatactttatatagctttaaatgactccagcaataytttataaagctaaggcacttattttaggaactacaaactagcataattaagcaatgaccttactttctttgatctatgaaccaagattctcttcagaacttatgaacttgatgaagaccagtttcaaagatgaggtaagtatctcccaggaattataaacactgcacactcaagcagctgctatactgcaaagagcccagggaaactgttcccttaataactaatctaactaaaagtaaatgtggcctttttgaaatgatctgctttaggccaagaattgtacctcacaagagctaatta

SEQ ID NO: 55346 - DNA, 601 bp, Human
acgccattgcactccagcctgggcgacagagcgaggctccgtatcaaaaaaaaaaacaacacaacaacaacaacaacaacaaaatgcagccccaggtaagacaatgggacttcaacatccaaagtcagaattccaggaaaagaattcatggggatggaagagtccttgagagtgatttagtcccctcatcccatcaacctagctgtccaccccagtatagagaagatacatgggaacaccttaaatgaactggattttgtacagaaatgtcatactttatatagctttaaatgactccagyaatactttataaagctaaggcacttattttaggaactacaaactagcataattaagcaatgaccttactttctttgatctatgaaccaagattctcttcagaacttatgaacttgatgaagaccagtttcaaagatgaggtaagtatctcccaggaattataaacactgcacactcaagcagctgctatactgcaaagagcccagggaaactgttcccttaataactaatctaactaaaagtaaatgtggcctttttgaaatgatctgctttaggccaagaattgtacctcacaagagct

SEQ ID NO: 55347 - DNA, 601 bp, Human
gagtgaacaacatgggaaaatttaaaaagaaatggatttagaattggcaggtgttacctccatcactttctaactgtaagttatttaacctattagccagtctctttgtgtataaaatgaaaaagcagaatatttatatacatttttcttaatcatagttgtgtaaattaaattagacaatggacatgaaagtgctttgtacattataaagtaatttaaaaaaacctattctactgcctaatttgggacagagctgaaaatatccagtctcgtaaggaaaagaaaggtaaataaaaggaasgcccataatgatggaagtatctggagtatctggttgcacctgtggctgcccacaatgatgcagaattctgggttatagtctccaaattttcgaagagagagtgatcccatatactcccaatgccctctataccccatagttataagactttaatagactaatggttctcagtatgtttttcttttctcccagacagaaaagctttagtatttaatccatcttctctgtcttctttcttacatcctataatccttccactaattcaacacagactgcatttattcgatcaggaggtaattg

SEQ ID NO: 55348 - DNA, 601 bp, Human
gcccagattcctgcaagtaacgacagaacataaaattagtacattaaaaacaaaaagtaacaataacaaaacattctaaatttatattactcagactaaatttttaaattcagttatagcatgttgtaaaaattcctacattcaaggaactatagaaaaacctataataaccacaaagtatacctttgctgtatattcaaatatgtcagcaataattttcatggatggttctggaggaaaaatgtatgtatttcgaaccataaattcctttagtatatcattttggatggtaccagtaagyttctctttaggtacaccttgttcttctccagttactataaaatttgcaagaactggaataactgctccattcatagtcatggaaactgacattttttctaaaggaattccatcaaaaagaattttggtatcttccacagtgtcaatagcaactccagccattccaacatcaccacgaactcgagggttgtctgaatcatagccacgatgtgtcgccagatcaaaggcaactgataatccctgctgaccagctaaatatataaagaaaaataatgtaagattcaagagtctggaatcaagg

SEQ ID NO: 55349 - DNA, 601 bp, Human
aatttcatatgtaaagagaacatgtataaaaacaaggccataactatacaatttttaagagaacaaattaaattacccaagtaaaaatagtctttaaacagtctgcttgcatgcttgcttaaatacataactttaacacataaaatatgtatgtatatataattaattttaaataggcagttttatgttaagaattataactcttacaattatatgagagtactaacttatgacttttgcttccttctcatcatcaaattctgttttctttctttctttggtttttttttttttttttttkagacgtagttgtgctcttgttgcccaggctggagtgcagtggcgtcatcctggctcactgcaacctccgattcccaggttcaagtgattctcctacgtcagcttcccaagtagctgggattataggcatgcaccaccacgcccaactaattttgtatttttagtagaggtaggtttttgccaggttggccaggctgggtgcctcggcctcccaaaatgttggaattactggtgtgagccaactcgcccagccttgtttacttttacaagtgtttcagcactacagggaagctaggatgta

SEQ ID NO: 55350 - DNA, 601 bp, Human
atgatcttgatctcctgaccttgtgatctgcccgccttggcctcccaaagtgctgggatttacaggcgtgagccactgtgccaggtctatttctccatttataagaacctgaagttttatttcatacagagtataatagttattattcaacatttaaatgtataaaagcaatgtaactttgcacatataaattatttttaaatgtaccaaaataatttcatatgtaaagagaacatgtataaaaacaaggccataactatacaatttttaagagaacaaattaaattacccaagtaaaaayagtctttaaacagtctgcttgcatgcttgcttaaatacataactttaacacataaaatatgtatgtatatataattaattttaaataggcagttttatgttaagaattataactcttacaattatatgagagtactaacttatgacttttgcttccttctcatcatcaaattctgttttctttctttctttggttttttttttttttttttttagacgtagttgtgctcttgttgcccaggctggagtgcagtggcgtcatcctggctcactgcaacctccgattcccaggttcaagtga

SEQ ID NO: 55351 - DNA, 601 bp, Human
tttttaggtacataaagttttcataattacataaagtctgtaagaaaaatatattttaaaatgcaatttacttttgatttgagctgcagagaaacaatgtaacctcatctttaatgaaatcaggaaacatttaaaccttcaatcatagcttcatatatgaaggcagaaaacagacagtggaatgatatatgacttagcagaaaggatcaaggtcaacctgcttttccctgatgaattcaagaaagaagaatctatattggattctacgtaagtgtaaaatgagaagctaaaaagaagaagmcaatttgagagtctgcaaccacccctctctcattctgtcaggagaaccaaagtttactgtctacagaaaatgaactcgagacacaatgaactatcaaataccaaatacagacagaagtaagggtaagatgtcttactgaaataaaagcctgtactctgactaaagactaaaaacaaaaagcacagagagaaaatggagacaatacaggatgtaaaagaaaacttcagaaaatatcatgaattcagaatataaatggattctgtactaatgaaacaaatgaagatgacattaattataagg

SEQ ID NO: 55352 - DNA, 601 bp, Human
atagcacttatcatgatctataattctttatttacttgttcattttcctctcttttactagaatgtaagatttgtgtgcatagaggtcatagaggtcatgtctgtcctgttcacagttgtatgcccagacatagcaagtgcctcaaacaaaataaactaaagaagtattcattgaatgaatgaatactccaatgcagagaacactgtgatcatcaacagtgtcatcttcaaaatgttaatgacatctacccacaaacatgtacatatatacaatggttagacatccacacacactttgtamatatgcttgcctgtgtgcatccatgtatgtgaaaatacatatatagatagatacaagtatatgagaaaaaatttacccaagttccatttttcattatttttgttttgttaactatacatgttatcttcaaacagaaatgaatttctttttaactactggatttcatatatgaactttctcactatcttaccagaatctattctagcttgtcttcgggcagcacattcttcaattcgaagtttaggtattccctcagctacagctttggccattccacccatttcttcaatttcattaatg

SEQ ID NO: 55353 - DNA, 601 bp, Human
agaccatgggcatttgagctactttctcatgtaacttacttgtgccttcaggacctgctcaagctggaccacatatataccacttccatttgatgatggaatgctgctgtgcaagacccactttatagttagatgggtcagaaagcacccagttcatgataggcagttctggtcgcatggtgacttgatgacccatagtcaaacattcagtttccaccaaagtccagtaacaggccaagagctgtctctcaaaaggagagtagttatctgcagaagatggcaggcccttcctccaaaatcytagaggcctctgctgtgactcacctatgggggcctgccaaaggctccaaacatcattgctatctgccactgacacctcaagcaccattggatctgctgggtcatatggcccaagtggcagagtagcttgcacagcagcctggacctgttgcagagccttctcctattctggaccccactcaaaactggcagtcttttgggtcactcgataaataggccagagtaacacagagtaacacattccaaatgaggaatgtgttgcttccaaaaatccaaataggcccactaggcattgttcctc

SEQ ID NO: 55354 - DNA, 601 bp, Human
agggtggcaggagtggagaccatgggcatttgagctactttctcatgtaacttacttgtgccttcaggacctgctcaagctggaccacatatataccacttccatttgatgatggaatgctgctgtgcaagacccactttatagttagatgggtcagaaagcacccagttcatgataggcagttctggtcgcatggtgacttgatgacccatagtcaaacattcagtttccaccaaagtccagtaacaggccaagagctgtctctcaaaaggagagtagttatctgcagaagatggcaggsccttcctccaaaatcttagaggcctctgctgtgactcacctatgggggcctgccaaaggctccaaacatcattgctatctgccactgacacctcaagcaccattggatctgctgggtcatatggcccaagtggcagagtagcttgcacagcagcctggacctgttgcagagccttctcctattctggaccccactcaaaactggcagtcttttgggtcactcgataaataggccagagtaacacagagtaacacattccaaatgaggaatgtgttgcttccaaaaatccaaataggccca

SEQ ID NO: 55355 - DNA, 601 bp, Human
tttgagcctaaaaaactattttctcctaggtattttgtctgcagttagtgaatgatggcactttgaatttggacaactgatagattttctataaatgaaaataagcccattttttttttcattctctgttgctgttgattttttttagtttatttatttgttttgtttatttatttatttttgagatggagtctcgctctgttgcccagactggagtgcagtggcgctatctcggctcactgcaagctccgcctcccgggttcacgccattctcctgcctcagccttccaagtagctgtgrctacaggcgcccgccaccatgcccggctaattttttgtatttttagtagacacagggtttcaccacgttagccaggatggtctcaatctcctgacctcgtgatccgcccaccttggcctcccaaagtgctgggattacaggcatgagccaccgtgcctggcctttttagtttattttaacagtcaaagtatgagtgaaaagatatcaagggcacaaataatactgcaggatttaggctgttataacatctgaacatttgtagctgcaatatcgattgatgttaggatgtgctacaagaac

SEQ ID NO: 55356 - DNA, 601 bp, Human
tatgatgtgataagtttgagcctaaaaaactattttctcctaggtattttgtctgcagttagtgaatgatggcactttgaatttggacaactgatagattttctataaatgaaaataagcccattttttttttcattctctgttgctgttgattttttttagtttatttatttgttttgtttatttatttatttttgagatggagtctcgctctgttgcccagactggagtgcagtggcgctatctcggctcactgcaagctccgcctcccgggttcacgccattctcctgcctcagcctyccaagtagctgtggctacaggcgcccgccaccatgcccggctaattttttgtatttttagtagacacagggtttcaccacgttagccaggatggtctcaatctcctgacctcgtgatccgcccaccttggcctcccaaagtgctgggattacaggcatgagccaccgtgcctggcctttttagtttattttaacagtcaaagtatgagtgaaaagatatcaagggcacaaataatactgcaggatttaggctgttataacatctgaacatttgtagctgcaatatcgattgatgttagga

SEQ ID NO: 55357 - DNA, 601 bp, Human; identical to SEQ ID NO: 20823

SEQ ID NO: 55358 - DNA, 601 bp, Human; identical to SEQ ID NO: 20824

SEQ ID NO: 55359 - DNA, 601 bp, Human; identical to SEQ ID NO: 20825

SEQ ID NO: 55360 - DNA, 601 bp, Human; identical to SEQ ID NO: 20826

SEQ ID NO: 55361 - DNA, 601 bp, Human; identical to SEQ ID NO: 20827

SEQ ID NO: 55362 - DNA, 601 bp, Human; identical to SEQ ID NO: 20828

SEQ ID NO: 55363 - DNA, 601 bp, Human; identical to SEQ ID NO: 20829

SEQ ID NO: 55364 - DNA, 601 bp, Human; identical to SEQ ID NO: 20830

SEQ ID NO: 55365 - DNA, 601 bp, Human; identical to SEQ ID NO: 20831

SEQ ID NO: 55366 - DNA, 601 bp, Human; identical to SEQ ID NO: 20832

SEQ ID NO: 55367 - DNA, 601 bp, Human; identical to SEQ ID NO: 20833

SEQ ID NO: 55368 - DNA, 601 bp, Human; identical to SEQ ID NO: 20834

SEQ ID NO: 55369 - DNA, 601 bp, Human; identical to SEQ ID NO: 20835

SEQ ID NO: 55370 - DNA, 601 bp, Human
tacaggggattggaaacaggtatgaaagaaaatctttcagggaaagaaatgaaaagaacagcaaattatttgaatgaggccctagatgatgaatgaattatctgcacattgataatctaattacagtaatacaatgactatatttctgaatgccaaatgaagtttgaactgagtgtcagagtcctccagtctgaaaagtcctagcgagtctaatgtgcacagagttaatggaagatatgacaagaaacagcaatgccaaagctgtttcagaggctacctgctcaggagatacacactgcaygtgagcactgcacattttatcattgaagattgctgaccatattatggggtcaattcaacaaagtagcatattagaaataactctaggacctgaattcaaaatcctcttggcccttcacatactaactctattatcactactaaacaaagcactaaggcttttagagttagggtttttgttttcttaattaaaaatataaatctaattattcttataccctaactatacaaattaaatgtgttaatatagtggagaaattgtgctaatttaatattatataagtatattgttaattttgta

SEQ ID NO: 55371 - DNA, 601 bp, Human
atgatctacaagatagggaggaaggagggatcaatttttctttgaagtcagagaaagcttcataaaatgtgattctggggttctgaaagatgaacagagttttctaggcatcttgaaaacatcagaaaatcatactgggcagagtgtttatagagcatctgatttcaaacatttagtggtgccaaagacaaaatgacatctcactttttaataattttataaatgaagaccaggagatgagctgagatgttacaggggattggaaacaggtatgaaagaaaatctttcagggaaagaaatraaaagaacagcaaattatttgaatgaggccctagatgatgaatgaattatctgcacattgataatctaattacagtaatacaatgactatatttctgaatgccaaatgaagtttgaactgagtgtcagagtcctccagtctgaaaagtcctagcgagtctaatgtgcacagagttaatggaagatatgacaagaaacagcaatgccaaagctgtttcagaggctacctgctcaggagatacacactgcacgtgagcactgcacattttatcattgaagattgctgaccatattatggggt

SEQ ID NO: 55372 - DNA, 601 bp, Human
ttggggatgttatagaacgttgttttgtcatattaccagaatttttttctggttccttctcatcaggtagactatgtccaaggaaggatctggggctcaagggctgctgttcaggttcttttgccttgaacccttgatgtggtactctcccccttctcctagagatggggcttcctgagagccagactgcagtgattgttattgctcttcggggtctagcgacccagcagagctactgggctccaggctggtactggagaatgcctgcaaagagtcctgtgatgtgatccatcttcaggtrtctcagccatagatactggcacctgttccagtggaggtagcaggggagtgaagtggactctgtgagagtccttggctgtagttttgtttagtgcactggttttcttgaatgttggttatgctaatagtgaagttgtcatgtggacagtctcaggacctctggttagccaggatgttacaggcagtggaattaactgctgttttgtctttccttggagtagagttgttctgagttgctgtaacagctcgagttggtttcaagacagtgtaagctgtggtagtatggggggatacaagtttg

SEQ ID NO: 55373 - DNA, 601 bp, Human
aatattagttgttaagcattgccactaaatctgagttgaagatataacttttaaatagtaaagtagtagactgaaacatttaaataggaaagtagtagattaaagctttgggaattgtgagtaactcatggcatgacaaactaaaaacccctctgaggccacaaatgccgatttctggtttcaagggaacttttcaaaaaataattttgggggaacaggtggtaaattgttgcatgaataagttctttactggtgattcctgagattttggtgcacccatcaccccagcagtgtacactgyatccaatgtgtagtcttttatcccacgccaccctcccacattttctcccaagtccccaaagtcaattgtatcattcttatgcctgtgcatcctcatagcttagctcccacttattagtgaggacatatgatgtttggtttttccatttctgagttacgtcacttggaataatggtctccaactccatccaggttgctgcaaatgccattatttcatttctttttatggctgagcagtattacgtgtgtgtgtgtgtgtatatatatatatatatatatatatacacacacacacacacac

SEQ ID NO: 55374 - DNA, 601 bp, Human
gcgggatcctaaaagaaaataaaattggaattattatttaacaatattgtaaatttcatataatagtgaataagttaattcaagagaacaaaggtcactttaaaaagtgcaaaatagttatcatgtacatatattaaatactaaagttatttaaataataaaagccaatattagttgttaagcattgccactaaatctgagttgaagatataacttttaaatagtaaagtagtagactgaaacatttaaataggaaagtagtagattaaagctttgggaattgtgagtaactcatggcatsacaaactaaaaacccctctgaggccacaaatgccgatttctggtttcaagggaacttttcaaaaaataattttgggggaacaggtggtaaattgttgcatgaataagttctttactggtgattcctgagattttggtgcacccatcaccccagcagtgtacactgtatccaatgtgtagtcttttatcccacgccaccctcccacattttctcccaagtccccaaagtcaattgtatcattcttatgcctgtgcatcctcatagcttagctcccacttattagtgaggacatatgatgtt

SEQ ID NO: 55375 - DNA, 601 bp, Human
gatcctaggagtagcaggttgtggcaggaaatgaatatgcaatgttaaaatatcattttccatttgaaaaatggaaaaaactccatagtatctctaacagaaactatgaaaaatatagctccagagtatttttttcttccagatggaggttgcgatttttcagtagttagtggtgtgtgtgtttgtaggagtgtgcttaggaaggtttgtgagcttctagaggtggcatgtatgagatttttacatttaccaaaatggaatattagtttttgttatcccagaacttaaaaaaaaaaaaaagaaaaaaagattaaagaaaagttttgataaatactgatatccaggatataatagttttgcaatgattaaccataggataatgatgatcattattctattggccattaaattcatttaaaattatgtgggagtccaaatctcaatagaccaagtggggtaaggacccaaggaagtgcagctgaatctcagtctctttgcctagaatatagctgtgtgtgtatgagctcttggaaaattgtgaaacagatataaaaggattttaaaagttctagttcccttggcttccctcatgatctattcc

SEQ ID NO: 55376 - DNA, 601 bp, Human
agatcctaggagtagcaggttgtggcaggaaatgaatatgcaatgttaaaatatcattttccatttgaaaaatggaaaaaactccatagtatctctaacagaaactatgaaaaatatagctccagagtatttttttcttccagatggaggttgcgatttttcagtagttagtggtgtgtgtgtttgtaggagtgtgcttaggaaggtttgtgagcttctagaggtggcatgtatgagatttttacatttaccaaaatggaatattagtttttgttatcccagaacttaaaaaaaaaaaaaagaaaaaaagattaaagaaaagttttgataaatactgatatccaggatataatagttttgcaatgattaaccataggataatgatgatcattattctattggccattaaattcatttaaaattatgtgggagtccaaatctcaatagaccaagtggggtaaggacccaaggaagtgcagctgaatctcagtctctttgcctagaatatagctgtgtgtgtatgagctcttggaaaattgtgaaacagatataaaaggattttaaaagttctagttcccttggcttccctcatgatctattc

SEQ ID NO: 55377 - DNA, 601 bp, Human
tcccatggacacagcagctgataccagctgataccatgacagatgaattccagacttgttagcaaatagcattcagcaaaatgtataagtattcaactatttttttctttttttttttttttgagacagtctcgctctgttgccctggctggagtgcagtggccgaactcggctcactgcaatctccgcctcctgggttcaagcgattctcctgcctcagcctcctgagtagctgggactacaggcatccaccaccacacctggctcatttttgtatttttagtagagatgcagtttcacygtattggccaggttggtctcgaactcctgaccttgtgatccgcccacctctgcctgatttatagctttggtatcattaatattctgaaatatagctatataactgagtcagaaaaaatgcttagtaaaggtgaatgcattgaagaggtaaaaatttcagtgatggtgtcaactttatcattcataataattttaataaaagtatcccaactacagaaagccagcagctatttttacttctattcatggcaatttattaaatgagatatatggtatttatttcattttctccttttgcaaa

SEQ ID NO: 55378 - DNA, 601 bp, Human
agagtaccccacacacttccttctctttcccccaagtggacagtgtctctctcccctctgtgttacctagggtttatgagaggggtgatgcaggcaatcccatggacacagcagctgataccagctgataccatgacagatgaattccagacttgttagcaaatagcattcagcaaaatgtataagtattcaactatttttttctttttttttttttttgagacagtctcgctctgttgccctggctggagtgcagtggccgaactcggctcactgcaatctccgcctcctgggttcaagmgattctcctgcctcagcctcctgagtagctgggactacaggcatccaccaccacacctggctcatttttgtatttttagtagagatgcagtttcactgtattggccaggttggtctcgaactcctgaccttgtgatccgcccacctctgcctgatttatagctttggtatcattaatattctgaaatatagctatataactgagtcagaaaaaatgcttagtaaaggtgaatgcattgaagaggtaaaaatttcagtgatggtgtcaactttatcattcataataattttaataaaagta

SEQ ID NO: 55379 - DNA, 601 bp, Human
ggatgaggtgaggaaactattttaggaacatgatactttacagaaaaatttatgtggcttttattatgaactgtgttcccaaacacgacgggaggcaacacttctgaaatcattgagaggccatgcaaccatcaacactgtcaccaaatagagtttgtgaacaaatgctatggtaaccagtcattttcttcttctccatatgagaaatgtgaagcccatacagacatgctaggtctcctctgtgaatgtgtatattcaaagaaacgtaaacagcagccaattacagctaggagagaattgyggcaagtgttgaattacaaaaagccaattactaaaatacctttcttgcaggtatggaattaaacctaacacttcataaattttgttcatcactcgaatggctgcagtacaatgagataacagtcttaaaataaaactgaagaaatgttaacaagctgttcctgtgttttgaagattaagcgaaatatacaaatcctaactcaataacaaattactttctgttacagcaattacatttttataagttttaatataaaatcaaacatcgttttacacatttacctgtttcccactagggttt

SEQ ID NO: 55380 - DNA, 601 bp, Human
tcacagaaaggaaatgcaagggagacagtcctctgaaaggcaaaaaacaacccaaggtacaaagaaggaactcaccagagaagtcaaacccactgtgaacaatattcctccctcaccctgggagctttttagagaactagaccatctcagttacattctaggtttgcactgtccaatacagcaaccactagagatactagcaacatgtgactatttacatttaaacttaaattaagccaggcatggtggctcatgcctgtaatcccagcactttgggaggccaagacaggaggatcacttsaggccaagagtttgaggccagcctgagcaacatagtcagaccctatctgtacaaaaataaaaataaaaaaattagctaggtatgttggcacaactgtagctattctggagactgaagtgggagggtcacttgagcccaagaggtggaggttgcagtgagttaagatcacacccctgcactccagcctgtgtgccagagtggggccctgtctcaaaaataaataaacttaaaagttcagtttcatagtcacactcacatagttcaagtgctcaataatagcacatgtggctagtggctact

SEQ ID NO: 55381 - DNA, 601 bp, Human
ataggtatattcacttatcaaaaaatatgcaggtaacatttcagtgaatgtaaattttaccttaaaaactataaaaaatagtggccgggcgtagtggctcacacctgtaatcctagcactttgggaggccaaggtgggtggattgcccgagcggaagagttcaagaccagcctggacaacacagtgaaaccccatctctactgaaatacaaaaaaaaaattagccgggcatggtggcgtgtgcctgtaatctcagctactcgggagactgagacaggagaatcacttgaacccggggggcrgaggttgcagtgagccgagattgcaccattgcactccagcctaggtgacagagtgagagactccatctcaaaaacaaaacaaaacaaaacaaaacaaaaaaaaaactaggcaggacatgatggctcatgcctgtaatcccagcactttgggaggccgaggtggtggatcacaaggtcgggagttcaagaccaacctggccaacatggtgaaaccccatctctactaaaaatacagaaattagctgggcgtggtggtgtgtgcctgtagtcccagctgctcgggaggctgaggcaggagaa

SEQ ID NO: 55382 - DNA, 601 bp, Human
atttgttaaatatatatttgttcagtaaatgaaaattatagatgctaaaacttaaactaaatttggcataaagtcagagaaaggtaaaatgtcaccatctgacatttggaatcagaatctaaaaacttcagttatgttaaaactgattttatatcattttagctgggttgtcacaagattctttgggtaacctttaaaacagttctcaaagagccttttgtaagcacctgaattaataatgataagacatgggatggcccacataaaactaataacattgattgcttcaagagaggaagaytgagccaagcacggtggctcacgcctataatctaaacactttggaaggctgaggccggcggatcatttaagatcaggagtttaagactagcctgagcaatatggcaaaaccctatctttacaaaaaaaaaatacaaaaaaaaatttagacaggtgtggtggtaggcacctgtagtcctgctacttgggagcctgaggcaggaggattgcttgagcctggaagggtgaggccgaagtgagccatgatcgtgccactgcactccagcctgggcgacagagaaagatcttgtctcaaaaaaaa

SEQ ID NO: 55383 - DNA, 601 bp, Human
ttagctgaccatactgttatctaatttatgaaaaaaagtgccacacagtgcagatggacaaggatggtatttgcaataaatggtgctggatcaaacagacgtctatatagaaaaaagtgaatcttggcccggtgcagtgggtcatgcctaaatcccagcactttgggaggtcaaagcaggtggagatcatgttactgcactccagcctgggtgatacagtgagaccttgtctcaaagaaaaaaaaaagtaaatttttttttttttttttgagaccgagtctcactctgtcgcccaggctasagtgcaatggcacaatctcggctcactgcaacctctgcctcctaggttcaagcgattctcctgcctcagcctcctgagtagctgggattacaggcacccgccaccacgcccagctaatttttgtatttttagtagagacagggtttcgccatgttggctaggctggtctcaaactcctgacctcatgatccgctcgcctcggcctcccaaagtgctgggatttcaggcatgagccaccacgcccggcctaaaaagtgaatcttgacccctgcgattcatcaagaatttactctaaattat

SEQ ID NO: 55384 - DNA, 601 bp, Human
tgacaaatatacaaatagaacaaagtatccagaaacagacccacactaatttcataaattagctgaccatactgttatctaatttatgaaaaaaagtgccacacagtgcagatggacaaggatggtatttgcaataaatggtgctggatcaaacagacgtctatatagaaaaaagtgaatcttggcccggtgcagtgggtcatgcctaaatcccagcactttgggaggtcaaagcaggtggagatcatgttactgcactccagcctgggtgatacagtgagaccttgtctcaaagaaaaamaaaagtaaatttttttttttttttttgagaccgagtctcactctgtcgcccaggctagagtgcaatggcacaatctcggctcactgcaacctctgcctcctaggttcaagcgattctcctgcctcagcctcctgagtagctgggattacaggcacccgccaccacgcccagctaatttttgtatttttagtagagacagggtttcgccatgttggctaggctggtctcaaactcctgacctcatgatccgctcgcctcggcctcccaaagtgctgggatttcaggcatgagccaccacgc

SEQ ID NO: 55385 - DNA, 601 bp, Human
ttctcttctcaagagggtaaaccatacaaggtggaagacataggcatcctaacagagacagattgtgtgagcccaatatactaaatgttctttggctccttacccaaccctcttttcctgagttcccagatactgacaaccagacctcaactctccaagcagaaaactggaagatactctctggaaaatatgactgggacaaaaggaaagataaatacagtggagacagcctcaaacaatccacccagatcaattatttcaatcttggctacacactggaattatcttggcagctttaaamaatactggtgctaatcttcggagatagaaatcagaatagtggtcacctctaggctgggagtgagacaacagaagaaagggatatgaaggaattttctagaattttttgccatgctctacatcttatatcggttacatggtaaaaatcaaactatacacttaaattctgtgcattttactgtatgtagccacacctaatttttttaactatccctacctgggacctagtctcagagattctgacgtattagcagcagggatttttttttttaattctccatgtgattataatgtgcagccg

SEQ ID NO: 55386 - DNA, 601 bp, Human
ttactaaaacaaggataaagaaagttgtgttattgttgtttgttctgtttttaggacacaagccattatgacagggagaatgagacaatagcaacaaaattttggaagctggaaagcagctggataactgacctagtcaaagatgccaaaatcttttttttttttttttgtgacggagtgtcactctgtcgccaggctggaggtgcagtggcgcaatctcagctcactgctacctccacctcctgggttcaagcaatcctcctgcctcagcctcctgagtagctgggactacaggcgcacrccaccacgcacagctaatttttgtatttttagtagagacggggtttcaccatgttggccaggatggtctcgatctcttgacctcatgatctgcctgcctcagcctcccaaagggctgggattacaggggtgagccactgcaccccgccaaagatggccaaattctaagccagcaatgctgacaactaagaacaaaccggtttatgccatagattcctcaaaaggctcaggaactgccagaacaaagagtggaagggggactaaaagaaaggagcaagtgaatgctgaacagttagaatcc

SEQ ID NO: 55387 - DNA, 601 bp, Human
acatttctgggacaagtcaatacaatgagagtacataagcaagactaaagatacacagctacacaataaaagactttcagaagacgccaaaaaagcatttaggactgcaagaggtttttttaaatctgataatattaaaggaatctaaagtgttacatactcaactccaacacatccacacctttctagttctcacctgccataggcaagtaggtattctgtctaaagtcagaagacttccgtcagagcttatgctctttggactctcctagagctcaggtgattgctcccttcttcccastttctgctctcaatttttaaacctgctcctctgccatatttaaaaatcttggctgggtgtggtgactgactgacatctgtaatcccaggactttgggaggccaaggcaggtggactgcttgatcccaggagtttaagaccagtctgggcaacaagatgaagccccatctctacaaaaaatacaaaaagtagccgggtgtggcagcacatgcctgtagtcccagctactcaggaggctgaggtgagaggactgcttgagcccagtagatcaagactgcagtgagccatgaacgcaccaccg

SEQ ID NO: 55388 - DNA, 601 bp, Human
ccaggcgcagtgattcaagcctataatcccagcactttgggaggccaaagcaggcggatcacttgaggtcaggagtttgagaacagcctggccaaaatggtgaaactctgtccctactgaaaatacaaaaattagctgggcgtggtggcacacacctgtaatcccagcgactcgggaggctgaggcaggacaatcactggaacctgtggaggcagaggttgcagtgagctgatatcacaccactgcactccagcctgggagacagagcaagactccctctcaaaaaaaaaaaaaaaaaaaaatccaattcatcaattctaaattatatgccatctgccctgttccacctgggacatgaaccatcactttgcccagtgtatccatactgtatatgctatccgcctgttagttacttagtatgcatctcatttatcagatccactattgttgctgtatgacagtgcttgtgctcaagtaatccttattttacttaataatatttgactagtaataattattaattgttgtctttactctgttactgtgcctaatttataaataaaactctatcataggtaggtatgaacaggtaaatacatgc

SEQ ID NO: 55389 - DNA, 601 bp, Human
gcccaatgtgaaataagaattaccactgttttgaaaaatcctaaaatgtcaataaaaatctcaatataatcctccaaaagggtaaatagtgcctagatcatagcaaaggcctaaaaactctattttaatgctagccattttagttactttaactacacaggtacagtagttcctccttatctgaggtttcactctccatggtttcagctacctgccatcaagctggtccaaaaatattacatggaaaattccagaaataaacaattcattaattctcggccaggcgcagtgattcaagccwataatcccagcactttgggaggccaaagcaggcggatcacttgaggtcaggagtttgagaacagcctggccaaaatggtgaaactctgtccctactgaaaatacaaaaattagctgggcgtggtggcacacacctgtaatcccagcgactcgggaggctgaggcaggacaatcactggaacctgtggaggcagaggttgcagtgagctgatatcacaccactgcactccagcctgggagacagagcaagactccctctcaaaaaaaaaaaaaaaaaaaaatccaattcatcaattctaaa

SEQ ID NO: 55390 - DNA, 601 bp, Human
gttcaagaccagcttgggcaacatggcaaaaccccgtctctacaaaaaatacaaaaattagccgggcatagtggcgcacacctgtggtcccagctactcaggagcctgaggcaggactattgattgagtctacgaggtcagaggctgcagtgagccattattcagccactgcactccagcctgggtgacagggcaagaccctgtctcacaaaaaaaaaaaaaaaaatctggttaagacaacaatcaggcagaccacatgcaaaatgttaatacaacaaaaagtgaaaaaagaactcaaatwacacatatattcaaattagatcaaagatataggcagagacatgaagaaaatacatcaaaattaaaataaaggttatgtcagaatactaaatttggggtcagagagagttctttctcttttttctaattatctccaatatggttacataaaacttataattaaggaatgagacctacacatcaaaaaaaaaaggtgaaagatgatcaagagcagatagaaaaaaaaagacactagacagcagcctaaagaagacaaatactgtctaatgtaattttgtttttaaagtaattcttagctggg

SEQ ID NO: 55391 - DNA, 601 bp, Human
aataaattatgacactaccatacaacagaatgtgatgcagccattaaaaataacatggttcccaatttgatggagccaatcaaatataggtaaagaataggatatacatacaatataataccatattttgataggctatgaaactattaacagctacctcaagatagtgagaatgtagcaagtgaaataaaaacagagaaagaaaactttgctactttagcgacttctgtatttaaaattttttagtatcatgtaagccttttgtaattttgttttaaaaagttggttaaggctgggcgcrgtggctcatacctgtaatcccagcactctggaaggccaaagcaggtggattgctcgagcccaggagttcaagaccagcttgggcaacatggcaaaaccccgtctctacaaaaaatacaaaaattagccgggcatagtggcgcacacctgtggtcccagctactcaggagcctgaggcaggactattgattgagtctacgaggtcagaggctgcagtgagccattattcagccactgcactccagcctgggtgacagggcaagaccctgtctcacaaaaaaaaaaaaaaaaatctggttaa

SEQ ID NO: 55392 - DNA, 601 bp, Human
ttcatgctttgaaaggtgattatgtgtaagggtaataactgacccagactgctctgtgacttgaagctctgggtaagctttttgtaaacttccattcaaaagtaaagagatccaaatgacatcagaactcttcaggtaccagcaccaggaagactgaatatctctttcaatatgccatgaacacctgcaaggactaaacaaacactttgacggtgcgtgtgtcaaatttagttacaacaaatccgtgtatgacaaaaatgctcacgtcctggctaatagttcaaatatttcaaaaatattmaatacaacagaaaatttggacagactccaatttgccgttttgagatttgacctatggtagattatgggcctaacattggcttataagtcaaaaacaaacgtttatcttgggcttgccaaacagtcttttatgatgtaaagtactaatttttgaagaggttttttttttattctacagttttgagttttatctttgttctctagaagaaattttgagtaagtttaaagtcatgaattcctatgctgtggcaatctgtacaataaaaaaaatttagatgattctacataacttcctattata

SEQ ID NO: 55393 - DNA, 601 bp, Human
tcacgctctttctacaccagcatcttgctatttactagaactatttatggattgctatgacatctctatctagcagctgtatttagctgcagtttcccatctgcttctagcaagtaaatctgaagaaaaagaagatagtgtgcctaagctggaacagctcaacagcctaggtgttatgactaatatgaatgtagtattaacaaaacaaaatttgctacatgtgtaactcttatcattagaaacctatcagtggaatggacctccgccttccaacagctgcccatttcattgaatttgttcyctctgaagtagtacacaaaacagatcttcacgatggctggccaacgatttgcctggaaaagattaaacactacacagccaaatatgcagatttcctggaagtactgttgcaaaattacccctttctaaattatgcactttcttctgtagctgctacatgtatggcttcttcgaggattatacttcgtctttctccaacatggcctacaagactacatcattacatcatcttactgcttactcctggtatttcttagtgccgtgtactgaacagctattgactgctcatgataatgatgtg

SEQ ID NO: 55394 - DNA, 601 bp, Human
aagtcagccctattcaacatgggaagaaagcgcataacagcataaatataaggaagtggagaccactgacagccatcctggaggctaatgacctcatgtgacatattatgttcaacacacaaagttgggcaataatgaaaatgtaaaagggcatgtttatatgatatactgtttataaacatacatataagtataatgttatatcttaaagaagatggggattatgtttacaagtacatttataatgtttatttcttaaggtgggtgatgtgaacataggtttttttttttttttttttttgcatctgaaatattcattataaaaaactgatgctttgggccagctgtagtggctcacgcctgaaatcctagcactttgagaggctgaggtgggtggatcactacaggtcaggagttcaagaccagcctggccaacatgttgaaaccccgtctccactaaaaaatataaaaattagccggacgtgggtggcacacacctgtagtcccagctattcaggaggctgaagcaggagaatcacttgaacccaggaggcagatattgcagtgagccaagatcacaccactgcactccagcctgggc

SEQ ID NO: 55395 - DNA, 601 bp, Human
caccagaatactatcaatttcactcaacaaatacttactaaacataggcataaggctaggcattgagtgggaaaataagtaagacatatggttcctgtcctgtcttcaaattgctcactagtaatgaagtatggggaggcaaacatggaaacaattacaagtctctttctctcatccattactaccaaacctagtagcttaatacattaaatatttattatctcccagtttctgtatgtcagaaactgcagtacagtttagctgggcgattctggctcatggcctctcatgagcttgcagcaatcttggctagtgctgctgtcatctgaaggcttgactggggctggaagagctgcttcaaagatggctccctcatatagttattggcaaaagtcctcagtttctcaccatgtggacctttccataagactgctgagtatcttcaccttgtggcaactggcttcccccagaacaagaaagcaagacagaaaatgcttacatgatttagcttcataagtcactctgatatttttgtaatattcaattggttacacaagtcagccctattcaacatgggaagaaagcgcataacagcataaat

SEQ ID NO: 55396 - DNA, 601 bp, Human
tgtaactactctaattttattaactaacccatttttcctttacctctgggaacttctctatcttctccttagccccttagttgtgaaaattcaataaaatgacggaatctcgctctgttgcccaggctagagtacagtggcacaatctcagctcactacagcctccgcctcttgggttcaagcaattctcctgcctcagcctcctgagtacctggaattacaggcacgtgccaccacgcctggctactttttgtatttttagtagagacagggtttcaccatgttggccaggctggtctcraactcctggcctcaagtgatttgcccgcctcgacctcccaaagtgctgggattacaggcgtgagccactcactgcacccagcctaatgaaacgtcttaatacagatatttttttcacctgttgtgcttagcactccaatgggcccttttaatttagaaaaggaccaatcggagtgctaagcacagcaggttgttcagttctgggaacttttccttctttgtggggagcggggagtcgacctgagcatgacgaggggcagcggtgcagcacagccctgttttcctaatttcttttatgaca

SEQ ID NO: 55397 - DNA, 601 bp, Human
actgtagcctgagcgacagaacaagactccctctcaaaaaaaataaaaataaataaaaaacatatttttggttacaccaatattcagtgtatgcattaacatgactatgtaactttagtcacagttgttctatgaggtatactgtgattacttttactttcttggaccaattttttactttccctggagttaataaatgtctaattgtttagctttatttgtacttataaattcacccccaattcatccaattatataaatctcctcaacatattcgagcatatcacatgtgctatcaatsttatatttttgtacaagtcctttctgcaaccttctgacttgctccattctggactagttgctctacacctggtacacaactgtgatcccaggtattcctttcacctcacttgggttggatcatttgtttcctaaacactatgtcttccctttgctcaaaacactcttattttggtggagtacctcctctactaccttcctgaaaggggttgcatgagaggtgagtttgagacactgcatatgtgaaaatgctttttctactgttacacttgaaaatgactgcactataaactcttagatt

SEQ ID NO: 55398 - DNA, 601 bp, Human
tccatactaattcatgttcacataactgctctctaagtctcttaaaatgctcaatcaagccaccaaagttgacacagatgaaaataagctcaccactcaaaaatataactcacacaagagacaaaactcaataaatgacagctgagcatagaattagacccacaagcacttcaactattggaattatcaaatacagaatatataactacttttaaaatgcttaaagcaataaaagaattttttaaatgagcaaggaataggatacaaacaaagatcatgcaaatttttgaagtatccaagyggaacttatagaaataaaaaatttaataaatgaaataggaaaaaaagggaggtgagatgtggggaagacagagggatagagaattaaacagacataaacagaaaatcaatgaactagaagagccgaagacattaactcagaaggcagcacagatacaaatcaatacttaagaggtttattttaatacaaaaccaaataaaaaatggtatttgctttaccaaactaagtcatctttcatataacaagataatgaatacatgaaaacataaaaataaatcaagaatcaaaactaaaactaac

SEQ ID NO: 55399 - DNA, 601 bp, Human
aagtgttataaaataatgtactttgccaagcattcgaagagtcactaaaatgtagatccaaccttatcacacataatctacatcctgctaaaagggggcccacagcctcagatttccaaatatccatactaattcatgttcacataactgctctctaagtctcttaaaatgctcaatcaagccaccaaagttgacacagatgaaaataagctcaccactcaaaaatataactcacacaagagacaaaactcaataaatgacagctgagcatagaattagacccacaagcacttcaactatyggaattatcaaatacagaatatataactacttttaaaatgcttaaagcaataaaagaattttttaaatgagcaaggaataggatacaaacaaagatcatgcaaatttttgaagtatccaagtggaacttatagaaataaaaaatttaataaatgaaataggaaaaaaagggaggtgagatgtggggaagacagagggatagagaattaaacagacataaacagaaaatcaatgaactagaagagccgaagacattaactcagaaggcagcacagatacaaatcaatacttaagaggttta

SEQ ID NO: 55400 - DNA, 601 bp, Human
tgagaccaaagacgtgaagcagagacaagtcctcttcataatcctctgtctaaattcctgacccacagaatctaagcacatactaaaatgattatttgaagccattaagtttcatggtggtttgttacaccgctacagtaactggaacaatatcacattatcccacaaaacaaaattaaaatatttaacagtgcttgaaataaaaccaagaaactaaaagtatagagtatcagtaaagacagcataccagacttatttttattttggggagacagaggcttcaaataattgagaaaaaaacatcttttcatttgtctatagtgtgctatgagtaggtacaagtacactaagaaaatataaatacatattggccagtcacggtggctcatggttgtaatcccagcactctgggaggccgatgcgggcagatcacctgaggtcgggagtttgacaccagcctgaccaacagaagaaaccccatctctactaaaaatacaaaaattagctgggcgtggtggcgtatatgtgtaatcccagctacttgggaggctgaggcaggagaatcacttgaacctgggaggcagaggttgcggtgagccaa

SEQ ID NO: 55401 - DNA, 601 bp, Human
cagcaaccaagctttaggcagccaacattgaacccatgttctaataaagcaaatgccaagctgtaaccaaaagagctgtctctttacctcgcttctgttttctgtccataaatgctgcttgaccacattgcaggtcagagttctctgaacttgttctggttctgaaggctgtccgagttgtgaatcgttctttgctcaattaaactctgttaaatttaatgtgtctaaggcctttcctttttaccagtgagtactcaatactttctcaatgacttttgattaattttgattgttaaatagmacatttcaatgaaggtatctcctattcaaaattccctttgcagctatacacactaaaaataacttttaaagtactgtactggctgggcacagtggctcacgcctgaaatcccagcactctgggaggccgaggtgggtggatcacttgaggtcaggagctcgagatcagtctggccaacatggtgaaaccctgtctccactaaaaatacaaaaattagccgggtgtagtggtgcatgcctgtagtctcacctacttgggaggctgaggtgggaggatgacttgagcccaggaggccaaggc

SEQ ID NO: 55402 - DNA, 601 bp, Human
ctcccgagctcaagcaatcctcccacctcagcctcctgagtagctgggaccacaggcacacaactaccatgccaggctaattttttttttttttttttttggtagagacagggtttcaccatgttgcccaggctggtctcaaactcctggggctcaagcgatccacctgcctcaggctccaaaagtgctgagatgacaggcgtggaccacccacccagcctttttcactctttactgcaaaacaaattctgagaaatgctgctcagttgccaacagtactcattctttaaggtgtttgtgygctctgtgtcatgtttctcttcacttctatggtacttcttgtttatattaaatattgtgacattcattaataatgataatattcactgagtactttcacatacattatcacctcatctccacagtgctatatgtgccatattatgcttacactgttatattataaaccattagatgtactactgcctctcagtaccttaagaaagaaaaacaggccacatatggtggctcaggcctataatcccaacactttgggaggcagaggcaggaggatcacttgagatcaagaattcaagaccag

SEQ ID NO: 55403 - DNA, 601 bp, Human
tataaatcaaactctaagcactgcttttgctgcttttcattttccttcagttcaaaatatttttagtttgagacttcaactcatgtgttacttagaagtgtgttttttaattcccaagtattttcagattttccaaatatctttctaactatacaacacaagttgtatagataattgttagtgatctctaacttaattccaccgtggtctgagaatacaagttaagatgtgttttatgtcccagaatgtggttaatcttggcgaatgttccatatgagtttgagaaaaatgtgttttttgytgttgttggatgaagcagtctatatatatcaattaaatccagttgataaatggtgctattcagctatagcctaactgattttctgtctgctacactataaattactgagaggtgttgaggcatccaactataatagtgaatttgtctattactccttacactgctattggtttttgcctcacagactattttgtcttctttgagaacggacccatttatcattatgtaatgcctgtctttatccctgataattctccttcttaagtttgctttgtttgaaattaatataattatgccaaa

SEQ ID NO: 55404 - DNA, 601 bp, Human
caatctcccatgagaaacagacatgattatatcactttatattttattaaaaggatgctcttaacttccctaaaatagatctatttttaaagattctgattttagatcaaaaaatcatgagggagaaaaggacatggctatggttaattacttcctgaatcatactgtgaaactgaatcacatttctagagtataatattcccccctgggtaaagggtactattgtgggtaaagaggaactatgagtatgggtacctgtgccatcaccgagagtcaaaaacccaacagatctttaaatgtyaaaagtcaagttacctttaaaaaaaaaaaaaggggcagtgcggcagaacacatttcataatgtcaggacttcagctatatacagatgtcacaaagattcaccaatcattttgcagttctatctttttacccttccttagagccagggaatatttcctaatactttttcatatctgtttactgaatgaacacatgagatgattttaaaatatagttaccattagtgtacatacagcttgcttatataaacatttcactatctattatcattttacaatcttccttcaaaaagtacaggaac

SEQ ID NO: 55405 - DNA, 601 bp, Human
ctgacaatgtaaatatgtcacaaagttcctgtctatctcatagaggtgttatgcatttattttaaaaagtgaacatactggccgggcacggtggctcacacctgtaatcccaacactttgggaggccaacgcaggcagatcaccctgaggtcaggagttcgagaccagcttggccaacatgacaaaaccccgtgtctactaaaaatacaaaaattagctgggcatggtggcgggcgcctgtaatcccagctactcaggagtctgaggcaggagaatcacttgaacccgagaggcagaggtygcaatgcaccaagatcacgccactgctctccagcctgagcaacaaaagcgaaactccgtctcaaaaaaaaaaaaaaaaaaagcgaacacactttgaaaatgctaaaaccatcattaaaaaggcttagtaatcacacacaaaaaaggccacatattgtatgattccatttacataaaagttccaaacaggcaaatccagaagtagatcagtaatttccagggcctgggaaaagggatggaaaatgactactaatgggtacaggatttctttatggggtgatgaaaataatctgggattggt

SEQ ID NO: 55406 - DNA, 601 bp, Human
aagtttctgttttaggtggctaaccaggaagaaaaaagcctttaagattcctctcttttctaagattcaacgaattatacatatgctcacatatttgtcataaaccatgccaacctcctaagcagatatgtatacaacaaattcagctgaaaaagaaaatgtacatactgttcaaagctaacactggtttatatatggcaatccatatgaacatatgtacacacacaaaaaaaaaatcctgtccaggtcctggtagtaggtaccactctcctcattggttacccaagcatttcctcctgcyctcaatatatacatggctttttctctgtctccacttcctccacttcaatttagcagggaaattccatgtacggaaaggataaaatggaaaagcaattctaaggacatagttaagccacttaacctgaggatggagcatctaaaaggacaaagattccattacaagtgctgaataggggcaagagttttattaaactcaagatgcctctcattttctttccatttgccaataattttccccttttagaacttacttcctttagaaatgatattatagaaaggatcagtgggctgttaccgt

SEQ ID NO: 55407 - DNA, 601 bp, Human
gtagtacattctctaccaatagctacgttaatgtggcaattgtaaaagccaaatgtcaagcgttggttaagggttaagtttctgttttaggtggctaaccaggaagaaaaaagcctttaagattcctctcttttctaagattcaacgaattatacatatgctcacatatttgtcataaaccatgccaacctcctaagcagatatgtatacaacaaattcagctgaaaaagaaaatgtacatactgttcaaagctaacactggtttatatatggcaatccatatgaacatatgtacacacacaaaaaaaaaatcctgtccaggtcctggtagtaggtaccactctcctcattggttacccaagcatttcctcctgccctcaatatatacatggctttttctctgtctccacttcctccacttcaatttagcagggaaattccatgtacggaaaggataaaatggaaaagcaattctaaggacatagttaagccacttaacctgaggatggagcatctaaaaggacaaagattccattacaagtgctgaataggggcaagagttttattaaactcaagatgcctctcattttctttccatttg

SEQ ID NO: 55408 - DNA, 601 bp, Human
cagttaaacatatacctaccatatgatccagtcattccattccaagagaaatgaaagcatatatccatgcaaaggcttaaacacaaatgtttatggcatttaatagcaacaggtgagtgaataaactgtgatatttccacatgatggaatactataaaaaggaatcaactatcaatatgtgctataacatgactttcaaaattatgctgagtgaaataatccataccaaaaaaactacatactgtatgattccatttctacaaaattctagaaaatgcaaactacagtggctgcctggggrcagcgacggggataatggagatgttcattttcttgattttggcgacaatttcacaggtgtatacatatgtcagaatgtatcaaattgtacagtttacgcatagttgattacaacaatacatcaaaaaacctgttaaaagttatttttgttatgattttaagccagtagcattatatagcttgactgagcacaaaagggtgctcttccatatgtatataatgtatatattatattatgtattatatataattatatgatatatgatatatgtcatatatattatatatacatatatcataa

SEQ ID NO: 55409 - DNA, 601 bp, Human
cactgcaagctccacctccaacagaaactatttctatttatcctttgtctcttttctattctaattgtcatggacatgtatagtggctttagatttacttaaaggagtaaacttggaatgctcaaagataaataaaataagataaaacttctgctttttgaaagacacttttaagagaatggtaagctgccagctgggggaagaatttgaaagtcatgtgcttgatacaagacttttaccccaaacatataaagaactctccaaacatagtaataagaaagcaaataatcaaatttttttwaaaaaatcaaagaatatatacagatgacaaataaacacataaaaagatgctcaaaaccaacagagaaatgcaaattaaaaccagagatactaatacctaataaaatggcttaaactaaaaagactgatcataccaagtgttgacaaggatgtagaagaactggtaatttcatacactgctggcgggatatcaaaaatacaggccctttgaaaaacagtttggcagttaaacatatacctaccatatgatccagtcattccattccaagagaaatgaaagcatatatccatgcaaaggctt

SEQ ID NO: 55410 - DNA, 601 bp, Human
aatgctcttgactgatgttttctattgacacccagaaaatactactataagcagaacagaaactatttctttttcttctttttttttgagacggagtctcactctgtcgcccaggctgcagtgcagtggcatgatctccgctcactgcaagctccacctccaacagaaactatttctatttatcctttgtctcttttctattctaattgtcatggacatgtatagtggctttagatttacttaaaggagtaaacttggaatgctcaaagataaataaaataagataaaacttctgctttttgaaagacacttttaagagaatggtaagctgccagctgggggaagaatttgaaagtcatgtgcttgatacaagacttttaccccaaacatataaagaactctccaaacatagtaataagaaagcaaataatcaaattttttttaaaaaatcaaagaatatatacagatgacaaataaacacataaaaagatgctcaaaaccaacagagaaatgcaaattaaaaccagagatactaatacctaataaaatggcttaaactaaaaagactgatcataccaagtgttgacaaggatgtagaaga

SEQ ID NO: 55411 - DNA, 601 bp, Human
cccaaagccttacatgactgccactcagtaacttgttaaagacattgattccaaaacaggagagacagcaagcaaagaagggaaaggtgacaaaaaatagtgaaacagctgcaaaggaattgcattgaaattgaggatatatgctgatggagatatatcactgccacagggagaaactatttgctttcaagttttcttacctaaggggagcaaagagaagggcaaaccaatgttcttttccatggatgaagcatcagaaaggtcacaaactttgccacttctctggccagtcttaaagctytgacaataggctgggcacggtggctcacgtctgtaatcctggcactttgggaggctgaggagggcggatcacaaggtcaggagtttgagaccagcctggccaacatagagaaaccccgtcactactaaaaatacaaaatattagctgggcgtggtggcgggcacctgtaatcctagctacttgggaggctgagggagaagaattgcttgaacccaggaggcagacattgcagtgagcagagatcgcaccactgcactccagcctgggagacatgtgagactccatctcaaaaaaaaaaaa

SEQ ID NO: 55412 - DNA, 601 bp, Human
ctatctgatttcaagactcagtataagcctacaataatcaaggcagtatagtgctagtattaagatagacatgtagaccaacagaacagaatagagcccagaaatagactcatacacatacagacaactgatatctgacaaaaatgcaaaagtaattaagtaaagaaagaacagccatttcaataaatggtacaggaataattagatgtccatattcaaaaaatgaactccaaatgtatcacagagctaaatgtcaaacttaaaactataaaacgttcaggaaaaaaataggagagaaacsgtataatcttggatcaccgaaagcacaatccataaaagaacaatttgaaattgtaacttaatcaaaatttaaaatttctgttctttagtggcacgagagagatggcacagttgaacactgggcagcactgccagattttctttcatttgtgtgtgatactcaggaatattttgccttgaatacaaaagctggcggcagtctcatggttgtcctgagatgactgtaatcaatgagagactgaagacataaacataaattttacccatgctcattcaaggaccgtgttgaaaaacttgtggc

SEQ ID NO: 55413 - DNA, 601 bp, Human
atctagacaaaaaccaaaaaaaactaccaaaacaataactgagtttagcaaagctgcaggatacatgaatcaatataagaaaaacaattgtagagccaggcacagtggctcaggcctgtaatcccagcactttgggaggccgaggtaggcaaatcacttgaggtcaggagctcgagaccagtctggccaacatggtgaaaccccatctctactaaaaatacaaaaattagccgtcatagtggcacatgcctataatcctagctactcaggaggctgagggagaagaattgcttcaactcargaggcagaggtcacagtgagcagagatcacaccactgcactccagcctgagtgagtgaggccccatttcaaaaaaacaaaaaaagaaatacaattgtattttctttttaacacagaaggtgttgacaattgtagttctatatgccagcaatgaacaattaaaaatgaagtttacaaaaacaataccattgacaaataataattgagaaatacattgtgttcatggggaggaaggcaatattgttagagatttaatgcaatcccaaccaaaatttcagcaggcgtttttgtagaaattaac

SEQ ID NO: 55414 - DNA, 601 bp, Human
tgtctgttcaccacttccattcaaatttatacaggaggttcccagttagtagcaatggtcaagaaaataaataaaaggcatccagattggaaagaagcaaaagtgctcttattcacagatgataggctcatctacatagaaaatctaatggaatctagacaaaaaccaaaaaaaactaccaaaacaataactgagtttagcaaagctgcaggatacatgaatcaatataagaaaaacaattgtagagccaggcacagtggctcaggcctgtaatcccagcactttgggaggccgaggtagrcaaatcacttgaggtcaggagctcgagaccagtctggccaacatggtgaaaccccatctctactaaaaatacaaaaattagccgtcatagtggcacatgcctataatcctagctactcaggaggctgagggagaagaattgcttcaactcaggaggcagaggtcacagtgagcagagatcacaccactgcactccagcctgagtgagtgaggccccatttcaaaaaaacaaaaaaagaaatacaattgtattttctttttaacacagaaggtgttgacaattgtagttctatatgccagc

SEQ ID NO: 55415 - DNA, 601 bp, Human
attaaaatatttggaaaataaaaactgtcaacctattaaatagaattctatagtcaaagaaatatatgtaaaaatcaaagccaaaatgatgaccttctcaaacatacaaacgctaaataattcatcaccaataccaccaactacatgaaatgttaaagaaaaagtatttcaagaaggaaatatcagatggaaatctggatctaaagaaaggacagaagagcattagaaatggtaactaaataggtaaacacataaaagttttttcttattatttcaatctcatttaaagataattgactgytgagttaaaaaataatgtagtgtagagtttataacacatataaaagtaaaatgcatgacaaaactggtacaaaggactggacaggagaaatgcaagtgtgctattataaggtgcttacagtacatgtgaagtggtataaccctcaaagtcagactgataagttaaagatttatattataaatcttaacacaaccaccaaaataacagttatagcttataaatcaataaatgaactataacaaaatcataaaaatattcaataaagtcaaagatggcagaattaaaggaaacaatataaga

SEQ ID NO: 55416 - DNA, 601 bp, Human
gtgataaagcagagaaaagagacatatacaaagaaacaaatgtgcttgagagtaacaaacaaacaaaaagacaaggaacacactgaatttctcactgaaaacacaagagagaaatcaatgaaatcgcaacattaaaatatttggaaaataaaaactgtcaacctattaaatagaattctatagtcaaagaaatatatgtaaaaatcaaagccaaaatgatgaccttctcaaacatacaaacgctaaataattcatcaccaataccaccaactacatgaaatgttaaagaaaaagtatttcragaaggaaatatcagatggaaatctggatctaaagaaaggacagaagagcattagaaatggtaactaaataggtaaacacataaaagttttttcttattatttcaatctcatttaaagataattgactgttgagttaaaaaataatgtagtgtagagtttataacacatataaaagtaaaatgcatgacaaaactggtacaaaggactggacaggagaaatgcaagtgtgctattataaggtgcttacagtacatgtgaagtggtataaccctcaaagtcagactgataagttaaagatt

SEQ ID NO: 55417 - DNA, 601 bp, Human
gagccatatttttcttcttgcagaaagtgagtagcagaaatatcgctgaattattttcccagcaaggaataaccctggggaaggaatgcaattcctgtgggtaggtctatgaacggctgctctgggaatgtctgtcttacgcggttgagataaggactgaaatacgccctggtctcctgcagtaccctcagacttactaggattgggaaattccagcctgttaaattctagtcagactggttgtctgctctcgaaccctgtttcctgttaagatgtttatcaagacaatgcgtgcacagtrggacatagaccctcatcagtaattctaattttgccttgccttgtgatctttattgccctttaaagcatgtgatccttgtgacctactccctgttccaccccctccccttttaaaatccctaataaaaacttgctggttttgcagctcggggtcatcatcaaggtcctaccaatatgtgatgacaccccctgaggcccagctgtaaaatttatctctttgtactctttctctttatttctcagaccggccgacacttagggaaaatagaaaagaacctacgttgaaatactgggggctggt

SEQ ID NO: 55418 - DNA, 601 bp, Human
agagccatatttttcttcttgcagaaagtgagtagcagaaatatcgctgaattattttcccagcaaggaataaccctggggaaggaatgcaattcctgtgggtaggtctatgaacggctgctctgggaatgtctgtcttacgcggttgagataaggactgaaatacgccctggtctcctgcagtaccctcagacttactaggattgggaaattccagcctgttaaattctagtcagactggttgtctgctctcgaaccctgtttcctgttaagatgtttatcaagacaatgcgtgcacagygggacatagaccctcatcagtaattctaattttgccttgccttgtgatctttattgccctttaaagcatgtgatccttgtgacctactccctgttccaccccctccccttttaaaatccctaataaaaacttgctggttttgcagctcggggtcatcatcaaggtcctaccaatatgtgatgacaccccctgaggcccagctgtaaaatttatctctttgtactctttctctttatttctcagaccggccgacacttagggaaaatagaaaagaacctacgttgaaatactgggggctgg

SEQ ID NO: 55419 - DNA, 601 bp, Human
aaattgattgtaaaatatgtgtgtttgaacaatagaaaatcagtgcaccctgaaaaagaacagaataacagcgattttcagggaacaagggaagataaccataaggtctgactgcctgcggggtcgagcagaacagagccatatttttcttcttgcagaaagtgagtagcagaaatatcgctgaattattttcccagcaaggaataaccctggggaaggaatgcaattcctgtgggtaggtctatgaacggctgctctgggaatgtctgtcttacgcggttgagataaggactgaaatackccctggtctcctgcagtaccctcagacttactaggattgggaaattccagcctgttaaattctagtcagactggttgtctgctctcgaaccctgtttcctgttaagatgtttatcaagacaatgcgtgcacagtgggacatagaccctcatcagtaattctaattttgccttgccttgtgatctttattgccctttaaagcatgtgatccttgtgacctactccctgttccaccccctccccttttaaaatccctaataaaaacttgctggttttgcagctcggggtcatcatcaaggtc

SEQ ID NO: 55420 - DNA, 601 bp, Human
gtcacctcaggatcactattgtacaaattgattgtaaaatatgtgtgtttgaacaatagaaaatcagtgcaccctgaaaaagaacagaataacagcgattttcagggaacaagggaagataaccataaggtctgactgcctgcggggtcgagcagaacagagccatatttttcttcttgcagaaagtgagtagcagaaatatcgctgaattattttcccagcaaggaataaccctggggaaggaatgcaattcctgtgggtaggtctatgaacggctgctctgggaatgtctgtcttacgyggttgagataaggactgaaatacgccctggtctcctgcagtaccctcagacttactaggattgggaaattccagcctgttaaattctagtcagactggttgtctgctctcgaaccctgtttcctgttaagatgtttatcaagacaatgcgtgcacagtgggacatagaccctcatcagtaattctaattttgccttgccttgtgatctttattgccctttaaagcatgtgatccttgtgacctactccctgttccaccccctccccttttaaaatccctaataaaaacttgctggttttg

SEQ ID NO: 55421 - DNA, 601 bp, Human
tgttatcttcgtaaactgagaatatacgtcacctcaggatcactattgtacaaattgattgtaaaatatgtgtgtttgaacaatagaaaatcagtgcaccctgaaaaagaacagaataacagcgattttcagggaacaagggaagataaccataaggtctgactgcctgcggggtcgagcagaacagagccatatttttcttcttgcagaaagtgagtagcagaaatatcgctgaattattttcccagcaaggaataaccctggggaaggaatgcaattcctgtgggtaggtctatgaacrgctgctctgggaatgtctgtcttacgcggttgagataaggactgaaatacgccctggtctcctgcagtaccctcagacttactaggattgggaaattccagcctgttaaattctagtcagactggttgtctgctctcgaaccctgtttcctgttaagatgtttatcaagacaatgcgtgcacagtgggacatagaccctcatcagtaattctaattttgccttgccttgtgatctttattgccctttaaagcatgtgatccttgtgacctactccctgttccaccccctccccttttaaa

SEQ ID NO: 55422 - DNA, 601 bp, Human
aatcaatactgtgaaaatggccatactgcccaaagtaatttatagattcaatgctatccccatgaagctacaattgactttcttcacagaattggaaaaaactactttaaagttcatatggaaccaaaaaagagcccacattgccgaaacaatcctaagcaaaaagaacaaagctggaagcatcatgccacctgacttcaaactacactacaaggctacagtaaccaaaacagcatggtactggtatcaaaacagagatatagaccaatagaacagaacagaggcctcagaaataacaccrcacatctacaaccatctgctctttgacaaacctgacaaaaacaaaaaatggggaaaggattccctattcaataaacggtgctgggaaaactggctagccacatgtagaaagctgaaactggatcccttccttacaccttatacaaaaattaatccgagatggattaaagacttaaatgttagatctaaaaccataaaaactcttgaagaaaacctaggcaatacctttcaggacataggcacgggcaaagacttcatgactaaaacaccaaaagcaatggcaacaaaagccaaaatagac

SEQ ID NO: 55423 - DNA, 601 bp, Human
ccaccatgtccagctaatttttttgtatttttagtagagacagggtttcaccatattggtcagggctggtatcgaactcctgacctcaggtgatccacccgcctcggcctcccaaagtgctgggattacaggcataagccaccgtgccctgacagtttcaatgatttttaaaaatacacacacgcgactcaaaatttgaacccaaaagttcaaattttttagtacttccacacaagaataaagagtgacttaaacttctgctccttttatttcttcaagttcttgtcaaaatctcttttckgaacatctttcaacaactctagtaaggaggcgtgttccaagatggctgaataggaacagctctggtctgcagctcccagcgtgatcgacgcagaagacgggtgatttctgcatttccaactgaggtacctggttcatctcactgagactggttggacagtgggtgcagcccacagagggcgagccaaagcagggcggggcgtcacctcacccagtaagcacaaggcttcgggggatttccctttcctaaccaagggaagcagtgacagactgtacctggaaaaacgggacactcctgctc

SEQ ID NO: 55424 - DNA, 601 bp, Human
actgcacctaacctttacttttaactaaagtcagagagatgtttttccaccaggattgttctcccaaggcaaaacaagactcattctctacatataaatccttcccatggattctgagttttaatgatttttttttctttttttttgagatggagtctcactctgtcgcccacgatggagtgcagtggcacgatctcggctcactgcaacctccgcctcccaggttcaaacaattctcctgtctcagccttccaagtagctgggactacaggtgcctgccaccatgtccagctaatttttytgtatttttagtagagacagggtttcaccatattggtcagggctggtatcgaactcctgacctcaggtgatccacccgcctcggcctcccaaagtgctgggattacaggcataagccaccgtgccctgacagtttcaatgatttttaaaaatacacacacgcgactcaaaatttgaacccaaaagttcaaattttttagtacttccacacaagaataaagagtgacttaaacttctgctccttttatttcttcaagttcttgtcaaaatctcttttctgaacatctttcaacaactctag

SEQ ID NO: 55425 - DNA, 601 bp, Human
tcatctacatttggggaagggaagaataaatcctaaataaaagcatctactttgttatgctacaaagtgtaagttgtatctcataatttttactttagatatataacttacatatctatattacaaaccacagaagtagagagaattcaaattattatccttgcaatttttccccagacttactagttggtggggcgataggacagaacaggaagaagagcactaaagcttagtgtttgtcattttactttacttaatcttatttttcaaagagagggtcttgctctgtctctcaggctgragtatagtaatgtgatcagagctcactgcaaccttaaatttctgggctacagcaatacttctgcctcagcctcctaggtagctaggactacaggaacatgccatcacacccagctaattcttttattttctgtactgatggggtcttgcaaatgttgcccaggctggtcttgaactcttggcctcgtgcaattctcccacctcggactcccaaaatcctgggattacaggcatgaaccactgcacctaacctttacttttaactaaagtcagagagatgtttttccaccaggattgttct

SEQ ID NO: 55426 - DNA, 601 bp, Human
aaaacaatcctcaatgaaaataataagaacaaagacttcaaatgaagatctacagacctttcctatgattaaaaatacaagaatttttaaatagagacttgaaaatatctattttgcttgcaagctcttcacttccttggtgttgctggatgttttatggagagtatcctcaggaaaactgaggtaatgctatggtggtaaaattataaatataagatggacattaggtcatctagatcagcctgtccaaaagagatataatgcagtccacttatgcaaagctaaatgttctaatcactamaattaaaagctttttaaaaaagatgaaaaatatatatataagatatatatattaagatatatcttaaatagagatggggtcttgagaggctggtctcaaactcctgggcttaagcaatcctcccacctaggcctcccaaagtgctaccattagaggagtgagccaccaggcccagcctgaaattaattttaataatttattttatcaaatacagttgaaatgtcacttcaacaggtaaacaaaattttttcaattaccaagatagtctctttttcaaatcaagttttaaaatctagtaca

SEQ ID NO: 55427 - DNA, 601 bp, Human
ggtcaaggcttcagtgagccatgatcacacgactgcactctagcctacgtgacagagcaagaccctgtttcaaaaaaaaggcagagagatttattacggaggaggcaacttttcaaacacaaggttcaaacatctctttgtaatgtaacaccaaagaaacaagatatgaatgtgcagcaacttgccaggtaaaagaatggaaaatgattaacaaaaaacttattttagtccatttgagcttctataacaaaatatcttggactgggtaatttttaaacaacagaaatttattgctcacagwttggagggtgggaagcccaagatcaaggcaccagcaagtttggcataagataaggacccattcctcacagatggaggcctttacgggccctcacatggtggaaggggcaaaggactccctcaagcctcttataaccacactaatcccatttatgaggattacagactcccaaaggcccaatatattaataccatcacctttgggattagctttcaacgcatgaattttagagggtaacaaaaagaccatagcaaaactacatgcctaacccagagaggaatcacatcctttcacatcaac

SEQ ID NO: 55428 - DNA, 601 bp, Human
atgacagagtacagacttcacgatggccatataagaaaaaagaatagcttgtgtatggcagcatgcagatgataaacagccccccaaaaaggcttatctataatactatgatttgaaaatacaagggaggaaagggaaaagaatgagttctcttttgagtatttggagtttgaagtacttgggggaaaatccatgtagacaataagcacagcagttgaaaagacaaatctgaagttcataagcaaggtgaacgccacaaacaaaaatctggtaattatctgaaaacagttgatattaaacwtcttgagtatcctattgtactcagcataatgttttcctatggataccagaactcagaaagcaggatacaacagcaactggtcaacatgccagttggtaatttataaactgctaagataatttataaggagctaagaaaggatctaaggaagaaaaacgctgtatgatacaaacacctgggaagctaaatacactggcacttaaaagtgcagtagtcccagctacttggaaggctgaagtagaaggactgcttgagcccaggaggtcaaggcttcagtgagccatgatcacacgactgcac

SEQ ID NO: 55429 - DNA, 601 bp, Human
atacataagaagatgttcaacatcactagtcatagggaaaaagcaaattgaaaacacaatgagatattttacaaccattaagatagttacaatcgagatgacaaataacaaacagttaagtgtttgtgagaatatggagacaatggaactctcatacactacttgtgggaatgtaaaatggtacaagcacttcagcctggcagttcctcaaatgataagcacaaaattaccatgactcagcaattccactcttaggtatatatccaaaagaaatgaaaatttatatccatcaaaaacttayatacaagcattcacagaaacattattcatgatatcaaaaaaaagaaaaatccaagtgtccatcaactgatgaatggattaaaaaaacatggtatacccaaacaatggaataccagccacgagaaggaattatattctgatacacactatgacatccatgaaccttgaaaacatgatgttaagttaatgaagccagtcacaaaagggcacatattccatgaatacatttatatgaaatatctagaagaaagaaaatagatcagcagctgctgagggttgtagtaggagtgaaggtagtcag

SEQ ID NO: 55430 - DNA, 601 bp, Human
ccttactgaaggaaaatttaatatattttcatggcaacaataattaaaataaaatttcccaaatattgctaaaaacataaaaacataccaaacagccaaagtgagcatcaactaattattataaataattttacttgaaaaaaattatttcagaacaaggtctctgaggaaaataaaaagataaaaaaagaattaatgatgatgttttactttaaatactgttttaaaatacatattatttcagtaagtccgtaatatatcttatggaaaaattagtttacataggtaattttccacatgwttctaaaccctaagaattgtaaatgcaataaagaaacaaattttactgaaataacctgaatcctagttatttgccatacttatttactgactgcttgctacatctcaattaaattgcatcactatcaacagagatatgcagttcaaagaaaataatggttttcctaagttaaacctaagttcgaggtgtaatccaagtatagatgaagaagcacctaaacagaaggcttttagagagtcaaaaagtcttggattgctgagttattaatacaacttctaggataggcacaaatatcaagtg

SEQ ID NO: 55431 - DNA, 601 bp, Human
tgaaagaagggttaagataatttccaagatccaatccatgactaatcactacattaagtcttttatttataaaaggaaggtggaaaacgtagctctatcactattttatatagctactactcacttccagtaattcttcaggaaaagtcatctgcttaggctacaacaaaagctcacaatactaattcataaaatacaaaagctgagaaagaaaataaacatatagaggtcaaatcctatttaacagattatacaaccaccctttgagagccagatttatatgctactcatctttatatcscttagaacatttagctcaatgcaaagtatattatcaaaatgaaataaaatcataagtccaaattttaaaattccaaattccaggtatgtcattttcaataatacaacagtataaactgaacaaacaaattctatccttactgaaggaaaatttaatatattttcatggcaacaataattaaaataaaatttcccaaatattgctaaaaacataaaaacataccaaacagccaaagtgagcatcaactaattattataaataattttacttgaaaaaaattatttcagaacaaggtctctg

SEQ ID NO: 55432 - DNA, 601 bp, Human
attcattaacaattcttccccaaagaatccaagaatcttcttcaaggtgactgaggttgctagaggctgatgaactcgacacaagagaagagccactgtttcttcttgacccatttacagatcttaaagacttactatccgtttctaacaatctaaaatataattaaaaactgttcaagatctaatcggacagtgatattagaagaggcattgatgatacttagagctttattactgcaatttaaccattgttttaaaatatagttttaataatatacataatttaaataaattttggtcmcatcaataaaattactgctatatttttttcacctattatagcagtttgaaaatttgaaaaagcaaattacgttaaaaatttttgagctactagccccattataatttcccttcatctccattaaaaattcaaattaggggaaatctgatgagaaaagtatttgggtaggcttcaggaaaaaagaacttatacttggaagaggtacaacaaatctatgaaataaccaatcctaaaacgtttacaatgtgtctaaggcttaaaagtaaggcagagcccccaaaattaaccaaatcacttctc

SEQ ID NO: 55433 - DNA, 601 bp, Human
gagctgggcacagtggctcatgcctataatcccagcactttgggaggcagaggcaggcggatcacctgaggccaggagttcgagatcagcctggccaacatagtgaaaccctgtctctactaaaaatacaaaaattagctgggcgtagtggcgggcgcatgtaatcccagctactagggaggctgaggcaggagaattgcttgaacctgggaggtggaggttgcagtgagctgagatcacaccgctgcactccagcctgggcaaaaagagtgcaactccatctcaaaaaaaaaaaaaaaaattcaagtaaaatttatattgatgtatataaaactagactaggtttaaggcaaaggattggcgaaattgaaatgatttaacaagaagtcagtatttcaaagaagtagctaaaagaaaaagtaactgtgggaagggaaatggcaatattgaagaaaaaatgacaatggtacacctttcaagggctaagtgctcttaacagtgctggccatagaaagcagaaaaatttgctcactgtaggaacacagatatgataggagaaacccacatcccaggttttgaacttcacagatggtgaattatt

SEQ ID NO: 55434 - DNA, 601 bp, Human
caagtaaaattgagctgggcacagtggctcatgcctataatcccagcactttgggaggcagaggcaggcggatcacctgaggccaggagttcgagatcagcctggccaacatagtgaaaccctgtctctactaaaaatacaaaaattagctgggcgtagtggcgggcgcatgtaatcccagctactagggaggctgaggcaggagaattgcttgaacctgggaggtggaggttgcagtgagctgagatcacaccgctgcactccagcctgggcaaaaagagtgcaactccatctcaaaaagaaaaaaaaaaattcaagtaaaatttatattgatgtatataaaactagactaggtttaaggcaaaggattggcgaaattgaaatgatttaacaagaagtcagtatttcaaagaagtagctaaaagaaaaagtaactgtgggaagggaaatggcaatattgaagaaaaaatgacaatggtacacctttcaagggctaagtgctcttaacagtgctggccatagaaagcagaaaaatttgctcactgtaggaacacagatatgataggagaaacccacatcccaggttttgaacttcacagat

SEQ ID NO: 55435 - DNA, 601 bp, Human
acagcattttctggaacccatatcctaccatcaacagaatagtctacctatatcctcaatctcttttccaaatgttcctctctttctttagctgaaatctgtatctcccctaagaatatttcaacactgaaacctggctctctcctaaggtagttgttttctcttttctctcccacagcactggaaggggacagagattactgaggtatatgtcctcaggcgatttaatcattgtgcgaacatcatagagtgcacctacacaaacctataccatatagcttactatacacctaggctatawgctatatagcctattgctcctaggctacaaacctgtatagtatgttactgtactgaatactgtaggccaactgtaacatgatggcacatgtttgtgtatctaaacatagaaaaagcaaagtaaaaatagggtattataatcttatgggcgcaccatcacacatgcagtccaccgttgaccaaaatgtcattatgcagtatgtaattataatttccctttttgtcttacaacaatttcttctcttctgaacatatcaaaacaagtttcattccctctcctctttgcaatagcattgatatg

SEQ ID NO: 55436 - DNA, 601 bp, Human
tatcataaagctcctgtaagagagcttagactacgtaacaataataggatataataaggaaattcatgtgcttaggtaaggggtgtatagtacatttggcagaaatgcttaaggattgaatatgaaaactggagtcaagtcctagactgtgatctacctaatttgaagggtcaaattgtacattaaccaaccaaaaaacaatcatgtaattaaaacacttacttcttcaagtgctttaatgcttttaacattaaatttgcttagttggcactcagaacaagatataaaaaatataaaggcratatgcctttttatcaacactgcacttttacctgtatcatacattcaaactggtacatacaaaggcccaattctgccatacttggtttaaaaagttcacgaagtctataatcttgcattaatttaacaaatacacagaaagcttcttcttctggcatctacattggaagaaaaaaaaacaacataggttaatgttctctgatacacaaataaaccaatgatatttaaactaagtacacagccaaccataaacattgtttgagtggctgtgtgctgcaatgttaagagcaatgaggtaaga

SEQ ID NO: 55437 - DNA, 601 bp, Human
ggcaggagaatggcatgaacccaggaggcggagcttgcagtgagccgacatcacgccactgcactccagcctgggccacagagcgagactccatctcaaaaataaataaatgaataaataaaaaataaaatataagaacattttacatatccccttgctcccaccacagatgggaaaaactggagtttataaggctgccaggagagaggaaactaataaaaatggctctcatgccagctgattcattcacctattttcttaaattctgctcatttaattgaaattgaaattgaaataaatkaaaatatttacattatagcaaacttaaatatataaaatataaaaattaaatccagaaaggtaaaatacttcaaaggtatttttcccttgattttgattctgctcctattctctccaccttcatacagtcactagataacttgagtcttaaactagcaacataagaaaacattacaggaaaaaaaattacgggctagcaaaaaataaaaataaaataaaagtaaaaaggcagaggagaggactcaaagagacagtctccaagtaaatggactgatgtcagtgtaatatcataaagctcctg

SEQ ID NO: 55438 - DNA, 601 bp, Human
tctaaaccctgaggaaacaaattaaataaatccaaatttatgttactcttccatcaacaaaaacgagtcatttgaaataatactaaggtaaacatttagggatctaaactaggggctggcaaacattttctgtcaagagtcagaaagcaagtattttaggtttggtgggctatattgtctgtcaaaattactcagttctgccactacaaccctaaagcagacatacacgacatataaataaatgggcagggttgtgttctaggaaaactttataaaaaacaggtgtggaagaatggatttygcacaaaaatctgtccatctgattggtacatgaatcacagctgaccaactgtgatctgaactaatttagataggtaatacaaattgattttcccaagatgtaattaataacaacattgagttcacagactagaaaacaaaggattacctctatgtgctactgacaaaaggacaacaacctgcaatgtgttcatagaagaaacatgcttattacttcttactctttggatgacagatgcatttcaacaatattaactgtaagacaaattttacctctcactaactttcactgtatgagtta

SEQ ID NO: 55439 - DNA, 601 bp, Human
ccagctacacagaaggctgaagcggtaggaggatcacttgaacctgggaggcagaggttgcagtgagccaagatcacgccactgcactccagcctgggcaacagaactaaactctgtctcaaaaaaaaaaaaagaaaataaattatgaacttacctgtaacatcccttccatgtcaagttgcatcagttctgcctgattcatctgaagaagtgctaatcctacacgaaacactatttctaaaccctgaggaaacaaattaaataaatccaaatttatgttactcttccatcaacaaaaacragtcatttgaaataatactaaggtaaacatttagggatctaaactaggggctggcaaacattttctgtcaagagtcagaaagcaagtattttaggtttggtgggctatattgtctgtcaaaattactcagttctgccactacaaccctaaagcagacatacacgacatataaataaatgggcagggttgtgttctaggaaaactttataaaaaacaggtgtggaagaatggatttcgcacaaaaatctgtccatctgattggtacatgaatcacagctgaccaactgtgatctgaactaa

SEQ ID NO: 55440 - DNA, 601 bp, Human
atccccaatgatacttttttttttttttggagacagggtctcactctattgccaaggctgaagtacagtgacgcaatcacagttcactgcatcctagacttctcaagtgattctcccaacttagtatcttgagtagctggaactaaaggtgtacaccaccatacctggctaatttttggtcttttttttttctatacagtcaggatttcaccacgttgcccaggctggtcttgaattcctggcctcaagtgatctgcctacctcggcctcccaaagtactgggattataggtgtgagccaytgtgcctggccctcaataataacttttgagcagactgagccaagaggtggaaggtcataatgaactggatattcttacaatgccaaagtatcaacttacaaagtacttactgggtgccaagagggaaaacataacctcataataaagaaatctgtcattaccttaacctagtcaccaatcatggcatctctaataacagtgagacagacattatgcatcttttaagatgaataaagtacatggtatcacctattaagtattcttgccagaaatgtttgcacttaattagattaagtcttc

SEQ ID NO: 55441 - DNA, 601 bp, Human
ttgcccaggctggtctcaaactcccaggctcaagcaatcctcttgcctgggcctcccaaagtgctggtattgtgggtgtgagccaccacgcctggctgaaataatgaagtgtttatatgtgtttccagtagaatgaagttagctgcagttaaagaagaaaaggttatgaagaaagctgactgataaatgtaagaagaataacatttttaaaatcatgcttttgttatcctaaatgaaataatttaacatgaaaagtatccccaatgatacttttttttttttttggagacagggtctcackctattgccaaggctgaagtacagtgacgcaatcacagttcactgcatcctagacttctcaagtgattctcccaacttagtatcttgagtagctggaactaaaggtgtacaccaccatacctggctaatttttggtcttttttttttctatacagtcaggatttcaccacgttgcccaggctggtcttgaattcctggcctcaagtgatctgcctacctcggcctcccaaagtactgggattataggtgtgagccactgtgcctggccctcaataataacttttgagcagactgagccaag

SEQ ID NO: 55442 - DNA, 601 bp, Human
gtagctgggaccacaggtgtgctggcgccaccacatccagctaatttttctatttttttgtagagacaaagtttcaccatgttgcctgggctggtctcaaactcctaggctcaaacaatctgcctgcctcagcctcctgaagtgaaaggactacagatgttaaaccactgcacatggccacaataagaactcttacactgccgggttagactatagattagtgtcactttggcaaaattttgtgatgttgaacacagcttactttgcaaccttaaaacattctgaatataggctgtaattygttaataatgccacctgcaaaagaatagactaatttaaaagaacaccattcccactaactcttttctctggaaattggtaattaaagggaataataaagttgttttgttttgtttaagagagagggtctcactctgtcacccaggctggagtgcagtgctgtgatcacagctcactgcagcctccaactccagactcaagcaatcttcccacctcagcctatggaaaagccaggactacaggcacctggttagcttattttatttattgcagagatggggtctcgctatgttgcccaggc

SEQ ID NO: 55443 - DNA, 601 bp, Human
atggatgaagctggaaaccatgattctacacaaactatcacaaggacagaaaaccaaacaccgcatgctctcactcataggtgggagctgaacaaaacctgtacgttgtgcacatgtaccctagaacttaaagtataataataataataaagaaaacttccatttttcttgctttgctctctcaggggatgctctctcaggggatactccctcaggagcaagtcattctgaaattgttcattttgtttggagccacagagattttttataaactaaagtaaggtaccatagtaagatctargttgggtgacaggttttccttccttcctttaataaagtgggagaaggcatgctgtaaaaaggaaggtgcgaagaagaaccgaggcacctctactacagaaatgttatcagaaagataaattgtaggaaagactatagatagaaattgaaagtctacttaaccaagctctgaacattttcctgacacccagcagtctgtgtatgccagtctgaagacatacgggttaggtatctctaacatataattttaataatctgttacatatttgcatctaacaagccatttacttttctgtgctgc

SEQ ID NO: 55444 - DNA, 601 bp, Human
gggaggccgaggtgggtggatcacctgaggtcaggagttcgagaccagcctggccaacatagcgaaacccagtctctactaaaaatttttaaaaaattagctggacatggtggcatgcgcctctagtcccagctactcaggaggctgaggcttgaaccttggaggaggttgcaatgagccaagatcgcaccattgtactccagcctgcaagacttcgtctcaaaaaaaaagaaagaaacaaaggtcttcaaaattgtactcaggtatcatctccttcagagaactacctgaaacttcctcytctgccatcatcctatgccatcctgtggtcttatttttctgctcatgtatctgctaaaagaatgtttcctcatatacattttaaagacttctaaattttgttttatctcaagtgtaaatatagttaaaaaggacatacagttgtaatttatatgtactttaaaatttttccactgaaacttaagtgacatttatcttatttatggacgtctaatctaggacctaactggcaaaggcagtcattattattaaaccaatgagccaaattacatttacttcctgtcattaaagtgttgccttc

SEQ ID NO: 55445 - DNA, 601 bp, Human
tcaaatggacctcccccaaaatgggaatggattttacacacacacactatatttatatacgcatacagaggagagaggataataaagcaaatgggatgaaatgtaaacaattggtgaatcttggtaaagagtatatcgtacccccttaagtttaaaagtataccaacgtaaaaattcatcaaaaaaaagtcaaaggctaagattcaactcttacaactgtcatgtagtaagggaacctatgagcctttgtacctattaccgttcttcttaaaatgccctccttctcttcacctggccaacyttcattacagcaaagagtaaaacttttaaaaccagatcatgtcacttttcgcaaaatcctctactggtttcccctcagatgtggaaaaagtctggcccatgaggaggacaataaccaacaaaacgtttgacaatgacgaaaacgtgctagatctgtattgtccaatagagtagccattagccacatgtgagtgactaattagcacttgaaatataactgatgaaataaattttaatcatatttagactagatagtcacatatgggtaatggctaccacagtagatggcattgctctaaat

SEQ ID NO: 55446 - DNA, 601 bp, Human
gggcaacatggtgaaaccctgtctctaccgaaaatacaaaaaattagccaggcatggtggtgtgcacctgtagtcccagctacttaggaggctgaggtgagaggatcgcttgagcgcgggaggtcaaggctgcaaatgagccaagatcatgccactgaactccagcttgagtgacagagggagaccctgtctaaaagaaaagaaaatactgcaggtataggtgaaagtctgctaaaaatctgttttctgaaaatgccttttggtattcctatattcatgtacttaattttataagaaatttcttcaagagtaaggattgttcatagaactgtgatttttttttcaataatatagtgtggtgaaatgaacaggatggcttccccatcctcagattcttgatttgcagttccgaatattcgtagtatgtgaaaactcatactctctccccactcatcaggatgacgtactttttacttgcagtaaaagtacccttactcatagtacctaaaagaaaagcaaatagggctggacgcggtggctcacgcctgtaatcctagcactttgggaggctaaggcaggtggatcacgaggtcaggagatc

SEQ ID NO: 55447 - DNA, 601 bp, Human
gaaagagatgaaaatggtataagaaagaactacatggaaacaatattataaaaagagaacagactacctttgagatcagcactttatttacctgatatgttccactaactttctaaactcttttttccgattcttctctatagacaattttatgccaactgcctgagacacatggagctagattcaaaaacatttcttcaggcatatgaactatatatttcctcaaaaaacaaagtatagaaaatactgcaaatggctgggcgtggtggctcatgcctgtaatcccagcgctttggaaggycaatgcaggtggatcgcctgcactcaggagttcgagaccagcctgggcaacatggtgaaaccctgtctctaccgaaaatacaaaaaattagccaggcatggtggtgtgcacctgtagtcccagctacttaggaggctgaggtgagaggatcgcttgagcgcgggaggtcaaggctgcaaatgagccaagatcatgccactgaactccagcttgagtgacagagggagaccctgtctaaaagaaaagaaaatactgcaggtataggtgaaagtctgctaaaaatctgttttctgaaaatgc

SEQ ID NO: 55448 - DNA, 601 bp, Human
agcaaactaacacaggaacagaataccaaacaccacatgttcttgctcataagcaggagttgaacaatgagaacacatggacacaggggaggggaacatcacacactggggcctgtcagggggtggagggctagggaaggaatagcattaggagaaatacctaatgtagatgacgggttaatgggtgcagcaaaccaccatggcacgtgtatacctatgtaacaaacctgcatgttctgcacatgtatcccagaacttaaagtataattaaaaaaaaaaaagtattcagttgaaaaaaaaatcagacacccctaaatatgaagtttaaaaaaagtatagtcattcaaaagttgttttggtttttctatctggtggaactggggagtgaagaaagagatgaaaatggtataagaaagaactacatggaaacaatattataaaaagagaacagactacctttgagatcagcactttatttacctgatatgttccactaactttctaaactcttttttccgattcttctctatagacaattttatgccaactgcctgagacacatggagctagattcaaaaacatttcttcaggcatatgaact

SEQ ID NO: 55449 - DNA, 601 bp, Human
tgaagaatacacatgggccttagaataacacaaatcagacttcaaatccttgactctgtttcctcgcaatgtgaccactggcataatatttgagctttctgaagcctaatttcttcacaggtaaggataagaaccctttaataatgctgttttaagaataaggggaaataatgcatgtaagtgacccatcatatattaagggctaaataaatgtgagcttcaattctaatacttcacattgattgttaaaatgtaattcctgggcaacttagataacacttctcttttttttttttttttttcatttttatgccaggcagtgaatatgtgagcacttttatattattttctggctttcagcatatctgaaatgtaccatagtttttaaacaggaaaaaatactttacttttgactaaaaactggccagaatttctcatacttctcattttagggctttagatctctgcatcccgaagcacaaatttaaatataaaaattagattaactgttcgtatgtctatcagaatcaaagtttttttcctttttaaagatttgtgggttaccctaatataagctagaattttagttttataatttttt

SEQ ID NO: 55450 - DNA, 601 bp, Human
ttggttcctcctcctcacacatctctacattctagctgtccactttatatttgaaatctattcagaatccaattacttcttacctcagtccaagccaccatcatctttttttttttttttttaagacagggtttcactctgtcacccaggaaggaatgcagtggcatgatcacagctcactgcagcctcaaattccctggttctagtgatcctccttcctccgcctcctgagtagctaggactacaggcatgcaccaccatgcctggcaatttgaaaaaaaaaatttgtggagacaggggyccactatgttgcccaggctggtcttgaactcctgggctcaaggaatccgcccaccttggcctccctaagtgctgggattacaggcataagccaccctgatggtaggcatgcctggcccaccatcatcttttgtctgcattaccacatcagcgttcatcagaaatgctctcaatccctgcaatttactcttaacacagcaaccagaatgatctactgaacttaaatcacattttgtccttctctgctgaaaactgccatctaaccagagtaaaagccaaagtccttaccactgtcgacaac

SEQ ID NO: 55451 - DNA, 601 bp, Human
tcattctcattccgaaggttcaatgaaatattataatcctttcccagtttaaatgtcttactccaaagatttaaaaaaaaaaaaaaaaaactaagaagatgcatatttgactgtaagctagatatttagtgggaaaaaagagtatataattaaaacaacttaaaagcaagctcaatcttcctgtggagtcaccaaaagtagaattactctcatagcaaccctaacatgatgagagaaaaacagggaaactatttttgacttaatatgatgtatctgcaattattatacaacaaaggcagayatgtaataaatatcctgtccttacgcacttctatttaatatgaaatcatcaatacttttcaaacaaacgacaaatactgcaaaatatccatatttccatttatttatttcttgattgtagattttcagggaagattttaagatccttggcaatatgatgaggggtatgtttaaatctacttactcttatctctagttaaagaaagaaaaaagtggctgggcacggtggctcatgcttgtaatcccagcactttcggaggccgaggcaggcggatcacgaggtcaagagatcaagatcatc

SEQ ID NO: 55452 - DNA, 601 bp, Human
gtagctgtttagtacgcaccctaggttgattaagataattagaaatacaccctaggttaattaagataatttttaaagggttaatctttttcatctttgcaacttctctccctttgaaatataggcatacaccttaacccataattcaatgtcttgatgtaggaagtctaagcaatagtatttcgtaagacacaaattgccacactgtcgaagctttaaatgagataactgcatatattctgcatgctggataatgtttcatctgtacaatgaacaaaaactagctgaagttgggatttamaaattactgttagcaaaatgatacctattatgaaaacagatttctaaaaacttaaaagcaattctgacatacactgcttatttcccattacttaaaacacagtgtaaggaaagaaaatattacctatttctaacaaaactatgtagacagaaaaaaaattagaacaggagtccttaggccacaataagacccctaaatatcacagaacataaaattgtataatttaaaagttcaaagtctaaaacaaaattatttaaaacaacagcacaaaatctgtgctatgaaaaaaaaaatgattga

SEQ ID NO: 55453 - DNA, 601 bp, Human
tattggaaggctataattaaaacaatgagcaacagatgttcactttctagccgtaatatgctcattcactttattatggccatttttgctcaccaagttaaatttttcactataaaccagcattctatccctttgatatacatctatcaataagtctcaatatttgaaaaacaatgtaaaaaatttaattcatgattctaatgtattatgactgtagcttatgctaaatgcaaacaatacttattgtgttttctttagaaaatcacattgaagtaacttatttcaggtaaattcctaatayaaatccacaattgtttttttctttttaatgctttgatattattgacattacatacaaaagtggagcaaaatatgagttcccttctttttagtattattttgtcactctcctattcatttttcttagcaatcttcaataacagaaaaaaaaagatgtttatgaccctttcaactgccaatttttctttttgcttctggttttctgatttttttgtaccgagatgacgatgctgtttcttaattttattgaataaaaagaacgtcctactttgcagtcactctatttgccttccagatctgc

SEQ ID NO: 55454 - DNA, 601 bp, Human
tgttagctaattactctgatttgatgtgtcaattaaaaataaaactttcaaaaataatcaaaaaagtgaatagatatgctaagtgaaagaagccagacataaaagtcacataccttacaattctatttatttgaaattctagaagaggtaaaactatagtgaaagaaagcacacaggttgctggggttggggggtggtgaaccataaagggaatgatagaaatattatttgttttgattgtggtagtgtttcataactacatacatttccaacacatcaagctacatacctacatttgatkaattttattacatataaattatactttaataaagttaattttaaaagtgaaagagagagacctgagaaggtctagccctatttaatcatttgggaaaaaacacacacacacacacaaaactgtctttgagtatacaagatcacatagttggcaaaacaggactagaatctagttccataaataaaatccaaagctctttatatcatataaattgccactatttggcagtagggagtggtggcggtggatgcttatattggtaattcaatacctcctgctggaatacaaatttaaaaccct

SEQ ID NO: 55455 - DNA, 601 bp, Human
caagagagtaggggagggggttgccacacagtcttaaacaatctgatttcacaaggactcactcacatgaggacagcaccaagtcatgaggtctttgccccatgatccaaacacatcccaccaggtaccacctccaacaatgaggattacatctcaacatgaaatctggaagggagatccaagccatatcataggcattgaaggaatatacctgaaaataataaaaaccatatacaacaaacccacagccaacatcataatgaatggggaaaagttgaaagcactcctctaagatctggarcaagacaaggatgcttactttcaccactcttattcaacatagtactaacagtcttagccagagcaaccaggaaagagaaagaaataaaagatattcaaattggaaaagaggaagtcaaattatctgtttgctgatgttatgatcttatacctagaaaaccctagagattcctccaaaaggctcttagatttgataaaagaattcattaaagtttcataaaaccaatgtacagaatcagtaacatttctgtacaccaataacaatcaagctgagatccaaatctagaagtaaattccattg

SEQ ID NO: 55456 - DNA, 601 bp, Human
cttgcattgttatgaagaaatacctgaggctgggtaatttataaagaaaagaggtttaataggcttatggttctgcaagctgtacaggaagcactggcatttacttctgggaaggcttttactcattgaggaaggcgaagcaggagcaggtatgtcacacagtgagagtgggagcaagagagtaggggagggggttgccacacagtcttaaacaatctgatttcacaaggactcactcacatgaggacagcaccaagtcatgaggtctttgccccatgatccaaacacatcccaccaggtwccacctccaacaatgaggattacatctcaacatgaaatctggaagggagatccaagccatatcataggcattgaaggaatatacctgaaaataataaaaaccatatacaacaaacccacagccaacatcataatgaatggggaaaagttgaaagcactcctctaagatctggaacaagacaaggatgcttactttcaccactcttattcaacatagtactaacagtcttagccagagcaaccaggaaagagaaagaaataaaagatattcaaattggaaaagaggaagtcaaattatctg

SEQ ID NO: 55457 - DNA, 601 bp, Human
aaggaaatcccctcagactaacagtggacatactggcagaaactttacaagccagaaaaaaaatcacaatcccattttaagacttattaaagaaaaaaaaaacctgtcaaccatgaattttttatcctgctagaacaagcttcataaatggagaaaaagtctttcccagacaagcaaatgctaacagaattcatcaccattagaccagccttacaagaaatgttcaagtgagttctaaacatgtaaacaaaaggtcaatactcaacatcataaaaacagacaaaagtataaaacttacagstcttacaaaaaggatgatccagtaatatgctgcttacaagaaacccacctaatacagactgaaggaaaaagggtagaaaatgatatcccacaccaacagaaaccaaaagcaagcaggagtagctatctttgtatcagataaaacagactttaaattcaacaacagtgaaaaaagacaagggaaggtcatttttaaaatgataacgggataaagtcaacgggaagatgtaacaatcctaaatatatatgtacccgatataggaggtacccagattcataagacaactactactggggcaca

SEQ ID NO: 55458 - DNA, 601 bp, Human
agaagactccaaaacaaagacattctggcagcaagccaaggggcagtcatcttttatggctctcaggtacattgcagcctggagatagacagtggtgtctgaccaatttgagtgttctgagtttggggacaggggcatgacagggagagagattacattcctgcctgcccgggctatggaactggggtggctccctgcctctctgcagagacctcagtgtacttaccaggagcttccctgccacccccactcaggtcttctgcttgtgctcatcattggggaatccaagggccggcttggytgtccatctctgccctgacttgtcccctgctagggggtgagcagagagctcaagccactgtacattccacagcccagcccattgcctgaagcaacaaagaacttcccccattaaacaaagatcaagcacctgtccatctgcttctgttgcagcaggctcttacccacaaccaccacctactgtcctggaggctgaaatgcacaacccaacagaaaatctgctgacacaagtgcacagtgctgggaaatgagataagattcttgagacttccgccatcccagccctgcaggaagctgtgat

SEQ ID NO: 55459 - DNA, 601 bp, Human
tgctgtaggcatagccatggctgataccacaggaaactggcatgggtgcatcagagcacacagactttctggggcagacaggggtgactgtggtcttactggcaatcagtccaccatatctaagcttgtgcaaaaggtgggaccccctccccctctccatgcagagcagcagcgttcctgcaagggagaggagagccaaaaagctgtgtgttttggactgaggaagaagactccaaaacaaagacattctggcagcaagccaaggggcagtcatcttttatggctctcaggtacattgcarcctggagatagacagtggtgtctgaccaatttgagtgttctgagtttggggacaggggcatgacagggagagagattacattcctgcctgcccgggctatggaactggggtggctccctgcctctctgcagagacctcagtgtacttaccaggagcttccctgccacccccactcaggtcttctgcttgtgctcatcattggggaatccaagggccggcttggctgtccatctctgccctgacttgtcccctgctagggggtgagcagagagctcaagccactgtacattccacagccca

SEQ ID NO: 55460 - DNA, 601 bp, Human
ggtgtgggcagtgatttggggacttcttgagggcactgcaccagattaccaacttgcactgggttgctcactctgcccccggacttgagcagcagcgatagggtgctatactgggagcacagccatcaggggtctgtaccctgcccagggaacctcagcctttgtgtctccacatcaccagagccccatagacattccctggcatctgctcagattgtggcagcagcaaagggatggctggacccagggagctgcagggttcctcggcaactgctgccccgaagagaagaacaagtattgsacgccaagggagcacccactgggacaaaggaaaccagaacacatactttcctgtgcccaagagctcaccacctgtggactctgagtgactgcactgcctccagcaaagatgtgggcactgtgcttggctctacaaggctttgcaagtgtgatttcatcccaggggccaacctagtatgagtgctcagacccaggcatggagatggggactcctcctcaaccccactgctgtaggcatagccatggctgataccacaggaaactggcatgggtgcatcagagcacacagactttctggggc

SEQ ID NO: 55461 - DNA, 601 bp, Human
gggggctgggcgcagtggctcacgcctgtaatcccagcactttgggaggccgaggtgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagaaagaaattggaacccttgtacactgcttgtgggaatggaaagtggtacagttgctatagataagtctgacacaacctcaaaaaattaaacataaaattacatatgatccagcaactctacttctaggtatatgcttaaaagaattaagagcaggaacttaaacagatacttatagggcaatgttcatagcaacattatccacaatagctaaaaggcagaaataacccaaatgtccatcaacaaacaaacggatgaacaaaacgtagtatatacatactatggaattttatcagccataa

SEQ ID NO: 55462 - DNA, 601 bp, Human
tgagttcagcttgaggccagcctgggcaacatggcaaaacctcatctctattaaaaaatatggaaattagctgggcatggtggcatgtgcctgtagtctcagctactcgggaggctgaggtgagaggatcatttgagccctggaggttaaggctgcagtgagctgattgtgcccttacactcgagcctggcgacagagaaagaccctgcctaaaacaaaacaaaactgtaaaatctatggaatatttttagttaatttttgtatacagtatgttaggcatctaatttcattctttagcagragaatatccagttttcccagcatcatttgttgaagagactattcgttcctcattgaatgttcttagcatccttgtggaaaaccaactggccatagatgtatgggtttatttctggactctcatttctattccattaatctatgtgtctatccttatgccagtactactttgactactctagctttgtattaagtttacaaatcagaaagtgtgagtcctccaactttgttcttttttttcaagattgtttggctattcaaggccacttgcaattccatgtgaattttaagatcagctttt

SEQ ID NO: 55463 - DNA, 601 bp, Human
agatcctgatcagctacaaaacttgcaactattttctaccattctacaggttgccttttcactttcttaatctcctttgatgcacaaaaagttttcatttagatgaagtccagtttatcttttgttgctcatgcctttggtgcctaagaaccaatatctaaaaccactgacaaatccaaggtcatgaagatttatctctatgtattcttctcagggttttatggctttaaaaacataaacatgttatttttaaatcataaagttggctgggcacagtggcttatgcttgtaatctcagcaytttgggaggctgaggcaggcagatcgcttgagttcagcttgaggccagcctgggcaacatggcaaaacctcatctctattaaaaaatatggaaattagctgggcatggtggcatgtgcctgtagtctcagctactcgggaggctgaggtgagaggatcatttgagccctggaggttaaggctgcagtgagctgattgtgcccttacactcgagcctggcgacagagaaagaccctgcctaaaacaaaacaaaactgtaaaatctatggaatatttttagttaatttttgtatacagtatg

SEQ ID NO: 55464 - DNA, 601 bp, Human
tcactgacatttaagttatcccacacctcacacagcttttttgctacatctctaataaagatgccagggtttgtggatttgatcttggggtgaaattctgaacagtgcaggaagaatacagacatgtctcttttggagacatgaaggtccttcttcttgcctcacttaactggttcacaatcctgcaccttccaagcatagcatactttatctgcctttgtcatttcaccacatttaggattctctttgccagacactgtcttccacctctcagagcacttcttggaaaattctgcaaaaytgacagagacctctgggtttctcttatgttcttctctgcatgtctgcacaaagaaggaataagcagacacctttccctctggtttcttgggatcacctttagccatcctgactaaattgcttcttccttcctggtcacctagcaagagggaaggtgaagggggcaggaagggtgcttggaggagaggtaggaggtcaataacattttttgagggggtggggggtatagaatttctccctgtcgcccaggctggagtgcagtggcgcaatcttagctcactgcaaactccacctcctgggt

SEQ ID NO: 55465 - DNA, 601 bp, Human
gatcacttgttgttggttctaacctgaccctcaccaatgggttctagcacagggactttacacgttctcccataaactcgtcttctactgcaatcacttaaatgtgtcgagtttctttgagctttatattatcatttatttagtctttttaaaaacaatttattgaagcaaaattctaaaatcatttttaacactatttaacttcaaaaacatttcagcattctaaacatacaaaaaaaaccccagaacactgaaaatcacatttaagtacagaaggttctttcttgaactttcattgatrcagtggctctttactttgctgacaacagttctacagcttgttcaaaaagtttatagacaatgcacttaattaaaaaaatcccaacacttctcaggccagctgacccctctttgtccacagctaagaatggtagcagactgttatattaccgtttgtagaaacaagacaagctgaagctaaatggctgaacattacaggggaaacaggactagcctcacagtgcacgctctaagctacgacccctccaaaaggcattgtcccccacaggctcagcgccaagaaacgagcaccaagagtttg

SEQ ID NO: 55466 - DNA, 601 bp, Human
tatcaggtgtgaataattcctaaatgctgctgaacaaacattttctaaaatacattatctagaagaattcacaacttcactgataaacaggtagttttaattttattaacatttattcatgtgtttaatccaggtaagatgggtttatattcttcatatcaaatccttggttcttaaaagtcctacataattctttgatgttctctctagaattatagaaaagggagggaaggtcagaagaaatcctgtctagcctcccattaagtacttcctagtatgaaggtcccaataacttcaaacrgcagtcatttcagcattcagcagcttttaactcaaattcctccttatttatgatgaactaaactgcataataaaaatacctgaatggtaagaccaagaacagctggataaaactgcataataaaaacacctgaatgataagtagtcataggtaggtcacaaagcttttaaatggatcaagctagacttagacagttggtctcatcaggaaaagttgtccaacataaacacatttgttataccccacattagcaggagtcagatgtgcaactgtgtgaaatatcactggaggatttctaca

SEQ ID NO: 55467 - DNA, 601 bp, Human
ttaagccagtgcccatagaaaagcttctgtacaaaagcaatatgtaattcatcattataaaatactttctaaaataaattgtctatcacttcacatttaatttatgtagtaaagaaaatgtggcaactcaaaatttcaaaataaagtcataaaaaacaatcttctactgaactagcatgaataaagcacagttatttttactctttaatatgttaggaacaaaacagatgtcaaatcaaaactattaaaaataaccagatgcttaatacatggtactctcctgccccagttaccaaaaaaagatgtgcaaatgaggactttaattcaatgcattatacattatttcttctagtaattttgatactattgaaacaatatttcaatacgagaagtgcatctgcaacagacacatcatcttagcaaatacttaccttttatcaattaggaaaaaggcattcttttggaatgaccacatccaaactagatgtgccataatttatttaattagatcacagttatttcgtgggtactggaagaatttttttgccctcaacttaaagccctggcaactgtagcacaggtttgtttgcaaagactttat

SEQ ID NO: 55468 - DNA, 601 bp, Human
ctccagcccaggtgacagagcaagactcttgtctcaagaaaaaaaaaaaaaaaagatatacatagaaataattgctggaagtagagaagacgcagatgctgcacaaagaaattaaccacggaagcacgcaactttcccatttgctttcctactctataaaacatgaatattgatgcaaacacttaagtcgtcatttttaagccagtgcccatagaaaagcttctgtacaaaagcaatatgtaattcatcattataaaatactttctaaaataaattgtctatcacttcacatttaatttaygtagtaaagaaaatgtggcaactcaaaatttcaaaataaagtcataaaaaacaatcttctactgaactagcatgaataaagcacagttatttttactctttaatatgttaggaacaaaacagatgtcaaatcaaaactattaaaaataaccagatgcttaatacatggtactctcctgccccagttaccaaaaaaagatgtgcaaatgaggactttaattcaatgcattatacattatttcttctagtaattttgatactattgaaacaatatttcaatacgagaagtgcatctgcaaca

SEQ ID NO: 55469 - DNA, 601 bp, Human
ttgagcccgggaggtggaggttgcagtaagccaagatcatgccactgtactccagcccaggtgacagagcaagactcttgtctcaagaaaaaaaaaaaaaaaagatatacatagaaataattgctggaagtagagaagacgcagatgctgcacaaagaaattaaccacggaagcacgcaactttcccatttgctttcctactctataaaacatgaatattgatgcaaacacttaagtcgtcatttttaagccagtgcccatagaaaagcttctgtacaaaagcaatatgtaattcatcatyataaaatactttctaaaataaattgtctatcacttcacatttaatttatgtagtaaagaaaatgtggcaactcaaaatttcaaaataaagtcataaaaaacaatcttctactgaactagcatgaataaagcacagttatttttactctttaatatgttaggaacaaaacagatgtcaaatcaaaactattaaaaataaccagatgcttaatacatggtactctcctgccccagttaccaaaaaaagatgtgcaaatgaggactttaattcaatgcattatacattatttcttctagtaat

SEQ ID NO: 55470 - DNA, 601 bp, Human
gtgggttgtctgttcactctgctgactgttcctttctccgtgcaaaagctcctcagtttaattaggtcccagctatttatctttgttctaattgcatttgattttgggttcttggtcatgaaatccttgcctaagcaaacgtctagaagggtttttccaatgttatcttctagaatttttatagtttcaggtcttaggtttaagtccttaatccatctcttaagttgatttttgtataacgtgagagaagaggatccagtttcattctcctacatgtggctagccaattatcccagcacayggatacaagacttagatcaatttcccaccatattaaaagataaaaaggatacagggtagcccagtatcaaacttctctggagagttaccaagagatccaaaatgaggccgtagggaaagctccctagataaaaaggtaaactgaggtaacactgagatttcaaggcctgattctatgcaattttctatctctaaatatttcacggtacacatgcaaatttttgctcatagggatgatggaatgaagttattctcaccaattacactttcttataatggactttaaatatcttctcaattg

SEQ ID NO: 55471 - DNA, 601 bp, Human
ttttaaaatttcaagtttattgcaatctgatactttgtcaaaacatgttttaaaaaaaggcatgacaatgtcaaggcctaatttcggtccttatatagaatatgtattttgttccttgtcaacatttccctcatacatgaataaatttgtggtcacataccagataaatgtcatttatctggtgaggtaactaagttactaatttatacattaaatttataatgttgtcacccttctggtgtttcacactaaccaacaatggacttaatatcaaagtttaagacaaaatatgtattatatrgaacactttcacagtttgcagaaaaagttacacaaggcacaatggtacaatgacaaaaatattatctgatgtctactgtatcttttattttattataagaattaaagagggagaaacagcttaagtgcactttcagtttataaatactctcaattttgacattaaacagggtctctctcactttaaactcatctactataggtcatcaggtacttcaaactcttacaaattggatatttcggttttactctcttttaaaaaagcacacaaaatatattaatatacctgccagtgttcctc

SEQ ID NO: 55472 - DNA, 601 bp, Human
tttttcatattatcttcaatgaaatcccaatacattagaaaaaaaatggggccattaaggaaggaatgttagaagttaagggcagtgtttctcaaaatatctgtgataaaagacaagttttgtcttttttgttttaaaatttcaagtttattgcaatctgatactttgtcaaaacatgttttaaaaaaaggcatgacaatgtcaaggcctaatttcggtccttatatagaatatgtattttgttccttgtcaacatttccctcatacatgaataaatttgtggtcacataccagataaatrtcatttatctggtgaggtaactaagttactaatttatacattaaatttataatgttgtcacccttctggtgtttcacactaaccaacaatggacttaatatcaaagtttaagacaaaatatgtattatatagaacactttcacagtttgcagaaaaagttacacaaggcacaatggtacaatgacaaaaatattatctgatgtctactgtatcttttattttattataagaattaaagagggagaaacagcttaagtgcactttcagtttataaatactctcaattttgacattaaacag

SEQ ID NO: 55473 - DNA, 601 bp, Human
atacagttcaaattttttctctatatactgaggattaattcttgaaaagattacaattttcactgtaatttttttaatgagagatttttcatattatcttcaatgaaatcccaatacattagaaaaaaaatggggccattaaggaaggaatgttagaagttaagggcagtgtttctcaaaatatctgtgataaaagacaagttttgtcttttttgttttaaaatttcaagtttattgcaatctgatactttgtcaaaacatgttttaaaaaaaggcatgacaatgtcaaggcctaatttcrgtccttatatagaatatgtattttgttccttgtcaacatttccctcatacatgaataaatttgtggtcacataccagataaatgtcatttatctggtgaggtaactaagttactaatttatacattaaatttataatgttgtcacccttctggtgtttcacactaaccaacaatggacttaatatcaaagtttaagacaaaatatgtattatatagaacactttcacagtttgcagaaaaagttacacaaggcacaatggtacaatgacaaaaatattatctgatgtctactgtatcttt

SEQ ID NO: 55474 - DNA, 601 bp, Human
tccacaggttccagactgccaacagtgttgatagcagacacaaacacaaaaacggtaagaacctttgtacttaagaaactcttgaagatatacacaaggaaacataagcaagaatgttcagagtagcactgtttgcaagagcaaaaaggagagtggatcaataaattgaggtatagtcactgacagacttttctaaaagtccttaaaatgacagaactggagttacatgtataaacatggacaaatttcttaatctaaatacatgggtgtttgatacaataatctttagattactacacamcaccaccattaccctatactatttttatttatttatttttcatttatcaatgtaaaaatttcatggattaccaccagtccaaatactggcatttaggaaccagtgcctattaccatcctgcttccagcaaaatccatccaaaatcacacttattagtcagcaatggtattaagcacaatacaaattccttaggaaatctttctccaaaccacctagttgaaattaattttccccgcctagtctccgtagcaattcctatctaactctctacttaccaaatttctgaattatattaaatat

SEQ ID NO: 55475 - DNA, 601 bp, Human
gtaatcccagctacttgggaggctgaggaggagaatagcttgaacccgggaggcagaggttgcactgagctgagatctggccactgcactccagcctgggcgacaaagcaaggctccgtctaaaaaataaaaattaaaaaaaaaaagaaatctaaatctaaaatattaaaaacctgaatctagcaatgggaatgtgttgtatctctatgtgatctacagcacaaacatgtttttagtattttgataactgtacctcagtagaagtggcttcctttgcaatcctttgtacttggttttacgyattaaaaaatattattttaagaaggggtccacaggttccagactgccaacagtgttgatagcagacacaaacacaaaaacggtaagaacctttgtacttaagaaactcttgaagatatacacaaggaaacataagcaagaatgttcagagtagcactgtttgcaagagcaaaaaggagagtggatcaataaattgaggtatagtcactgacagacttttctaaaagtccttaaaatgacagaactggagttacatgtataaacatggacaaatttcttaatctaaatacatgggtgtttg

SEQ ID NO: 55476 - DNA, 601 bp, Human
ggtgttcctagaagtgaaattgataggaagtctgctcattcctacttaatttatacaagcagaaaacttctaggtcaaatgagcaaaatactaatttgaattataaaaacagagattcatggcccccataggtgaatcacagcagagacctctaggattttggagcgagaccctgccatcttcttcagataactactctccttttgagagacagctgttggcctgttactggactttggtggaaactgaaccattgttcatcatagtcatgaagtgactatgggtcatcaagtcaccacgygacctgaactgcctatcatgaactgggtgctttctgacccatctagccatgaagtgggctgtgcacagcagcactccatcatcaaatggaagtggtatgtacgtgatcaggcttgagcaggtcctgaagggacaagtaagtttcatgaggaagtagctcaaatgcccatggtctccactcctgccaccctgtcttctcttctccagcccgcactgatggcctcatggggagttccctatgatcagctgacagaggaagagaagaccagggcctggttcacagatggttctgcacgatatg

SEQ ID NO: 55477 - DNA, 601 bp, Human
gttactcaactacaaaatttaaatacaatgggaataattgaatactgaggtgccggggccaagtggcagcactcaaccatcaaacgcaaggtaggcatagctactgtcatgaacagcagcggcaaagcggcaatcagaatagtctgacttgtgtagagctctggcattggctaattaatcacggtgttcctagaagtgaaattgataggaagtctgctcattcctacttaatttatacaagcagaaaacttctaggtcaaatgagcaaaatactaatttgaattataaaaacagagattcrtggcccccataggtgaatcacagcagagacctctaggattttggagcgagaccctgccatcttcttcagataactactctccttttgagagacagctgttggcctgttactggactttggtggaaactgaaccattgttcatcatagtcatgaagtgactatgggtcatcaagtcaccacgcgacctgaactgcctatcatgaactgggtgctttctgacccatctagccatgaagtgggctgtgcacagcagcactccatcatcaaatggaagtggtatgtacgtgatcaggcttgagc

SEQ ID NO: 55478 - DNA, 601 bp, Human
aatacggtaagacccaaaaatgctaaggactctacttctaacagtatggagcacactgatagttcttggcatgaactgtttgtagagagttacgcaaaataaatgcatttgacactcctgatttactatttgtgagaggcaagcagtttagtgactctatacataatacctttgactatatgtggagaaccaaggaatgtaatgaagttggttggttgctcctaagttcactggacaaattgatgaaagaaaatgatgaattcaggggattctgtccccctgcttcagaagcagatactaygcctcaaatctgctaagattgccctgaatgagagtagacagtcacaagctcttcatgcgagtggctgacctgcaacgaaagatgcatgcacagccttgccaggtgtctactgttaaagtgagggcattgattggaaaagaatgggaccctaaaacttggaatggggacatgtgggaggaccctgatgaagctggggacatagaggtttgtaaactctgatgaaccttttttgtcagaaggaacaacttccccatccccagtagtggaaacaacccctccccaacccatgctgccatcagc

SEQ ID NO: 55479 - DNA, 601 bp, Human
ttaggctggagtgcagaggtgtcatagttcactacagcctcaaactcctgggctcaagcgatcctcccacctcggcctctcaagtagctgggactacaggcacatactaccacacctggctaatttttaaaaatttttatacaagacagggtctcactatgttgcccaggctagtctcaaactcctggcctcaagtgatcctcctgcctgggcctcccaaagtgttggggattataggcattagccactgtgcctgtctaagactgaggcttcatcagaacaatagaaaacactgttgccmctccaactcttctgtaataagtaacaaatggaatactgctgaagacagacccttttaaaatgttatgcaaagggaaaacctaaagacacaaaattcctctggcaaacagctcctactctaaaaataaggtattactaagggaaaaataaagtattgctaagggaatttgaagcctatggtgcactgatgataccacagaaacaacaaacctcaaactcaacccatctctggactatattaacttgaatctcccactttaaaggcctagcagaaggaaaaatgtgcccatttccaggcaga

SEQ ID NO: 55480 - DNA, 601 bp, Human
tttaatttagaaacaggatcttactttgtggcttaggctggagtgcagaggtgtcatagttcactacagcctcaaactcctgggctcaagcgatcctcccacctcggcctctcaagtagctgggactacaggcacatactaccacacctggctaatttttaaaaatttttatacaagacagggtctcactatgttgcccaggctagtctcaaactcctggcctcaagtgatcctcctgcctgggcctcccaaagtgttggggattataggcattagccactgtgcctgtctaagactgagkcttcatcagaacaatagaaaacactgttgcccctccaactcttctgtaataagtaacaaatggaatactgctgaagacagacccttttaaaatgttatgcaaagggaaaacctaaagacacaaaattcctctggcaaacagctcctactctaaaaataaggtattactaagggaaaaataaagtattgctaagggaatttgaagcctatggtgcactgatgataccacagaaacaacaaacctcaaactcaacccatctctggactatattaacttgaatctcccactttaaaggcctag

SEQ ID NO: 55481 - DNA, 601 bp, Human
atttcagtgacactgataaaccattcaagcttcactcttggtttttaatgtcaccagaataagctgatggaattacagctttacatgtgccatcaaaagtcttatttcttatacaataataaggctggaatctttaaagggcatcattcctactatctcaccatggaaaggtggatgcctagtttatttttttaaatcccataacttgcctttagtaatccattctaatgcccagtctacagtcatctctttagttatttcacacacacacacacacacacacacacacacacacacacccaaaccctccctcctctccttccatctcactgcctttcccccactctctcaccactgctatattgtaaatttatttcaggaaagaatgtacttgcattcaaatacttttgatgctttttgaatccaaacacttcacaaaaaagtaaagtatataactgattaaaataataatgggtaatatacccatttttcccaacacactggtacatacacatttcttttgctctctagtctatccagaaaacatgtatcaatgttattaacattactgcccactaataagataccaatcaaagcagag

SEQ ID NO: 55482 - DNA, 601 bp, Human
aacacagacaatttagcatcataaaaactcaatcagatattggtatgacaaatcagactgatacaacctcatttaatattattttatttatagtttagtcatatccttcaaaagtgactgtgcttttagtaggaatttcagtactgcctacagatttctgtcagtatacattgtaacagccatgcatatttataaggatgtaatttcatctctggatttcagtgacactgataaaccattcaagcttcactcttggtttttaatgtcaccagaataagctgatggaattacagctttacaygtgccatcaaaagtcttatttcttatacaataataaggctggaatctttaaagggcatcattcctactatctcaccatggaaaggtggatgcctagtttatttttttaaatcccataacttgcctttagtaatccattctaatgcccagtctacagtcatctctttagttatttcacacacacacacacacacacacacacacacacacacacccaaaccctccctcctctccttccatctcactgcctttcccccactctctcaccactgctatattgtaaatttatttcaggaaagaa

SEQ ID NO: 55483 - DNA, 601 bp, Human
atagacttcttgagtacaggcaattttgtctgtcttaaccttggttagaagttttatgtataatatttgtacacatacaatgtactttgttttattaacttctctgtacctcatgtttcataatttttaaattattaaaccatttagaaaattattggtaaggggaaacaggctggggctggagataaattatgattcactgttgcaacaattagtggtccccaacctttttggtactagtgacagatttcgtagtccatagagagggtgggagaatggtttcaggatgaactgttccacytcagatcatcaggcattagattctctcataaggagagtgcaaccaacacccctgacatgtgcagttcacaataggattcgtgctcctgtgacaatctaatgatgccactgatctgacaggaggtggagctcagacagtatgctgctggctgcccgctcacctcctgctgtgcggcccggttcctaacaggccatggactgatacctgtctgtggcctgggggttgggaaaccctggtaaagatggttcctgaagccatgtaagtgagacccttcatttgggtatagtttgtaaaagccaa

SEQ ID NO: 55484 - DNA, 601 bp, Human
tcttaaattagacctaaaagttctaagtagactgattaatctttgaaaataaatttaataaatttcagtctacctatatctatatactacatagcatgtatataaatatactatatatctatatgtaagtatctatatattacaatgttatagtatttataaaaatgagtatttcttcatgtaatgtattttctcatctaaatgagatgtttacaaaagtataattttcataactacattaaaaagcaggctttcattatatgaataacagattaaataataatttattaaaagaagagtytgaaagaattcggtttgtgcaaaaacattttactcgcaagagagtaccagtaattggaagagttaatctgaagacatctgaagtacaaaaatcttagactaagttgagttctccccctagtggaacttgaatatgatctaagatatttccatgactaagaaaataacctaaaatatattactttgataactgaaaaaagtttcaggttttaatgaaagatctatttatgaatcttaatctgtattaaaaatatacctctatatatctatatttatatagacatatacatataattaaata

SEQ ID NO: 55485 - DNA, 601 bp, Human
ctggccccaagataattcttaatttcaggctttatataatttttggaaagggatatatattcagtatctgaggttgttaaagactatctttaaggaaactcaaagagtttcagaactttctagtttggttgtaattttggggactctacaatattgaatgtgactttttacataaggtctacgagctgtttttccggatattatgtaggcaagaaagaacactttacatgagttttctcatttgatcccaacaactataaggcagatagctttagaatcctcagttttgaatgagtgaacsaacaaatacattaaaaaacttgtcaaagataagaggctaataagaggttggactcaaaaatccattcttttaaccaatacagaatctctagcaattagaagaaaacaaaaagacaaaaagttgggaccacagagacattcaggattttaaaatcctcttgttcttcataactaaatttcttgaagctctttattctgattaagatatgtcatatttatttttgcaggctactaaaagaagttcctttagactgagacattcaaacagaaaactgggttctaaagcatatgtgaggatagc

SEQ ID NO: 55486 - DNA, 601 bp, Human
catacaaacaacaaaatctcattttaaaattttctctatgcctcagttttctcaactataaaatgaagatattaacaatattttgctgggcttggtggctcatgtctgtaatcccagcactgtgggaggtcaaggtgagtgcactgcttgagcccaggagatcaataccagtctggggaacatggcgaaaccccacctctacagaaaaaaaatacaaaaattagccgggcatggtggcatgtgcctgtagtcccagctacttggaggctcaggtgggaggatctcttgagcctgggaggtygaggttacaatgagccgtgactgcgccaccgcattacagcttggatgacgaagtgagaccctgtcttgaaaacaataacaaaaatagcaacaaaaaaaaccccaaaaccaatatctcctatgatttttgtgaggattaaatatgtgaatatcctcaaatggcttagaacactgcctggtatgtaccaagtgttcagtaatgccagctattattactcttattattagtatcctggaataattaaagttgttaagtaataagctctatatttccaaatacagcaaatacacaaaaaatgaa

SEQ ID NO: 55487 - DNA, 601 bp, Human
cataaaaaaggatgagttcatgtcctttgtagggacatggatgaagctggaaaccatcattctcagcaaactatcacaaggacaaaaaaccaaacaccgcatgttctcactcataggtgggaattgaacaatgagaacacatggacacaggaaggggaacatcacacaccgaggcctgttgtggggtggggggaggttagagggatagcattaggagatatacctaatgttaaatgacgagttaatgggtgcagcacaccagcatggcacatgtatacatatgcaacaaacctgcacgttktgcacacgtaccctaaaacttaaagtataataataaaaagaaaagctgacttttgaaataaaaagcaagatcaaaggaggagggagaaaaacatggaggaaaatgagatgacagatttgaaggattcttaactggtatactgggcctcaagtaccgggtatatatatgtcggggtaactgggaaataaagctagaaaagtaggcaacaattcgagcaggaaggatcttacaaggagggccagagtttgaattttgtccccaacgctaggggaaacaactgaaaaattttaagtaatgaac

SEQ ID NO: 55488 - DNA, 601 bp, Human
gctgaggtgggtggatcacttgaggtcagaagttttgagaccagcctggccaacatggtgaaactccatctctactaaaaatacaaaaaattagctgggcatggtggcacgtgcctgtaatcccagctacttgagaggctgaggcaggagaatcgcttgaacctgggaggcggaggttgcggtaagccgagatcacgctactgtgctccagcctgggcgacagagtgaggctctgtctcaaaaaaaaaaaaaaaaaaaaaaaaattagatttttcatccaccttcatcagttacataaagratacaaagaaatctaaaatagaaggaaaaaatcagaataggaataaaatttttaaaaagatggcttatttaaatttgcaattattttctagtattgtactggccaatggtattagaagtataagctactggaagtaccaatgccttctctctctctctctttttttttttttttacattctttccagatatctaatataacaaactgaaacttataattagttattaaattttcacatattaactttaggataggaaaccactacttaatatattttaacattttactcctggctattaa

SEQ ID NO: 55489 - DNA, 601 bp, Human
gtcacttttctgatctctttcacttggttatcctttgcagaagtttctaccactcctcagtcagaagattacatactcattttccttctctccacatgtgagatataaatgaattctcctgggattttgctgacttacacagcctggaaatgggatagatagtcaaggttagaagccaagccctggcaggcctctctgctctaccactgtctgcttcttttgttagctgtcactttttaaagtttattgcattaggttatgttccttttcctctcaggtttattgggcaagtttttgcttwaaaaaaaaaaaaactatttactattttgttagatagttggggtaggtaattctgggagtttcaagccatctttggtgcaacatttatttaaataaaggaatctttacacagaaagtacttaaaacctgctacctgctcttatggcatagaaggtcaatacatgactattttctccctcctaaaattcattcagcaactatttgttgagcacctgtgatatgccaggcaccaggcatacagcagtaaataagacaaacaaggttctaatgtagtcacgactcgcttaacaatggggataca

SEQ ID NO: 55490 - DNA, 601 bp, Human
gaggctaatgcttgaacaagaatggcatttaaaactaatttatatgtaaacatttttttcagcaaaattctagaagtttgtccattttagagtcattctttcctgtttagtccaaaaatcaaattccacccagcaaggactgctattccaataatgttgtaatcttttgcaattgtctgctagtgatcctgattcatatattgcattcataacaaccaaaaataaaagaatatttaattaacactaggcattctaaaagcttcaaagcttaagtaataaattttaaaaaccaatcaatgayagttaaagtaaggggttctcaattttacatattttgttaagctttattgtacagactaaaattttggttttgtaggctcagtattactaagttgcttattgtatttagtagtttcttgtatcacctcttgtaagtatccaattcgttcatcaccaaagtcattaggtttttcttctgagagggaggtgccaaaacatgctttttcagttgaattttgtgttttctttatcttgcttgccataacattgctgcatacaccttccattcctgcaaatacactgagccttgtcagaaccaaca

SEQ ID NO: 55491 - DNA, 601 bp, Human
ttatgttattcatgtatcttttcttgagccctctgtaaagagtgatatcaagtcaaagttgggaagcaaagctgtcaaagtttctcgtgtatcttctgtagcattggatgatcagatggctcctaaatattcatcttattaataaaccattcccttccctagtctgtctgaatggcctatgaagagtttattttgccaaaaaatatttaaatcaactgatcagactattagtgtattcaaatttaataagagagccaatggaaggaggccagtgtggaaaaccagattataattacttacraatcccttctcatatgaagtcaagggagaccaaggtacaaaaaataaaacaaagataaatcaaagacagcctataaaaaatatcaatggtattttatatatttcacggaaataatatactataaaattaatttcctttttcagcaattttaatgtgatggtttggttttactgtgactaatacagttattaatagccatttttcccctctgtatacatttctccattactatttattacttttagcttataaatgggagttcaccttttgtatagaaagatctaaatgtttgaggggaaa

SEQ ID NO: 55492 - DNA, 601 bp, Human
agatttaaaatggacggccgggcgcctgtaatctcagcactttgggaggctgaggcgggcggattacgaggtcaggagatcgagaccatcctggctaacacggtgaaaccccgtatctactaaacaaaatacaaaaaattagctgggcgtggtggcgggtgcctgtagtcccagctactcgggaggctgaggcaggagaatggcgtgaacccgggaggcagagcttccagtgagctgagatcgcgccactgcactccagcctgggagacagagcaagactctgtctaaaaaaaaaaaaaaagaaaagaaaatggactcagtggttaagtaacttatcaaggaccacatgactagccaggaaaaagcaaggagtagaagccaggtttcactcttagtcccattctctttatatcattataaatggctccaatataaaccatggttttgtttgtttgtttttaaatagagaccaagtcttgctacattgcccaggttggtctcaaactcttgggctcaagtgatcctcctgcctcagtctcgcaaagtgctggtattacaggtgtgagtcatcatacccagcctaaacctaaaatcaggattt

SEQ ID NO: 55493 - DNA, 601 bp, Human
tatttaagggttgggtaaatcaaaggattaagtatagaagacatgggcactaaaacttaaatatctgaagtgaaggactcagaaaacataggaacagtgctaaaagacactggtaaatatgtatgacatgtattctaccttagagtcatatgtatgatattatgtatacatgtcctacacatatgtatgtcatgtgtacatatgtatattagttaacatacatattttgtatatgtacattaaaagttaaacataatattggcagttacaatttttaaatttttttgccttatgttaaacrcaagtattggtagttataatttttaaattttttgcctcttattaagagactaacctatagatttacacctttcagtgctatgaagtccaaagaattctctccatatttaacatgactttatttttaaatttttactaaaatataagtaaaattattaagaagaatattgataaaatgtatcaagagagatagctaacggggtagagtaaaaaggtcaaatacaaaatactggtaggcaagtaactgaataatttttagagcagcattcctactagaatgtctggtacagaagtggctttt

SEQ ID NO: 55494 - DNA, 601 bp, Human
gattaagcagctccaggctatggcagtaacccctgggcaagaaaattactatctcagcttatttgtcacacattagtggcacaccagtgtgacagaccagttagaaagctctgaatgggatattctgattcaacagtctgccttaaggaaatatagctgacattccaaaaacagaagtaaaaagtgagatgtcctaaatgctatttaataaattaaaatgtatcaataaccatttatcaaaagtctgtgatttttatgttctacattttatgctctcatttaaacttgttaattcaaagcmttttaggatcctctttaaaagttaaaacagggtaactatatttacaataccaaaagacatagcaatgaattactatattctaagtgggtatcaatttaattttagttctgggacagttcattcaattatctaatgtttacaattttttcctaagtatttttataactttctattttcaaacagtgtccacatggttgtttctgataagcaggtgggaaaatgtcaactacactaataaatttaccagaaacctgcattttcttgaggttttcttttggtctagctgataacaacagattg

SEQ ID NO: 55495 - DNA, 601 bp, Human
aaacctatctaaaaaaaaaaaaaaaggaaaaaagaaaaagaaaaaaatacagatttttgccacttgcaaccaaaataataatagctattatatattgaacagttacaacacttatgagcccttctcatttgagattcccaaaggattaagccctaacgtctaaagcatcattgtatgtgtatgatttcatgcctgtgcatctagagtactaccaggtaccatccttggaagaactgagaaaatacagttgacccataacatggctttgaactgtgcaggtccacaaatatgtggactttcrtctgcctctgccaccctgagacagcaagacaaccccttctcttcctcctcctcctcagcctaatcaatgtgaagataagaatgaagactgtcgccatgatccacttccatttaatgaataatatattttctcttccttatgattttcttaataacattttcttttttctagcttattttaagaatacagtctatgatgcatgtaacatacgaaatgtgttcatcaactgtttatgttatcaataaggcttctagtcaaaagtaagctcttagtagttaagttttgggggagtcaaaagtt

SEQ ID NO: 55496 - DNA, 601 bp, Human
ggtgcaatggcacaatctcggctcactgcaacctccacctcccaagttcaagcgattctcgtgcctcagccttctgagtagctgggactacagacgcacaccaccatgcctagctaatttttatatttttattagagacggggtttcaccacattggccagtctggtcttgaactcctggcctcaagtgttccgcccacccgccttggcctcccaaagtgctgggatttacaggcgtgagccaccacgctcggccatgtgcctaagtttttaataaaaaagtttaaagagttaaaaaaacrgcttatagaataaagacacagagaaagaagatatttttgtacagccatacaatatatttaaactaagtgttattataagagtcaaaaagttaaaaaaaattaagtttataaagtgaaaaagttacactaagctaaggttaatttattattgaagaaaaagaaaataaatttacagtatagattaactgtactgtgtttataaagtctacagtagtgtgcagtaatgtaggccattcactcactgactcacccaaagcaactttcagtcctgcaagctccattcatggtaccatgctctat

SEQ ID NO: 55497 - DNA, 601 bp, Human
ccatgttggccaggctggtttcgaacccctgacctcaggtgatccgcccaccttggcctcccaaagtgctgagattacagcgtgagccaccatgcctggcctagataaagaacttattaaacagtgaaactagaattgtttttgatgtctccagattatttataattaggaagccatgtgttgatgcttaaaatgttaagcagctctgatccggagccatctactgaaactactgagtaactcctgataccaaaagagtatgggcttacttttaacagttgccaatcacccagtttccttycatggagacaacaattgttaacagttttttggtgtagtctttccacgatattttacacatatataatcaaacacacatgaatacatgcacacgtttatccatactacagacactatgtatgctactctgtactttgctattatctctcaataatacaacttgaagatcattcaatatcagtacatatggagcagaaagatacacattctaactttagagagctttgaaattcctgtaaaagttaccttagtaatatccaagtatttacaggtttttttaaaagcaggtttaaaacgtgtc

SEQ ID NO: 55498 - DNA, 601 bp, Human
cccatattctttcattcttgggaatctgcttttgcttggggaacagaaaaggggggaaaaaaaagaaaaagttgtccaaatcactctaaaaaggggaggacaactttgagtctcctctggttaattagctctcgatgtggactggaagtcccagatacagctgattaaaagctgcttctgatcctaagagtttgtttcaggtgagcactgggactattttctagggatatagattggtgaagagaggcactttttcttataccacctgaaaacgaacataaattatttttcagataaagattttttttttttttttgagatggactctcgctgtcacccaggctggagtgcaatggcgcgatttcggctcattgcaacctctgccacctgggttcaagcaattctcctgcctcagcctcctgagtagctgggattacaggtgcccagcactgcgcctggctaatttttgtatttttagtagagacagggttttgccatgttggccaggctggtttcgaacccctgacctcaggtgatccgcccaccttggcctcccaaagtgctgagattacagcgtgagccaccatgcctggcctagata

SEQ ID NO: 55499 - DNA, 601 bp, Human
cctagaatttcaaagtaatttatctagttattttgagggcagatgattttctattcataccgtaagggattcaatacttagtcaagaagatggcaagcttcccatattctttcattcttgggaatctgcttttgcttggggaacagaaaaggggggaaaaaaaagaaaaagttgtccaaatcactctaaaaaggggaggacaactttgagtctcctctggttaattagctctcgatgtggactggaagtcccagatacagctgattaaaagctgcttctgatcctaagagtttgtttcagktgagcactgggactattttctagggatatagattggtgaagagaggcactttttcttataccacctgaaaacgaacataaattatttttcagataaagattttttttttttttttgagatggactctcgctgtcacccaggctggagtgcaatggcgcgatttcggctcattgcaacctctgccacctgggttcaagcaattctcctgcctcagcctcctgagtagctgggattacaggtgcccagcactgcgcctggctaatttttgtatttttagtagagacagggttttgccatgtt

SEQ ID NO: 55500 - DNA, 601 bp, Human
tcacctgaattctgaacaaatccattctcaaactacctctgacaaacaattcataatgaactatgctttaattaattaattaatttatttatttagaaacagagtttcgttcttgttgcccaggctggatggagtgcaacggtgccatctcggctcaccgcaacctctgcctcccgggttcaagcaattctcttgcctcagcctctagagtagctgggattaacaggcatgtgccaccacgcctggctaattttgtatttttagtagacacagggtttctccatgctggtcaggctggtckcaaacttctgacctcaggtgtgattatttctttaaaaatgcttaataaaggttgtttataataaatataatttataaaatatatcttttgaaagagtctcagaaatcagtaattgaatggatctactgatgaaaaaattaccctagaatttcaaagtaatttatctagttattttgagggcagatgattttctattcataccgtaagggattcaatacttagtcaagaagatggcaagcttcccatattctttcattcttgggaatctgcttttgcttggggaacagaaaaggggggaaa

SEQ ID NO: 55501 - DNA, 601 bp, Human
gatcaaaatttatcacttacctcatgattcagctctgctatctgatctttcagttccccaatatactggttagaatcagacttgttaagctgtccttgaagctttccttcttctttctgttttgtgacaaaacaacaaagcaaaaacaagaggcaatttttcacagcatgtactcaaatagttcaaggtataggaaaagcataggcacataccctttaatcacctgaattctgaacaaatccattctcaaactacctctgacaaacaattcataatgaactatgctttaattaattaattwatttatttatttagaaacagagtttcgttcttgttgcccaggctggatggagtgcaacggtgccatctcggctcaccgcaacctctgcctcccgggttcaagcaattctcttgcctcagcctctagagtagctgggattaacaggcatgtgccaccacgcctggctaattttgtatttttagtagacacagggtttctccatgctggtcaggctggtcgcaaacttctgacctcaggtgtgattatttctttaaaaatgcttaataaaggttgtttataataaatataatttataaaata

SEQ ID NO: 55502 - DNA, 601 bp, Human
aataattcaaaacaagaaagatggtattccattagtgtttagccaaatattatcattaaaacagaaaataataaaggataagaaaattgacctcgagccacattaacatatctctctaatcaaaacatactaaatactttaaattactcagtatagtacttggtaaaactgaaaattttgtgagttgaatctcacagattcaaggtagtaccagtttaaaaagcattcagatactaagaaatctgttaactgatattaggcaagtatccttttttgcaatctcagtaataccatcatgagsggtaaaagaagacaagagtaaaaagacttccttctgcatgcaacggtaaataccacaaatctattctataggtataagcaaaattttagtttagttaaagtaactttgacatctatgcaaactatcaagagtttttacaccacaataaaaaaataaaatatttgccatgaaaatattaatttatcattctaggtcatgctaatgaggttaagggaaataaatccccaatattagaacagaagatccttgctaaaaagacaattttcaaaaatgttattaattataaccaataattcacag

SEQ ID NO: 55503 - DNA, 601 bp, Human
gttgctttattttaatcacaatttcctctgagaacaccttttgaacataaataattcctggggttctcaaaagaataaagatttctacaacacacttaattgtaacttgttctttcacactatggctatcgatttaaaaatattataataggccaggtgcagtggctcatgcctgtaatcccagcactttgggaggctgagacgggcagatcatgaggtcaggagatcaggaccatcctggctaacacagtgaaaccccgtctctactaaaaaaatacaaaaaattagccagcctggtggygggcgcctgtagtcccagctactcagaaggctgaggcagaagaatggcatgaacctgggaggcggagcttgcagtgagcagagattgcaccactgcactccagcctggccgacagagcgagactccgtctaaaaaaaaaaattataataaatacacacaaataggtaaagattatatgtaagatcctgaatccctcatatgttatcatggctgaaaattgatatttacaggaatgattccccaaatttcaaaacaaattaaactgagccacatctaagatttactgtttttgtttatgtt

SEQ ID NO: 55504 - DNA, 601 bp, Human
aaagcttccttataatgagacatcaaaattttaaatgggaggttgctttattttaatcacaatttcctctgagaacaccttttgaacataaataattcctggggttctcaaaagaataaagatttctacaacacacttaattgtaacttgttctttcacactatggctatcgatttaaaaatattataataggccaggtgcagtggctcatgcctgtaatcccagcactttgggaggctgagacgggcagatcatgaggtcaggagatcaggaccatcctggctaacacagtgaaaccccrtctctactaaaaaaatacaaaaaattagccagcctggtggcgggcgcctgtagtcccagctactcagaaggctgaggcagaagaatggcatgaacctgggaggcggagcttgcagtgagcagagattgcaccactgcactccagcctggccgacagagcgagactccgtctaaaaaaaaaaattataataaatacacacaaataggtaaagattatatgtaagatcctgaatccctcatatgttatcatggctgaaaattgatatttacaggaatgattccccaaatttcaaaacaaatt

SEQ ID NO: 55505 - DNA, 601 bp, Human
agttttagaaataaagtcaatctatacgtaactttcttgtttcagcaacattaaagcttccttataatgagacatcaaaattttaaatgggaggttgctttattttaatcacaatttcctctgagaacaccttttgaacataaataattcctggggttctcaaaagaataaagatttctacaacacacttaattgtaacttgttctttcacactatggctatcgatttaaaaatattataataggccaggtgcagtggctcatgcctgtaatcccagcactttgggaggctgagacgggcrgatcatgaggtcaggagatcaggaccatcctggctaacacagtgaaaccccgtctctactaaaaaaatacaaaaaattagccagcctggtggcgggcgcctgtagtcccagctactcagaaggctgaggcagaagaatggcatgaacctgggaggcggagcttgcagtgagcagagattgcaccactgcactccagcctggccgacagagcgagactccgtctaaaaaaaaaaattataataaatacacacaaataggtaaagattatatgtaagatcctgaatccctcatatgttatca

SEQ ID NO: 55506 - DNA, 601 bp, Human
ttgtttcttctgtctggaatactctttccactgattttcacacattaagaggattctggctgggcatggtggctcatgcctgtaatcccagcactttgggaggctgaggcaggcggatcacaaggttaggagttcgagaccagcctggtcaacatggtgaaactccgtctctactaaaaaaatgcaaaaattagccaggcatggtggtgtgtgcctgtaaccctagctactcgggaggctgaggcaggagaattgcttgaacccgggaggcagaggttgcagtgagccaagatcgcaccastgcactccagcctgggagacagagcaagactccctctcaaaaaaaaaaaaaaaaaaaaaaaaagcttcttggcattcccatgcaacttatatgtgacctcatctgcaaaacctttcacaaacatcattttttcattagaaacattttcacatagtacctactacatgccatcattgttctatatactgggggaaaagtactcaatctcattaataatcagggaaatgcacattaaaaccataatgagaaatctcttcatagtcacagaatggctaaaataagaaagactgacaattccac

SEQ ID NO: 55507 - DNA, 601 bp, Human
ctagttgtttcttctgtctggaatactctttccactgattttcacacattaagaggattctggctgggcatggtggctcatgcctgtaatcccagcactttgggaggctgaggcaggcggatcacaaggttaggagttcgagaccagcctggtcaacatggtgaaactccgtctctactaaaaaaatgcaaaaattagccaggcatggtggtgtgtgcctgtaaccctagctactcgggaggctgaggcaggagaattgcttgaacccgggaggcagaggttgcagtgagccaagatcgcrccactgcactccagcctgggagacagagcaagactccctctcaaaaaaaaaaaaaaaaaaaaaaaaagcttcttggcattcccatgcaacttatatgtgacctcatctgcaaaacctttcacaaacatcattttttcattagaaacattttcacatagtacctactacatgccatcattgttctatatactgggggaaaagtactcaatctcattaataatcagggaaatgcacattaaaaccataatgagaaatctcttcatagtcacagaatggctaaaataagaaagactgacaatt

SEQ ID NO: 55508 - DNA, 601 bp, Human
tgtgggagaatgggtccaggatgtcccaaggatactaaaacccatggatgcacaagtcccttatatcaaatggcatatttgcatataacctatgcctgacttcctgtatacttcaaatcatctctagataacttataatacctaatacaatgttaatgcaatataaactgttatactgtattgtttagggaataatgataaggaataaaatttgtagatgttcagtacagatacagatgcaatagtctttaaaaaatatttttgatccacgattggttgaatccactgatgcaaaatccayggatacagaggaccaattgcaatctgacctcacttgcctctctaattttatcttataccatttttcctacccttcactatactccagccacactagcattgtttctcaaaataaccatttcattttcttctagggtctttgggctagttgtttcttctgtctggaatactctttccactgattttcacacattaagaggattctggctgggcatggtggctcatgcctgtaatcccagcactttgggaggctgaggcaggcggatcacaaggttaggagttcgagaccagcctggtcaac

SEQ ID NO: 55509 - DNA, 601 bp, Human
gaaatgatcccttcctccttctgggactcctgtgtcttcatactctccagtttcccgcctatctccctggtggttttggtcctctcctggctctcttgaccctaaaggttgggagaacttcagaacttgctcctggacacccttctctttatatatgaacgccattcacatgccagtgatggctacaattatttttagccctgacctctcttcagaatttcagactcatatccactgcctatctgatatcttcatttgcagtaaggaatctcaaccttactacaaatcttagcataaaaayagagctcttgtttacctttctctatgctggtcaatggcaccaaccaatcattcactcaattactcaagccaaaactctctggagccaatgaatgttttttgttatgagataaacatacttctaacacagccgcattacatttccacttcttccatccttctaagccatgtttgatcttatctggaccattgtaacagactcctgatgaatttccctgttctcactctttctcttctacaatcagttcactgtacagcaggcagagcaaatgaaattataaaattttctgtatgaaaccat

SEQ ID NO: 55510 - DNA, 601 bp, Human
aaaaaatctgtcttaataagtttattcttcaaaaggatcagggaagtttaaaatctgatttaaataactacgctgaaatgatcccttcctccttctgggactcctgtgtcttcatactctccagtttcccgcctatctccctggtggttttggtcctctcctggctctcttgaccctaaaggttgggagaacttcagaacttgctcctggacacccttctctttatatatgaacgccattcacatgccagtgatggctacaattatttttagccctgacctctcttcagaatttcagactaatatccactgcctatctgatatcttcatttgcagtaaggaatctcaaccttactacaaatcttagcataaaaatagagctcttgtttacctttctctatgctggtcaatggcaccaaccaatcattcactcaattactcaagccaaaactctctggagccaatgaatgttttttgttatgagataaacatacttctaacacagccgcattacatttccacttcttccatccttctaagccatgtttgatcttatctggaccattgtaacagactcctgatgaatttccctgttctcactc

SEQ ID NO: 55511 - DNA, 601 bp, Human
cagtcagtagtatttagagatagaacatttctcctttcaagttctttcttaaatcatccattgttctctgacaaatcataaaaaattccgaagaaaactttttttttttttcttgagacaggatctcactgtgtcgcccaggctggggtgcagtggtgtgatctctgctcactgcaacctctggttcccaggctcaagcaatcctcccacctcagcttcccaagtagctgggactacaggcgcgcaccaccacgcccagccaatttttgtatttatttatttatttatttgtagagacagrgtttctccatgttggccaggctagtctcaaactcctgacctcaagtgatccacctgcttcagcctcccaaagtgctgggattataggcatgggcctccgtgcctggccaaaaaatctgtcttaataagtttattcttcaaaaggatcagggaagtttaaaatctgatttaaataactacgctgaaatgatcccttcctccttctgggactcctgtgtcttcatactctccagtttcccgcctatctccctggtggttttggtcctctcctggctctcttgaccctaaaggttgggagaac

SEQ ID NO: 55512 - DNA, 601 bp, Human
tgtttctctaatttcttcaggaagggtgtttcagtcagtagtatttagagatagaacatttctcctttcaagttctttcttaaatcatccattgttctctgacaaatcataaaaaattccgaagaaaactttttttttttttcttgagacaggatctcactgtgtcgcccaggctggggtgcagtggtgtgatctctgctcactgcaacctctggttcccaggctcaagcaatcctcccacctcagcttcccaagtagctgggactacaggcgcgcaccaccacgcccagccaatttttgaatttatttatttatttatttgtagagacagggtttctccatgttggccaggctagtctcaaactcctgacctcaagtgatccacctgcttcagcctcccaaagtgctgggattataggcatgggcctccgtgcctggccaaaaaatctgtcttaataagtttattcttcaaaaggatcagggaagtttaaaatctgatttaaataactacgctgaaatgatcccttcctccttctgggactcctgtgtcttcatactctccagtttcccgcctatctccctggtggttttggtcctctcc

SEQ ID NO: 55513 - DNA, 601 bp, Human
tttttgtttttttgagacggagtctctgtggcccaggctggagtgcagtggtgagatcttggctcactgcaacctccgcctcccaggtttaagccattctcgtgcttcagcttcctgagtagctggggttacaggcacgcaccaccatgtcctgctaatttttgtattatttatttatttatttttagtagagacggggtttagccatgttggccaggctagtctcaaactcctgaccttagatgatctgcctgccgcagcctctcagagtgctgggataacaggcatgagccaccatgamgggctgtttctctaatttcttcaggaagggtgtttcagtcagtagtatttagagatagaacatttctcctttcaagttctttcttaaatcatccattgttctctgacaaatcataaaaaattccgaagaaaactttttttttttttcttgagacaggatctcactgtgtcgcccaggctggggtgcagtggtgtgatctctgctcactgcaacctctggttcccaggctcaagcaatcctcccacctcagcttcccaagtagctgggactacaggcgcgcaccaccacgcccagccaatt

SEQ ID NO: 55514 - DNA, 601 bp, Human
aagatcttattaaccacttttttctttctttcttttttttttttttctgagatgaagtcttgttctgtcccccagcctggagtgcagtggtgtgatcttggctcactgcaacctccgcctcctgggttcaagcgattctcctgccacagcctccccagtagctgagattacaggtgcacaccaccatgcctggctaatttttgtatttttagtagagacggggtttcaccatgttggccagcctgggctcaaactcctgaccttgtgattcacccgcctcggcttcccaaagtgttgggaytacaggcgtgagccactgctttaaatagaaaaatacaagcataaggaaaaaaaaatccaaagaaatataagaggacatatagtaagttctcacttaaagttttccataggttcttggaaactgtcattttaagtaagatgacatataaagaaaccaaacttttcccctcatcatcataaacaaaacgacattattcatggacatgttatatgtctttcactctgaagtctcagtttccaagaacctactgacaatgttaagtgaggacttaatgtattgtcatctgattgttaaagttcc

SEQ ID NO: 55515 - DNA, 601 bp, Human
ccacgcccggctaatttttgtatttttagtagagacaggctttctccatgttggtcaggctgttctcgaactcctgatcttgtgatccctctgcctcggcctcccaaagtgctgggattacaggcgtgagccaccgtgcccagccaatttttgtatttttttggtagagggttttgccatattgcccaagttggtctcaaactcctgggctcatgcaatcagccaacctcggtctcacatagtggtggaatcacaggtgtgagccaccacgccctgcccctgtatgtgattattacagttyttcccagactacagtatgttatacattcttttaaatggcaagaaatacatggagaaacatattgccttggagatttaaaaaaattaatctggaaacattggtggaagtttgccaccagttaaacttcaaactcttcaaacagaatgcttttaacagcaaagctaatttgtgtctttgaataagcttgtatttcctaaataagaggcatatatgaattggattgactttttgtcaagttctgtgtttctcaaaacatcaaacatggctaggaaaactgcctgttttcagaaagtcatcaaa

SEQ ID NO: 55516 - DNA, 601 bp, Human
aaaaaaaaaaaaagacactggagccagcttcaaagagttcccactggccaaatttgggacaatatgaacaccaagggaactgactgaattcatgagttcagactactgtgccaggactttcaaaagaccctaagaaatataaggctgaataagataatctttgctgtcaagaaattcacaattcagcttgactctgaacatcagagaggatataacaaccattaattagaataaatgaaattaagtgctgtgttatctcccatttctgaactattaaatactctctatcagtgccaaccayatagtctttatcaaattaacttttccacttttccccaccaaactaaaagttccctgagagtagggccactcttctcattgtgtctaggacaatgttagaaaaaattccatctaatgcagcttaatatccaagactgactttacaattccacctggttctgtttcttgaccagtgtgatatatcccttgaagatatttatttggtcctctgagtatcagattcaaatcccttgttttacgttgattctgtattctttaagttggctgcgcactcgaattttttcctagaaatctcttaaca

SEQ ID NO: 55517 - DNA, 601 bp, Human
tatggatatgcttagaagtactgacatgataatggaagaaaagaatgggagttagatgaagagtaggaataatcagctttgaatgaatggaaaaaaatttaaaaatgaacactcaagccctaaaaccagagtaagttcacaagattttaaaactgtagctcattttagcatcccatatatcaagttgaatgacacatttgagcacatcctattagtatcactcaaatgataaatatgcttaatactacagtcatgctaaaagtttagatataattaaaatggttttagatgtttatatttmattttctcatgtctgcgacctagtaagagtatgttaccagtatggtctcttcctgggaatgctaaaagaaatagaagtctctttcacccttactgaattaaatctgcttaagaattgctgtaaaaaactataaaacctgtcactacaggcttgatagttagctccatttccttcaaaaaatgcttatcaccatctgcctttatttttcataaacacttgacttccagtttcccttgaagtggtttctcatgatttatatttccattctaattgtcaaagagtaattgttgggaccatctc

SEQ ID NO: 55518 - DNA, 601 bp, Human
acaggcgtgagccactgtgctcggcaactgcatgaatttctattcctcccccttctccattttatggatatgcttagaagtactgacatgataatggaagaaaagaatgggagttagatgaagagtaggaataatcagctttgaatgaatggaaaaaaatttaaaaatgaacactcaagccctaaaaccagagtaagttcacaagattttaaaactgtagctcattttagcatcccatatatcaagttgaatgacacatttgagcacatcctattagtatcactcaaatgataaatatgcwtaatactacagtcatgctaaaagtttagatataattaaaatggttttagatgtttatatttcattttctcatgtctgcgacctagtaagagtatgttaccagtatggtctcttcctgggaatgctaaaagaaatagaagtctctttcacccttactgaattaaatctgcttaagaattgctgtaaaaaactataaaacctgtcactacaggcttgatagttagctccatttccttcaaaaaatgcttatcaccatctgcctttatttttcataaacacttgacttccagtttcccttgaa

SEQ ID NO: 55519 - DNA, 601 bp, Human
tccctaagtgctgggattacaggcgtgagccactgtgctcggcaactgcatgaatttctattcctcccccttctccattttatggatatgcttagaagtactgacatgataatggaagaaaagaatgggagttagatgaagagtaggaataatcagctttgaatgaatggaaaaaaatttaaaaatgaacactcaagccctaaaaccagagtaagttcacaagattttaaaactgtagctcattttagcatcccatatatcaagttgaatgacacatttgagcacatcctattagtatcaytcaaatgataaatatgcttaatactacagtcatgctaaaagtttagatataattaaaatggttttagatgtttatatttcattttctcatgtctgcgacctagtaagagtatgttaccagtatggtctcttcctgggaatgctaaaagaaatagaagtctctttcacccttactgaattaaatctgcttaagaattgctgtaaaaaactataaaacctgtcactacaggcttgatagttagctccatttccttcaaaaaatgcttatcaccatctgcctttatttttcataaacacttga

SEQ ID NO: 55520 - DNA, 601 bp, Human
actaaacttaccaaatgaaaaaaaataggctgggcgcggtggttcacacctgtaatcccagcactttgggagaccgaggcgggtggatcacaaggtcaggagttcaagaccagcctggccaacatagtgaaaccccgtctctactaaaaatataaaattaaccgggcatggtggcacacgcatgtaataccagctactcaggaggctgaggcaggagaattgcttgaatccgggaggcggaggttgcagtgagccgagatcacgccactgcactccagcctgggcaacagagcaagactcyatctcaaaaaaaataaataaataacagactttaaaccaacaaagatcaaaagagacaaagaaggccattacataatggtaaagggatcaattcaacaagaagagctaactatcctaaacacgtatcacccaatacaggagcacccagattcataaagcaagtccttagagacctacaaagagacttagactcccacacaataataatgagagactttaacaccccactgtcaacattagacagattaacgagacagaaagttaacaaggatatccaggaattgaatcagtctgcaccaag

SEQ ID NO: 55521 - DNA, 601 bp, Human
acatgatttactgtatgtactacagactcccaaccacaatttaaaattttagtttttgtaaatctgagagagctacatattcatcttttatcaattcctctttaattgacacttagtaaattagtggagcacattttcaatttgaaaaactgtcaatactgttattgtttatttttaaaaataacattattaattaattttttaaaagagagacagggtcttgctttgttgcccatgctggtcttgaactcctggcctcaagtgatcctcctgtctcggcctcccaaagtgctgagactayaggccattgtgcctggcctgtttcttttaaaaactagtattttaaaatcaaactacttgatgtaaaaaaaaaaaaaaggtttttaaagtgaattactatatttcaaaaatcatggtatagtcaaagaaataagacttttatatttaagaacatagagaattaaaaaagaagcatgatgtattgggtagcttcgtggataacagtattcagattggctctgaaacacacctcatatggaccaagactccagaagtaacacaatcccaaacgatttttaaaaacacaatcaagaaagtaatt

SEQ ID NO: 55522 - DNA, 601 bp, Human
tatccagatcactcaaactttctccatatcagcaatgaggctgctttgctttcttatcatttgtgttttcagtggagtagtaactttaatttccttcaagaactcttcctttgcaatcacaacttggctaactgtttggtgcaacagacctagctttcaggctatctcagctttcaacatgcctgcctcacagcttaatcatttctggcttttgactatatgagtgcaatttgtggcacccaaaaacaattacaatagcaacatcgaagatcaatgatcacagatcaccagaaggtataayagtgaaaaagtttaaaaaattgtgaaaattaccaaaatatgacacagagacatgaagtgagcacacgctgttggaaaaacggcattgaaagacttgctcaatgcaggattgcgacaaaccttcactttgtaaaaacacagtaggatataacaaccatttattgaggcgcaataaagcaaagcataataaagccaggtatgcctgtttatccatacagtagaacattattaggtgacaaaaataaataaaagcactgacacatgctacgacatgaatgagccttgaaaacattatactaag

SEQ ID NO: 55523 - DNA, 601 bp, Human
agctacttgggagcctgaggcaggagaattgcttggccccgggaggcggaggttgcagtgagctgagatcgtgccactgcactccagcctgagtgacagagaaagactctgtctcaaaaaaacaaaaaacaaataaacaaaaaagcagaagcttaatctataaagtcaaccactctcacttttagtgttccatagaagaaagcctgaaaatcattctagtcatatagttgtttcagtttaaaaaatatagtgaagaaaaatatttaaaaatcagaaataatgtatctgataaggaacacayatttagaatatgtaaagaactcttgcaactcaattataaaaagacaatccaatttaaaaataggcgaaggatctaaataagacatttctctgaagaagctataaatggccaataagcatatgaaaacatgctcaatatcattagccaccaggaatgtacatcaaaaccataatgagatactacttaatcgaaaaaataaataataaatgttagtaagaatgtggataaatcaaaacactcatacacagctggtgggaatgtaaactggtactgctactttggaaaacagtagggcagttc

SEQ ID NO: 55524 - DNA, 601 bp, Human
gcgcagtggctcacgcctataatcccaacactttgggaggccgaggcgggcggatcacgaggtcaggagatggagaccatcctggctaacactggtgaaaccccgtctctactaaaaatataaaaaattagccgggtgtagtggcgggcgcctgtagtcccagctacttgggagggtgaggctggaggatggcgggaacccgggaggcggaactagtagtgagacgagatcatgccactgtgctgcagcctgggcgacagagctagactccatctcaaaaaaaaaaaaaaaaaaaaaaaaycttgaacccattctcccaaagatccgcctatgtttatacataaaatatttgtaaatactttaatagaccccatccatgggccccaggttaggaaactgtccagaagagaaagactatgaatttttaaaatgaccttgagatataacttgccttccatacaatttacccatttagagtgtacaatttgatggcttttagtatatgcatagagttgtgcaaccatcaccacaaccaatcctagaatatttttatcatgccataaataaaccacacacctcttagctgtcatcccttaaaacc

SEQ ID NO: 55525 - DNA, 601 bp, Human
cggccgggcgcagtggctcacgcctataatcccaacactttgggaggccgaggcgggcggatcacgaggtcaggagatggagaccatcctggctaacactggtgaaaccccgtctctactaaaaatataaaaaattagccgggtgtagtggcgggcgcctgtagtcccagctacttgggagggtgaggctggaggatggcgggaacccgggaggcggaactagtagtgagacgagatcatgccactgtgctgcagcctgggcgacagagctagactccatctcaaaaaaaaaaaaaaaaacaaaaaatcttgaacccattctcccaaagatccgcctatgtttatacataaaatatttgtaaatactttaatagaccccatccatgggccccaggttaggaaactgtccagaagagaaagactatgaatttttaaaatgaccttgagatataacttgccttccatacaatttacccatttagagtgtacaatttgatggcttttagtatatgcatagagttgtgcaaccatcaccacaaccaatcctagaatatttttatcatgccataaataaaccacacacctcttagctgtcatccct

SEQ ID NO: 55526 - DNA, 601 bp, Human
agcattaatttacttaattcccccaatatctcccacaagataattgagggatggaggaaaacttttttttaggtgtcaaatcactcaagaaatctgaaaaaatcttgaacccggccgggcgcagtggctcacgcctataatcccaacactttgggaggccgaggcgggcggatcacgaggtcaggagatggagaccatcctggctaacactggtgaaaccccgtctctactaaaaatataaaaaattagccgggtgtagtggcgggcgcctgtagtcccagctacttgggagggtgaggcyggaggatggcgggaacccgggaggcggaactagtagtgagacgagatcatgccactgtgctgcagcctgggcgacagagctagactccatctcaaaaaaaaaaaaaaaaaaaaaaaatcttgaacccattctcccaaagatccgcctatgtttatacataaaatatttgtaaatactttaatagaccccatccatgggccccaggttaggaaactgtccagaagagaaagactatgaatttttaaaatgaccttgagatataacttgccttccatacaatttacccatttagagtgtaca

SEQ ID NO: 55527 - DNA, 601 bp, Human
ttaagtgcttttccagcattaatttacttaattcccccaatatctcccacaagataattgagggatggaggaaaacttttttttaggtgtcaaatcactcaagaaatctgaaaaaatcttgaacccggccgggcgcagtggctcacgcctataatcccaacactttgggaggccgaggcgggcggatcacgaggtcaggagatggagaccatcctggctaacactggtgaaaccccgtctctactaaaaatataaaaaattagccgggtgtagtggcgggcgcctgtagtcccagctactygggagggtgaggctggaggatggcgggaacccgggaggcggaactagtagtgagacgagatcatgccactgtgctgcagcctgggcgacagagctagactccatctcaaaaaaaaaaaaaaaaaaaaaaaatcttgaacccattctcccaaagatccgcctatgtttatacataaaatatttgtaaatactttaatagaccccatccatgggccccaggttaggaaactgtccagaagagaaagactatgaatttttaaaatgaccttgagatataacttgccttccatacaatttaccc

SEQ ID NO: 55528 - DNA, 601 bp, Human
gatttcctttgatttaaccttcagcaaaatgaagcatttaaaaattcaaacctttagcaaaacaccctcatgaaaatgaagtacttcttttctatttggattggattctgttcagaggaaattcttgttctctaaagctatatcatgtgttttttcagtccatcaatcaattaaccaaatatgcacctagtgtttaggtgacaagtgttgtgatgctggaaaggcaaagacaaatgacaaggctcctgccctcagttaaaaatctgaagggcaagacaaaaaaactaaacagctgattccmaggtggcacactgttaagtaaacccacaggagaagcaatacactggctagaagggagaattcttagggaaggaggaagatgatgatgttcgagttgggtctgtaaggatgagcagaggtggagggaggagaaatcaggcacaggtggcatggggaaaagcctaaggccagagaatgtattatgtgttaggaaactgcaagtggtttggtgtggctggatataggtctcaaaatgagaggtgagagatgaaacttgaaagaaagctggggctaaactatgaagaatcttatgccatgttaa

SEQ ID NO: 55529 - DNA, 601 bp, Human
taagctaagtaaatcataaaaaatataaaatttagaatgaaaaaattgtagatttcatgtaaaactgtatataatgcaatagttaaagctgacgtttttagaaggaaaaaacatgcacccacattaataagtaaaaaaggtagaaaggagaggaaagtttggaatagaagaaacttacaactgcacactttttacctgagaagaagagagggggagtcatttacagagaattcttagtctttctacagtgcatacttagatgtattcagtattgtgggcaaacaaaatgaaactgccactcaatgtcttcttcctggcagctgacacatcttgataaaattgaaaccattaacattatttagaaggtactctaaggtcaacgctgatgaggctacgaatatgtgaggttctatgtaaatttatgaccaattacaggaaataaatcacttcacacttgtttcactctgaacttttaaagctacatcaaagtaccatgtagatttcctttgatttaaccttcagcaaaatgaagcatttaaaaattcaaacctttagcaaaacaccctcatgaaaatgaagtacttcttttctatttggattg

SEQ ID NO: 55530 - DNA, 601 bp, Human
tcgactggaggtcatgatttcttcattactttattacacagacaagagccaaaattctaatctacagtacttaaaaaaaaaaaactaaaaaaaattcaagaattttattgaaataatactaggtacataatgctgaaaatgtttttggttttaagctaagtaaatcataaaaaatataaaatttagaatgaaaaaattgtagatttcatgtaaaactgtatataatgcaatagttaaagctgacgtttttagaaggaaaaaacatgcacccacattaataagtaaaaaaggtagaaaggaraggaaagtttggaatagaagaaacttacaactgcacactttttacctgagaagaagagagggggagtcatttacagagaattcttagtctttctacagtgcatacttagatgtattcagtattgtgggcaaacaaaatgaaactgccactgaatgtcttcttcctggcagctgacacatcttgataaaattgaaaccattaacattatttagaaggtactctaaggtcaacgctgatgaggctacgaatatgtgaggttctatgtaaatttatgaccaattacaggaaataaatcacttc

SEQ ID NO: 55531 - DNA, 601 bp, Human
ataaatactttcataaaaattatgcttactgtattttcataaatactttcataaatattgtacttattaacacatgattgaatatatgtagataaattttttctaaatcatatgatttgacattagagctaaatatttaaaataagcactgtttagaaaaatatggaataattggtaggtgtggatgtattctctctcttctgttagacccttgatggtagggattatttcttaatcatatttatatcctagaacttagtactctgacttgacaagagcaggcacatgaactatactgaamagacggtaggattcttgaaaaagccctagtggtagcaaggccactgaggccagactgcctctccagattccctcctctctgggcagggcatctctgaaaaaaacgcagcagccccagtcaggacttatagatacaaccctcacctccctgggacgaagcacctgggggaaggggcggttgggggcacagcctcagcagacttatacatccctgcctggcagctctgaagagagcagcggatctcccaacacagcgttcgagctctgataagggacagactgcctcctcaagtgggttcct

SEQ ID NO: 55532 - DNA, 601 bp, Human
aattttcagctatccaatcacgttagtgaagatacggaataggaagtcttgcacattgctggtgggagtgtaaattggtataagcactttggaaaatggcttcgcagtatcgactaaagttgaatgtctacacactttatacctagaataactatacacttcagtgtgcttgggacagtcctggcttatgcctgttgttacacagtaatttttaattattttcattctcaaaagtgtcctggcttgaacaattatagtagtcacccagcaattccattcctaggcatatgaaaaatagaartaaatacattacaccaaaaattttataacagggctcataacagttttattcataataaccccaaatggaaataactcaaatgtttacaatagtcaaatgcacaaactacaatatattcatatgagatactactatacagtagcaaaaatgaacagactactgctgcatggaactacgtgggtaaatctcagcattgagtgaaagatccaaaaccccaaataactcattctatatgatttcattagtaaaatgttaaaaaccagggatctcgtttgtcatgttagaagtcaggaaaatgag

SEQ ID NO: 55533 - DNA, 601 bp, Human
caatagttttgtctattcttgtatttaatataaaggattatatggtatgcatttgtttctgtatcctgttactcagcattgtctgtgagattcaccaatgttggcatatagcatggtagcttatgcttttccggtgtggcatagtattgcatttgtgattacatcataatttatcctttctaatgttaatggccatttgggttgtctccaatctattatatataatgctgctatgagcattcttaaacatgtcttttggtcagtatatgtactcatttctctagagtgtaacttctgcgtmataaagaagatttagtaaatactgccaaaccattttccacagagtttgtaataggctccttactttttgcaagagaacttttaccttaccttctgcctagttaactgtcaaagccaattaatggtcccttaactgaccacactgaataacttaattctgtgttcttaatagaaaatacaacactgaattttcagctatccaatcacgttagtgaagatacggaataggaagtcttgcacattgctggtgggagtgtaaattggtataagcactttggaaaatggcttcgcagtatcgact

SEQ ID NO: 55534 - DNA, 601 bp, Human
tgatcctcctgcctcaggctcctgagtagctaggaatacaggaacactccaccacactaactagtatttattttatttctgtagagatgaggtttcactcggttgcccaggctggtctttaactactagcctcaagcaattccctcacctcagccttccaaggtggtgggattacagtcatgagccactgaacttagcctgtgactaactttttttgtagaagcaaggtctatgctccctaggctggtcttgaactcctggcctcaagcaatcctcctgcctcagactcccagagtgctgmaattatagatgtgagccacggtgcctggcctttaactttttattatggaatatttttttaaaaatacagtgaataatttagtgaacccccatgttgtcatcacctagctctaacaatcattaaaatatgcactttgtttccatgttaacatccccccttcaccctcaccctggcaaccatggactatttaattggaagcaaatgaaaaaggatttttaaataacaaccttggcctgttgaaatagttatatttcaacattttaaaaaatttattaatatattttttaaaaaatatattac

SEQ ID NO: 55535 - DNA, 601 bp, Human
gacattaaataataatcaaataatgtcaaaaaattatcaatgatttcatggacttctttttttgagggcattttaaaagcttaacagcataagaaactactggaaattgtcaaaaaatggtcttccatataattttagttttattatttactacataaactatacctcaactaaaggcaccttagaaaataaagcaattctacaacccacaatccggagataatccattaacattttaatatagctttcaagataatttctctaaccttattgacttttcaaaaatggattggtcattacrcatgttgtttaataacctgctttttcacttaataacatatcaaacatttcttgttgtcataatcttttactggctgcacggtatctcatttagcaacatgtcatcatctgcttaactgattttgtttggaaatttagctttccatctcctcacaatagcactgccatgaactcagtttctgaactcacagttcttcagagccgtcttattctttcattaagatatatggccagaaatataaaatacagcatgagttttaacactgaactttgaacacagaactttgatttctatgtttaa

SEQ ID NO: 55536 - DNA, 601 bp, Human
aaggcaatcctttgggcaaatgtataccagcaaaacactcacattaaaacactatttccatacaactgatgctatttggcaataaaaaggaatgaagtgctgatatatggatgaacttcaaaaatattaagttggccgggtgcagtggctcatgactgtaatcctagcactttgggaggctgaggtgggtggatcagctgaggtcggtacttcgagaccagcctggccaacatggggaaactccgtcgtctctactaaaaatacaaaaattagttgggtgtggtggtgcacgcctgtaatyccagctacttgggaggctgaggtatgagaattgcttgaaccccagaggcagagtttgcagtgagctgagatcatgccactgcactccagcctgggcaacagagtaagactctgtctttaaaaaaaaaaaaaaaaaaagaatatgaaagctaagtgaaagacacaagagacaatatattatatgattccattatatgaaatgtccagaacaggcaaatcttatagagacagaaagtagattagtggctgcctaggactgggggagagaaaagaaagggggtgatcgcaaataggcatgcag

SEQ ID NO: 55537 - DNA, 601 bp, Human
aagcatatgcttttgaggcccattgtctttcctaatttttgaatacatactacatgagtatcttcaaacactgagcaacaacaaaaattttttgtgaaatgccagtaaaaacaaaaagtattatatttccaggtaaaatgagacacgggttttttaaagtcactgaatgtgcatggaagtatttttgagactcactaaggaaatagaggcaccagcactctctgtaatttttagtaaaagactcctatctgagggaatctgggattccccccaaaaggatctcagtttgatcaccctacartgaaggtcaacaagtcctacccaagaattcaaaacacctgtcagtctttagttccctagtcttgaagtttgagcagagtcacatattaccagagaattcgaggatagtatctccgagaagccgggaaaaaactcagttaagagagaagggatgctttaaaaaaaaaaaaaagaggtcttagacgtaaatttctcttacctgaaagtcatgagcttcgagactgaaaaggcctagcaagtgtccaggacagtggatcaaagtggacctataccatgatacatctcagtgaagtttcaggac

SEQ ID NO: 55538 - DNA, 601 bp, Human
tggaagtgggcatttggggaaggaattccagggtactgactacccagaatatgttctagaaggggctgcatgaacttcaggtagacatgtcttctgggagtcctcatcctgtggaaaggggtttggctagaagaaagccacagctgggccctctaaagtgcagtcctggctatctgatctaaatgatatactgcttatccttattaccagactttcaggggcaaactatatttaagcaacaacaaaaagcaggcagacaatcaacctttccaactctccctttcctccaaaaaaaaaaaaagaaaaaaatccttatgggtattatcagtagcaaactgagattagcatatttcaaaacgtaatccactagtcatctgcataagaactgaggatctctgtcaaaaatgtagaatccctcttgagatccaaggattttgaatccttttgaaaagtgaaatcccagaatatacattttttacacgcattcaggaaattttgaaatatggtcggatctctgtatcagtgcgacccacattcatggattcaaacaattgtgggtccaaaataattaggagaaaaaaggatggtttcctctatactg

SEQ ID NO: 55539 - DNA, 601 bp, Human
taggtgtgtgcacactggatctgatgagggaggagtcctgtactaggtctggaagtgggcatttggggaaggaattccagggtactgactacccagaatatgttctagaaggggctgcatgaacttcaggtagacatgtcttctgggagtcctcatcctgtggaaaggggtttggctagaagaaagccacagctgggccctctaaagtgcagtcctggctatctgatctaaatgatatactgcttatccttattaccagactttcaggggcaaactatatttaagcaacaacaaaaagcargcagacaatcaacctttccaactctccctttcctccaaaaaaaaaaaaagaaaaaaatccttatgggtattatcagtagcaaactgagattagcatatttcaaaacgtaatccactagtcatctgcataagaactgaggatctctgtcaaaaatgtagaatccctcttgagatccaaggattttgaatccttttgaaaagtgaaatcccagaatatacattttttacacgcattcaggaaattttgaaatatggtcggatctctgtatcagtgcgacccacattcatggattcaaacaat

SEQ ID NO: 55540 - DNA, 601 bp, Human
acattctgtcacttatttcatttctctcatgcaccatgaattttctcctacaataaagtggaagagtaaaaaaccaaaaccaaaaacaagaattagctaccaaatatctactctgactattaagaatcttgctaaaatatgctccacgtctcctaccctcatccttgtttctcagggacaaactcctagtcacaatctttcaattctttagataaaggcaatgtgaaatattcaggaaatattacatacactttcaaaactaacggtcctgagaataaagacattacagcctcaccataayacctcccagctttcctgaaagacttccaggaagaagtgaagaaacctcagcacttccctgcttgtatatgacaacaagaatcagcagggatgcagggactcagaacaatgatgtctggcccaagcagaccttcaactatattcctgtgccctagaccaagtggacaaatttatagtgaggtacaacgtaatttaaataataccattctccttggcagaacagagggatctatacttggagttgaatctttaggaaaagggcatatagcaccacaaaggcctcctcaaggttatgataccc

SEQ ID NO: 55541 - DNA, 601 bp, Human
aatccacaaccatgacagtaccagttctactcacatacaattaagtcatcagctctgccctcaagagtttatgttttaaagtttgattttgacattctgtcacttatttcatttctctcatgcaccatgaattttctcctacaataaagtggaagagtaaaaaaccaaaaccaaaaacaagaattagctaccaaatatctactctgactattaagaatcttgctaaaatatgctccacgtctcctaccctcatccttgtttctcagggacaaactcctagtcacaatctttcaattctttmgataaaggcaatgtgaaatattcaggaaatattacatacactttcaaaactaacggtcctgagaataaagacattacagcctcaccataatacctcccagctttcctgaaagacttccaggaagaagtgaagaaacctcagcacttccctgcttgtatatgacaacaagaatcagcagggatgcagggactcagaacaatgatgtctggcccaagcagaccttcaactatattcctgtgccctagaccaagtggacaaatttatagtgaggtacaacgtaatttaaataataccattctc

SEQ ID NO: 55542 - DNA, 601 bp, Human
gataagactgtaaaatatatatatatatatatatatatatatatatatatatatatatatatatatatatgtacatatgaaacaaattatttccaaaaagccctaatcatatgataactgatcccttaaataaatccatagtctaggtcacagtgatggtcagacagtggttgaatacgactctcttcttctcgggggccgctccttttgaaccacttggttgctctctctggtctccagcacactgtcttctgtttcgctctcactaccatctgccactgcggggtccaaagacatcgarccagattttccgtgcaaaggaaaaccaacaccagtttcctgtaaggaattatctataaaatcttcatcggaggaatggaatgattcatcatctcctattaaatggttgacaatgtggattccatcaaaaggaggttggcctgagaagcccctctggccttttaggcacctgagctgttaaaacaaaatccaagttaatacagtcaaatgggggaaacacacacacgccaaaaagcaaacattccatgtttaaggaagaagatgccttattatttttctatttacaggtataatcatagtt

SEQ ID NO: 55543 - DNA, 601 bp, Human
ccaattaaagggaaatctgcttttgagtaaaacaatcatgcccttgttacaaagtatcccaggaaccctcaagataggcaaaacctttttaatcacattttttctcattacaagttggctaataggaacatcatagtaattccccgttaactcttccacttttcacacccgcacaaacacactgggttataacaatgctcttattctatctttgtctcagacacattctcaagcatgttggtttactctctccttagaatatccccgtatcctcattctgatatgcaaacgtatcctcacytacagaccattctttcctcctctcctctctcatgcacgcgtgcacacacacgctgaaacgctatatacacactatatatgcatataaacatatatgttctccttttaattcaatactaatccagtcattcgtatttcccaatttcttctcagtctctcatacaggtccacgcagtgaagcccaagggagatacttacctccatagcctgcgggaaacttcatgaagtgagaataatttccatacatgtttactcgtcagttcatgttcctctcctgtgcagcttctaaatattaccgcct

SEQ ID NO: 55544 - DNA, 601 bp, Human
tgccagcaaaatatgagggtctttgtggatttaattttattttcccagattccttatttattattttacaataatgtctgatttttaactattttgcatgttagtctctgagtaaaatagaggggaagaaaatattgtattaggtagcaaatatatggacaacactatagcagctgtttttcacatgctaactcatttaattttcacaatactctaaggatgagattataaatcccattttagagagaaaggtgctaaggctcagagaggttcactagcttgcctaaggtcacacagctastaggtgaaaaattgggaaccaaactcagcacactacctcttcctgcctcctcttcctcctggtgctcttttcactatattaaagcaacaatattataaatttgagtaagggcttttctggaagtgttctgcagctcagccccatataaatttggactagtccctgccttcttttgagcctcagtttacacatctataagatgagagcctaagatgctgtttcaggtccttaggatgctaacattccaagattccagcccccatggaattttaactagatcttctttctctggctcttact

SEQ ID NO: 55545 - DNA, 601 bp, Human
gggcccaaagctgggagattgggcacctttgtggagccaccacgtagccaccacactttggccagtttgagcaatctgttgctcactgatcagatgatgctctgacatctggtaagcatggtcccagacacaaatctcaggtgttatttccaaaaggtgactttgcttccctggagattcttatacaaatcatggggccctctgtaattccatgtgctaatatgtaacagggcagggggttatacaccaagtattttaataagtgccgtgcaacttgctgcactgtggcaggggaggttakaggccaaaggtgacgtccactctaatcctgctttcccctgtgcctgcttgtgagtcctctgtccctctccctcatcacagaaagttctcaaacagacctccctgcagacgggggcagagtcctttggctcagcatttaggcctcctcttaactggcacatgccaacaaaatggaaaacctcaacagaactaaacaaaataattcttctcctccctcaagaatgacaaagaaaagtagctttacaggagacatgtagacaacctacatgaccctttcccctcaagttccctatactatact

SEQ ID NO: 55546 - DNA, 601 bp, Human
gtatgtacccaagggaagccaccaattaattctgcagagatcaccgttgctcttaacctatcccatggcttattcctcaatggccagtccactgggtctgcaacaaccagtcagtgctgaggctgcatatctgaggttgtattggagcaccgggagctccctgggggtgtgctgctgcccctggctttgcagagcaactgtgtcactcacagaagctgtgagaggcagctcagcagtgtgaactctgggagctagtctgcctgggttcaaatccctggctgtgccattttctagctataakaccttaagcaagttatttcacctctcaattcctctgtttctttgtctctaaaaggagtacgagaacaatggtaacagtacctactcctagggttgttatgaggattacatgagccgaggctggtaaagtgcttacaatagtagcgagcattagtgttacagtgtgtttgttaaatgaaatgagagaagtcctctctctccctgatctccttctcaccctgaggattactgcacaattggatgggggggattacaggctttgttttgccatcttctaagaggcagcaactgtctcatccca

SEQ ID NO: 55547 - DNA, 601 bp, Human
cttacggactacactgtcagtttgaagtttgaatgaaatagacggtggcctccaggaggggcccctctatctgttgtgctgagattgactcagccctggctcagcgatcctcagaaaaaaagtgaaaatacaggttgagtatccctaatccaagcctctaaaatctgaaatgcttcaaaatccagaactttttgaatgccaatatcatgctcaaaggaaatgctaattggagcattttggatttcagatttttggattatagatgctcaattggtaagtataaggcaaatattccaaaataaaaaaaaaatcccaaatccaaaacacttctggtgttaagcattttggataagggatacttaacttgcatcaactcatttcataactacaacaccactttaaggtccgtagttttattatccccattatatggggattaagcacacggcttggcacagaatagacactcaccaaatattttttgacagataacccaatgattggtatggaaataaatagcacatattcataaagagttttaggaatgtaaggcattatctagcagacggaataaacttggacccaggggccagaagacctg

SEQ ID NO: 55548 - DNA, 601 bp, Human
gcacactatgagatgctgacaaagtaaataagacatggattctgcctcggagggagcaccattttcagaaaactacgttttaacaaatcatcccagggcaggcactcatgaggtcagacagaaagggagccatgacctgggacttccaactcctatcattttcaggagaccctcaccccaggcagtgaccttgagaagtcctgaccccctccatttcctcaaatgcaaatggaacaacctggagttccttggcctcttttatcagctactgtaaccagatggggacagaagtgggggacarcaagagtttcaaggttaaagatcaatcccaaactcctggtgggatttcagaattaacaaccaaacttgaaaagtggaaaagcctgttatcatctttaattcaaaaagcatttacaagatgtcagaggaacgggaaacaaagcacttaatgaatatcttggagtgtttcttctaggctggttgcctgggtttcatttctgtgactcaaaatctcctttgctcctccttttcattttactggtcactagtgtcatggggaagcagcctcctggagggttcagggctcacagtatctgttttc

SEQ ID NO: 55549 - DNA, 601 bp, Human
gtttatcaacagaaattatttgcataagaaagcaatgttcctgatgtttaccagaaccacaatctctaaacaatgaattgcatgtgtgtgtgtgtgtgtgtgtgtgtgtgtgtgtgtgtcagagagagagacttactgagaaaggggacacaaaagccagggtacttagaactacagaattcttaccaaggtaaggaagttgcttagcaacctcatcctcagccaataaaagcaaaatgtcaagcatgcagtttttctgactggccagacaagggagcaaatggcctggtgtttccacccytttgctgctgtgccaggaagggtagagagtttgctctcccattagcaaccctcttcaggttggaatggaaacttgtaatgaatcattgataacggctaatgcccacccatggggaaagggacagagctaaagacttggcatttttcagagtcaggagtctccatatgaagtcacaggagcaccatggggccctatcccactctgatctctcccacagtggaactgtcacacaccaaagcctgtctctgttcctccagtggagggatatggtgtgaaggcccaacaatgataggattctca

SEQ ID NO: 55550 - DNA, 601 bp, Human
gcaatgattttatttgcaaaataacttatctaatgaaaaagcgctagtggagttcctcaaaaggttttcttctctcctggtaacatacccaagaatagcattgcatactcctgggtctcatttcccccagtaaggagctggcactcagtgacctgaaagatcccttccagcactaatgtttcgtgagcattgggtaggacatggcttgttggcattgaaaagaaagaagtgcaggtgttggtggtctggaatggtctgagtctggaccagatgctgaggggtacctcccaccatcaactgraccatgttaggccttcaaaccatttggcattccaattaaaggtgctaagagtgtcaccaggagccaaaactgagaagggaatctgtacagtgcataactctacaatgactccaaaagtccctgtgtgcattgatggcactatggcttcagggatgcaggactgaggaggagacaacagctcagaagtcagagttctaggttgaggttctgccactttccagctatgtaaatttgagcacggaacatgacctctgtaaactgcagtttcctcattcataaattgagacaaataggcctaac

SEQ ID NO: 55551 - DNA, 601 bp, Human
cagggtcaagaaccaaagcctgacatcaggcctagactgagggcacaggcaagagcaagagtttgcttcacactcatcaccccaagaattccagggtgtggtccctctgccaccagtgacaaagggcattttaagtggtatgtcagcaaacttaaaaaaaaaattaatagttttatatttatgctttctgtttccttttgtttatagggagggactgagctctcatttcttgttataaaattatcttcctaaagatagctatttaagctttcttaaaacagtaaattgatttaagaaaaaktctaagtacagaggatatataaaatatcatgaaaatagtatgcaaaggaatgatgtttaaaaaacatcaacctgcataaaaatatacaaatatggactttgaagaactcatgagttgtttcaaaaataaaatgagataatgatgtgaaagtgatttgaaaattaaagtacatttttgttgttgttatcattattaataagaagtaagttaacttgactactgagagcagtggtgagaatggtacattgttgagatacaatgaaataatgagttaaagtttggttctcaatggcctttaaa

SEQ ID NO: 55552 - DNA, 601 bp, Human
accgtggatcccatcactagatccctgtgcagctagcatgcaagaacagatgtgaagaagccatgtgcacagtagctgcacgcagcacatccatggcacccaagctgtccacatggatagaaagggagaggattaagtgctcagtaagcacagtctgctggagaagctaccccattctcagatgcctactgtgggtcagacaccttgccaagcagatgggataagaagtggaggaagtcatatgcctgactttatgtggctcattattcatccaacaaatatttcttgagtgcctactacmtgcaaggcactgtcctaagcctttgggcaacatcagtgggtgctaagtgtaatgtcaggagtaggatgctaggagaaactggcttctttcaagttctggtagagagcaggaagtgtcagaaatataactgtgaaactattcttaaacgtaaatattccactggaaaaaatgtcaacctgcagtttctcttggagcttctgctagcttagttgagggctacttgtggaaggaagtcactccaaggaagctgtgaccctcttgtcattctacgtatggagctttggtctatcagggacaatt

SEQ ID NO: 55553 - DNA, 601 bp, Human
cagccagggaaggtgagtctataccaaacctcgatggggagagtgagtaggttcccaggctgctccataattccctgactagaactcatattgctctgataatcagggcagggctgagattcattcatttatatgcaacaaacatttattagggtgccaggtgctggggattcagagcagaagagcacacagtcgctgacatcaggagtcacattccataataatgatggggaaggcagtggctgttgtcatacccctagtttcctatatctattgaagctttatgtacatgatgttcttktcctgtccctctctatagtacagggttaattagcactcaggggagaagacttggaatggctaggcatggctttatggccacagaggcccaggtagcacaggaaggcaaatgcagaccagactgccgagaccatttctgcctccaagaatagaatgctgcagccaaaagtgtctgtggaacagggtctgggtgaggaggtcatcagtatcactttcttccaataaattgaacccacattcccctgtagtcagtagcaaactcgagatgaaacaggagagtgccctcctgtcatcttgggag

SEQ ID NO: 55554 - DNA, 601 bp, Human
agtccagaagaccccagcctgagtgactgaggcctgggccagccagccagggaaggtgagtctataccaaacctcgatggggagagtgagtaggttcccaggctgctccataattccctgactagaactcatattgctctgataatcagggcagggctgagattcattcatttatatgcaacaaacatttattagggtgccaggtgctggggattcagagcagaagagcacacagtcgctgacatcaggagtcacattccataataatgatggggaaggcagtggctgttgtcataccccyagtttcctatatctattgaagctttatgtacatgatgttcttgtcctgtccctctctatagtacagggttaattagcactcaggggagaagacttggaatggctaggcatggctttatggccacagaggcccaggtagcacaggaaggcaaatgcagaccagactgccgagaccatttctgcctccaagaatagaatgctgcagccaaaagtgtctgtggaacagggtctgggtgaggaggtcatcagtatcactttcttccaataaattgaacccacattcccctgtagtcagtagcaa

SEQ ID NO: 55555 - DNA, 601 bp, Human
cagcttggaatccactctggactatgctggatccacagccagtgcaacaaggggcacagtccagaagaccccagcctgagtgactgaggcctgggccagccagccagggaaggtgagtctataccaaacctcgatggggagagtgagtaggttcccaggctgctccataattccctgactagaactcatattgctctgataatcagggcagggctgagattcattcatttatatgcaacaaacatttattagggtgccaggtgctggggattcagagcagaagagcacacagtcgctgacrtcaggagtcacattccataataatgatggggaaggcagtggctgttgtcatacccctagtttcctatatctattgaagctttatgtacatgatgttcttgtcctgtccctctctatagtacagggttaattagcactcaggggagaagacttggaatggctaggcatggctttatggccacagaggcccaggtagcacaggaaggcaaatgcagaccagactgccgagaccatttctgcctccaagaatagaatgctgcagccaaaagtgtctgtggaacagggtctgggtgaggaggtc

SEQ ID NO: 55556 - DNA, 601 bp, Human
aaaacaccctctcagaaacacccagaacaatgtttaaccgaatatgagggcatcctatggcccagtcaagttgacacataaaggccctgccagttctgcctctaggtgtgctggtagttggggcagcagggactctggctgttatacagggagagaagaagctgtggcagatgggattattgttcctaatacttcactccttttaattcttcatattctttgcattgtttctctgcagtacttcccactaatatagacacagccttcttccttgccccatcaatgttggaatctgtcataggttttgttttgttttgttttgttttgttttgttttgttttgtttgagacggagtctcgctctgttgcccaagctggagtgcagtggcatggtggcactatctcagctcactgcaacctccgcctcccaggctcaagcaattctcctgcctcagcctcctgagtagctgggattacaggcacctgccaccacaccgggctaattttttgtatttttagtagagacggggtttcactgtattagccaggatggtctccatctcctgatctcatgatccacccacttcggcctcccaaagtgc

SEQ ID NO: 55557 - DNA, 601 bp, Human
acctgatgcatagcaggtccacataagtagttattgggatgaatgtcaatgccctttgcaaaactgtactttcatccccaaactacaatgtactttctgtctgtaactaccagattttactcgccttcctggactctgttcacaggaaagaaaggaaacaaacaaacctcatacattatgaagcatagggtatcaatggccctgctgattatagtgggtgggggtggcataaatacatgtacacccccactgctgccccatccccactcctctgagcactggggtcaaggaatatatattragcagtttataattcactctctttgctcccttcaggtctgctcctgcgtctatgacagcacacagacagcactgaagtgcaatggatctgcataatgtggccacctctcccacaagattacccgggagcactgattatccatcttttaatccttggctgccaacaggaagatcttggggtcactgtgcaagtcagcatatatcacagcattaggcaaatgcagggttgtgaacacagggctgcaagccaggggacaggatttcattgtggctctgtttttgactggctgtgtgaggctgc

SEQ ID NO: 55558 - DNA, 601 bp, Human
cttgtttattccttaggtttttgcctgtcctgcctgctattgtgtgattgccatgagagtaaagaccttggccaccttattccgtgcttatccctaaaacctaggacagtatcaattagtacctgatgcatagcaggtccacataagtagttattgggatgaatgtcaatgccctttgcaaaactgtactttcatccccaaactacaatgtactttctgtctgtaactaccagattttactcgccttcctggactctgttcacaggaaagaaaggaaacaaacaaacctcatacattatgmagcatagggtatcaatggccctgctgattatagtgggtgggggtggcataaatacatgtacacccccactgctgccccatccccactcctctgagcactggggtcaaggaatatatattaagcagtttataattcactctctttgctcccttcaggtctgctcctgcgtctatgacagcacacagacagcactgaagtgcaatggatctgcataatgtggccacctctcccacaagattacccgggagcactgattatccatcttttaatccttggctgccaacaggaagatcttggggt

SEQ ID NO: 55559 - DNA, 601 bp, Human
ttactcctcaagatcaaaaatccaacaactgcaaaaagagaagctcaaacaatgaaatgacagagcacagaggagactggccctgcctgctgctcccacccctagacacttcctcctcccttcaccccccaaattgtacttacgcgagaaccaggtcacagaatgaacatgcttccatcatgaatccctctcagaccagtcctgggtgaggaaggcaggatgcataggaataatctgcccagacgatccagagtccagctcactgtagctaacaccaaggccttttttccagtgtcatctygttaaccgagcaaagcattgctgcagtgtggttccggagcccaagcccagaacactgctcagggtctcaggctgctgagcttccccagcacttggcaagcttaatatagctccccaaagccaaacttggccttggcctctgcacacagcccagttggccaggaccaaagcttccatctgacctttcaaccccaatccctctgtacagacatatggtccaggaatagcggccctgctactcacacagctctgaagatgaattgactggccatgtttggctcaatcagacttgagtgtggtt

SEQ ID NO: 55560 - DNA, 601 bp, Human
gagatgaactttaaggtctattccagctctaacatttgcaatttttatttattttctataaaaatgcaaacagactcaagaggataataattcagttatcaataaatatctaagcagaaattagcaatgatagaacccaggtcaggctgcagagttcaggaggggagaaaaagacaggagtattgcaaagatctgtgaggcccattccggagtccagccagcagacatcatgctgacaaagatgcagtatcaaacatacacacacaaacacactcagaaaaatgtttcctatatcacattrtctacaaagtacataaatatcttcccaatgatatattgatgtctttagaaattgcatcactccacttagatgctccccagggcagggattaaatctcatacacatttttggtatctccagtgcccagtactgggcctggttcaataaatgcttgttgaaatgaacttctctagaacctctcagaaacagtacacctgaattacctaagtgtataatactatcacctgggaataatcctaataataccaagttactgctatagagcatcgcacgtcttgagaagtgatttttaaatccaca

SEQ ID NO: 55561 - DNA, 601 bp, Human
gttccagggagcagaactcttatagtgtcacagccttaatctagctaaggccttcatcatgaggagtaataagcctggacctccaacatgggtttggtctaaacctgcgacttcctaatcaggtcacttcacttagcaaagactctatttccccatttctaggtgagtgtgtgtgttgctggggggggtggggagggaggttgaggcttcaagtcttttgtccctggctcaaccagatctgcttttatcttatgtgtatatcaggcttccaactatgctttcatctgaagaaaagacttgwtgacttaattttttaaaatcatcagacgagatgaactttaaggtctattccagctctaacatttgcaatttttatttattttctataaaaatgcaaacagactcaagaggataataattcagttatcaataaatatctaagcagaaattagcaatgatagaacccaggtcaggctgcagagttcaggaggggagaaaaagacaggagtattgcaaagatctgtgaggcccattccggagtccagccagcagacatcatgctgacaaagatgcagtatcaaacatacacacacaaacacac

SEQ ID NO: 55562 - DNA, 601 bp, Human
gattagaggagacatccaaggtattgcacctgcccagataccaggttaggtaccttaccaggtctgactgcttggagccagaaccccaagatcctggatctcagatcatcattccccattcaccacattgtctgccttgggtgagaggtgatcctcaatcctcaactgccctagcagcttccttcctcacctccttggccaggagcccctgcaggagcagacttgctttggggcactttctccccagtctcagccagcagcccctctccaacactcctcctcttcatgagtggatagtggyaggaggggcagtgagacaggttggttgatgttttctctgtccatctctctggctggcttggggtttgttttgggctcagagcaatggcagatgagatcaaaggcagccatcagagcataaacccattagctgcctggtccccaagtcccccaatcccggctgtcttgttccattagaaacagtctactgaaataagcactttagagccgggattcaccaggcaactcctatctgctgctgcacgcaagccagctgctccctgagaacaggaaagaaacatacttgtctgctggatcgtct

SEQ ID NO: 55563 - DNA, 601 bp, Human
tttggatcattcaggaaggaaagatcacatgctattgagatcagggaaggcttcatgaaggaagtggcatttgagctgggacgacagccttcaaaaatgtgtaggatttggatgggctagtgatgggcagaaggctttgagagcagaggcctagagggaagcccaagtgtttgtggagcaaacatgtccagtggatggatgggagataatgctgagaagtgcgctatgacaaagcctagaagctgaattgccttgctaggagaattgatttagtttgggaagcaataagcagccactagasgcttggagcagagaaataattacctgaaaccatttcagtaatacagtgaatgaggtacagcatgaggaaagattagaggagacatccaaggtattgcacctgcccagataccaggttaggtaccttaccaggtctgactgcttggagccagaaccccaagatcctggatctcagatcatcattccccattcaccacattgtctgccttgggtgagaggtgatcctcaatcctcaactgccctagcagcttccttcctcacctccttggccaggagcccctgcaggagcagacttgctttg

SEQ ID NO: 55564 - DNA, 601 bp, Human
attgccattgctaccatctatggaaagcttgctcagtgctaattaattatgttaatcctctcaacaaccctaagaggtcttcctatttacagataaggacattgagccttaaagtgggtttattcatttgtttattcaggaacaatatggagatccaaaacggaaggagatgcaggcactgcctcaaggaattggccattaatgtgattaaaagtcagtttggatcattcaggaaggaaagatcacatgctattgagatcagggaaggcttcatgaaggaagtggcatttgagctgggactacagccttcaaaaatgtgtaggatttggatgggctagtgatgggcagaaggctttgagagcagaggcctagagggaagcccaagtgtttgtggagcaaacatgtccagtggatggatgggagataatgctgagaagtgcgctatgacaaagcctagaagctgaattgccttgctaggagaattgatttagtttgggaagcaataagcagccactagaggcttggagcagagaaataattacctgaaaccatttcagtaatacagtgaatgaggtacagcatgaggaaagattagaggaga

SEQ ID NO: 55565 - DNA, 601 bp, Human
ttttgaaatcaacatcactgttaatttttaaaaattaatttgcataataaatgacaacacatatgtgatagaagaattccctcttccagcaccacccctttttttatacaaggctatgagaagacatgtggaacttgtaaccagtattttgctttgttttcatgtagtacactggttctcatccctgggggctttgaaaaaaaacatggacctcatccatgtcttgagattatgattccatgagtctgaggtagggccttggctctggcatttcttttttttttttttttcctttttttgwgacagctgtgttgcccaggctggagtgcagtggtgccatctcagctcactgcaaacttcacctccctggttcaagcaattcccctgcctcagcctcccaagtagctgggattagaggagcatgccacgacacttagctaacttttttgtatttttggtagagacaggatttaaccatgttggtcagactggtctcgaactcctgacctcaggcaatctgcccgtcttggcctcccaaagttctgggattacaggggagagccactgtgcctggctggctctggcatttcttaatttcacc

SEQ ID NO: 55566 - DNA, 601 bp, Human
ggtccccagttagcccatcctaaagggccattttcctttcattgagtacaaagtatccaggcagacagtgagcagccccttctctgtggcacttttcagggagtgtctgcttctgcatgtacctgaggatctgtctccacagatggcacagatgtgtttaaccagagatccggggctggtggatgggtagttcatgtttccaatcccgggaagccctggtaagggcttgatgtcctctgaactgctgacactgttgaccacatttagctgcaagagaaaaaaatactgtaaagcacagagscagagtaaattcaatccccaaggcctaaggcaatgagggcttactcaagaaaaaacaagttctatttcaagaaacagtttccaagtacagagtatttgaaactgcctatctgtgagatgaacttaagggagggataaaagtgccataggaggaacaaaattatttctagaagccaaaacttaaaccaaaaatcacaacacatctccattagagtctatctgcttttattcattttactcatatgttttatttaagctagaaatccatgccaaattacacacccaggacaatgtcaactgt

SEQ ID NO: 55567 - DNA, 601 bp, Human
caacagcttctgtctctcagatacatgtgtaatagtgtgactccagagaagggtttctgaaatgtttcctgtaaatctcatcctcaaaaaataaagccatcctttaaattcatcaaaacggcagcctgtgaacccagtgacataaacgtataggtgggtccccagttagcccatcctaaagggccattttcctttcattgagtacaaagtatccaggcagacagtgagcagccccttctctgtggcacttttcagggagtgtctgcttctgcatgtacctgaggatctgtctccacagatrgcacagatgtgtttaaccagagatccggggctggtggatgggtagttcatgtttccaatcccgggaagccctggtaagggcttgatgtcctctgaactgctgacactgttgaccacatttagctgcaagagaaaaaaatactgtaaagcacagagccagagtaaattcaatccccaaggcctaaggcaatgagggcttactcaagaaaaaacaagttctatttcaagaaacagtttccaagtacagagtatttgaaactgcctatctgtgagatgaacttaagggagggataaaagtgcc

SEQ ID NO: 55568 - DNA, 601 bp, Human
agcccatcctcagacaggcatcatgaatcaatcacaatcctttttctaggtagaagtcttcttaataccaggcactatgcttgattgattgaaattgcagaacttcaaaaatataaggaaacaaatcattcaaaacatatttgtgtctgattctttgaatgtaatatgtgatgtcattgagttacagaaatgacatgactttctaattctgttttacttaggtttccagcatctcaggagtttacagttcagaggaagccactgtaagatgaaatgatgggtacagatagcctgcctgaaraaaagccagcctttgcctcattggttgaccatactacaggccggcttttcacattgctgaactcacagcaatgataaatacaggattttatcttgggcccagaaaacctagtgctctcagttctgaaatatttgtcttagagaaatatgggaccaatttttcaactgtgtgacatagtcattcccatggcttttcaatatttaaatgaacctcatagactttcaactagaataagcatagcagagaaaacactgtcgggctgtggctggtgtgctattatggcaatggccaagtctgcat

SEQ ID NO: 55569 - DNA, 601 bp, Human
taccataaactatgaacagaattctgagttatgaattgttaagtgctattgactgttgaggaaattaattgctgtttgatctttatatcatcatatgacaatcaagctatgacataaagatctgatagaagctgattttgcagccgggcatggtggctcacgcctgtaatcccagcactttgggaggctgaggtgggaagatcacttgaggtcaggagcttttagaccagcctggccaacatggtaaaacctcgtctctgttaaaatatatatatacaaaaattagccgcgcatggtggcrcatgcctgtggtctcagctactccagaggctgaggtatgggaatcacttgaaccctggaggcggaggttgcagtgagccaagatcatgcccctgcactctagcctgagtgacagagcgagatcccgtctcaaaaaaaaaaaaaaaaaaaaaaaaaaagaaggtgattttgcttaatccagactaatttgttgcatatttcattgcccttattacctgtccacacatgcagttttcaattaccccaggcaggggtggctaatttaggtcaggagagccaccaagcccatcctcagacaggc

SEQ ID NO: 55570 - DNA, 601 bp, Human
tattatcctttaccataaactatgaacagaattctgagttatgaattgttaagtgctattgactgttgaggaaattaattgctgtttgatctttatatcatcatatgacaatcaagctatgacataaagatctgatagaagctgattttgcagccgggcatggtggctcacgcctgtaatcccagcactttgggaggctgaggtgggaagatcacttgaggtcaggagcttttagaccagcctggccaacatggtaaaacctcgtctctgttaaaatatatatatacaaaaattagccgcrcatggtggcacatgcctgtggtctcagctactccagaggctgaggtatgggaatcacttgaaccctggaggcggaggttgcagtgagccaagatcatgcccctgcactctagcctgagtgacagagcgagatcccgtctcaaaaaaaaaaaaaaaaaaaaaaaaaaagaaggtgattttgcttaatccagactaatttgttgcatatttcattgcccttattacctgtccacacatgcagttttcaattaccccaggcaggggtggctaatttaggtcaggagagccaccaagcccatcc

SEQ ID NO: 55571 - DNA, 601 bp, Human
gttctgcctccattcaaaacattagtgtaaataataaataaaaatatatatgcttgtcacgtattacctagcaggaaaagaaccccaacttaactaattataattgagacccaagttcttaggaaacctatttaaatttattatcctttaccataaactatgaacagaattctgagttatgaattgttaagtgctattgactgttgaggaaattaattgctgtttgatctttatatcatcatatgacaatcaagctatgacataaagatctgatagaagctgattttgcagccgggcatgrtggctcacgcctgtaatcccagcactttgggaggctgaggtgggaagatcacttgaggtcaggagcttttagaccagcctggccaacatggtaaaacctcgtctctgttaaaatatatatatacaaaaattagccgcgcatggtggcacatgcctgtggtctcagctactccagaggctgaggtatgggaatcacttgaaccctggaggcggaggttgcagtgagccaagatcatgcccctgcactctagcctgagtgacagagcgagatcccgtctcaaaaaaaaaaaaaaaaaaaaaa

SEQ ID NO: 55572 - DNA, 601 bp, Human
aggttaggtctgtcaaacctgtgtaatgccagtaatgccaaaagatgatggaatataccaatatcaaagatttgatagcagacccaggtaaaaaaaactcagtgagtgaaatgaaacctacagtttgccccagagagagacctaggattagaggagaaaagtcacctccaccctgaaggtcagtctgacgatccattggtagagcagatcataaggaccctgaaaccttggctctgagacttgctgcctggttattggaagaaaaaaggagacggtccagtttggggatcaccatctgggytccagaagaggatgggtaaatgtggaggaggaagatgcctcttgccctctctgctctggagagacacacttcctaggaaaagggtacattcaattgcaatacacgagtacccaaagtcatcctaatttcctattcagacttctctttagagccctgtgggaaagaaatttgaagtggagattaggatgactttgggcaccatgacttctcgtgtattgcagttgaatgtccccttgcctaggaaatgcctctctccggacacgagttttggaactgaatgtgtctcaccttccctcttca

SEQ ID NO: 55573 - DNA, 601 bp, Human
gattcaccactatccccatgtccctgcttgagctcactagttaattaactgcccacttcaatttatctgtgatacttaatggaaagtcttttctgtctactaacgggacagaaagcaccttctgaggtttttttctctcatactagaatacccagctaaaccacactataaattaaaagatgtgatggtttcaacacacagtggtggtctctctgaatgggaaggttaggtctgtcaaacctgtgtaatgccagtaatgccaaaagatgatggaatataccaatatcaaagatttgatagmagacccaggtaaaaaaaactcagtgagtgaaatgaaacctacagtttgccccagagagagacctaggattagaggagaaaagtcacctccaccctgaaggtcagtctgacgatccattggtagagcagatcataaggaccctgaaaccttggctctgagacttgctgcctggttattggaagaaaaaaggagacggtccagtttggggatcaccatctgggctccagaagaggatgggtaaatgtggaggaggaagatgcctcttgccctctctgctctggagagacacacttcctagga

SEQ ID NO: 55574 - DNA, 601 bp, Human
gataatgagccccagaggctgcagaatggactggaatcgcaatgccgaacatctagtttgtcatgcgagccatatcagtctctcaaggtaggtcagagaagagtatgactgcaaaaacacaacttatactccaaaacttagtggagatacgccaaaaagcttcaagacaagaatggtactgtgtcattgagagagaggcaaggagggtagaaagaagaaaaggaataagggaaagagacaacaaaacagggtgagaaaaagaggaaacagaagggagagagaacagagaggagaaaatagkgaaaagaggggaaaaaacctgtgccttggagtcaaagaaaactttttcacatataactctaccccttccttgctaaatggcattggccatatgactgagcttagtaagccccagatcccttatctgtgaagcagagattaactgagatagttaaggctggtacttagttaaggttggtactcttcagtagttaactgaaataatatcgtaaggatgaatgaagcaattataaaaactcaatacaaatagttatttcctcttgcctttggtgtctttttacccccttgggctcatctctcc

SEQ ID NO: 55575 - DNA, 601 bp, Human
gtttctctcccttcctccccatagtccacttgcaagagtgcctcctactctctgaggagataatgagccccagaggctgcagaatggactggaatcgcaatgccgaacatctagtttgtcatgcgagccatatcagtctctcaaggtaggtcagagaagagtatgactgcaaaaacacaacttatactccaaaacttagtggagatacgccaaaaagcttcaagacaagaatggtactgtgtcattgagagagaggcaaggagggtagaaagaagaaaaggaataagggaaagagacaacwaaacagggtgagaaaaagaggaaacagaagggagagagaacagagaggagaaaatagtgaaaagaggggaaaaaacctgtgccttggagtcaaagaaaactttttcacatataactctaccccttccttgctaaatggcattggccatatgactgagcttagtaagccccagatcccttatctgtgaagcagagattaactgagatagttaaggctggtacttagttaaggttggtactcttcagtagttaactgaaataatatcgtaaggatgaatgaagcaattataaaaactcaata

SEQ ID NO: 55576 - DNA, 601 bp, Human
caaggataaggaggaggtcttgagggaaaacagaacacattctttctttacttataatcacccaaggcatgtactattatcccacataacacaagcagaattgacaatctagggaggttaagaattagttcaagatgacacagttcattagcgaagaaacaaaggataagactggggtctcctgacttatggctctgcacatccccccactctctctcagatgcaacccagaatgacagcttgaagacaaggattctttttttttttaatcagtcaacaaatgtgggttgaacatttagcrgataatagtcactatgttagctgccatggtggataaagctaatataccttgcagtttttccccttaggatctgacaacctagttttgtttctttggcattgtctagtaacacccaacacagtctgtagctttcagctgacactcagtgagtgctcattatctaacagggatgaatgagtggactggttcccaatgctcagccaatcttcatgaaatttccctgctggctcagtgacaaagaggagatatggcatatgtcaacggcctgcaagtgtcccagaaataggaggcaaaagaaaa

SEQ ID NO: 55577 - DNA, 601 bp, Human
ccctctccacccacaacttactagctgatgtcaagatctaatctctccttaggaaatccattgggagaataggttctcccaactgcctggcaactgtgctggcctctgagtggctccatcttattgtgatctcaatctttcttttaatctctccctcattccccaggtttatagtttcatgtgcctagtggtctctgcatggtcatgtgtagctaactgtttgggctgcccatcctccatcccagcactacccagaggttcatgcccacgtgagaattcatgtatgtacacatgtgtatayacacacacacacacacacacacataatacacacaaatactggaagcaggagagagacacctgtcaaagatggagccgaccccagcactgtgggcactgctccggtggacatgtaaacccgtggccagaaggatgccatcctgcacggaaactgagcggtgggagaaagaggcaatcagcaattcattccaccctgcaaggataaggaggaggtcttgagggaaaacagaacacattctttctttacttataatcacccaaggcatgtactattatcccacataacacaagcagaattgac

SEQ ID NO: 55578 - DNA, 601 bp, Human
accctctccacccacaacttactagctgatgtcaagatctaatctctccttaggaaatccattgggagaataggttctcccaactgcctggcaactgtgctggcctctgagtggctccatcttattgtgatctcaatctttcttttaatctctccctcattccccaggtttatagtttcatgtgcctagtggtctctgcatggtcatgtgtagctaactgtttgggctgcccatcctccatcccagcactacccagaggttcatgcccacgtgagaattcatgtatgtacacatgtgtattcacacacacacacacacacacacataatacacacaaatactggaagcaggagagagacacctgtcaaagatggagccgaccccagcactgtgggcactgctccggtggacatgtaaacccgtggccagaaggatgccatcctgcacggaaactgagcggtgggagaaagaggcaatcagcaattcattccaccctgcaaggataaggaggaggtcttgagggaaaacagaacacattctttctttacttataatcacccaaggcatgtactattatcccacataacacaagcagaattga

SEQ ID NO: 55579 - DNA, 601 bp, Human
gcacgatgcccaggaatataactgccatgagcaaagtccaagtgggttccaaagaggaagcaatgaactccaagcagggaaatggaaaggcatcatggaagtcttggaaattagaaacgcaacaggcacagcaaggtaaggggattgcatgtctagaaaaacacagcagagggcagcattcaatgaactggtagaaaggtccggttaccacgaagggggatgagtcattccaaacaccatgttgggctctacatggaacatgtgggaaagggcagggaagtaatagatacagctcagtggmtgtgcacatgaccaaagaagaccatttacgatggaggtagaaagggacaacggggccctggcattggacagagagattaatttcaacttaattctcctctttaccagttctccatcctctcactctcaagtcattaactactcattttattcaactccttatcagatggcttaattttcctttagtatcatttaaggcacagaatttctgtcagggtatccctgcctgacgaagatgggtttgctcctgctgcaggcctccttctgagatcatccagagcccagcataaacagtccatct

SEQ ID NO: 55580 - DNA, 601 bp, Human
agccactcttggatatctactacccatttcctattttaatgtccaaagacaagatcccgattcctacccacccgctgtcagaacttgctcctcatggagttttccccatctcagtgaataagaacttcatttttcccattgttcaggaaaacaaaacttaaaaaaaaaaaaacccagagagtcatctataactcctttctttctttctcattctatattcaatccatcagcaaatcacagtggctttatctagaaatatatccagaatgtgatcgctttttaccacccccttcactgccaycctgggccaccgtcatctttcatcttccccacttgccccagacacgcgcctgccacactcattcaaaacattttccaaaatggctctagctgacactgtgagctctcctggattcctggctctgccatctgtgtctcagctgagatggaggaccaacaacatgggagcactggaggttgaccgtggaagagggctgaacacacacatcccctggggttgaagggcggttacctgggttaaagagtacaatggctcgcaggcatcccagttccgacttgtccatctgcatgtctttcattt

SEQ ID NO: 55581 - DNA, 601 bp, Human
cccagccatcttctctgctctatctccccagatgatctcaccccagtgtcacagccttacacaggcagaggctgacagctctcagatgcacatggcttctcccatgaagtccagactcatatgagcagttgcttcctgggcagccactcttggatatctactacccatttcctattttaatgtccaaagacaagatcccgattcctacccacccgctgtcagaacttgctcctcatggagttttccccatctcagtgaataagaacttcatttttcccattgttcaggaaaacaaaacttaaaaaaaaaaaaacccagagagtcatctataactcctttctttctttctcattctatattcaatccatcagcaaatcacagtggctttatctagaaatatatccagaatgtgatcgctttttaccacccccttcactgccaccctgggccaccgtcatctttcatcttccccacttgccccagacacgcgcctgccacactcattcaaaacattttccaaaatggctctagctgacactgtgagctctcctggattcctggctctgccatctgtgtctcagctgagatggaggaccaacaa

SEQ ID NO: 55582 - DNA, 601 bp, Human
cactgactctaaggaggagagcttaattttatccggaccattctcgaaatattacctgcacacatttaccgagtgcctattatgtgctgagcatggactgagtcataagatgggacacgaaagctgaattggcacatgtcctgcattgatgaactaactgcctaattctggagataaagcctctgcatgaatgactacataattctgaaggttcatctttcttgaccacagcagggtttgctggagctgatcgcctccttcttgaaagactattttccctcgagcctccaggacaccaccyttctgattctgtccctatctcactgcctgccccttctcaggttcctctgctggctctcccttttttacctgacctctaaatgttggcatgccccagggctcagtccccagccatcttctctgctctatctccccagatgatctcaccccagtgtcacagccttacacaggcagaggctgacagctctcagatgcacatggcttctcccatgaagtccagactcatatgagcagttgcttcctgggcagccactcttggatatctactacccatttcctattttaatgtccaaagacaaga

SEQ ID NO: 55583 - DNA, 601 bp, Human
ttatgaagattaaataacatttaaaaacacctaaacagtgcctgctgcactttaggggctcagtagatgaagagtgggagtagttgctgctgttactacgattctgccagcactgcctcacctgcctggctgttccggatacttctgcttggtgtaggcctcaagggtggcataaaccttctctcgcagagtctccacctcagaggggttggacaggcccttggcatctaaaagacatgactgagttagcctttgattacacaccctccagcagaggctgtccccattctctctggccacygtctctagagttactagagacaccctggatggggacaagtgtgaaataaacaaagctggtcattcatgcccccttgctcttctttctgtgcccaatttacccaacaaactcttggggcaaagattttaaactccatgaataggcaaatgtacccaccactgactctaaggaggagagcttaattttatccggaccattctcgaaatattacctgcacacatttaccgagtgcctattatgtgctgagcatggactgagtcataagatgggacacgaaagctgaattggcacatgtcctgc

SEQ ID NO: 55584 - DNA, 601 bp, Human
ttgagtggcatcaccattcaggaaagaggtagttagagaataaggaggctgaactcccggccgtgcctctgccgttaagctttatggaagtaggcaaaggaaacagcttctctgtaagtacaaagttagactgggattaactttaaaaaatttttttaactctaaaaaggccacgattttacaatatctaaaattcgaagtatgccatcatactaccctctttgttgtgtgacctggatttaggaactgagatcaaggctaatagaaataaacacacccatgaacgtcacagcattcctcrcccacaggttagcagcaaggggcatttatgcctttgaaggtgcctgctgtgtgtgcaagagagtgtgtgtgtgagttctgtgacctgacttttgatctctgctttctgatcagagtgaaagcagaatgtggcccttgtgacatgcacttctgaaatgtttccacagagtggcagcactctcccactgagaaatctgcctctacctggctgtgccaggatccccttcaaccaggttctgcggaccagaggtgaccagccctcagcacacccacatgcctggccagtgacacccctgatgta

SEQ ID NO: 55585 - DNA, 601 bp, Human
gcccaggggtcatcctgggtggggaggctgtggctggtggggctcaggtgatctgcagcggggtctccaacatctccatgaggaaggtgtcaatgggggtgtccccgatgagcttgaagaagaagaggtgctccaggcatttcaagccaatggaacgcagagctgggaggcgcagcagcagcttggcaaacctgcagggaagccaagaggcatcagggacagggacgggcaggcactgcacacctgcacctgctggcaggaggccgtccaattggccttctcgacccatctgtgataaaaragctggaagggtagacaagggggtcacagaatctctaagcctaaagagcttcagaaacaggctggagggcttgtcagccttaacagaagctggagcgcatgacccttcaagaatcttgaattctgtagccatgtcccaggactgccctcagctcccctcattcacagtggagaagaggaagaactagatgactgtgtccactcactttgccagccatactggctcctcacattctctgtgtccctcgggtacccgcacagatctgctgaggcacttagagccaagcgtgagacactgaat

SEQ ID NO: 55586 - DNA, 601 bp, Human; identical to SEQ ID NO: 31311

SEQ ID NO: 55587 - DNA, 601 bp, Human; identical to SEQ ID NO: 31310

SEQ ID NO: 55588 - DNA, 601 bp, Human; identical to SEQ ID NO: 31309

SEQ ID NO: 55589 - DNA, 601 bp, Human; identical to SEQ ID NO: 31308

SEQ ID NO: 55590 - DNA, 601 bp, Human; identical to SEQ ID NO: 31307

SEQ ID NO: 55591 - DNA, 601 bp, Human; identical to SEQ ID NO: 31306

SEQ ID NO: 55592 - DNA, 601 bp, Human; identical to SEQ ID NO: 31305

SEQ ID NO: 55593 - DNA, 601 bp, Human; identical to SEQ ID NO: 31304

SEQ ID NO: 55594 - DNA, 601 bp, Human; identical to SEQ ID NO: 31303

SEQ ID NO: 55595 - DNA, 601 bp, Human; identical to SEQ ID NO: 31302

SEQ ID NO: 55596 - DNA, 601 bp, Human; identical to SEQ ID NO: 31301

SEQ ID NO: 55597 - DNA, 601 bp, Human; identical to SEQ ID NO: 31300

SEQ ID NO: 55598 - DNA, 601 bp, Human; identical to SEQ ID NO: 31299

SEQ ID NO: 55599 - DNA, 601 bp, Human; identical to SEQ ID NO: 31298

SEQ ID NO: 55600 - DNA, 601 bp, Human; identical to SEQ ID NO: 31297

SEQ ID NO: 55601 - DNA, 601 bp, Human; identical to SEQ ID NO: 31296

SEQ ID NO: 55602 - DNA, 601 bp, Human; identical to SEQ ID NO: 31295

SEQ ID NO: 55603 - DNA, 601 bp, Human; identical to SEQ ID NO: 31294

SEQ ID NO: 55604 - DNA, 601 bp, Human; identical to SEQ ID NO: 31293

SEQ ID NO: 55605 - DNA, 601 bp, Human; identical to SEQ ID NO: 31292

SEQ ID NO: 55606 - DNA, 601 bp, Human; identical to SEQ ID NO: 31291

SEQ ID NO: 55607 - DNA, 601 bp, Human; identical to SEQ ID NO: 31290

SEQ ID NO: 55608 - DNA, 601 bp, Human; identical to SEQ ID NO: 31289

SEQ ID NO: 55609 - DNA, 601 bp, Human; identical to SEQ ID NO: 31288

SEQ ID NO: 55610 - DNA, 601 bp, Human; identical to SEQ ID NO: 31287

SEQ ID NO: 55611 - DNA, 601 bp, Human; identical to SEQ ID NO: 31286

SEQ ID NO: 55612 - DNA, 601 bp, Human; identical to SEQ ID NO: 31285

SEQ ID NO: 55613 - DNA, 601 bp, Human; identical to SEQ ID NO: 31284

SEQ ID NO: 55614 - DNA, 601 bp, Human; identical to SEQ ID NO: 31283

SEQ ID NO: 55615 - DNA, 601 bp, Human; identical to SEQ ID NO: 31282

SEQ ID NO: 55616 - DNA, 601 bp, Human; identical to SEQ ID NO: 31281

SEQ ID NO: 55617 - DNA, 601 bp, Human; identical to SEQ ID NO: 31280

SEQ ID NO: 55618 - DNA, 601 bp, Human; identical to SEQ ID NO: 31279

SEQ ID NO: 55619 - DNA, 601 bp, Human; identical to SEQ ID NO: 31278

SEQ ID NO: 55620 - DNA, 583 bp, Human
tactttttaaaaaatagaaacttttccctcagagagctcacaaatttgcaattattcctaagtcctttacgtttgtcctcaacagagcaccttcccgtgaagtcctgccagaacctattgccgccactgcccccacgcacgccttgccttccctttgcaaatacccaggaaccacagaaatggacttcagtctgaaatgtcagcaagttagcaaatgtcctatgaaagtcaacaacaactaacatggatataattctttactggttccaaagcctttcagtcacattattagcttctcccscgtttccccacagtgggcctaagttgtttttgggttgttgttgtttgtgagatggagtctcactctgtcgctcaggcttgagtgcagtggtggaatcttggctcactgcaacctcaacctcccgggttcaagtgatgcttgtgcttcagcctcccgagtagctgggactacaggcatgcgccaccatgcctgggttatttttgtattttcagtagacacggagtctcaccacgttggccaggctggtctcgaactcctgacctcaagttgatccacccacct

SEQ ID NO: 55621 - DNA, 582 bp, Human
actttttaaaaaatagaaacttttccctcagagagctcacaaatttgcaattattcctaagtcctttacgtttgtcctcaacagagcaccttcccgtgaagtcctgccagaacctattgccgccactgcccccacgcacgccttgccttccctttgcaaatacccaggaaccacagaaatggacttcagtctgaaatgtcagcaagttagcaaatgtcctatgaaagtcaacaacaactaacatggatataattctttactggttccaaagcctttcagtcacattattagcttctccccygtttccccacagtgggcctaagttgtttttgggttgttgttgtttgtgagatggagtctcactctgtcgctcaggcttgagtgcagtggtggaatcttggctcactgcaacctcaacctcccgggttcaagtgatgcttgtgcttcagcctcccgagtagctgggactacaggcatgcgccaccatgcctgggttatttttgtattttcagtagacacggagtctcaccacgttggccaggctggtctcgaactcctgacctcaagttgatccacccacct

SEQ ID NO: 55622 - DNA, 601 bp, Human
gtactaaaaatccaaaagttagccaggcttggtggtgcacgcctgtaatcccaactactcgagaggctgaggtgagagaatcgcttgaacccgggaggcggagattgcagtgagcggagatcccgccactgctgtccagcctgggcaacaaagcaagaccctgtgtcaaaaaaaaaaccacaaataatttttttttaaaatatgcttgtaacaaaattgcatttggcaaattataggatgtgaaatgtataatattaactgacacgactcccatcccaggcagacaagcaaccctcattaygaaaattacattttgtttagaaaaattccctcaacaggcatccccagagctttctgggcatcagcagagcagacgtccagttcgggggtccacgccagtatgcggcagtggcgcggggccgaggctgctcacaggctgggtgccgacagcccagctctcctttgaaataagccgttttgaagttaagaatgcacccagtgccaagtgtgaaatgtgctttatacatatgttaggcccgacatattgtgagaaaatgtctggtaacctttttaacaggtgattgctggaatttgatgattg

SEQ ID NO: 55623 - DNA, 601 bp, Human
ctgctgtccagcctgggcaacaaagcaagaccctgtgtcaaaaaaaaaaccacaaataatttttttttaaaatatgcttgtaacaaaattgcatttggcaaattataggatgtgaaatgtataatattaactgacacgactcccatcccaggcagacaagcaaccctcattatgaaaattacattttgtttagaaaaattccctcaacaggcatccccagagctttctgggcatcagcagagcagacgtccagttcgggggtccacgccagtatgcggcagtggcgcggggccgaggctgmtcacaggctgggtgccgacagcccagctctcctttgaaataagccgttttgaagttaagaatgcacccagtgccaagtgtgaaatgtgctttatacatatgttaggcccgacatattgtgagaaaatgtctggtaacctttttaacaggtgattgctggaatttgatgattgcctccgtaaatgtggaggcacaggggacccgtgtctgcccgcatgcaccctgctaactggctgcttgttttccggtgcaggtgcttgaggaatccaaagccctcgtgcgctgcaacatgaagatggag

SEQ ID NO: 55624 - DNA, 601 bp, Human
cagcctgggcaacaaagcaagaccctgtgtcaaaaaaaaaaccacaaataatttttttttaaaatatgcttgtaacaaaattgcatttggcaaattataggatgtgaaatgtataatattaactgacacgactcccatcccaggcagacaagcaaccctcattatgaaaattacattttgtttagaaaaattccctcaacaggcatccccagagctttctgggcatcagcagagcagacgtccagttcgggggtccacgccagtatgcggcagtggcgcggggccgaggctgctcacaggmtgggtgccgacagcccagctctcctttgaaataagccgttttgaagttaagaatgcacccagtgccaagtgtgaaatgtgctttatacatatgttaggcccgacatattgtgagaaaatgtctggtaacctttttaacaggtgattgctggaatttgatgattgcctccgtaaatgtggaggcacaggggacccgtgtctgcccgcatgcaccctgctaactggctgcttgttttccggtgcaggtgcttgaggaatccaaagccctcgtgcgctgcaacatgaagatggagctggagca

SEQ ID NO: 55625 - DNA, 601 bp, Human; identical to SEQ ID NO: 31277

SEQ ID NO: 55626 - DNA, 601 bp, Human; identical to SEQ ID NO: 31276

SEQ ID NO: 55627 - DNA, 601 bp, Human; identical to SEQ ID NO: 26813

SEQ ID NO: 55628 - DNA, 601 bp, Human
aataaaatattacagccgggcatcgtggctcatgcctgtaataattacaatgattttaaaacccatctgtgttgtgtatatgtagatttagttcatttctcttagctgctatatatcccttgcattactatactattacaatttttgtttataagttgccttaaaggtgggaaagtaaagttgaacgtggtttcatgtatgtttgttaaccactcaattttcctccttgtgatacttattcagtttctagacagagcaaatcataaatgtaaagggaagaatggagacagatctattgtayagcttggtgactatggttaataatgtattataatttcaaaattgttgagagtaaatttcaaatgttcttacccccaaaataagaatgtgaggtgacaaatatattaattagcttgatttaattattccacaatgtatacatctatcaaaatgtcagctgggtgccatggtttatgctataacccctgcactttggaaagcttaggcggaaggatcacttgagcccaggaattcagcaacatagtgagatcctgtctctacaaaaaatttaaaaattagccacgtatggtggcgtgcactg

SEQ ID NO: 55629 - DNA, 601 bp, Human
gagcgaacacgtctggctgatcattgttaacattttgacaaatttgttatctttcctataagaaataaaatattacagccgggcatcgtggctcatgcctgtaataattacaatgattttaaaacccatctgtgttgtgtatatgtagatttagttcatttctcttagctgctatatatcccttgcattactatactattacaatttttgtttataagttgccttaaaggtgggaaagtaaagttgaacgtggtttcatgtatgtttgttaaccactcaattttcctccttgtgatacttrttcagtttctagacagagcaaatcataaatgtaaagggaagaatggagacagatctattgtacagcttggtgactatggttaataatgtattataatttcaaaattgttgagagtaaatttcaaatgttcttacccccaaaataagaatgtgaggtgacaaatatattaattagcttgatttaattattccacaatgtatacatctatcaaaatgtcagctgggtgccatggtttatgctataacccctgcactttggaaagcttaggcggaaggatcacttgagcccaggaattcagca

SEQ ID NO: 55630 - DNA, 601 bp, Human
aagtgctgggattacaggtgtgagcgaacacgtctggctgatcattgttaacattttgacaaatttgttatctttcctataagaaataaaatattacagccgggcatcgtggctcatgcctgtaataattacaatgattttaaaacccatctgtgttgtgtatatgtagatttagttcatttctcttagctgctatatatcccttgcattactatactattacaatttttgtttataagttgccttaaaggtgggaaagtaaagttgaacgtggtttcatgtatgtttgttaaccactcarttttcctccttgtgatacttattcagtttctagacagagcaaatcataaatgtaaagggaagaatggagacagatctattgtacagcttggtgactatggttaataatgtattataatttcaaaattgttgagagtaaatttcaaatgttcttacccccaaaataagaatgtgaggtgacaaatatattaattagcttgatttaattattccacaatgtatacatctatcaaaatgtcagctgggtgccatggtttatgctataacccctgcactttggaaagcttaggcggaaggatca

SEQ ID NO: 55631 - DNA, 601 bp, Human
tccattaaaaaatgttttcaatttaaaaaaaaaaaagaaataaaacattacattagtcacccctagaaagtacaggaaaaaaagaaaaaaaattacagatacaattgaagcccccttgcactcccctcaaccccagtccaaatcaattaccctcccagtctcttcagaggtaaccactttcaggaatttagagtgtatccttccagtgtgtccctttcttccgcatatgtgtgtgtctgtgtgtgtgcatttaaaaagacagaacatgaagatgctattagtatgaatgtgtccatttaakaatgttccattttccaatgcccaccaaggagaaaaacaaaacaaataaataaaaacgttacataagcagtacataatctgtaacttgcttttcattcaacagtatgttttttttggtttttctgttttttttgagatggagtctcgctctgtcaccgaggctggagtgcagtggcgcgatctcggctcactgcaagctccgcctcccgggttcacgccattctcctgcctcagcctcctgagtagctgggaccacaggcgcccgccaccacgcccagctaattttttttttatttttagt

SEQ ID NO: 55632 - DNA, 601 bp, Human
attttttgtctttcctataagaaataaaatattacagccgggcatcatggctcatggctgtaatcccaggactttgggagcccgaggcaggaagattgcttgagcccaggaattcaagaccagcctgggcaatatagcaagacctcagtctccattaaaaaatgttttcaatttaaaaaaaaaaaagaaataaaacattacattagtcacccctagaaagtacaggaaaaaaagaaaaaaaattacagatacaattgaagcccccttgcactcccctcaaccccagtccaaatcaattacyctcccagtctcttcagaggtaaccactttcaggaatttagagtgtatccttccagtgtgtccctttcttccgcatatgtgtgtgtctgtgtgtgtgcatttaaaaagacagaacatgaagatgctattagtatgaatgtgtccatttaagaatgttccattttccaatgcccaccaaggagaaaaacaaaacaaataaataaaaacgttacataagcagtacataatctgtaacttgcttttcattcaacagtatgttttttttggtttttctgttttttttgagatggagtctcgctct

SEQ ID NO: 55633 - DNA, 601 bp, Human
caggagagaacaaatcttatttataagaaatcttcaaaagacagaaaaatgcaaagaatataacaaacactcatgagtcaacatccaaaactgatcattgttaacattttgacaaattttttgtctttcctataagaaataaaatattacagccgggcatcatggctcatggctgtaatcccaggactttgggagcccgaggcaggaagattgcttgagcccaggaattcaagaccagcctgggcaatatagcaagacctcagtctccattaaaaaatgttttcaatttaaaaaaaaaaaagaaataaaacattacattagtcacccctagaaagtacaggaaaaaaagaaaaaaaattacagatacaattgaagcccccttgcactcccctcaaccccagtccaaatcaattaccctcccagtctcttcagaggtaaccactttcaggaatttagagtgtatccttccagtgtgtccctttcttccgcatatgtgtgtgtctgtgtgtgtgcatttaaaaagacagaacatgaagatgctattagtatgaatgtgtccatttaagaatgttccattttccaatgcccaccaaggagaaaa

SEQ ID NO: 55634 - DNA, 601 bp, Human
tgtatatatcttttttaacttttttttaaattaaaaaagacaaagtaagtttcctaaactagttctccagacattcaactttttaaaaatacctccaggttcaactcagctggaattttgagtgctgctgagtacacttatatacttgcctggttgtttttctctttcctatatgttttactaactggcatttcagtttgagactctttcagaggagattataatggtcttttcaatagcactctgcagctccactgcctttgcaggtattgtactgtcaaatgtagcctgcgggggtatyaggcagcatttgggtatttatgtggcaaagggacagcatcgacatattttgggagatgccgacttgacgtggggaagaggaatattcgttagaaagggtaataggtctgaaaagcatatttggtaaaaggttttgttatctttgggaaatctcatgtacaaacacaagaaaagtattatgtcccaaggcctttgtgtggcacagttctggtgacagcatattttcattgtatatattggttcattaagctcaaaccaacctcataattacatgattgtgacaagattaactgaatggaca

SEQ ID NO: 55635 - DNA, 601 bp, Human
ggaagccaaaggttctgacatgaggaaggggtttccatagtcagacctgttcacatagagtaaataaatcaaaccccctaggctggagcaaataagcctgctgactaaagctagctgaaagagaaagagtcagatacaggagtagaaataatgtataatgctttactatattgctcttattttggtcttataatagtatactgctagagtttttaaaaatgatgtccatactgctattatcattgctggaaaacgctggctatttccttctagagaaggaaaagtaaacaagtcttaaagkgtctttgactaactccccaagtgagagaaaggaaggaagccctcattaatgtacacatcccctacttcctactcactttttcttttcttttttttttttttagggagtgaagtgtatatatcttttttaacttttttttaaattaaaaaagacaaagtaagtttcctaaactagttctccagacattcaactttttaaaaatacctccaggttcaactcagctggaattttgagtgctgctgagtacacttatatacttgcctggttgtttttctctttcctatatgttttactaactgg

SEQ ID NO: 55636 - DNA, 601 bp, Human
tgtttcttattttactgagaatatcagagccctcagaagaaagtatctttgtcttcccaccacatctgccgattttatctatgcgtcttctctgctctgctttctctcgttaccctggatgaactggccttgcttcctccatctgtgccctggagtcattccttcaatgactcaatgactttcatcctgtagtaattccctcttgcaattgcagcctcagatttctttctttcctggatcattctcatcaacttacaaacatactagaatatttcttgtctttaaaaatcttacttgaccscatctatccaccttacccctatttctctactccctttgcactaactcctcaaaagagatgtcttcctttgttgcccacacttcttcatccacagctcctcctcaatcagatccaatcagatcacttgtcaaggtcaccttgtggcaagaccagtgactgatactcagttttcatcttacctaactgctcttagtttacgcaagagattacttcatcctctttgagacactgcatttggctgcagggataagatgtactaatggtttccctcccatcacactggctgttccttctaagtca

SEQ ID NO: 55637 - DNA, 601 bp, Human
agcaattcttgtgcctcagctctcaagtggctgggattacaggcacgtaccaccatgcccggttaattgttgtattttctgtagagcagggtttcaccatgttggccaggctggtcttgaactcctgacctcaagtgatctgcccatctcggcctcaaagtgctgggattacaggtgtgagccactgtgcccagcccaacttgtaacacattctttaagattcaggaatgagttaaatagaaatttgtttttatgttgtattttttattttagtgacaatcttaaaaagcaatcttttatmctgttttttttttcctgacaaggataattaagaaccaaaagactttctcataataaaagacattatttgcttatagtccatgtttttcaaagtaggaaatgttttcccaaaggtttctaagaatgtttctcttcaaaaagcgttcagtcagttggaggatttaaaattttatttttggtttataatacattgttaacatttgagaaaaataatataaaatttttaattaaaacttccttaaaaaaaaaaaaaaacttcctttggccaggcgcggtggctcacacctgtaatcccagcact

SEQ ID NO: 55638 - DNA, 601 bp, Human
ttattgctgttattattgggtctgttattattaccctttattgagcacttattttgtggaaggccgtgttgtaagtttgggtttataaaatgtattttctaacatattttgaaaatgggcatatccacatatttgtcataaaattacctgctgtaacatttcttgagtttcttttaacatgttgtctaaggagaaagaagagtttcttaacttgtaactatttttttttttgagacagagttttgctctgtcgccaggctacagtacagtggcgtgatctcggcccactacaaccttcacytcccgggttcaagcaattcttgtgcctcagctctcaagtggctgggattacaggcacgtaccaccatgcccggttaattgttgtattttctgtagagcagggtttcaccatgttggccaggctggtcttgaactcctgacctcaagtgatctgcccatctcggcctcaaagtgctgggattacaggtgtgagccactgtgcccagcccaacttgtaacacattctttaagattcaggaatgagttaaatagaaatttgtttttatgttgtattttttattttagtgacaatcttaaaaag

SEQ ID NO: 55639 - DNA, 601 bp, Human
tcattgacttcatttcaacaagtagaagaaatgctgaaagtctacttctaaaaatatctaaatttaaaaattattgctgttattattgggtctgttattattaccctttattgagcacttattttgtggaaggccgtgttgtaagtttgggtttataaaatgtattttctaacatattttgaaaatgggcatatccacatatttgtcataaaattacctgctgtaacatttcttgagtttcttttaacatgttgtctaaggagaaagaagagtttcttaacttgtaactatttttttttttgagacagagttttgctctgtcgccaggctacagtacagtggcgtgatctcggcccactacaaccttcacctcccgggttcaagcaattcttgtgcctcagctctcaagtggctgggattacaggcacgtaccaccatgcccggttaattgttgtattttctgtagagcagggtttcaccatgttggccaggctggtcttgaactcctgacctcaagtgatctgcccatctcggcctcaaagtgctgggattacaggtgtgagccactgtgcccagcccaacttgtaacacattctttaag

SEQ ID NO: 55640 - DNA, 601 bp, Human
tcaatctcacatccaccgacctcaaaacctgtccacgattcaatctcacatccaccgacctcaaaacctaagtccttaaccaccaggttcttctacctgtcatcagaagctttatagactggcaaaataaaagggctcttttttttaattctgagctatttagtttcagtagatgatatggaaaaacacaagaaattacatcagtatttacaaaattaacaatgtctacagagatgttttctctttaaatctttacaatgtgatattaaaagcagaaatccagatacctcaagcatagackaaaggtttaaaataaacttgaatttttggttcctgagcaaagctctataaaaaagggttcccctacctcttttctttctttctttcttttttgagacggagtttccctcttgttgcccagactagagtgcagcagcgcgatctcagctcactgcaacccccacccccacctcccaggttcaagtgattctcatgcctcagcctctcaagtagctgggattaccagcacccaccaccatgcctggttgatatttgtattttcagtagagacagggttttgccataactcctgacctcaagt

SEQ ID NO: 55641 - DNA, 601 bp, Human
attagatgctcacagcaactttacggggcaagtactactatcctcacttcacagctagggaaatggaacggttttcttcttccagcttttcgtgaggacaccaaatccactaagttctactttgccaaggtaattcatgcttgacacgtcggctcctgacactatgcgattctgcaaagcggggcaaatgccctaataagatcaagtctgcaagcagattcttctagcgacagtccaagatttccaagtttgtcctaaccaaatgaatacaagaagagagccttcaaaataaaccggggcgggggggggccgagctgcagcttgcggctcagcccgcaaggcaccctgagggcgcggccagcggggaacgcaaaccgcgtccgtgcacgagtccgggagccacagcctgggccacggcaattgactgcgaacccacaacaaaccattcccaccgaagctgtcacgcgcccggagggaagtggccgccgcgccccgcaggggtcagaaggacccgcggagaggaagagtgagggcgggcgtggagaattcctccccagcactgcgcatcgccgggggcactgcctgccccgtgcggccgctg

SEQ ID NO: 55642 - DNA, 601 bp, Human
attcaacatacaggccctgtcctcaaggtcattcttaatcagttcaaattaaatctagtcctccattataaactccaaaagcaacttagttattttgctagatattttgccctcccctttcaaactatatgtttaatactctaaaaacgggtttatgcgccttatagatatcaacagtgtgttatgctccccctattgactaatattcaaaataacaatgaactccccacgggttgcctttgaagtgctgggattcaaaactatgttggtgatttttatatttaaaaacatgagctgaatyaacagttgttaggcaaagctgccgtgtaacggtcagattccatcaaaacaggaaaaattaaagttgacaaatgtcaaactgaagggccaaaaaaaaaaaacgctcaagccttgaaacactaaacaatgcagaaataaagccaaaagcaaagaacagcaagaaatagagcaacatcctttaactgacacaatggcatgaaatcaatttcatgttaatagcccttaagggggtaagaattatttccctgcctcctgtgccaaccccaagctgtttcctaaggaagccaagtaatggtgatca

SEQ ID NO: 55643 - DNA, 601 bp, Human
atagataaatgtcaagtgtgattttttcaagcatattcttattgtttatgtttacaagtatgagtattcatagacacatcacacctatactagtatcaaatatgatacatctgaactactactatacttgaatattaacgtaagcctctgaggaatgcacagtaatagaactgctgttatttaggattactgatcccctattgtcttgcacttagaagatgttaatgaaagatgatgacaggattgtgaacacaccaacctccctgagaacaaattcattatattcagttttctacaaaaracaaatgaggatcattacaaaaggattcacaacaaattcctctggatttccatttctcccaggtaagttgaaatattattcaaaccacacaaaattagtttacatacaaacttcactttttaaagagatgggggtctcactatgttacccaggctggtctcgaactccttggccaagtgatcctcctacctcagcctcccaaagtgttggaattacaggtgtgagccactgtgcctggcctacacaccacttaaggaaacaaattgaaaaaaaactatatgtgtgtttatctatctgtcc

SEQ ID NO: 55644 - DNA, 601 bp, Human
aggctttctgtaagaaagccctaagcaacctgaaggcattttggcccccagtcatcagagcactgaataaggacaattaatttgccaagctccaagaccagaaaccatagcctagtagggagtaggaggttataagtgtttgttgaattactcgagtaaactagagcaaagcatagaagactaaatgagatcctaaataaatgccactctgtagtataagcgcaatgctaagatttaaaaagaagggactcaactaattttgaaagttattttaaaataggatccatgggaccctaacgtrgtaaatgaaataaaggtaaatcaatactacataatatggggccgggcacagtcgctcacgcctataatcccagcactttgggaggccgaggcgggtggatcatgaggtcaggagatcaagaccatcggggctaacacagtgaagccccgtctctacgaaaaatataaaaaattagtcgggcgtggtggcatgcacctgtggtccccgctactcgggaggctgaggcaggagaatctcttgaacctgggaggcggaggttgcagtgagccaagatcactccactgcactccagcctgggcg

SEQ ID NO: 55645 - DNA, 601 bp, Human
aaaatgaaatttccaaatagtctccagagtatttttgcatccaaggaccaatatcacactgtcaaaacaataaatcactaaaaatgctaacaaaacgaatactcccaaaagggacccttttcacttgccagatggaattaagtattcatcaagtttccattagcaaaatagtatgatacaaatttaaaaagaaatccagagttctactagaccctccacctggcccatttgatgttctcacctataaaaggtagtgagtcatgcttgtgaaactgcagaccttcgcccaaggcaatctgayccacaggaaagctcaaggactagtatctgtaaagatcattttctaaagatcatttttcaaggactaatcaacttaaatgtgtttttacaaatgatccatcagcaattttacacaaaaaacctgaccttcggcatataccagagaaatgaattatgtgcctggaaggacagaaaagcaggtgtttcgtcctcctgcaaacaacacccaactccaaaggcccccttcactaggagtccaatgtccagaaagtatacgcttctttataaccattttttaagtaaagatagagctaacatttca

SEQ ID NO: 55646 - DNA, 601 bp, Human
cacagcaacacagtgagtatcttacaaaagtactcagggtaccacatgaacacaagcctttgtgattagaatctaagtttttcacctcaaataaccttccagaatgaaaagaaaaaaaaaaaaacacacattctgctccagcaattatcacacagttagttaattataaaatgaaatttccaaatagtctccagagtatttttgcatccaaggaccaatatcacactgtcaaaacaataaatcactaaaaatgctaacaaaacgaatactcccaaaagggacccttttcacttgccagatrgaattaagtattcatcaagtttccattagcaaaatagtatgatacaaatttaaaaagaaatccagagttctactagaccctccacctggcccatttgatgttctcacctataaaaggtagtgagtcatgcttgtgaaactgcagaccttcgcccaaggcaatctgatccacaggaaagctcaaggactagtatctgtaaagatcattttctaaagatcatttttcaaggactaatcaacttaaatgtgtttttacaaatgatccatcagcaattttacacaaaaaacctgaccttcggca

SEQ ID NO: 55647 - DNA, 601 bp, Human
gaccttacgctgcaatgatgcaaaatgtatgtaatgagtcaatggtgctttccctcaaagttaaatttaatttgccagccaactgcacaaaatctaatataacaaaatgagatacttattctttatggagactcagaagagttttgttttaaagaaaaaaccataaaagagataactcacagcaacacagtgagtatcttacaaaagtactcagggtaccacatgaacacaagcctttgtgattagaatctaagtttttcacctcaaataaccttccagaatgaaaagaaaaaaaaaaaaacacacattctgctccagcaattatcacacagttagttaattataaaatgaaatttccaaatagtctccagagtatttttgcatccaaggaccaatatcacactgtcaaaacaataaatcactaaaaatgctaacaaaacgaatactcccaaaagggacccttttcacttgccagatggaattaagtattcatcaagtttccattagcaaaatagtatgatacaaatttaaaaagaaatccagagttctactagaccctccacctggcccatttgatgttctcacctataaaaggtagtga

SEQ ID NO: 55648 - DNA, 601 bp, Human
acttaggttttatcacaatcattctggctattgggtgggaactaggctgcagaggggcaagaagagaaacactgctctctggttgttctcatctttagagaaacttaaggaagattattctaagccccactgtaaccctaaactctatgattctgagttgattttctgtgtcttttctatagctataatttatatcaactgtaagcctgatctttccccaaagccataactgaagtgggctgaaatgaagaattccatttgacaatatatctataaaccaggcccatgctacacacctagrataccaagatggtaagactcaatcctgctctggggaatctgccgaaggaaaaacaacattctcacgaggcagcaagagaagcacctgccaggaggagccacatgaagccccactggaggagctggcagcagtgagagcctggaagagtaagcaggaacccccatagagaaggagggacatgggaaatacagaaggtgacactgtggaggctgtggaccacagagaagtaatatggtggcttttggactgtaacagaaaaatctacagaacaaccagatggcactgtccgataggctgttg

SEQ ID NO: 55649 - DNA, 601 bp, Human
aacaagatacataattatatattatatagagaccaatgctaagaaaacaaagcagaaaagggagagacaaagtatgtgtgtggggttttggtttggtttgtctgttttgagtaaggacctaacagaagcgaattctgtagctatttggggaaaaacattccaagcaaaggaaacagcacatgcaaaggccctgagacagagcgtatctggcgtgctcagggaccaacagtcaggtgcggcagctggagcagattgagcagcctagagagcacaagagggaagtcaactgggtcaccagcayaagagtggtgggctggttgggcagggctttgcagatcactgtaagagttctggcttttattctgagaaagacaagaataaacagtagagtggttttttggttttttggtcactctgtcaccagactggagtgcagtggtgcaatctcagctcactgcaacctccgtctcctgggttcaagcgattctcctgccttagcctcccgagtagctgggattacaggcgcccaccaccatgccaggctaattttttttttagtagagacggggtttcaccatgctggccaggctggtctcaaact

SEQ ID NO: 55650 - DNA, 601 bp, Human
ctaccaatagtcctcacctcattccaaaagagacttctgattaatcccatcctactgtgaacattctgtcacttatcattttgtgtataatttgttccatgttatcttctagtcagagccaacttggaatgctagaacaggtagtatctactccgaccctttaattttacagattagcaaaccaaaaattagaaaggctcaacgactggcccagctttacacagctacttagttacaaagccaagacttgtccacatgctgctttgtaattattctgtggttgatcaagtgtctatacctkattccccttcctgtcagaagctgacatctctgctttcttctgaacccacaaaatgtctgttatcatctactgaacacctatcatgtatatcacaatttcccatttaatcttctcaacaatacaaggagacagatgccctttactccattttgtagtgagaaaggtgaggcttcaagatgctaagtaaggctgggtacagtggttcacacctataatcccagcactttgggaggcagaggccaaaggctcccttgaagccaggagttcatgaccagcctgggaaacatagaaaaaataaaa

SEQ ID NO: 55651 - DNA, 601 bp, Human
aataaatagaatattaatactacattagctattttaatatataacttacgtaaacaaaaattatttaaatgcagtatcttcccaacaatgtaagcacacaaaaaacctgaattttgtcagatctaaccattttatcacaatctgccatctttatgctattcctcaaagtccaagaactctaccaatagtcctcacctcattccaaaagagacttctgattaatcccatcctactgtgaacattctgtcacttatcattttgtgtataatttgttccatgttatcttctagtcagagccaayttggaatgctagaacaggtagtatctactccgaccctttaattttacagattagcaaaccaaaaattagaaaggctcaacgactggcccagctttacacagctacttagttacaaagccaagacttgtccacatgctgctttgtaattattctgtggttgatcaagtgtctatacctgattccccttcctgtcagaagctgacatctctgctttcttctgaacccacaaaatgtctgttatcatctactgaacacctatcatgtatatcacaatttcccatttaatcttctcaacaatac

SEQ ID NO: 55652 - DNA, 601 bp, Human
ctcaaaggaaaaggaggcaggagtgcgaccatcagcatgttttaccagctcagaccttctgcatcctacttccctcatttctaatatgaagaaattaaacaagaaaatcttttattctatatcatactataattgtcattacatggactaataatcctgaatcccttctagaaaatgagacttcaaacacacttgtggaaatctgaaatgcataattatgtaaaggctagcaggaataacttcacaaaacagaaaagtgttatccaagaaaaatattcaacttggcaacataagaataaayagaatattaatactacattagctattttaatatataacttacgtaaacaaaaattatttaaatgcagtatcttcccaacaatgtaagcacacaaaaaacctgaattttgtcagatctaaccattttatcacaatctgccatctttatgctattcctcaaagtccaagaactctaccaatagtcctcacctcattccaaaagagacttctgattaatcccatcctactgtgaacattctgtcacttatcattttgtgtataatttgttccatgttatcttctagtcagagccaacttggaa

SEQ ID NO: 55653 - DNA, 601 bp, Human
ttcaatggttgcccactgccgtccagataaacagcaaaacttcacatggccaccaaccatcgtctagttagtccaagctcatcttctgcacactccagccacactagtgtcaattcagtcccacaaaagggccaagtcctcaccttccaaaagtgatgttcactatatcggaactcaacatccctccatggtccctaggatggtcactttctaacatcttcaggtctcagcaaaagccttacttcttgaaggaagcctcctctgattcccttggaccaagttaaacttggacacctagaaygcagtacaacccttcaggttgtaattattatgtaattatttccttccaagtatggctttcccactgtcttaattccagcaaggcggatcacagtctacctacacttggctgacagcgggcatctaatgagggtaccacagtggactacaggtataaatactactgtgcacactacaataaaaatagtacaggccgggagtggtagctcacacctgtaatcacagcactttggtaggccaaggtgggcagatcacttgaggtcaggagttccagaccaacctggccaacatggtgaaatca

SEQ ID NO: 55654 - DNA, 601 bp, Human
gctgtcatcaaaaaggtttaaatcataaagctgtaattattcgagcaaaattcagcatatcagaatattctcaggacaacagtcatcctccctcaggccctagcaagcacctggccattgaaaaaagcttttgatagcctggacaacatagtgaaacgctgtctctacaaaaaatttaaaagtgcaccaggtgtggtggtttagagcccaggcatgtgaaacactaagaattaaaactcttcaatggttgcccactgccgtccagataaacagcaaaacttcacatggccaccaaccatcrtctagttagtccaagctcatcttctgcacactccagccacactagtgtcaattcagtcccacaaaagggccaagtcctcaccttccaaaagtgatgttcactatatcggaactcaacatccctccatggtccctaggatggtcactttctaacatcttcaggtctcagcaaaagccttacttcttgaaggaagcctcctctgattcccttggaccaagttaaacttggacacctagaacgcagtacaacccttcaggttgtaattattatgtaattatttccttccaagtatggctttcc

SEQ ID NO: 55655 - DNA, 601 bp, Human
taagggtgtctgcttttaagctagaattaataaagaactgtatttgggggttcaaaacctggcttacccagctgtgttacattggaaaagtcatttagcccctaccacgccctcatctgtaaaatggtagcaatattttgattataatataagacagaatataggcatggtacctaaaacaatacctggcccacacagtctattttattttattctttcttttttgagatggagtctcactctgccacccaggctggagtgcagtggcacgatgtcagctcactgcaacctctgcctttgkgttcaagcaattctcttgtctcagcctcccaaatagccaggattacaggcatgtgccaccacgcctggctaatttttgtatttttagtagagacagggtttcgccatgttggcccagctggtctcgagctcctgacctcaggtgatcaacccacctcagcctcacaatgtgctgggattacaggtgtgaaccactgtgctcggccccacactgtctattttaaataaataatagtcattggtatttttatggttaaaatatacctagacttccaaaaagaaaataagcaaactactagta

SEQ ID NO: 55656 - DNA, 601 bp, Human
agaaaggatggaggtttagatcagaatggagcctcagtttcctcctttgtaaagagtgtaacagacaaaacttagctacatcacagagttgttgcaagaatcaaatgagattgtgcatgtatagtattaaaactatcatttatcattagcaagctgtttctaccaaagagatttattatcctgaggtatcagattaattagtcccaacattctgtggctgccagtggcaggaaaagaaaggaggaagattactctggaaccacctgtactggtaggcacgggggaagcagtacgcacagakggtacgaggagagcagagaagcctgactccactctgcctgttctgtgccggctgccttcagaggcaaggtgggctgtccctccagagcaggcccaccctcattcctggctgggagcatgatcaacaaatctggccccagcagccttggtttccttggggccgaacttcagtccgtccttaagagcccttccatctatcccaagcacaacacacctcactcccaaggaaaatacaggaaaaagggagggtgggtgttgacacatttcacaaagttggaaaagaccatgttttattcaaact

SEQ ID NO: 55657 - DNA, 601 bp, Human
ctgccccacatgccctcatgacccaacagagtgcacaggtaaagaccaagattagctgaaaaaatcccatccaaatgaatcctcaaaaccatcacgttctaaaccaatattcaaaaggatctggttgggtacaatattccctaaggtgaggagagaaatcttgctctatctaagagaaaaactgtggcaaaatggatgtctggcaataggctaaaaaccagtaagaaaaaattagtagcttccccttagatggctaacatggcctggctacatccatgagttgattcagaatcagaactawactaatccccatcttcagatagatttggcacaatgagagaaaaagtcctagatttggataagaaatcttcggaatcacatccaagcacaactgatattcaataaatattactgctatatgccaggcactgttcaagatgccagggatatagcaatgaaaaaaagacgccaaaaatcctgccctcagggagcttatatccgagtaaaaatatcatttactacttctcacaagacatttaatttcctgagtttctcctttcaacaaatctttattgcttactctgctaagcagtggccaagg

SEQ ID NO: 55658 - DNA, 601 bp, Human
cccagcactttgggaggccgaggcgggtggatcacgaggtcaggagatcgagaccatcttggctaacatggtgaaaccccgtttctacttaaaatacaaaaaattagccgggcgcggtggcaggcacctgtagtcccagctactcgggaggctgagacagaagaatggcgtgaacccaggaggcggagcttgcagtgagctgagatcgcgccactgcactccagcctgggtgacagagcgagactacgtctcccaaaaaaaaaaaaaaaagaaaattcttagaacttaatgggtttaaaamaaaagcaaacaaatgtgctgctaattctgctaatttcagagatcccctgggtttatttctgagtccattaaactgagcatactgccccacatgccctcatgacccaacagagtgcacaggtaaagaccaagattagctgaaaaaatcccatccaaatgaatcctcaaaaccatcacgttctaaaccaatattcaaaaggatctggttgggtacaatattccctaaggtgaggagagaaatcttgctctatctaagagaaaaactgtggcaaaatggatgtctggcaataggctaaaaacc

SEQ ID NO: 55659 - DNA, 601 bp, Human
ttcctttactttcttaataaacttgctttcacttaaaaaaaaaaaaaaagtagaaatacctaatgtaaatgatgagttaatggtttcagcaaaccaacatggcacatgtatacctaatgtatacctatgtaacaaacctgcacattgtgcacatgtaccctagaacttaaagtatttatttaaaaaaaaagtagaaatataaatagggtactctgagatcatgaaagagcaatttggaataatagtcattttccccacatttcaaagcaacatgttccatttaaaaggtaggtgaactttsatgaactgaagaacacttagtattcatcaatgaacataagaaaattctgagaacttggccgggcgcggtggctcacgcctgtaatcccagcactttgggaggccgaggcgggtggatcacgaggtcaggagatcgagaccatcttggctaacatggtgaaaccccgtttctacttaaaatacaaaaaattagccgggcgcggtggcaggcacctgtagtcccagctactcgggaggctgagacagaagaatggcgtgaacccaggaggcggagcttgcagtgagctgagatcgcgccact

SEQ ID NO: 55660 - DNA, 601 bp, Human
tattcctttactttcttaataaacttgctttcacttaaaaaaaaaaaaaaagtagaaatacctaatgtaaatgatgagttaatggtttcagcaaaccaacatggcacatgtatacctaatgtatacctatgtaacaaacctgcacattgtgcacatgtaccctagaacttaaagtatttatttaaaaaaaaagtagaaatataaatagggtactctgagatcatgaaagagcaatttggaataatagtcattttccccacatttcaaagcaacatgttccatttaaaaggtaggtgaactytgatgaactgaagaacacttagtattcatcaatgaacataagaaaattctgagaacttggccgggcgcggtggctcacgcctgtaatcccagcactttgggaggccgaggcgggtggatcacgaggtcaggagatcgagaccatcttggctaacatggtgaaaccccgtttctacttaaaatacaaaaaattagccgggcgcggtggcaggcacctgtagtcccagctactcgggaggctgagacagaagaatggcgtgaacccaggaggcggagcttgcagtgagctgagatcgcgcca

SEQ ID NO: 55661 - DNA, 601 bp, Human
ttttagcttaaaagtctctccataatgtaactgttcaaaaagaaaataaactgcagaaggtttttgtctaatctccccagtgtggtgaaaggctcccaaggcagaggagaagcaaaagggaagtgtgtcattctcattcagctgaactccagttttggccacaacttgtacacctcagtgccttaacacccgacttaggaatcagttccctggaatgctggatggactgaaggcttccgaaaagttgtagctttgataaaactaacaaaatacaaactcctctttcttctgtgaggttctrccacactgactgcaaacatcagggactcccaatcctgactttttgacctcaaagaatctctggactttatgaactaaatgctttctttagaaatatgggttctggctgggcacagtggctcatgcctgtaatcccagcactttgggaggccgagctgggcagaacacctgaggtcaggagttcaagaccagcctggccaacctggcgaaactccagctcaaccaaaaatacaaaagttagccaggcgtggtggtacgtgcctgtaatcccagctactcgggaggctgaggcaggagaatc

SEQ ID NO: 55662 - DNA, 601 bp, Human
tttcaaaaagaatttcttagatatgtcttgaaactaaattattatataggcaggaggccactatggttcaatcttgatatacgatagtgattaaaatcctagtatgaatagcatacggattatgataaagattaaaaatctgcctgggtgtgaatccactctgccccttaccaaatggtaatgttaggcagcttactcttcttgaatgaacatatcctgtggtaggaaatgtatggtaggctgttgtgaggattcagttagttaatatacatacacaatgcttagaacagtccctagcacrtaacaaccaaccaaataaatgttagctacaattactgtactgtatcactacttgtccattctctttgagctatttataccaataaagtggagaaattaagatatagctatttatgtaattcttagctactgtaaatccagttcaatcttttgtttactgaaaaataaacattacaacagtcaaaaggagataagctaaagagtggactcactaaaagaacaaaattaccagtcaagttgaggcataagtcatcaatgacacaacggtcttgtctcaaaagctgactaaattatagagata

SEQ ID NO: 55663 - DNA, 601 bp, Human
ataaaagttatgggtaaaagtgcaaagaccctccctgatctaagccctggaaaaggcagaatggtggcatttccgggagccatctcacacacctgggggttgtggccttgtcatcctcactcaggaaatatcacgcaacaggagttgcccatagctaccttcagagacaaagccaatgtgggcgcttgtagataacagtacaaaaaaaattattttaaatgagtttttaattaaatggtcttaatttattgcatcaagtgacaaagagagatatttaaaatggctctttgcaattgtaacwttacctatgagaacgggggaaatagggtgactgcaggacaggggtgggagggagcagaagcttttcactgaattcccttctgggttttgtattaataccatgtgcaagtattacctatccagaaataataacagtaaagttccaatttcaaaaagaatttcttagatatgtcttgaaactaaattattatataggcaggaggccactatggttcaatcttgatatacgatagtgattaaaatcctagtatgaatagcatacggattatgataaagattaaaaatctgcctgggtgtgaat

SEQ ID NO: 55664 - DNA, 601 bp, Human
ggttccttctcatcaagaataaaagttatgggtaaaagtgcaaagaccctccctgatctaagccctggaaaaggcagaatggtggcatttccgggagccatctcacacacctgggggttgtggccttgtcatcctcactcaggaaatatcacgcaacaggagttgcccatagctaccttcagagacaaagccaatgtgggcgcttgtagataacagtacaaaaaaaattattttaaatgagtttttaattaaatggtcttaatttattgcatcaagtgacaaagagagatatttaaaatgsctctttgcaattgtaactttacctatgagaacgggggaaatagggtgactgcaggacaggggtgggagggagcagaagcttttcactgaattcccttctgggttttgtattaataccatgtgcaagtattacctatccagaaataataacagtaaagttccaatttcaaaaagaatttcttagatatgtcttgaaactaaattattatataggcaggaggccactatggttcaatcttgatatacgatagtgattaaaatcctagtatgaatagcatacggattatgataaagattaaaa

SEQ ID NO: 55665 - DNA, 601 bp, Human
gattagagactcaatctaatgttataataacagggttatcacaaggatcaaattaagttgtgctaggaatcaatctgaaaaaaataaagaaacataaaaaggcaaggttcttatttcaactgtttgccaacattttaacaggaaaaaagtcttccctgtctctcagcccatctgagactatctggttactggactcaaggatctagaaggttctttctaaccttttcctatccagagtcttcaatgagagttttgtggtggtttgcctaacttgaatattcctcacacggccctaatggtyactgatttagacactccaaagtatatttctccagccctctatccctgagcctggcacaactcacagaagttcaattaacaaacatgtactgagcatttactatgctccaggcatggttccttctcatcaagaataaaagttatgggtaaaagtgcaaagaccctccctgatctaagccctggaaaaggcagaatggtggcatttccgggagccatctcacacacctgggggttgtggccttgtcatcctcactcaggaaatatcacgcaacaggagttgcccatagctaccttcagagac

SEQ ID NO: 55666 - DNA, 601 bp, Human
gctcagagcacagacaatctttgcaaatcagaagtagtcttaaagtccctccttgcaattttcaaactgcctgtaaaacaaatttcaataagaaaacttaatgaagaaacttcataaacaaacagacactaaaattaaacagagaatttctgaaaagcgtaatgtaagaaatttatcttaaaagatgcaaaatagcactcaagcaaactagactgagggcagtgactatctaataaagatttttatagcaaatacttttgcaaatgacatatttgttattggcttttttttttttttttttgagatagagtctctctctgtcgccaagctggagcacagtggcgcagtcttggctcactgcaacctccgcctcctgggttcaagcgattctcctgcctcagcctcccaagtagctgggattacagacatgcgccactacgcctggctaatttttgtatttttagtagagatggggtttcaccatgttggccaggctggtcttgaactcctgacctcgtgatctgcccacctcagcctcccaaagtgctgggattacaggcgtgagccaccacgcccggccctgtttttgacattttaaatc

SEQ ID NO: 55667 - DNA, 601 bp, Human
ttaaaaagttagtaatcccagcactttgggagaccaaggtaggcggatcacctgaggtcaggagttcaagaccagcatggccaaaatggtgaaaccctgtctctattaaaaatacaaatattatccacgtgtagtggcaggcatctgcagtcccagctacttgggaggctgaggcacgagaattgcttgaacccaagaggaggaggttgcagtgagccgagatcaggccattgcactccagcctgggtgacagagcaagactctgtctccacaaaaaaaaaaaaaaaaaaaaaaaaaaaaaggttacatattgaaatatgtgaaataggcaaaactaaatacctcccaagcagcctatgtcaagagtgtcacctcaatctagaagatctatttatttgctaataaaggacaaaaatgctttcttgaaatccttattcagggacaaaaatgtaaatacaggtcgggcacagtggcacatacctgtaataccagcatgctaggaggccaagaagagaggatcacttgaggtcaggagtttgaaaccagcctgagcaacataggaaaccctatctctacaaaaaataaaacattagctgggcat

SEQ ID NO: 55668 - DNA, 601 bp, Human
tctttcaagatatttatagccaggggaagtggctcacgcctgtaatcccagcactttgggaggctgaggccaggagatcgagaccagcctggctaacatggtgaaaccttgtctctactaaaaatacaaaaaattagccaggcatggtggcacacgcctgtagtcccagctactcggaaggctgaggcaggagaatcgcttgaacccaggagacagaggttgcagtgagccgagatcacaccagtgcactccagcctgggcaacagagggagactccatctcaaaaaaaaaaaaaaaaaaagatacttgcaatgagaggaacattctactttccaatccataaaccagtttctgccagctgactctcgcttagtctacgtctgcacacaaccccagatctgagtctattggagtcttaagggagatctggtttcttcagtataacacagaggtgaagagcatagatgtaaaatctgaatgtaaaatctggctcttccactttccagctacatgacactacgcaagttacctaatctctccatatctcatttcatcatttataaaatgccaaattaattctacctccaagttgtgattaagt

SEQ ID NO: 55669 - DNA, 601 bp, Human
ttgataaatgacagcctgtgagccaagcactgctgggtctgaagctaatgaggccacatactcagcctcactgtttgaggccaccgtttgaattccaagattaaacagtgcatgcctttggctccaagggatggaagaagagagcatccaaaccacagaataaaatccacaagcctcattatgatatttaagaactttcataatctactccatccttctttccaaatagacctcctgctacatttccacaccagctctccaggtcatccatttatttaaaaaaaaaaaaaaattaagcacytaaatgccacattccgtgctaggccaggttttcccacctggtgaactcagtgcctccttcttcctagattctgcccagtcttcaagacagagttcaagatctagagcttccacatagctgtccctggctactctgacccacagggcttcccctcgtgacccctctgaggtctttgggttttacttggctttcactacacattcattatttggttatatggttatattttataagcctaaataaagtacaagcaactcaaaagaagggatgaatatggctgggcacagtggctcacgcctt

SEQ ID NO: 55670 - DNA, 601 bp, Human
gctactcacctggtatttaatcaatcaagaagaggtttattcatcccacacacagggtctcctccctagagaaggatctagtggttgatgggctggattctagagccaaactgccaggttcaagtctcaactctgccacttattagttccaggactttgtacaaattattaaccaaactgagtctcaatttccttgtttgtaaaatggaggtgatgataataataatacccatctcatagagttgtcttaaataaattagctggcagagatcaagcccttgataaatgacagcctgtgagycaagcactgctgggtctgaagctaatgaggccacatactcagcctcactgtttgaggccaccgtttgaattccaagattaaacagtgcatgcctttggctccaagggatggaagaagagagcatccaaaccacagaataaaatccacaagcctcattatgatatttaagaactttcataatctactccatccttctttccaaatagacctcctgctacatttccacaccagctctccaggtcatccatttatttaaaaaaaaaaaaaaattaagcacctaaatgccacattccgtgctag

SEQ ID NO: 55671 - DNA, 601 bp, Human
actcgaacccgggaggcggaggttgcagtgagctgagatcatgctactgcactccagcctgggtgacacagtgagactccatcccaccccctcccaaaaaaaaagtcaaactcatagaaacagtaaaatggtggttaccagaggctggggagtgggggtggaaggactgaggagatgttggtcaaatatacaaaatttcaattagacaggaggaataagttcaagagattgactgtacaccatggtgactatagttaataacaaggtattatagtagccactgccaccactgagcctaagwtggccatgacccctgtagaggtgacccccactcacctacccctctaggactcatgccttcctcaaaaatgcctgggccatggagctggtgccagtcatgtccttcaccatgggggccaatactcagcccctaccaagtacaacatcatgaccaaccaggtgacgccctgaaactatctagtgcccttccaaggtggtaggaacatgctgacatacagagccacctccaggacccccagtgcccagcttggagctgccaaagaaactgtgaccacctcactcgacagtgaggaggccccct

SEQ ID NO: 55672 - DNA, 601 bp, Human
ggctgcagtgagccaagactgcactactgcactccagcctgggtgacagagcaagaccctgtctcaaaaaaaaaaaaaaaaaaaaaaaaaatgcagagcaggggctgactccagaggctgaacctctgccctcctttgaggcctatgctacctgtgtatcctcatgggtggagtaggagagtaggaaggaagggaggtgttactcagatggccctggtcaatcttctggactaggacgcagttactcaggcatatgaggacaaaaggaagcaaaacaaagaacacagagcaattttatcawgaccttttccttttgccatatatggttcccctcattgccaacaaacagagtaactttaaaataattttttaaatcaacatttccctttgaaggtagtaaaattttccacattacactgtagatttttttaaagatgtttaagagctggcaagggagggcaggggaatagctgggcttcagtccccagagcacctgctgcctactccttggaaggaacgttccaagagctatggcatttttcagccctctagaattccacctgattgacagtgccctctcagaaaacaaaaatatgactag

SEQ ID NO: 55673 - DNA, 601 bp, Human
cagcctattctcagcccagcagccagagtggtcctgttaagacatccttcagatcatatcattcttctgctcaaactctccaatggctcagtgtcattcagagtgagaaccttatgatggcctgcaatgccttgggctatacacacccgcaccgtctcccacccctcagttaactctctgacttcccattccagcaggcacctggcccacctgctattgcctgagcactgcaagcaaacttccaccacagggcctctgcacttgcttttcctgctgcctggaatgctctttccccagatayccacttagctcacctcctccaaacctttgctcaatgttcctagtgaagcccttcctaatcaccttacttcaaattgcaatccccgctaacaatccccaacctctttgctttttattcgacgaacctgctgatatatgcattttgtttgtttctggtctctctccactagagacatgcttcataaggacaaggatttttatctgttttgtttactactatctctccaacacttggaatagtgtctgaaatacaataggtactcagtaaatccttgttaaatcaatcaatcaacactttagg

SEQ ID NO: 55674 - DNA, 601 bp, Human
taggctattaagacgatgatttttcaaggacattcattcacaacacaaagagattttctttagatggtttggggaggttgttttgtgttttaagactcagctttttcagttctatagatgtaattatctttaatattaggctatggcacagtattccactgatgtgagaaatacatctttatccactttcctcctcaaaaggaataggttggggaaaaattacaaaagcatcattctgaatttcctaagcatatgactcccaagggtccttccttctaataaggagtcctggtcatcattwtctcttgccagtatctccaaatccacctttgcccaacagcctattctcagcccagcagccagagtggtcctgttaagacatccttcagatcatatcattcttctgctcaaactctccaatggctcagtgtcattcagagtgagaaccttatgatggcctgcaatgccttgggctatacacacccgcaccgtctcccacccctcagttaactctctgacttcccattccagcaggcacctggcccacctgctattgcctgagcactgcaagcaaacttccaccacagggcctctgcacttg

SEQ ID NO: 55675 - DNA, 601 bp, Human
cctctcattaccgaagagtcccttggccacaggttccgggaccaatgaccccgccctcagtgacccaacacgaatctcctaccttggtctactaagtcacaaggcaagaaatgagacaaggcaaaagaggcacataaaaggaagaaatggtgggggcgggaagaattccttctttaacaactgttaggattatgtcaaggtgtagccccagctaataaagatgcacctggtttctgcaggtgcaccacacttacagtcagagagctaaaggcatctgtggaactcactgcctcaaaccaayttcctctccagcacatggatccctctgacccaaacaagtttaccaaaggtgttcaaggtagctgttgtaaaggcatgctaaaatcaagctcccttttatggcactaagaaattgtctaggtgtttgcagtttctgtgttacaatttgtgcattgagaaaacagatgacctatgctgtcaaatgtggtcctcagactaacggtatcagcatcttatgagcctgttaaaaatctacagtctttgacccatcaaggcctactaaaacagaatctgcattttaacaagatccctgggtgattct

SEQ ID NO: 55676 - DNA, 601 bp, Human
ttataagaataaagtagggccgggcgcggtggctcatgcctgtaatcccagcactttgggaggatgaggcaggcagatcacctgaggttgggagttcgagaccagcctgagcaacatggagaaaccccattcctactaaaaatacaaaattagccaggcgtggtagtgcatgcctgtaatcccagctactcgggaggctgaggcaggagaatcgcttgaacccagtaggcggaggttgcagtgagccgagatcacgccattgcactccagcctgggcaacaagagcaaaactccatctcawaaaaaaaaaaaaaaaaagaataaagtaggaagtcaatggggaaacctgagctagaaaattagagccctgctagcagaaatgaggtatacccaacttttaacttttagtccctaactccagagccaccctcgctaacccacctaaagtcccccttttatccactcagcccatatcacctctcattaccgaagagtcccttggccacaggttccgggaccaatgaccccgccctcagtgacccaacacgaatctcctaccttggtctactaagtcacaaggcaagaaatgagacaaggcaaa

SEQ ID NO: 55677 - DNA, 601 bp, Human
tcaccccataccattaatggaacactgccagacagcctttgatagggtatttctagagctaattaagcttggcaaaacagaggacacaaacttcctggcactcacaagggccaggctgagacctggcaggtgacagacagtaaagttgtccttacagataatcctggggtgatgaaaatggcaggctgcttggatcaggctctcggagtcctctataatatgccagaccctactctcaaattatataactatcaggcttttcgcatttgagctattctttcaccctgaagacattttttttcttctgagtgaagatttgatacttaaaagtttggtattgcttctagtccacaccccatcctgtcacccccgaaaagggttagtttagaaaaaaacaaaaagttgtatactaggtttttttttactatatcttaaaataaatctcatctcaaaatgtccttcttccaatcaaagagtccttgcataatccaagatttctcactcctataacctcagtcacgtgggaaatctatttttttcactatctaatgtcacacagaattccagactgctccacatgcatggacagcaacataaacac

SEQ ID NO: 55678 - DNA, 601 bp, Human
gaattcaccccataccattaatggaacactgccagacagcctttgatagggtatttctagagctaattaagcttggcaaaacagaggacacaaacttcctggcactcacaagggccaggctgagacctggcaggtgacagacagtaaagttgtccttacagataatcctggggtgatgaaaatggcaggctgcttggatcaggctctcggagtcctctataatatgccagaccctactctcaaattatataactatcaggcttttcgcatttgagctattctttcaccctgaagacatttwttttcttctgagtgaagatttgatacttaaaagtttggtattgcttctagtccacaccccatcctgtcacccccgaaaagggttagtttagaaaaaaacaaaaagttgtatactaggtttttttttactatatcttaaaataaatctcatctcaaaatgtccttcttccaatcaaagagtccttgcataatccaagatttctcactcctataacctcagtcacgtgggaaatctatttttttcactatctaatgtcacacagaattccagactgctccacatgcatggacagcaacataa

SEQ ID NO: 55679 - DNA, 601 bp, Human
atattgtctaaataaagattaactttttgaagacctaactactatgtgccataaacttctggctgctttacaagtattttatcctcatcaaatcaaaggaataggtataattagcagtattgtatagataaggcaacaaaagctctgcaaaccacaaaactgggactcaaatctccaaaacaaaacaaaacaaaaagttggggggcagggagagcacttcttatccacaccctctcccaactccatcactcccattgtaccactgtggtatttccactgtactgctctaagtaaaacttayggaaaataaagaaactgggcatcaataaagtctgtttaacagcaacattatatttcaggatcagatctaatttttgtaccaaaaatatgcctgaataatagaactgcaacttaaaagactgattaaatatgtccaccatgtgttacggactgaatgtgtacccccctaaaatttgtatgttaaaatcctaaccccagtgtgatggtattgggagatggggcacgctaacaggtggagcaattaggtcatgaggacagcgctctcatgaatggtatgagtgtcttaaaagagactccagag

SEQ ID NO: 55680 - DNA, 601 bp, Human
aaaagtagttttaggccgggtggagtggctcacacctgtaatcacaacactttgggaggcaggtggattgcttgagttcaggagttcgagaccagcctgggcaacagagcaaaaccccgtctctaccaaaaaatacaaaaaattagccaagcatggtggtgtgcacctgtggccccagctacttgagaggctaaggtaagaggatcacttgagactgggagccgaaggttgcagtcagccaagaaatgtgcccctgcactccagcctgggtgacagagcaagactctgccaaaaaaaaaaagaaagaaagaaagaaaagaaaaaagaaaaagctgcaccagagcaaaagcaaaactaacttgactctcacggagcttacattttagtgggggaagataaataataaacataagtaaattacaagcagcttttgaggtgagaagtgctacgaggaaaaacagagcaagataagaaggaataggagtttctgtggttagagagggattacaattttaagtagggtggttagactgggactgagcctagaggtaccatatagatgaggaaaactaccaatacacagcctcaatccacttcactt

SEQ ID NO: 55681 - DNA, 601 bp, Human
ttccatgaaaaacagaccagatcagctcacaactcaaacaactgcacagtgcttttcctcaagaaaatcattgtactttggaatgcagaaatgcaacatacgtacctcccattttaccatatagaataaggaaaaaacatgtatctgagggtaacaacactcttaaaggaaagtggcagatgttttactgcaagtgtgtgccagtgaagtactgccttcattcctgctgagtcaccagcagttttatccaatattgctcttatacaattagagcagtgttaacccaatcttggaattattrtaaaaatagttggccaggcgcagtggcttacacctgtaatcccagcactttgggaggccaaggcgggcagatcacgaggtcaggagttcaagaccagcctgaccaacatggtgaaaccccatctctgctaaaaatacaaaaaattagccaggagtggtggtgtgggcctgtaatcccagctactcaggaggttgaggcaggagaatcacttgaacctgggaggcgaaggttgctgtgagctgagatcacgccactgcactccagcctgggcaacagagcaagactccatctcaaaaaaaa

SEQ ID NO: 55682 - DNA, 601 bp, Human
ccttctgtcagtcaaaaattatctcaaaataaaaagtttttaaaaatcacttgctctggccaggcacggtggctcacgcctgtaatcccagcactttgggaggctcaggcaggtggatcacctgaggtcaagagttccagaccagcctggccaacatgatgaaatcccatctctactttaaaaaaaaaaaaaaatacaaaaattaactgggtatggtggcgtgcacctgaagtcccagcttcctgggagcctgaggcaggagaatcacttgagcctgggaggcagagtttgcagtgagccragaccatgccactgcattccagcctgggcaacagagcaagactctgtcaaaaaaaaaaaaaaaatcaattgttctatcttgtactctcaagatgtggaatattttaccaatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcattggtc

SEQ ID NO: 55683 - DNA, 601 bp, Human
ctaaaaaccaactataataaactgtaacataaacagtatctttcatgaaaaacaactactttctaaaacaaaatgtaaggtgagatgagcagcactgttttacatttttggaaatctcttttttttttttttttttgagacggagtctcgccctgtcgcccaggctggagtgcagtggggcgaactcggcgcactgcaagctctgcctcccgggttcacaccattctcctgcctcagcctcccaagtagctgggactacaggcacccgtcatcacgcccgactaattttttttttttttttgtattttttagtagagacagggtttcaccgcgttagccaggatggtcttgatctcctgacctcatgatccacccgcctctgcctcccaaagtgctgggattacaggcgtgagccaccgcgcccggccgcaaatctcttttcttgttaaatttcaaagacacatgcacagcaaatctctttaaatgtctggcttaatacaagaccactgggttttcccatctacttttgcattcaattttttgcaatacattgttctggttgaaggatatgaagaaatctggcctcacacagatacagtat

SEQ ID NO: 55684 - DNA, 601 bp, Human
aaatttttaaatatttattaattcactaaaaaccaactataataaactgtaacataaacagtatctttcatgaaaaacaactactttctaaaacaaaatgtaaggtgagatgagcagcactgttttacatttttggaaatctcttttttttttttttttttgagacggagtctcgccctgtcgcccaggctggagtgcagtggggcgaactcggcgcactgcaagctctgcctcccgggttcacaccattctcctgcctcagcctcccaagtagctgggactacaggcacccgtcatcacrcccgactaattttttttttttttttgtattttttagtagagacagggtttcaccgcgttagccaggatggtcttgatctcctgacctcatgatccacccgcctctgcctcccaaagtgctgggattacaggcgtgagccaccgcgcccggccgcaaatctcttttcttgttaaatttcaaagacacatgcacagcaaatctctttaaatgtctggcttaatacaagaccactgggttttcccatctacttttgcattcaattttttgcaatacattgttctggttgaaggatatgaagaa

SEQ ID NO: 55685 - DNA, 601 bp, Human
atccctttattgctttaaaattactgaggactccaaagagattttgttaatataagtctattaacattttctgcaatagaaattaaaactgaggaaatttttaaatatttattaattcactaaaaaccaactataataaactgtaacataaacagtatctttcatgaaaaacaactactttctaaaacaaaatgtaaggtgagatgagcagcactgttttacatttttggaaatctcttttttttttttttttttgagacggagtctcgccctgtcgcccaggctggagtgcagtggggcraactcggcgcactgcaagctctgcctcccgggttcacaccattctcctgcctcagcctcccaagtagctgggactacaggcacccgtcatcacgcccgactaattttttttttttttttgtattttttagtagagacagggtttcaccgcgttagccaggatggtcttgatctcctgacctcatgatccacccgcctctgcctcccaaagtgctgggattacaggcgtgagccaccgcgcccggccgcaaatctcttttcttgttaaatttcaaagacacatgcacagcaaatctcttta

SEQ ID NO: 55686 - DNA, 601 bp, Human
aaattgcctttcatttaaactaaaaaagaaaaatgttagttccaaagttggggattcttaatagattctagctggtacatttttaagtctgtatttgtaaatacagacctaataattttttttaaaaccaaagaaccaaaataacaaattaacttcatgaagactataagtaaggatattatttatttatttatttatttatttatttaattttccaagatagagtcttgctctgtctgtcgcccaggctggagtgcagtggcatgatctcggctcactgcagcctccacctcgtgggttyaagcaattctcctgcctcagcctcccaagtagctgggattacaggcatgcaccatcacgcctggctaatttttgtattttcagtagagacggggtttcaccatgttggccaggctggtctcaaactcctgacctcatgatccacttcagcctctcaaagtgctgggattacatgtgtgagccaccatgcccggctggtaagtaaggatataatggatatgcaacccgagtctacttcaacagagacatcagtggtatatttagaacccattaacaaatttaaatgatttatgtaaatact

SEQ ID NO: 55687 - DNA, 601 bp, Human
ggatcctgtttaacatttgatttaaactgatacttaacacaacaagatactactggcttcccctcccttttgtttccccattttaaaaaactaagccatcaaattgcctttcatttaaactaaaaaagaaaaatgttagttccaaagttggggattcttaatagattctagctggtacatttttaagtctgtatttgtaaatacagacctaataattttttttaaaaccaaagaaccaaaataacaaattaacttcatgaagactataagtaaggatattatttatttatttatttatttttttatttaattttccaagatagagtcttgctctgtctgtcgcccaggctggagtgcagtggcatgatctcggctcactgcagcctccacctcgtgggttcaagcaattctcctgcctcagcctcccaagtagctgggattacaggcatgcaccatcacgcctggctaatttttgtattttcagtagagacggggtttcaccatgttggccaggctggtctcaaactcctgacctcatgatccacttcagcctctcaaagtgctgggattacatgtgtgagccaccatgcccggctggtaa

SEQ ID NO: 55688 - DNA, 601 bp, Human
agttaactttactatagtttaccaaattgtagaagttagttcagcttccaaatcttatttccaagcagtagcttcaaaacactggaagaatctggctcaaaatcagttacaacattttgccatgacagtataacacatacacgctgcattagatatttatatttctgctaaatatcagagatgctcaagttggtgattatgacagagctggccctccactgtggcagtttccattactaaattcactttacaagaatgcaggatcctgtttaacatttgatttaaactgatacttaacacracaagatactactggcttcccctcccttttgtttccccattttaaaaaactaagccatcaaattgcctttcatttaaactaaaaaagaaaaatgttagttccaaagttggggattcttaatagattctagctggtacatttttaagtctgtatttgtaaatacagacctaataattttttttaaaaccaaagaaccaaaataacaaattaacttcatgaagactataagtaaggatattatttatttatttatttatttatttatttaattttccaagatagagtcttgctctgtctgtc

SEQ ID NO: 55689 - DNA, 601 bp, Human
gtctatgctctaaaacgctgcgctccattaagttctcctgctggcagtgaggagcattttcctcttagattgggttctatgaatatcctaaaatagtacttaaacctttgaaatttgatgaaacttttttatatataattatatatttctattgtatttataatatatgctgagttaactttactatagtttaccaaattgtagaagttagttcagcttccaaatcttatttccaagcagtagcttcaaaacactggaagaatctggctcaaaatcagttacaacattttgccatgacagkataacacatacacgctgcattagatatttatatttctgctaaatatcagagatgctcaagttggtgattatgacagagctggccctccactgtggcagtttccattactaaattcactttacaagaatgcaggatcctgtttaacatttgatttaaactgatacttaacacaacaagatactactggcttcccctcccttttgtttccccattttaaaaaactaagccatcaaattgcctttcatttaaactaaaaaagaaaaatgttagttccaaagttggggattcttaatagattct

SEQ ID NO: 55690 - DNA, 601 bp, Human
aacccagggagatggatattatctccattttacagaggagtacactgaagcaaaccgaggttacacagctactcagtggcagccgtgggatatgcacccaggcagctggctcttaacgtctatgctctaaaacgctgcgctccattaagttctcctgctggcagtgaggagcattttcctcttagattgggttctatgaatatcctaaaatagtacttaaacctttgaaatttgatgaaacttttttatatataattatatatttctattgtatttataatatatgctgagttaactttaytatagtttaccaaattgtagaagttagttcagcttccaaatcttatttccaagcagtagcttcaaaacactggaagaatctggctcaaaatcagttacaacattttgccatgacagtataacacatacacgctgcattagatatttatatttctgctaaatatcagagatgctcaagttggtgattatgacagagctggccctccactgtggcagtttccattactaaattcactttacaagaatgcaggatcctgtttaacatttgatttaaactgatacttaacacaacaagatacta

SEQ ID NO: 55691 - DNA, 601 bp, Human
ctactcaggaggctgaggctggagaatcgtttgaacctgggaggcagaggttgcggtgagccgagattgcaccattgcactccagcctgggcaacaagagcaaaactccatctcaaggaaaataaacaaataaataaattttaaaaaaaattcagatgtcatgaagaaataacctaaaacttaacaattgctaactaaacaataatggaacaacagagcacttgaaacacagtatctcgttagatcttcaaaacaacccagggagatggatattatctccattttacagaggagtacacttaagcaaaccgaggttacacagctactcagtggcagccgtgggatatgcacccaggcagctggctcttaacgtctatgctctaaaacgctgcgctccattaagttctcctgctggcagtgaggagcattttcctcttagattgggttctatgaatatcctaaaatagtacttaaacctttgaaatttgatgaaacttttttatatataattatatatttctattgtatttataatatatgctgagttaactttactatagtttaccaaattgtagaagttagttcagcttccaaatcttat

SEQ ID NO: 55692 - DNA, 601 bp, Human
cgtggttcatgcccgtaatcccagcactctgggaggccaaggtgggcggatcacctgaggtcgggagttcgagaccagcctgactaacttggagaaaccctatctctactaaaaatacaaaattagccaggcgtggtggtgcatgcctgtaatcccagctactcaggaggctgaggctggagaatcgtttgaacctgggaggcagaggttgcggtgagccgagattgcaccattgcactccagcctgggcaacaagagcaaaactccatctcaaggaaaataaacaaataaataaattttwaaaaaaattcagatgtcatgaagaaataacctaaaacttaacaattgctaactaaacaataatggaacaacagagcacttgaaacacagtatctcgttagatcttcaaaacaacccagggagatggatattatctccattttacagaggagtacactgaagcaaaccgaggttacacagctactcagtggcagccgtgggatatgcacccaggcagctggctcttaacgtctatgctctaaaacgctgcgctccattaagttctcctgctggcagtgaggagcattttcctcttagattg

SEQ ID NO: 55693 - DNA, 601 bp, Human
aaattcagatgtcggccgtggttcatgcccgtaatcccagcactctgggaggccaaggtgggcggatcacctgaggtcgggagttcgagaccagcctgactaacttggagaaaccctatctctactaaaaatacaaaattagccaggcgtggtggtgcatgcctgtaatcccagctactcaggaggctgaggctggagaatcgtttgaacctgggaggcagaggttgcggtgagccgagattgcaccattgcactccagcctgggcaacaagagcaaaactccatctcaaggaaaataaayaaataaataaattttaaaaaaaattcagatgtcatgaagaaataacctaaaacttaacaattgctaactaaacaataatggaacaacagagcacttgaaacacagtatctcgttagatcttcaaaacaacccagggagatggatattatctccattttacagaggagtacactgaagcaaaccgaggttacacagctactcagtggcagccgtgggatatgcacccaggcagctggctcttaacgtctatgctctaaaacgctgcgctccattaagttctcctgctggcagtgaggagca

SEQ ID NO: 55694 - DNA, 601 bp, Human
gagattgtgccactgtactccagtctgggtgacagagcgagactccacctcaaaaaaaaaaaaaaaaaaaaaaaaaaagccaacataccactagaactctaccatgccctatgaataccaaatcttcccagatgtaacttaccctaaaacattacttgaggatatatgttgttaatgagataaaaattcagatgtcggccgtggttcatgcccgtaatcccagcactctgggaggccaaggtgggcggatcacctgaggtcgggagttcgagaccagcctgactaacttggagaaaccctrtctctactaaaaatacaaaattagccaggcgtggtggtgcatgcctgtaatcccagctactcaggaggctgaggctggagaatcgtttgaacctgggaggcagaggttgcggtgagccgagattgcaccattgcactccagcctgggcaacaagagcaaaactccatctcaaggaaaataaacaaataaataaattttaaaaaaaattcagatgtcatgaagaaataacctaaaacttaacaattgctaactaaacaataatggaacaacagagcacttgaaacacagtatctcgttaga

SEQ ID NO: 55695 - DNA, 601 bp, Human
atctgcctttgagagttcagagttgatctttaattccatcatttgaataccgaacacctactacctaaagtgccaagttcttgtggctactcgagaaacagcagcgaacaagataagcagtttctcctctgctttcatggagcttccattctatgcaggaggagaaatagacaatgaacaaatacgtgagatggagtttgttttggtttggtttggtttttaagacagagtcttgctctgttgcccaggctgcagtgcaatggcgcaatcttggctcactgcagcctccgcctcctgggtycaagccattctcctgcctcagcctccctagtagttgagattacaggcgcctgccaccacacccagctaattttttgcatttttagtagagtcagggttttgccatgttggccaggctggtctcaaactcctgacctccggtgatccacctgcctcagcctcccaaagtgctgggattacaggtgtgagtcactgtgcctggcggtgagataatttttaaggcacaaagaagctcctcctccaggaaaggacaagtatagcaatggatgggggtgctttatgcaagtggggggcccagaga

SEQ ID NO: 55696 - DNA, 601 bp, Human
ttaaaatccaattctgatagcatggtgtctcccgccttcaataagagttgaaacctctcctttctagaaaatcttcacatatcaaaaagacaaaagatacttttctctttatgtatttgaaaattgcaaatagtaacagacgctgctgagatctcatttcctatcctctgacaggttcccctttggttcaggcctgaagaatgggcatgacatatgagtgtttattttcctgcactaaagtgaaaatctatctgcctttgagagttcagagttgatctttaattccatcatttgaataccraacacctactacctaaagtgccaagttcttgtggctactcgagaaacagcagcgaacaagataagcagtttctcctctgctttcatggagcttccattctatgcaggaggagaaatagacaatgaacaaatacgtgagatggagtttgttttggtttggtttggtttttaagacagagtcttgctctgttgcccaggctgcagtgcaatggcgcaatcttggctcactgcagcctccgcctcctgggttcaagccattctcctgcctcagcctccctagtagttgagattacaggcgcct

SEQ ID NO: 55697 - DNA, 601 bp, Human
caacatagcgaaaccccgtctctactaaaaatacaaaaaattaaccagtcttggtggcgggagcctgtaatcccagctacttggaaggctgaggcagaagaatcgcttgaacccaggaggcggaggttgcagtgagccgagatcactccattgcactccagcccaggcgacagtaggagactccgactcaaaaaaaaaaaaaaaaaaaaaaaacaggcctggtaacccacgcctgtaataccagctactagggagactgaggcagaagaatcacttgaacccaggaggcggaggttgcagwgagccaagatcacaccactgcactccaccctgggcgacagagcaaagctctgtctcaaaaaaaaaaaaaaaaaaaaaaaggccaggcacggtggcttacgcctataatcccagcactttgggaggctgagacaggtggatcatttgagatcaggggttcaagaccagcctggccaatatggtgaaaccccacatctactaaaaataaaaattaaaaaaaaaattggctgggtgcggtggcacacacctgtaattccagctacttgggaggccttgaggcaggagaattgcttgagcccag

SEQ ID NO: 55698 - DNA, 601 bp, Human
ttacttaaaaattcaacaaagttaaaattccacgtaaaggtaaagcttagataattcaaagttatgtcatgttctaactagtcagctctcctgagagcattcctagtccatcattaaccaataattaatggctaatttcctagaaattaactctatatcctgtatagggaagtgtaaatggaaaaacagctagtggccctaaatgagagagagctttgcaaatactaaggtcatctttgatatacagagacaatcgatattcctttgaatttgtacaggaattttaaatttgcatttttttccccattatatgaccctcaaaataaccacatttggctaataataacattattatctatggagtgtttactattgtgcaagggtctcttctaagcatttgacatgtattaacatgtttattcctcacaacaaccttgagatacactattattggccgcactttacagatgaaagaactaaggtagagtgatattaagtaactcactcaaagtcataaaattattgaatcaagtgattaagccaaaccagacagcagggggaaggtagaacctagactagaaggcagtccagcctcctgggt

SEQ ID NO: 55699 - DNA, 601 bp, Human
gaacacagtgaatctaataatagagcagactggcttttatatccctttacttaaaaattcaacaaagttaaaattccacgtaaaggtaaagcttagataattcaaagttatgtcatgttctaactagtcagctctcctgagagcattcctagtccatcattaaccaataattaatggctaatttcctagaaattaactctatatcctgtatagggaagtgtaaatggaaaaacagctagtggccctaaatgagagagagctttgcaaatactaaggtcatctttgatatacagagacaatmgatattcctttgaatttgtacaggaattttaaatttgcatttttttccccattatatgaccctcaaaataaccacatttggctaataataacattattatctatggagtgtttactattgtgcaagggtctcttctaagcatttgacatgtattaacatgtttattcctcacaacaaccttgagatacactattattggccgcactttacagatgaaagaactaaggtagagtgatattaagtaactcactcaaagtcataaaattattgaatcaagtgattaagccaaaccagacagca

SEQ ID NO: 55700 - DNA, 601 bp, Human
agccctggcaatctggcaggcagtcgatttccagggggagctctgtccacggtatggatgccccaggcttgaggtcctcattcattttcataaacaaagcccagttgccacagtgactggtgctgcaagcagctgctaaataacagaggtcacccagagctttctctgggttctacagtctgttcctaggcttctgtgaacagtgagtgggtcaacgggagctgcagtcataccagccagtactttatatgggagtctgccccctgaggagaaactcccaagaaagctgccagatacacamgtgatttcaggtggggtccaataccccacccctgacagatctcggtctggggcacaggaagaatgaagggcataaggagtagcaacttcctccttgtggcttcaacagtccccagagcagtgagagggcacagggtcagagcttggtgcaaaaggaatgatcctggaaaagtgagtgtggagttgggccagtgctgcttctgcaccctgtgtgccgatcagacgctttctccctgtcccacttaggtgggaaacggctctcaccacccccatagcaggaagcacaacacgcctcccaccc

SEQ ID NO: 55701 - DNA, 601 bp, Human
agggagagacaggcccccattatcctccacttcttaaggcttctttgtatgcacgccgcatgagataattcattaacgaagaaaaagttactggttatgataacacagtccctggcacacagtaagcacttggtaaatgtttactgaatgactacaggaaatatctgagtgctggacagaggaacaaagcctcaactctcccaggtttacttttttagccaacctgttaacaacaataatagtgcatgtcatcaaagagctggaaaggagctggcttcagtaaggctgcagtcactcactrctcagtgaatgaatcgatccattcagtttctctgacccccatccagaatacaaggtagttatggccagcacaggcataactcccaacggacttgttattaaccacactgggtaactatgaatggatgcagagacaccagttcagttcagctgcagactgtccggaacattatcttggttaatcatctactccagggtaccggctcttcagatcacgctgaggtctgcttctcaaagcctgacaggatcagaactgtacaacctctcacagtcttctttatcccttccccaagataactcg

SEQ ID NO: 55702 - DNA, 601 bp, Human
cacttgtggttaggttcagtggctcacgcctgtaatcctagcactttgggaggccaaggcgggtggatcacctgaggtcaggagtttgaaaccagcctggccaacatggtgaaaccccatctctactagaaatacaaaaattagccaggcgtggtggtgggtgcctgcagtcccagctcttcgggaggctgaggcagaacaatcccttgaacccaggaggcagaggttgcagtgagcccagatagtgccattgcactctagcctgggtgagagtgagaccccgtctcaaaaaaaaaaaaaatccacttgattcaagcaatgtttgataaaagttaaacacaaaggaatacgaagtatcctttttcgttcaatttgctgaaacccatattaagtccctgctatgtgccagctacagtggccacaaatagtaagacagagtgccttggccttaagcagctatactcccagagtcgagagagagtgacaggtggagtcaggatagagagacaggtacacagtgaggtagcacattagagggtcccctagaaggctgccgagggaacggaggaaacacaaacaagggccatgatcgcctcttcat

SEQ ID NO: 55703 - DNA, 601 bp, Human
aagacaatggacaaatatgtgctaaatagtgaagccaggtggctgagaccaaagagaccagacaaatggctaagcagagctttggcaatagtgtgacttatgtgacctattaccatatggggtaagaggcaaagaggataagagaagtcttttcaatcccacctagaagcctttagaatctggagagatgatagacaaaccgccacatttatattcttctactgccaaacagaaaacatttccagtatctcctagtgcccgctgtaggctgagaagagcaaagcattaaaaaaaaaaaaawaaaaaaaaaaaagatgaatcttagtgtgaccttcccaaacgtaaacttcattttccagcctcaccaatcttttagaacagaagatcaagtcaaatccctttagaatcaatgggtaataatatctcagcacatctaatctattttgggggctcagttgaaaccccatctcctttattagccttcccaaatcctcctcactaaaagctatcactctctttcacttctcacagactttgttcttcaactctattaatttctgcttcacattagttatttgcatgcctattttatctcccttac

SEQ ID NO: 55704 - DNA, 601 bp, Human
gagacaattcatccactgagagccattctcctgtttggagagggcctacaggcatcagcagcacctaaacatacagcctttcctggtcatgatttatttcttagcatgacagtaaatccatagcttacaatagcaggacgttgctgtcagacaccaaggtctctcagcatagccactatcctgaagtcatgaatcacacctccaagtccagtgacaggttcagaggctttaccaccccctccctcccctaaatccacaggatgcccactctgcttctctgctcatgcgatgatttcattarttcaaagatattctgccttctatcatttttctccttacagttcttaagagaatgaaccagcttcagaaaatggggaaagaaaaaacaaactgatcatcagatgagggttcaaatcttgaactggcttcttagaagctgtgtcactttatgcaagccacagtctttctcagtcttagttccagataaacagtgaatagcagcacattctttatgagattattataagactcaaatgagagaatacacaagaaaatacctagcacatattaaatgcctgctaaccttttacctatgagcaat

SEQ ID NO: 55705 - DNA, 601 bp, Human
atcatttatcctattacaagttttagagttttgcgtgtcttttgttgatggtggggttttttccagattttcttagttttcttcctcaaatacacttgataacttatttttaaatgtgagagcattattataacaccaacagcatcctcctgcaatctatggacacagattattttgccagagtaaaacagattccaaaaggctgttcacaccttctttgggggacctaaaacacagggtccaggaagagctcagaaacaatccttaaatcctgatcatcgccaggtgtggtggctcatgyctgtaatcccaacactttgggaggccgaggcaggtggatcatgaggttaagagttcaagaccagcctggccaacatggtgaaaccgtgtctctactaagaatacaaaaattacccaggcatggtggcatgcgcctgtaatcccagctacctaggaggctgaggcaggagaatcacttgaactcgagaggcaggggttgcagtgagctgagatcgcgccactgtattccagcctgggtgacagagcaagactccgtctgggaaaaaaaaaaaatcccgaccatcatcccactccactgacc

SEQ ID NO: 55706 - DNA, 601 bp, Human
agccaagcaaagagcagtgagatttctcaccattaattcactcttcatttcacatgttcctacagcaccagctgttagtttatattttcagtctttactattaaaaaaaaatttcaactgcaactgcaccatttccccttagccccagctttttttttttttttttttttaggaaagtttaggacagcaggaaaactgctgagctgtgacacaaagaaaagctgactctgcacatgcctcattgttttctattttcattccagcacagttgtggctggaaaccagccttcaggattccccrtggaccttgccagccctggtccctggtgttttaaaatgttacactttatacactactcatagaggtgtgattcaattgagtatgttccctgtggttctgagtgaggctaatatatatcatgtatctttggagaagtaaccaaaatatgtgtttagggaaaaggaaaaaaataggatcaagggagtattcagagatgtaattacacatactcaagtgggaccttttgtgtgtgtgtcttggaggtgggagatttaatgtaaacacagaccacgtttgtgctttctgttatacacatcctgc

SEQ ID NO: 55707 - DNA, 601 bp, Human
ccctagctatctaacaatatttttataaacaaagcatcataaagaacataacgttcaaacggcatggaaactgttttccacggtccatatttgacaatctttcaaaaaaatgttaatattacacatattagcactgtgtaatatataagatgtaaccccctcttcacaccaagatcagttgcaaaagaacactatgatcatatttcagaaagtaacatgtaaggaaaaagaaaaaataaagaacactatgaccttggcaaaattctcaagtgttcagacagaaacttctagaagtgcttgyttgtttgttttcaaattctgctttttgaaattactcacttgatttttaggccagaaaggatgcaaacgtctgaatttctgcagtcacctccctcccactgcttttaattgctctataaagcaatccctgtggatacctatcttaaactgccctggccttgccaggacaaatgttggcccatgtattccagtaaagccatgagtattctgaaggtcaaacaaaatacatattatttccaatcagaaaggaagcctgtgctttctggaataaggccccagctcaaccttgacttggtgcgct

SEQ ID NO: 55708 - DNA, 601 bp, Human
taggtattcttattaaagaaaacatcttaatgtcaccatatatgaattcatctaatctctgagtactcatttatcatctctacaactacacatttgacagaaccaaactgtggccctaagaaacaagaattactggcatagctaagaattcaagaaatcagaatacagtctccaattatgcatttacttcaaataagaacaataacttgaaactctgtgttaggctttgaattcacctccagcctgactttaaaaagctaccatgaggcctaactccagctggcagtagtaaacatccctrgctatctaacaatatttttataaacaaagcatcataaagaacataacgttcaaacggcatggaaactgttttccacggtccatatttgacaatctttcaaaaaaatgttaatattacacatattagcactgtgtaatatataagatgtaaccccctcttcacaccaagatcagttgcaaaagaacactatgatcatatttcagaaagtaacatgtaaggaaaaagaaaaaataaagaacactatgaccttggcaaaattctcaagtgttcagacagaaacttctagaagtgcttgtttgt

SEQ ID NO: 55709 - DNA, 601 bp, Human
tgaacaaaaagtttgaactttaatggtttgtgttataaaatcaactgacaaggaaagaagttggctgtaatcagactcttcccaaacaccccaaggaagaaagccaaccaagacagaggagtggagaagcctccacagtgtgaacctggaagggctcagcttgtatattcattacctaatgaaacgggggctttagaagtgggaattctgaacctgtcactgtggatgagaacctctctgaatccacttaaacccatgaattgaaagactgggttggattttttccattcctggttaagayagagccacacaaatcctaattctaaatgtggatgttcaacattccagaataaacagcagctcatggagaaagcaacagaaggatggcaagaggaaaaaatagatcaacaaactacaacagattggtcacttagtaattaaaaaagaaaaaaacgaaaagaaaacaacccatctcaaagttcaactcaaggctgaattcctatcagaaactaccagaggccaaagactacatctgcataatattttaaatctgagcctggtctttgagaaaacatttgacaaagattaccaaaacatctat

SEQ ID NO: 55710 - DNA, 601 bp, Human
ataaactctaagtgagatccctatagaagagacaaatgaaatcaatctgctgaacaaaaagtttgaactttaatggtttgtgttataaaatcaactgacaaggaaagaagttggctgtaatcagactcttcccaaacaccccaaggaagaaagccaaccaagacagaggagtggagaagcctccacagtgtgaacctggaagggctcagcttgtatattcattacctaatgaaacgggggctttagaagtgggaattctgaacctgtcactgtggatgagaacctctctgaatccacttawacccatgaattgaaagactgggttggattttttccattcctggttaagatagagccacacaaatcctaattctaaatgtggatgttcaacattccagaataaacagcagctcatggagaaagcaacagaaggatggcaagaggaaaaaatagatcaacaaactacaacagattggtcacttagtaattaaaaaagaaaaaaacgaaaagaaaacaacccatctcaaagttcaactcaaggctgaattcctatcagaaactaccagaggccaaagactacatctgcataatattttaaatc

SEQ ID NO: 55711 - DNA, 601 bp, Human
tgtttcaaaaaagtaagtgtctttagtcagttttaaggaaaatctgcctaaaatgtactacatgcataatttcttcttggccatcttaaatattttgagcatcctgaaactcgcttattgtatatttttcttgaagatgtagggctgccattatgaatactaattagtttattaaaacttgatgtgatttcagttactatatctaccaaatggtcccatatttctgtgctttatagttttttcggtttcgtttttgaggtggagtctcgctcagtcgcccaggctggagtgcaatggcacygtcccagctcactgcaacctccgcctcccgggttcaagcaattctccctacctcagcctcctgagtagctgggattacaggtactcaccaccatgcccagctaatttttgtagttttagtagagatggggtttcaccatgttggccaggctggtctcaaactcctgacctcaggtgatttgtccatctctgcttcccaaagttctgggattacaggtgtgagctaccgtgcctggctgctttatagttttgcctatacttttcatacttgtgggtttttttccagttctggctgcaggcc

SEQ ID NO: 55712 - DNA, 601 bp, Human
ttgactggcaatgagatattccacataagcaaattatccaaataactaagtcttttcttgtttcaaaaaagtaagtgtctttagtcagttttaaggaaaatctgcctaaaatgtactacatgcataatttcttcttggccatcttaaatattttgagcatcctgaaactcgcttattgtatatttttcttgaagatgtagggctgccattatgaatactaattagtttattaaaacttgatgtgatttcagttactatatctaccaaatggtcccatatttctgtgctttatagttttttyggtttcgtttttgaggtggagtctcgctcagtcgcccaggctggagtgcaatggcaccgtcccagctcactgcaacctccgcctcccgggttcaagcaattctccctacctcagcctcctgagtagctgggattacaggtactcaccaccatgcccagctaatttttgtagttttagtagagatggggtttcaccatgttggccaggctggtctcaaactcctgacctcaggtgatttgtccatctctgcttcccaaagttctgggattacaggtgtgagctaccgtgcctggctgcttt

SEQ ID NO: 55713 - DNA, 601 bp, Human
acgtttaatcccagcgctgccacattttagccttttaacctggggcagctacttagccattccctgcctctgtttctttatctatacaatggggataataacaggatctgccccataagactgttcttaggatcaactcatttttattattgtattactgtaattattaccatctcttcaactatgagatgtgttctggaaaaaaaaatgcaaaagagaaacttcatcaaagcacttagctaaaggaaactacatcatttgagtgccaaacctagctctgcgctttctagcaggcaggatraaaagaaaatatgatgctcacatagatatcataaaaaggaaacaaatcacaggcaggtgcagtggctcacacctgtaatcccagcactttgggaggccagggtgggaggattgtttgagcccataagtttgagaccagcctgggcaagagagtgagacctcatctctacaaaagattaaaaaattagccaggcatggtggtgcacacctgtagtcccatctactcaggaggctgaggtgggagaatcccttgagcccagggaggtcaagactgcaatgagccaagatagtgccactgcac

SEQ ID NO: 55714 - DNA, 601 bp, Human
tcgagtgattctcctccctcagcctcccaagtagctggaattacaggcatgcaccaccacacccggctaatttttgtatttttagtagagatggggtttcaccatgttggccaggctggtctcaaacccttggcctcaggtgatccacctgcctctgcctcagcctcccagagtactggaagtgagtcaccacaccgagcactgatttacttttgaccaataatatggtgcacctgtccctattcttctcacaagaaggaagcttaaacagaaggagacactggctacagcattcattttkgaggggataagaatttatgggatgttactgcctaattggctcagaacagagaccaagaacaaatctgaaggtttgaaggatgggagaaaataagatcttttttctcctaccctatgaatttggcagatacaaaataactgaaggatagtacacttctttattaaaatgcaaatgctttatcgacttagattcaaaatattaaactgaactttatcccataaaaaaattacaacttaattcctactaatgcaatatctgatggcaaagtaagacttgcagagctacaaagctacacctcat

SEQ ID NO: 55715 - DNA, 601 bp, Human
ctttgtttggtattttgttttgttttgtttttggagacacagtctcactctgtcgcccaggctggagcacagtggcgcaatctcaactcactgcaaattccgcctcctgggttcgagtgattctcctccctcagcctcccaagtagctggaattacaggcatgcaccaccacacccggctaatttttgtatttttagtagagatggggtttcaccatgttggccaggctggtctcaaacccttggcctcaggtgatccacctgcctctgcctcagcctcccagagtactggaagtgagtcrccacaccgagcactgatttacttttgaccaataatatggtgcacctgtccctattcttctcacaagaaggaagcttaaacagaaggagacactggctacagcattcattttggaggggataagaatttatgggatgttactgcctaattggctcagaacagagaccaagaacaaatctgaaggtttgaaggatgggagaaaataagatcttttttctcctaccctatgaatttggcagatacaaaataactgaaggatagtacacttctttattaaaatgcaaatgctttatcgacttag

SEQ ID NO: 55716 - DNA, 601 bp, Human
gctttacaaacttcaaatactattagagacataaagtcccttgaggggaagagaaataaatgaatgagaacattttctccaatcaaaaactgttttctctaaaaacttttagaatgattaataaaatatctaagataagatgttcttatactactccctagcattactccccagaaattatttctatgaattgcactggaaagacttaaaataaaactacagctgggcatgtactccctgtaatcatgcctgtaatcccagcactatgggaggccaaagcaggagtgcttgaggccaggasttcaagaccagcctgggcaaaataaccagacccccatctctttaaaaaaatttttttaattaaattaaactatgcacagtattagagtaaaaattcctgttctctgagcacattctggaagtacaactcccaaaggcgagaacaggccatgtttctgcctccagggaattccatcaatccataaagacaatcagttggcatcatcttggccaacagttcttctgatttactttgtttggtattttgttttgttttgtttttggagacacagtctcactctgtcgcccaggctggagcaca

SEQ ID NO: 55717 - DNA, 601 bp, Human
ggtgtccttgtattacagaagcaccgggaaatagtgaaccaggagatacaggagctgggttttaagcattccatgatctcttattctatgacaggcttgacttatagatcaaatgatgcactatatgtgaaaacgctttacaaacttcaaatactattagagacataaagtcccttgaggggaagagaaataaatgaatgagaacattttctccaatcaaaaactgttttctctaaaaacttttagaatgattaataaaatatctaagataagatgttcttatactactccctagcattamtccccagaaattatttctatgaattgcactggaaagacttaaaataaaactacagctgggcatgtactccctgtaatcatgcctgtaatcccagcactatgggaggccaaagcaggagtgcttgaggccaggagttcaagaccagcctgggcaaaataaccagacccccatctctttaaaaaaatttttttaattaaattaaactatgcacagtattagagtaaaaattcctgttctctgagcacattctggaagtacaactcccaaaggcgagaacaggccatgtttctgcctccaggg

SEQ ID NO: 55718 - DNA, 601 bp, Human
ccttcctcctaacaaactaaccctcttccaagaagtcaaccaccaactttttgggccaaaagccagtgcatatttgtgtattgttgtgttgaaatcatggagcaaccatgttggagaatttcctgtattcaattgtgttttcaaatgttcaaaaggaaacaaagggcacaggttctttaggaatccaaattctcaaagtgttgggaagtgccaagctataaaaggcacatactcttccatctaaacaagataccactatacaatctggacgtgccaacagagggggatttctgcagccctstgaggaagtggtgctgttatgtttcatggtttttatgacctgaagtgaagcagtggcatgtctcagaagtcaccactggacatagcaagaggtgtccttgtattacagaagcaccgggaaatagtgaaccaggagatacaggagctgggttttaagcattccatgatctcttattctatgacaggcttgacttatagatcaaatgatgcactatatgtgaaaacgctttacaaacttcaaatactattagagacataaagtcccttgaggggaagagaaataaatgaatgagaacatttt

SEQ ID NO: 55719 - DNA, 601 bp, Human
cacatgggaaacgttcctaagatctcgctataacatcaatgtctaaattcccagttccacttaaagaaaaaaatcaaatggactcaccctttcattatgtcctttagctgcaacacagcattccaatctcagttacagaacccccacatccctgctggcggtgggccagctccaaaactcgacagaacgcagacaaagcatttgggaacagatgcatttgctgcacagactttaaatttaatcagtgccaaaagaaattactaatatcacacctcatgcaacatggacaaaaatactggcrgggggggtaatgttttggagaagacatagtaagtaattttcacatttaataaatgtgatcctcaagcattctaaataccaatgcataccaagttgacacaaacatctggtacctattccacataattttcagcactctgattccccatatcacccagggttctaatgaggagcgtgtgttcagctgtaataaaagtggtaaagatgcagagggaattaaggggtaacattataggctgggaccaagacatcgcagtggggagattttattctaatgacaccattggctaataaggttttt

SEQ ID NO: 55720 - DNA, 601 bp, Human
acaaaaatatttactgacctgaagacagcacaaattcaaataaactctggtgagaaactccccaggtggcccagaccacggccacactgccaaggccactgccaaaccagcctccttcacaaagcaggcccccaccgctcgggtgctcagcagctgggccacctgaggccacactgtgaagcacatggtggctccctgggccgctgccttgtgtgagaagctgggggttaactcttcatatgtatggttaccacaccactaggggccacacatcttgtacatgtttctgattctcacaatrccactgtgaagacagtgttaatgccctcattttagagtgatgggaaactggagctcatgagaggctaagaaacacatcagcaggaagtggcaataggggatttgaacctgggtctctgagactccagctccagacttttcccctggcagagcaccacctgcctctgccttgtactttccagttcctcgcctcaggactgggtgaacagatgcataggccaaatgtaaacattcattcatatctactaaaataaaataaactgctcggttcacacgtatcacctttggttgacttaaaaga

SEQ ID NO: 55721 - DNA, 601 bp, Human
aaaagtgtgccagcatcacactgctgctgagagagcaaattggtataatttttcagtggtatccaaggccccacaaaaggtacacatcctttgacccagcaacttcccgctaggaattttatcctgaaaaacataactggataagtttgcaaggggtacagaatgtacaagtgaaaaaaattaagacttaagggaggggacaaaaagtccctgtgaaaacacccaggctaaaggacgtaggttaaactctaagtatggggtagagtagtcctctcctaagagaacagacacagtgtaggartcaggggagagggtttcctttgggtaaaaaacaagcctctctggccaagaaaggaaagaggcagtgtgattgtatgaagttttcctttgaatatcttggagagacgctcttctgccaccagctgttccatcgccgccttccaggtaaaatgcctgccaggccttcctggagtgcactatcctttttccatagattttctcaaacacatccatgggttcaactctcatctctttacagaaatgactccaggccatctcagacttacttatttctccttttttttctttttctttttttttt

SEQ ID NO: 55722 - DNA, 601 bp, Human
atccactgggtgaggagagggaaagggtgaccaagcattgtacggtgaacatccagcccaatgcctgggctactgtgccaacactttctgtgaaaataaaaaagtggtcatagatttaggggtgagatctaccgttttgtaacttactttgaaatacctcccaaaaaataagatggattgacagatggagagatatttgataaagcaactattgcaaaatgctaattgtggaatctaaatgttccctgtacaatggtttcaacatctctacatgttgaaacttttcattaaagaaaagttrggagagggaggcaatgcttataaaaaaaattaagcccagaaatgccttaagaaaccttcctcaaaaagtgtgccagcatcacactgctgctgagagagcaaattggtataatttttcagtggtatccaaggccccacaaaaggtacacatcctttgacccagcaacttcccgctaggaattttatcctgaaaaacataactggataagtttgcaaggggtacagaatgtacaagtgaaaaaaattaagacttaagggaggggacaaaaagtccctgtgaaaacacccaggctaaaggacg

SEQ ID NO: 55723 - DNA, 601 bp, Human
tggtgcccgtggagatggagagaaggggacagagttaagtggccagggagagaatccactgggtgaggagagggaaagggtgaccaagcattgtacggtgaacatccagcccaatgcctgggctactgtgccaacactttctgtgaaaataaaaaagtggtcatagatttaggggtgagatctaccgttttgtaacttactttgaaatacctcccaaaaaataagatggattgacagatggagagatatttgataaagcaactattgcaaaatgctaattgtggaatctaaatgttccctktacaatggtttcaacatctctacatgttgaaacttttcattaaagaaaagttgggagagggaggcaatgcttataaaaaaaattaagcccagaaatgccttaagaaaccttcctcaaaaagtgtgccagcatcacactgctgctgagagagcaaattggtataatttttcagtggtatccaaggccccacaaaaggtacacatcctttgacccagcaacttcccgctaggaattttatcctgaaaaacataactggataagtttgcaaggggtacagaatgtacaagtgaaaaaaattaa

SEQ ID NO: 55724 - DNA, 601 bp, Human
catggggcacaccctgatgaagtgacaggacagcgactctttacagagacccactggaggccaggtgcaatggctcatgcctgtaacaccaacactttggaaggccaaggcaggtggatcgcttgagcccaggagtacaaaagcaacctgtgcaatatgatgaaaccccatctctacaaaaaaaaaatatatatatatatacacacacacacacacacacactcacgcatatatatacatatatgcatgcatatatatatatatatgtgtatatatgtgtgtgtgtgtgtgtgtgtgtgtrtataaaagcagttgtggtggtgcacacctgtagtcccagctacttgggaggcaaaggtgggagaatcacctaagcccagggaagtccaggctgcagtaagccgtgatcacactattgtactccagcctgggtgacagagtgagaccctatctcagaaaataaaaataaaaatacagagacttacttggcttgacgtttaaatacactcaacagtgtgttcctgaccatctgacacaatagagtagtatttggttttcgaagttcctcatagaatttttttccctccaagattgaaaaaga

SEQ ID NO: 55725 - DNA, 601 bp, Human
atatgagtcagtccaaggtcaaagaaaagagaaagcaatgcatggggcacaccctgatgaagtgacaggacagcgactctttacagagacccactggaggccaggtgcaatggctcatgcctgtaacaccaacactttggaaggccaaggcaggtggatcgcttgagcccaggagtacaaaagcaacctgtgcaatatgatgaaaccccatctctacaaaaaaaaaatatatatatatatacacacacacacacacacacactcacgcatatatatacatatatgcatgcatatatatatrtatatgtgtatatatgtgtgtgtgtgtgtgtgtgtgtgtgtataaaagcagttgtggtggtgcacacctgtagtcccagctacttgggaggcaaaggtgggagaatcacctaagcccagggaagtccaggctgcagtaagccgtgatcacactattgtactccagcctgggtgacagagtgagaccctatctcagaaaataaaaataaaaatacagagacttacttggcttgacgtttaaatacactcaacagtgtgttcctgaccatctgacacaatagagtagtatttggttttcgaa

SEQ ID NO: 55726 - DNA, 601 bp, Human
ggttatatgagtcagtccaaggtcaaagaaaagagaaagcaatgcatggggcacaccctgatgaagtgacaggacagcgactctttacagagacccactggaggccaggtgcaatggctcatgcctgtaacaccaacactttggaaggccaaggcaggtggatcgcttgagcccaggagtacaaaagcaacctgtgcaatatgatgaaaccccatctctacaaaaaaaaaatatatatatatatacacacacacacacacacacactcacgcatatatatacatatatgcatgcatatatrtatatatatgtgtatatatgtgtgtgtgtgtgtgtgtgtgtgtgtataaaagcagttgtggtggtgcacacctgtagtcccagctacttgggaggcaaaggtgggagaatcacctaagcccagggaagtccaggctgcagtaagccgtgatcacactattgtactccagcctgggtgacagagtgagaccctatctcagaaaataaaaataaaaatacagagacttacttggcttgacgtttaaatacactcaacagtgtgttcctgaccatctgacacaatagagtagtatttggtttt

SEQ ID NO: 55727 - DNA, 601 bp, Human
accctctttaagggctagagctctagccacgggttggttatatgagtcagtccaaggtcaaagaaaagagaaagcaatgcatggggcacaccctgatgaagtgacaggacagcgactctttacagagacccactggaggccaggtgcaatggctcatgcctgtaacaccaacactttggaaggccaaggcaggtggatcgcttgagcccaggagtacaaaagcaacctgtgcaatatgatgaaaccccatctctacaaaaaaaaaatatatatatatatacacacacacacacacacacaatcacgcatatatatacatatatgcatgcatatatatatatatatgtgtatatatgtgtgtgtgtgtgtgtgtgtgtgtgtataaaagcagttgtggtggtgcacacctgtagtcccagctacttgggaggcaaaggtgggagaatcacctaagcccagggaagtccaggctgcagtaagccgtgatcacactattgtactccagcctgggtgacagagtgagaccctatctcagaaaataaaaataaaaatacagagacttacttggcttgacgtttaaatacactcaacagtgtgttcc

SEQ ID NO: 55728 - DNA, 601 bp, Human
atcaaataataaggtactcccaaagagggagggaactagtgccaggaagccttcagtgctgaagatgtgcacttcttgccttagagtctatgctctctgttttgccagagtccagaacagggcaaacaccctctttaagggctagagctctagccacgggttggttatatgagtcagtccaaggtcaaagaaaagagaaagcaatgcatggggcacaccctgatgaagtgacaggacagcgactctttacagagacccactggaggccaggtgcaatggctcatgcctgtaacaccaacastttggaaggccaaggcaggtggatcgcttgagcccaggagtacaaaagcaacctgtgcaatatgatgaaaccccatctctacaaaaaaaaaatatatatatatatacacacacacacacacacacactcacgcatatatatacatatatgcatgcatatatatatatatatgtgtatatatgtgtgtgtgtgtgtgtgtgtgtgtgtataaaagcagttgtggtggtgcacacctgtagtcccagctacttgggaggcaaaggtgggagaatcacctaagcccagggaagtccaggctgc

SEQ ID NO: 55729 - DNA, 601 bp, Human
aagatcttccttaaatcaccatactgctcacctccacactggggcaggggcaaaaactcaatggaaacaaatcaaataataaggtactcccaaagagggagggaactagtgccaggaagccttcagtgctgaagatgtgcacttcttgccttagagtctatgctctctgttttgccagagtccagaacagggcaaacaccctctttaagggctagagctctagccacgggttggttatatgagtcagtccaaggtcaaagaaaagagaaagcaatgcatggggcacaccctgatgaagtgmcaggacagcgactctttacagagacccactggaggccaggtgcaatggctcatgcctgtaacaccaacactttggaaggccaaggcaggtggatcgcttgagcccaggagtacaaaagcaacctgtgcaatatgatgaaaccccatctctacaaaaaaaaaatatatatatatatacacacacacacacacacacactcacgcatatatatacatatatgcatgcatatatatatatatatgtgtatatatgtgtgtgtgtgtgtgtgtgtgtgtgtataaaagcagttgtggtggtgca

SEQ ID NO: 55730 - DNA, 601 bp, Human
ctttccaggtaaactgttccaagactaagtggccaaaaagctagcctatcttctaaaatcccaatctcttaaatttcttttggataatttggtatgtatttgattttttaaattcccttttggactcacaagtcatgaatgcattcctctgggtagaagacacttcccatttaacatttgtgtttaattccttcttccctcttggtagaaaatcagagataaaataaattgcttaaagtcccaataatactatacataaataatattaaatacctaaaattgcacttaacaaaagtataakatacagatcctatcttttcagagcttccctttattagggaaagcaaaacaaacttaagaacaatacagagcaagatgtaacatgtagaggcgatcagggccagagctgtacagcaaaatttgggccagaggtcagaaaaatcctcccaaaagaagtaggatctgagcagagcctcaaatagaaaaagtagagtgctggtcatacttggttcctgcttcttcattccctcttcctctaatcagtcaagccttaaatcctaaatccatccactcctctccatctctacttctttaccaaccc

SEQ ID NO: 55731 - DNA, 601 bp, Human
tttcagtagtcttactcgaatttgttttcagagtcaacaacagtactgcacaatttaacgtcaagaattttctgctgttgctgcttctgtaacagcttggactttcttttccctctgagttcctctgagagaagcatatataaaatgagtaattgtcgctgctaaagaattgctggagtcagcaacgcttcataggagctgcatttcctcctctcctcctttccctctcaccacaaactctcccccatcagttcagaattaaaggcacattactgggataaagaaatctgacctgaaataygagttgcagcaacaatggcaagcaaccaagagtattaacaataatttccaatgttgctggaaaggttagatgatctgtctttgaaatgagccaactctgcacacgttcatgagattaaaatcagcttgcttttccttaacatctcgtgcttctcctcttcctaccaccccaaaaggatggggtggctgaggcacataaacaagtggctctggaaattaactttcttgaccagaagaaagctcaaagataaattccattctgcattacttttcctatacttcactatgatcaggatttttt

SEQ ID NO: 55732 - DNA, 601 bp, Human
ttgagatggagtctcactctgttgctcaggctggagtgcagcagcgcaatcttggctcactgcaacctccacctcctgggttcaagtcattctcctgcctcagcctcccaagtagctacgactacaggcacccgccaccatgccagctaatttttgtatttttagtagagaaggggtttcaccatgttggctaggctagtctcaaactcctgacctcaggtgatccacctgcctcggcctcccaaagtgttgggattacaggtgtgagccacctcgcccggcctccacttttttaaaaaaacatgtaacgtttagcagtcaacctccatttccttctttcccctctagccctaagcaatgactaatttactttgtctctataaatttctgtatcctgaacatttcacatacatggaatcatatgatatgtggtctttgtgtctgtcttttttcatttagtggattttcaaggttcatccatgctgtagcacctatcagtatgccatcctttttactgctcagtaacactccattgtatggatataccatattttatttacccattcatcagaagatgaaaatttgggtttttccacttttg

SEQ ID NO: 55733 - DNA, 601 bp, Human
tagactaattagcatgtcagcaggtcaaacggtttttttaaatagtttcattgagatacaattcccataccataaaattcacccacttaaattacaattcaacagtttttagtatattcacagaattgtgcaaccattaaaattttagaacatttttgtcatctcctccaccttttttttttgttgttgagatggagtctcactctgttgctcaggctggagtgcagcagcgcaatcttggctcactgcaacctccacctcctgggttcaagtcattctcctgcctcagcctcccaagtakctacgactacaggcacccgccaccatgccagctaatttttgtatttttagtagagaaggggtttcaccatgttggctaggctagtctcaaactcctgacctcaggtgatccacctgcctcggcctcccaaagtgttgggattacaggtgtgagccacctcgcccggcctccacttttttaaaaaaacatgtaacgtttagcagtcaacctccatttccttctttcccctctagccctaagcaatgactaatttactttgtctctataaatttctgtatcctgaacatttcacatacatgg

SEQ ID NO: 55734 - DNA, 601 bp, Human
catagaccatatcatgacatatctacaaaaaccaagttatccattgaaaataacaaaaagcattaggtgagtttaagttgaaggagtaagcaatcttggtaaaagtgaattgagccaacgtaaactttatagactaattagcatgtcagcaggtcaaacggtttttttaaatagtttcattgagatacaattcccataccataaaattcacccacttaaattacaattcaacagtttttagtatattcacagaattgtgcaaccattaaaattttagaacatttttgtcatctcctccactttttttttttgttgttgagatggagtctcactctgttgctcaggctggagtgcagcagcgcaatcttggctcactgcaacctccacctcctgggttcaagtcattctcctgcctcagcctcccaagtagctacgactacaggcacccgccaccatgccagctaatttttgtatttttagtagagaaggggtttcaccatgttggctaggctagtctcaaactcctgacctcaggtgatccacctgcctcggcctcccaaagtgttgggattacaggtgtgagccacctcgcccggcctcc

SEQ ID NO: 55735 - DNA, 601 bp, Human
tttccgaaaccaatgattacaaatgagaggtgtgttctcagatgaaaaatacaataggtctactctgacccgaggagaacccagcagggaggccgatgacaaaacattgctttggtactgagggctttttatgtactgttgtaacaagtgtgtttctgatacaaattctctgctggcctataaaactgttcatccaacttaagcgttactgtctccctaaatcttgtcaacctgctgcagttactacttttgggtgtaggctctgtcaccgcctctacacaggaaaattaaaaatctctcyccagctgaagaactttaaggcacctgggaggtaggaatttattaatagtaaaatattagatatggggtgatttataatagatcttgatactgatcttgcaccaataacaagccaaggggaaatggggctgatttagtaattccctcacatttaaggatgacatcatgaaaaccaactactccagtcttcagtcatagtcaattacagcttggagccagcacggtaattgttttgctaatttgtaagtaacggcacttatttcattttgaaaaatatttgcctttaatatttggtagaggc

SEQ ID NO: 55736 - DNA, 601 bp, Human
ttgtctgtgcctgccaaaaagcctggagccaaatttcaaacacaatcataccaaccacataaacccaaatggctcgcaagctgcacccttctttttcccttggtcctcattctgtatttctgcttacactgttggtatgcctgttgctggaggctcatcccaaatcctcttttggaatgaggcagagaagctcatagggttatgagctttttgacgggtgaagttattaaacctggcccctttcccatggtaatggagcctcctgatccccactccacccctacagccaggcactggcacrcccattgctcctttaatgtcaaaacaaatgcataaatttaaatgtccatatcttttctacacatatgtaatggctaacttgggacttatcctcagcagcttttcataataagcaagcaattagataggtcagaaatagaaaagacacaccaccacataaaagcaggtcacaagtaaaaattagatgataggaaacaaaattgttgccattccagcaactaatgaaagtatgttactgtaaacaagcctctaatggtgctgtaacccctctcaggaatcaggaaacgccctgagcaattaa

SEQ ID NO: 55737 - DNA, 601 bp, Human
agtgaccaccaagcctccctttcaggctgacgacaagactggcagaaccaaacaagtgcctggcaggtggctggcccacaggagacacgcagtcttcaccactacggctgctagtattgtcatttgggggatgtgagagctgttaagaggcaagtcgagcagttagcacttgacagtgtttacttccttctctttctccccactgtggtctttcctgccctcaaaaagaaccaaaaaagggacagctttatgccaatcctcagagaaggtacaaagtaaaagtgacttggagccacatgtstgattaaccacacatcccatttgtctgtgcctgccaaaaagcctggagccaaatttcaaacacaatcataccaaccacataaacccaaatggctcgcaagctgcacccttctttttcccttggtcctcattctgtatttctgcttacactgttggtatgcctgttgctggaggctcatcccaaatcctcttttggaatgaggcagagaagctcatagggttatgagctttttgacgggtgaagttattaaacctggcccctttcccatggtaatggagcctcctgatccccactccaccc

SEQ ID NO: 55738 - DNA, 601 bp, Human
gtagctagtttaatgtttttgctctcacatatgtactctcccaaaacccagccttgagattttgtatcagttcttttagtggtgttgggcaaggcacacccactcctccccaagcactgtattatctgaatctcgataatcgagggggaaaaagagaaaaggtgttcgtgtattaatattgtggaaatggggaaggattacatatagataggtaggtaggtagataaagatctccaaaatggtcaatctttgaattgccaaattcctcaatgtaagcaaaaagatgtcaaatcagatggcraagtctgaatactgaagctcttgcatatcattcttagcaagaagagtcagttaatatgctagttctctcttaccacacagttaaaacaagtttggatacaagacgtagtaaattataagcagaggacaggtgagctatttgtgtgaacacagctgaaggcctgggggtggggggaatgtttaactatgaaaacagacaagaacataaaaggccccttggtggtgccatttagcatggggattagcagccacatagagcacaatggctcctgagctcagccctgcattttataattactga

SEQ ID NO: 55739 - DNA, 601 bp, Human
cagggtaaaaaatgccccagatagagaaaagaatgtagctagtttaatgtttttgctctcacatatgtactctcccaaaacccagccttgagattttgtatcagttcttttagtggtgttgggcaaggcacacccactcctccccaagcactgtattatctgaatctcgataatcgagggggaaaaagagaaaaggtgttcgtgtattaatattgtggaaatggggaaggattacatatagataggtaggtaggtagataaagatctccaaaatggtcaatctttgaattgccaaattccycaatgtaagcaaaaagatgtcaaatcagatggcgaagtctgaatactgaagctcttgcatatcattcttagcaagaagagtcagttaatatgctagttctctcttaccacacagttaaaacaagtttggatacaagacgtagtaaattataagcagaggacaggtgagctatttgtgtgaacacagctgaaggcctgggggtggggggaatgtttaactatgaaaacagacaagaacataaaaggccccttggtggtgccatttagcatggggattagcagccacatagagcacaatggc

SEQ ID NO: 55740 - DNA, 601 bp, Human
aacaatgtttcaatcaacaagggaccacatatacaacggtggtctcataagattatagtaccataattttcctgtacctttttgacatttaggcatgtttaggtacacaaattcttaccattgtgttacaattgcctacaatattcagcatagtaacatgctgtgcacatttgtagcctagtagccatgggctatatataccatatggccgaggtgcgtagtaggacataccatctaggtttgtgtacctacactatgatgtttgcacaacacaatcccctaacaacacatttctctgaaygtgtctctgtcatgaagcaatgcatgacagtatctgttaaggactggtggaaaactaaatgaccatttcagaggtaatcttccctgtcaagctgggtgatttccagaacagcttccttttaaacaaacaccaggcagtgcttatatgcggaatgtatttgtttagaaaccaaatttcactgatatacagtgtctgtgtgtgaggggtttcctttgacacttgcttagtacataccacataaaaggtatctcaaacataaatagccctgggttttttgttttttctgcatatgcacaggac

SEQ ID NO: 55741 - DNA, 601 bp, Human
cactttttctaaaagtccaagactgcatttttggagagttcctattggagagttagctggaattttagattgaacatcttgccccaaagtgttagacatcatccttgactagtgtgaccagtgccagctctcgcttgcattgtcctctgttgtgacagctagcagatgcattgccttgctgtccctaaccctgctcccctttccaggcctggactggcaccttcacacgacctagcagggtgtcattgtttaaattgcattgagtgtcttcaagtaaaggagtaactctttttatataatrtgagtgtcctattcattcaggccctccaatcctatgtggacagacagattcagttgcctttgtaggtaatgaaatgatttctatagtaatactcaaataaatggggaagggaagaaaggagagaggaaatgggcaggtggggagagacagagaaaaaagagagagagagagaaatagtacaggcatgggccacataacaatgtttcaatcaacaagggaccacatatacaacggtggtctcataagattatagtaccataattttcctgtacctttttgacatttaggcatgtttaggta

SEQ ID NO: 55742 - DNA, 601 bp, Human
aaaacaccatactggttggaaaatgctgctgctggacaaattttaaaaggggtcagctgggcacggtggctcacgcctgtaatcccagcactttgggaagccgaggctgacggatcacaaggtcaagagatcgaggccatcctggccaacatggtgaaaccccgtctctactaaaactctactaaaaatacaaaaattagctgggcatggtggcgtatgcctgtagtcccagctactcaggaggctaaggcaggagaatctcttgaacccaagaggcggaggttgcagtgagccaagatcrtgccactgcactccagcctaggcgacagagtgagactcgtctcgaaaaaaaaagggggtgtcaaggcagtctctatctgggggaagaggcaataatgacaggtttttacaatctgtccagccagcatagaacataaatcggcattacctcattctaaaaaggccgagtccaaccaggctcagtccctctgccggggcaggggctgtactttcctggggcaactttacagcatctggatattactgtgacgaatgacaggatttaagtgacgtgaccaacctgcatcttggtaggaacgtt

SEQ ID NO: 55743 - DNA, 601 bp, Human
cagcactagggtcaggagaactggcctgggagggttcttaaattctattttagagagaataaaaattactgttagctagcagttgactgtacctataccggccctaagtgccacagagacatttctcaatggtcagtgaaccctctaaagaagtgctactagctgggcacagtggctcacgcctataatccccgcactttgggaggctgagacaggcagatcacgaggtcaagagattgagaccatcctggccaacatggtgaaactccgtctctactaaaaatacaaaaattagctgggygtggtggcacatgcctatggtcccagctactcaggaggctgaggcaagagaatcgcttgaacccaggaggcggaggttgcagtgagccgaggtcacgccactgcactccagcctggtgacagagcgagacgccatctcacaaaaagtaataattaaaaaaaaaaaagtgctattaacatctccattttacagatgaggaaacagggcttagggaattaagtaactcacccagggtcacacatggggagtggcagagctgagactagccctgtatctaacatgggagcgaaccacagtgac

SEQ ID NO: 55744 - DNA, 601 bp, Human
taagcccagggggaggctcaggaatctatacatcaagggatccgatgcaggggcttcacacagcacacacactttgagaagccgatccacaggattaagtccaaatccttacgtggcctttccagtctcatcttccactcagccccagcctacccccttcattgtcttcatcctctattacaggaattgccaagctcttcctgcaaagggctgaatagtaactatttaaagctttgcaggccatgcaggtctctgacacaatactcaactctgccacagtagtgagaaggcagccatagayaacatattatcaaatgggtgtggctttaaaactaataaaactttaaaaacaggcatcggactgatgaatgcattaacaaaacatggtatagccacacaatgaaaactacccaggaataaaaaggaatgaaacaactgatacatgctacaacatcgaggaacctcaagtgctttacgctaagtgaaagaagctagacacaaaagatacatattgcatgatcccattcatatgaatgtgcagaacagataaatctagaaagtagattagtggctaccttgggctagtgccgggtcgtggggg

SEQ ID NO: 55745 - DNA, 601 bp, Human
taatacaataaaacatataattccatactgtgggaaggcacaggttgtggtagggggaagaagattcagagcgatgtttagaaaagaaagaaatggaggagggtaaagcaatcaggcaagggtttggtgaagagctaagacctaagcatgggcttccaaagtggcaagaattgagagactgaagaaagaagtccaggtggaattaagaataagggcgtggggcaaggggtttagctggtaagcccagggggaggctcaggaatctatacatcaagggatccgatgcaggggcttcacacascacacacactttgagaagccgatccacaggattaagtccaaatccttacgtggcctttccagtctcatcttccactcagccccagcctacccccttcattgtcttcatcctctattacaggaattgccaagctcttcctgcaaagggctgaatagtaactatttaaagctttgcaggccatgcaggtctctgacacaatactcaactctgccacagtagtgagaaggcagccatagacaacatattatcaaatgggtgtggctttaaaactaataaaactttaaaaacaggcatcggact

SEQ ID NO: 55746 - DNA, 601 bp, Human
ttcaaacctggctcagatcaaatgagcaacccaagggagctgcatagagttgaaaaccatttatagctttttacccagctgacggaaaggactaactagtttactagcagatgactaaaacccctcagagtaaagaagaatgtaacaaagatttagaaatgggctagggaaaagactgaacaaagatctgcagtttagagtaaaaaataagattaattaaaagagatttaattaaaaaagtaaatcaaagcagtcatacaaaatggaggacacctgcttagctccaatgttgaggggcctrgggaccaaacactaagtccactaatagaatgcaaagcaaataaagatgcactatgcaaaaggaaagtcatttaagaagactttcagttatactctaaataacatccttggtgccatgcaataacccaatttgcataatgcaaaaaaagacccaagacctagttcctgcccgaaagcagtccactcaccagctgagtgtgcagaattaacacacacgattcagcagcaagtaatacaataaaacatataattccatactgtgggaaggcacaggttgtggtagggggaagaagattcagag

SEQ ID NO: 55747 - DNA, 601 bp, Human
agtgttaaatttacctaagactcccagagagtcaatgctcttcaggaactattctgaggcagaaatttcaatataacttccacctcatgaaaaaatccaactgtaggtcattaaaagaccccaggggcatggcgagggctgagaggtacgacagctcactttcgaccttttgttgctcaggcctctcagcagttgctatacctctctgcccctctcccccaaggcacctcggtatgtgctcacatcactggtagtgaggccacacctcactctgggagggggactcaccttttaagaagamatcgatgcagcttccacgtaaacgggtccacaggcatgcagtccctaacctgtggcaagcccagtgctaggcacagagaaccgacagccacatcaccgacttgctggagcaaattcaaaatggatcagatgtgtgtacacatgtatcaacaaatagaagttaagccataatgggcacaaggggacacttcagctccgggcaagagttaggctatggtagtgaccttggatcctaaagctgggctctgtccttgcttcacagtgagaatcagtaacacctcatctcattagctctcttatc

SEQ ID NO: 55748 - DNA, 601 bp, Human
cggaatcatgtgtgtcccaacggacctttggctcccttggaccagggctttctcctttaccttcagaaactgctgcctcccaaggaaagcactgcttgcacatcgactgacctgaggttgagaggaggagcagaggaatgtggaaaggattgtttttaccttcattaagtgttaaatttacctaagactcccagagagtcaatgctcttcaggaactattctgaggcagaaatttcaatataacttccacctcatgaaaaaatccaactgtaggtcattaaaagaccccaggggcatggcragggctgagaggtacgacagctcactttcgaccttttgttgctcaggcctctcagcagttgctatacctctctgcccctctcccccaaggcacctcggtatgtgctcacatcactggtagtgaggccacacctcactctgggagggggactcaccttttaagaagacatcgatgcagcttccacgtaaacgggtccacaggcatgcagtccctaacctgtggcaagcccagtgctaggcacagagaaccgacagccacatcaccgacttgctggagcaaattcaaaatggatcagatgtg

SEQ ID NO: 55749 - DNA, 601 bp, Human
acacagtaatagcaccaagccagagaaagtgtttaggaaatgtatttaagaacacatgacaaaacaggacgaaaaattgcccttgtacattgctctaaaacacatttaaaaaaaaaacctcacagcaagtcaagggcccatatcactttgctgatctctaataaacatagatcatttccatatttggaaataggctggcctttttattttaaatgcaaataggagagctgaatcaagaaaaagtaacttggagtaggctttgaaagattttatgatttgggaaatttgaagagcttccaamtaaaatactgggaattagatcttaacagcattaaaaatgaacacaaaagattcttttagaaaaataattgttcacaatggtaatattaccatttcatttagattctcactatcttaacaaccactggaaaaatgagtggaatcttcaaaccttatgaaagcaggaatcaaaaataaactgcaacacatgggctgacaacataccgagagcaatgaagggcctgcgtgaaagccctcacggggatgctgggctcagcaggaagaactcgcagcaaggaagaagcagagccccctggccaaa

SEQ ID NO: 55750 - DNA, 601 bp, Human
ggatatatctttgggggccattatttagcctatcacagtcaggaataccacaaataaaaacaataaaacgtacaggtgtggataaacagtgagcaaagcttttcccttttacatgagaatttgatcttctgttaactctctcaattctgtaaccctggtaatctggtaagacaatatgtcaattataacacaaggcagcttgctattgggactggaaaattttaagacatctgataagaagtgacatctgggggcttccctgagagcagtgattcttgtaaatggggcatatttatgagasagagtaccatgaaaactattcctacatagttgcctactagttcccgcaagggtctaaggctttttttttttttttttttttttctgacatggagtttcactcttgttgcccaggctggagtgcaatggcatgatattggctcactgcaacctctgcctcccgggctcaagcgattctcctgcctcagcctcccaagtagctgagaatacaggcatgcgtcaccatgcctggctaattttgtatttttagtagagacgggtttcaccattttggttaggctggtctcgaactcctgacctc

SEQ ID NO: 55751 - DNA, 601 bp, Human
gatatgacatctgagcaaacacaggaagtcatggataataatgccaaggactgtggccctggcaactgtgtggtagcgtcctttacagagctggggaacacaggagtaaacaaactggagacaggagggagcatggaactcaaactaatgtgagtgtgtgctcatttcccatactgctgtaacaaattaccataaactgggtggcttagaacaacagaaggctattctctcacagttctggaggccagaagtccaaaatcagcattgctaggccaaaaccaaggtgtcagcagagccacaygccctccagaggctccaggagagaacctgttcccagcctctttcaggttctcgtggctgctggcattctttggcttgtgggttccagaccaccaatctctgcctgcatggtcacacagtcttcccttttgtctgtgtcatcaaatccctgtcttataaggatacatgtgactgtatttaggggccaccagataatccaggataatcctccatctcacaattcttaatttaatcacacctgctaaggctttttctatataaaggcaacattcccaggtttaggggttagaacgtggatata

SEQ ID NO: 55752 - DNA, 601 bp, Human
ctcctaagagggatgggccagaggcccactgcctctcaagtaaaaatgtgatggtgggtcagaccgaaggtggtggtcagaagtgggcagattcagaatatggtcttagggtagaacaaataggattggatatgacatctgagcaaacacaggaagtcatggataataatgccaaggactgtggccctggcaactgtgtggtagcgtcctttacagagctggggaacacaggagtaaacaaactggagacaggagggagcatggaactcaaactaatgtgagtgtgtgctcatttcccatrctgctgtaacaaattaccataaactgggtggcttagaacaacagaaggctattctctcacagttctggaggccagaagtccaaaatcagcattgctaggccaaaaccaaggtgtcagcagagccacatgccctccagaggctccaggagagaacctgttcccagcctctttcaggttctcgtggctgctggcattctttggcttgtgggttccagaccaccaatctctgcctgcatggtcacacagtcttcccttttgtctgtgtcatcaaatccctgtcttataaggatacatgtgact

SEQ ID NO: 55753 - DNA, 601 bp, Human
ttatctcagcccagctgtagttgattacatctatttggttaagtttctatctcgtgtatttagggcgatgagatgtttctacgtctccgtactttctgttacaggtgttgctctttgtccctggatgcacggtgaccgtgagctccgagggctgcctgtctcctcactcctgcaatgctttgcaccggtgcccagttcacaaaggcagctgcagctgactgtccaactgcctggttctaatttatgtggagagaggcctccactcaacaaactgaaataattagttcttctaatcttctgyatttcaataaataaaagaaagacagggaaagattcacatgtactctgtcctgacgaaacagtagagctctttggaaaatcatgaaatttttactgtgcaaggcagtaagatataagcaatgaaactcaaaagcattttcccaagtattcagagaccagatctgcccccagatctgtaaatcctacttaatctaggttaaaaaaaaaaaaaaaacacacataagaagacatgagacacccttagtttacatttcagctcttaggtggttccttattcactgaatgctgagggtttctttaa

SEQ ID NO: 55754 - DNA, 601 bp, Human
aggttttgctccccaaatctcaccgtagttctggagacttctgaatctaacaaacaaaggtcctgggaagaccacattcattccacacctgaccccaacaccacatctactctgaggttaccccaaatctctgaacaaaaactcaatcacctgtgctcgctgcctttcctccctggcaggtaccttccaaaaaaataggaacataggaagtgccaaagcaaggaactgcttccaaggcagctgacatcactggattgtgaggtaaagctagaggtttctcccaatctgtagtggggaaatytggggacaaacatttatcttcagaggcctgtctacactgccccttccagtgtcacaggctgtcacaattcacctggctttgaagacctgtggtgttcagctgaagaccattctcccagcatcaacaccaacaggcaaaaccatcagatgaagctttcacagctgccaaggtacttgctgtcctcaacatatttcatactcaactcggctctattttatttaccagtctcctcccctagtcttggaaaattctcctttcagccctctgccaaaccacatccccatttcaaacctttccaat

SEQ ID NO: 55755 - DNA, 601 bp, Human
acaggtgcttaataaataatgatttcattattgaataaatgcctaagccttgggaaagcccaccttgcccagagccactcagagtgcatgtcaactccatctataggaagtgtgttgtgaattcaaggttaggttctaccaattatttcccagctcatgaccttgggtagaatacttaacctctcttagcctcaatttccacacctgtaaaacagagctaacagaatctcccttccaggggtgttgaaaaaaacaaataaaatgccaggttttgtaattctctggaaagaagcctaccagygtttgactttggctctgatcagtgtagtgccattacctcctgcctacaggtccctggattttcaagcagggtgacaaattggtggcagctgcatacatgaccctccaaacacttggcttcctcatgaggaactaatggttgttctgtcatttgtctgcttttccttcacctttgggatttggagctcattaaagacgagggccgaaaggtagcacaaacatcaacatctttgctagttgttcctgttcaggcaccactaacctggacaagctcaggttttgctccccaaatctcaccgta

SEQ ID NO: 55756 - DNA, 601 bp, Human
aaaatactaacctgtttccaagctattcagcaatattttggcacaggtaatccagtaagagaattgtttgtatagaacagagctgatgttaataacagggtgccctaacctgcccctctttctaagctcttcacctatagatgacagcccagctattcacatttaactcttacctgatggctgtttcattgcagctcaaagacttacctgcatatgattaagtcaacacgcaacactgggtgcaacatctaagcccacatttaagcaaagtaaagagcttgagatcatctaaatgggagcrggagcaagggagaactcactatccactgtgtttttgttacctttggcaaattctcaagggtagggggtcaggactgccagtgcctggcactgtgcctgacacattacaaacaggtgcttaataaataatgatttcattattgaataaatgcctaagccttgggaaagcccaccttgcccagagccactcagagtgcatgtcaactccatctataggaagtgtgttgtgaattcaaggttaggttctaccaattatttcccagctcatgaccttgggtagaatacttaacctctcttagcc

SEQ ID NO: 55757 - DNA, 601 bp, Human
gtctttcttttgtctgttttgctaaagggcaaaatactaacctgtttccaagctattcagcaatattttggcacaggtaatccagtaagagaattgtttgtatagaacagagctgatgttaataacagggtgccctaacctgcccctctttctaagctcttcacctatagatgacagcccagctattcacatttaactcttacctgatggctgtttcattgcagctcaaagacttacctgcatatgattaagtcaacacgcaacactgggtgcaacatctaagcccacatttaagcaaagyaaagagcttgagatcatctaaatgggagcgggagcaagggagaactcactatccactgtgtttttgttacctttggcaaattctcaagggtagggggtcaggactgccagtgcctggcactgtgcctgacacattacaaacaggtgcttaataaataatgatttcattattgaataaatgcctaagccttgggaaagcccaccttgcccagagccactcagagtgcatgtcaactccatctataggaagtgtgttgtgaattcaaggttaggttctaccaattatttcccagctcatgac

SEQ ID NO: 55758 - DNA, 601 bp, Human
caacctactcaagacatgcaagaattcaagaccaaatcagaatgcatcccagagttcacctgattctgccagcaggagccctgcagtgctgaatttctgggcatgtgaatgatacattgttgtactgaaacattcattttccaagattcctttccaaattcaactccatggtctttcttttgtctgttttgctaaagggcaaaatactaacctgtttccaagctattcagcaatattttggcacaggtaatccagtaagagaattgtttgtatagaacagagctgatgttaataacagggygccctaacctgcccctctttctaagctcttcacctatagatgacagcccagctattcacatttaactcttacctgatggctgtttcattgcagctcaaagacttacctgcatatgattaagtcaacacgcaacactgggtgcaacatctaagcccacatttaagcaaagtaaagagcttgagatcatctaaatgggagcgggagcaagggagaactcactatccactgtgtttttgttacctttggcaaattctcaagggtagggggtcaggactgccagtgcctggcactgtgcctgac

SEQ ID NO: 55759 - DNA, 601 bp, Human
ccccaagtcttcagaatttagggtcagctcttttaatcactagataagaacacagaaatgtaaagaaatgccaagaaacaacttcttactccgcagggccccacgtgatccaaccctcaatgaccaatcgcacctcccaccactctcccccttgctaactccactccagccatactggcccctctctcatctccaacaagctgcttccaagctgagggcctgggccctttatttggcctcttcttcacccagatctcggcatagttcacgccttttcaccgttcaggtctcagttcaagcrcgcttcctctaagaagcccttcctaaccaccctaacaaccaactcttcctgtcacttgaatacccaggtagctccacaacttggtgctgggaaatcctttcatttacatttttataaaattgaagggaaaagacacaaagcctgttggcatctatcccaagaatatctcctgggcacttctaagtaaaggccactgccagcaaaacaaaaataaccaactttcaacctactcaagacatgcaagaattcaagaccaaatcagaatgcatcccagagttcacctgattctgccagcaggag

SEQ ID NO: 55760 - DNA, 601 bp, Human
gttgttagcaaacacggactccccaagtcttcagaatttagggtcagctcttttaatcactagataagaacacagaaatgtaaagaaatgccaagaaacaacttcttactccgcagggccccacgtgatccaaccctcaatgaccaatcgcacctcccaccactctcccccttgctaactccactccagccatactggcccctctctcatctccaacaagctgcttccaagctgagggcctgggccctttatttggcctcttcttcacccagatctcggcatagttcacgccttttcaccrttcaggtctcagttcaagcacgcttcctctaagaagcccttcctaaccaccctaacaaccaactcttcctgtcacttgaatacccaggtagctccacaacttggtgctgggaaatcctttcatttacatttttataaaattgaagggaaaagacacaaagcctgttggcatctatcccaagaatatctcctgggcacttctaagtaaaggccactgccagcaaaacaaaaataaccaactttcaacctactcaagacatgcaagaattcaagaccaaatcagaatgcatcccagagttca

SEQ ID NO: 55761 - DNA, 601 bp, Human
gtaaaagtctgaaagaaacaaaaggataaaaccaaaaatgaaatttatatataataaaatcattgacttctagtgagaaaggagattttacagacattctactccaaatgtttgttatagataaggaaattgaagcccaaagaggtcatgagttgcccaagttctgtagctggttatggcatggttgggactagagcccaaatatccactctagtaatctagtttctacttcccttgccagtggaactattcgcatttctccttatagaaccaattctccgttgttagcaaacacggactmcccaagtcttcagaatttagggtcagctcttttaatcactagataagaacacagaaatgtaaagaaatgccaagaaacaacttcttactccgcagggccccacgtgatccaaccctcaatgaccaatcgcacctcccaccactctcccccttgctaactccactccagccatactggcccctctctcatctccaacaagctgcttccaagctgagggcctgggccctttatttggcctcttcttcacccagatctcggcatagttcacgccttttcaccgttcaggtctcagttcaagca

SEQ ID NO: 55762 - DNA, 601 bp, Human
tcactggtaaaagtctgaaagaaacaaaaggataaaaccaaaaatgaaatttatatataataaaatcattgacttctagtgagaaaggagattttacagacattctactccaaatgtttgttatagataaggaaattgaagcccaaagaggtcatgagttgcccaagttctgtagctggttatggcatggttgggactagagcccaaatatccactctagtaatctagtttctacttcccttgccagtggaactattcgcatttctccttatagaaccaattctccgttgttagcaaacasggactccccaagtcttcagaatttagggtcagctcttttaatcactagataagaacacagaaatgtaaagaaatgccaagaaacaacttcttactccgcagggccccacgtgatccaaccctcaatgaccaatcgcacctcccaccactctcccccttgctaactccactccagccatactggcccctctctcatctccaacaagctgcttccaagctgagggcctgggccctttatttggcctcttcttcacccagatctcggcatagttcacgccttttcaccgttcaggtctcagtt

SEQ ID NO: 55763 - DNA, 601 bp, Human
aagcaaaggaatagagaaaagagtgaaatcagaactagtgagtggacttggttactgtaagatcactggtaaaagtctgaaagaaacaaaaggataaaaccaaaaatgaaatttatatataataaaatcattgacttctagtgagaaaggagattttacagacattctactccaaatgtttgttatagataaggaaattgaagcccaaagaggtcatgagttgcccaagttctgtagctggttatggcatggttgggactagagcccaaatatccactctagtaatctagtttctacttcycttgccagtggaactattcgcatttctccttatagaaccaattctccgttgttagcaaacacggactccccaagtcttcagaatttagggtcagctcttttaatcactagataagaacacagaaatgtaaagaaatgccaagaaacaacttcttactccgcagggccccacgtgatccaaccctcaatgaccaatcgcacctcccaccactctcccccttgctaactccactccagccatactggcccctctctcatctccaacaagctgcttccaagctgagggcctgggccctttatt

SEQ ID NO: 55764 - DNA, 601 bp, Human
aattttaaatcccatttttgtttaggatcccatttttgtttaggatctaaagggtacctttagattgttgctgaattaccaaggaatatcttgcatggtgagaaaaatcaaactctagccctcaaccctaaatctcctagacttgaggagtttgttccttggctttgtccccaggtcatagtccctcaataaacacttgttgagtttggggtataaccataaactatcaatgaattaagcaactgagctaggagccttgagcatttctataaggaacaacttatagggcctggtaattctkgtcctggttacattattttatgtaaaagtctgtaagttctatccataattctctactgtgtaagaaatgagctgaattaagcctcttatctatccctctactttatcatctctaaggtgaaaacaagttaccattgtagaatggtgtacaatgtctttctgagatgccctcttaaatcttggcaagacctaccaatacaatattagcatcttcagtacacatttcagacaattttaggtcagaatctctctcattcttttcaaagaagaaagtaagtaaattgttggcatgaaattttag

SEQ ID NO: 55765 - DNA, 601 bp, Human
gcgtggtggcgggcacctgtagtcccagctactcaggaggctgaggcaggagaatggcatgaacatgggaggcggagcttgcagtgagccgagatcgtgccactgcactccagcctgggtgacagagcaagactctgtctcaaaaaaaaaaaaaaaaaaaaggtaaataatgcaaataatatatgaatactacacaaactgtgaagactaatagcacatataaacttatatttgggaagcaccactaagtaatgaaaggacttcaaatgtgagtcagacacaatacctgccctcaagaagytcacagtttgatgggggcagagggacaggcagatacaaacacatctgtgggcagcaggaagggggcacttcagctgggccagagggtgaatggggaaaggtggatctaaggggtccagacaaggaggagggcagtggaggcagcatgagtgggtgtgaagaatacttaattcagacggagctaaggaaatacaaaaaagaataaagaagaatgtcgttgaaagggtactggagccagatcacaatgagccttgaaagccaagcttaaccagttaatgaaagacgatcatttgcttttcag

SEQ ID NO: 55766 - DNA, 601 bp, Human
ggttaataagcgtgaagttactaaactaacagggaaaagaggttctcatgttatgttttgcgcatttactattcattcctcagaaactgaatggctactatgtgtaaagcactttactcagtcaatccttcccaaagtgtggagataataagaatgttttaagatatactttatgtatatatatttttacaggaattaaaaacatgatttcatgtttaggaagttgaggatgaagctaaagtcattttttaagtgagtagatttaagaaaaaatattatgggccggacacggtggctcacrtctgtaatcccagcactttggaaggccgaggtggatagatcctgaggtcaggaggtcaagaccatcttggctaacacggtgaaaccccgtctctactaaaaaatacaaaaaaattagccaggcgtggtggcgggcacctgtagtcccagctactcaggaggctgaggcaggagaatggcatgaacatgggaggcggagcttgcagtgagccgagatcgtgccactgcactccagcctgggtgacagagcaagactctgtctcaaaaaaaaaaaaaaaaaaaaggtaaataatgcaaataa

SEQ ID NO: 55767 - DNA, 601 bp, Human
ccctggattaaaaaaaaaaaaaagagtgggtgatttttctcataaaaccctaaatagactttatcccatgctgaacttacatagactgattcctacagatttaagaaaaaattacctaaactttattaaacaccaaatgaaaaaaatcacctgttctagtctctgatctgccaccctaaatctatactgcagtttacataataaataagaaactacagcatactatttctacactctatagaagcagcaaatatagagtatagtaactaagacagaaatctcttcatggatttataagagscttcaatatttattagtatgattaatttaattattaactatgttaactatagcttgaatatataggaacttgttctttttaaagaaactcaaattggtctacctgagtaatcttacaatatcctcaaaaattaggttaaaaaatatacaattcccattagcaaatttatagaaaaatccttcagacctctgttatgttggcagtacacaatgcattcctaaaaaacacttagtggtagtgagaaatctgtaacttaaactgccccaaacaggaacactgagaaatacaacaacaaccatg

SEQ ID NO: 55768 - DNA, 601 bp, Human
tgcccatgctagaacaactgttgatcccaaccctggattaaaaaaaaaaaaaagagtgggtgatttttctcataaaaccctaaatagactttatcccatgctgaacttacatagactgattcctacagatttaagaaaaaattacctaaactttattaaacaccaaatgaaaaaaatcacctgttctagtctctgatctgccaccctaaatctatactgcagtttacataataaataagaaactacagcatactatttctacactctatagaagcagcaaatatagagtatagtaactaaracagaaatctcttcatggatttataagagccttcaatatttattagtatgattaatttaattattaactatgttaactatagcttgaatatataggaacttgttctttttaaagaaactcaaattggtctacctgagtaatcttacaatatcctcaaaaattaggttaaaaaatatacaattcccattagcaaatttatagaaaaatccttcagacctctgttatgttggcagtacacaatgcattcctaaaaaacacttagtggtagtgagaaatctgtaacttaaactgccccaaaca

SEQ ID NO: 55769 - DNA, 601 bp, Human
ttgctaggctggactgcctgccctggtgcaaaggtctggagagaaactcatagcacattttccaaaacaaccatttcaaatttgctctaagagcagaccagggtaaaaatgtatgccattatatcaagttaccctgcccatgctagaacaactgttgatcccaaccctggattaaaaaaaaaaaaaagagtgggtgatttttctcataaaaccctaaatagactttatcccatgctgaacttacatagactgattcctacagatttaagaaaaaattacctaaactttattaaacaccaawtgaaaaaaatcacctgttctagtctctgatctgccaccctaaatctatactgcagtttacataataaataagaaactacagcatactatttctacactctatagaagcagcaaatatagagtatagtaactaagacagaaatctcttcatggatttataagagccttcaatatttattagtatgattaatttaattattaactatgttaactatagcttgaatatataggaacttgttctttttaaagaaactcaaattggtctacctgagtaatcttacaatatcctcaaaaattaggt

SEQ ID NO: 55770 - DNA, 601 bp, Human
atggtttagcaccatccccctagtgctgttctcatgagagagttctcacaagatctggctgtttaaaaatgtgtagcaccttgcccttcactctctcttcctcctgctccatccatgtaagatgtgtctgctttcccttcgccttctgccacgattgaaagtttcctgaggcctccccagaagctgctatgtttcctgtactgcctggagaattgtgagccaattaaacctcttttctttataaattacccagtctcaggtatttctttatggcaatgtgggaatggactaatacatgaawcaacacacacattttaaagcataatttcatctcttccaagatctacattttcttctaagttggccacatctcccgtaacccaatcctttgggtcactctgccttcctttctaaattacaggcagtttgacctggtggttaagaacagtgactcagagccaggcattaggttggaatctcagctctccacctacccaccctagggcctcgaggatgttaagactctactcacatcagtttcatcaattgtaacatggggataataattgtatctattctatcagatgtcaaagggttaaat

SEQ ID NO: 55771 - DNA, 601 bp, Human
ataggggtagtttctcgtgaatggtttagcaccatccccctagtgctgttctcatgagagagttctcacaagatctggctgtttaaaaatgtgtagcaccttgcccttcactctctcttcctcctgctccatccatgtaagatgtgtctgctttcccttcgccttctgccacgattgaaagtttcctgaggcctccccagaagctgctatgtttcctgtactgcctggagaattgtgagccaattaaacctcttttctttataaattacccagtctcaggtatttctttatggcaatgtgrgaatggactaatacatgaatcaacacacacattttaaagcataatttcatctcttccaagatctacattttcttctaagttggccacatctcccgtaacccaatcctttgggtcactctgccttcctttctaaattacaggcagtttgacctggtggttaagaacagtgactcagagccaggcattaggttggaatctcagctctccacctacccaccctagggcctcgaggatgttaagactctactcacatcagtttcatcaattgtaacatggggataataattgtatctattctat

SEQ ID NO: 55772 - DNA, 601 bp, Human
gcctaatgggaggtgactgcattataggggtagtttctcgtgaatggtttagcaccatccccctagtgctgttctcatgagagagttctcacaagatctggctgtttaaaaatgtgtagcaccttgcccttcactctctcttcctcctgctccatccatgtaagatgtgtctgctttcccttcgccttctgccacgattgaaagtttcctgaggcctccccagaagctgctatgtttcctgtactgcctggagaattgtgagccaattaaacctcttttctttataaattacccagtctcrggtatttctttatggcaatgtgggaatggactaatacatgaatcaacacacacattttaaagcataatttcatctcttccaagatctacattttcttctaagttggccacatctcccgtaacccaatcctttgggtcactctgccttcctttctaaattacaggcagtttgacctggtggttaagaacagtgactcagagccaggcattaggttggaatctcagctctccacctacccaccctagggcctcgaggatgttaagactctactcacatcagtttcatcaattgtaacatggg

SEQ ID NO: 55773 - DNA, 601 bp, Human
ctgctagtgccctcagcaggccactactgatgcaagtctgaggacacagacaggcacttttctatcattctttggcattaagataggttgtgtgaatggggtactgtgtacatcactaacacaccgcagccttgcaggattctggcctaaagtgcaccacagtgctccggatggacttgtgggtccagctcacaatgccatctccagtaaaatctttccccctccctcagacagagccagagctctctcagacagcactggtgtttctacctctgcctctgcctggcactataatgaactrcttagatcaagcttgtccaacccacggccacatgctgcccaggatggctttgaatgaggcccaacacaaattcgtaaactttctcaaaacattatgagatttcttttgcaatttttttttctttttcgttcatgagttttcattagcattcatgtactttatgtgtggcccgagacaattcttccaatgtggcccagggaagccaaaagatcggacgccctggtttggatgtttgtcccccctgtcacagtataaattcctcaggtcattcttcaagggcagaaactgagtcacactcat

SEQ ID NO: 55774 - DNA, 601 bp, Human
agctcatataaacagaggagtatttatgaaactacaggtcatgaccttctaaaggggtcctgggagccgttgcaaggagattccagagacccaggcccttccttcccagagcagccacagctcccccggctgcggagaagagaggcaggcaaagcggagaccctgatgtgtgggtggttcgggtggaggaacgctgctagtgccctcagcaggccactactgatgcaagtctgaggacacagacaggcacttttctatcattctttggcattaagataggttgtgtgaatggggtactgtrtacatcactaacacaccgcagccttgcaggattctggcctaaagtgcaccacagtgctccggatggacttgtgggtccagctcacaatgccatctccagtaaaatctttccccctccctcagacagagccagagctctctcagacagcactggtgtttctacctctgcctctgcctggcactataatgaactgcttagatcaagcttgtccaacccacggccacatgctgcccaggatggctttgaatgaggcccaacacaaattcgtaaactttctcaaaacattatgagatttctttt

SEQ ID NO: 55775 - DNA, 601 bp, Human
atttcaacatttctgattcttagaacagcccctgtgggctgttcatgaagcaatgaagtcatccaaaacactaccagggaaactcttattatctaaaaccagaccaaataattctctgaaatggatgattcaataatcagtttacactaagataagaaaagaactccaacagcgtgcctacaaccaagacccataaaatcacatgctggtctgtatatagccatcatctgtcccctcttcaggggtaaggagacatcccacttggcaacaatgttagtagtaactgaaaacatcctgaatstgggtctcccagcacccacactttgcacccacaaatggaaaggcacaaacctatttcaggacactagggtcccactgaactcaaatttcactgacatttgggcaatatgacttttaggaactcaaacctgaccccagatggatctaaaatgtgcaactgactgctaggggtgggaacagtatttacttagttgctgctgcagtatttaaagtatattctgatctaaggaacccctacagctgatattttattcaccattgcttgtccttcaccatttgggaattggcataaaaagattcc

SEQ ID NO: 55776 - DNA, 601 bp, Human
acctgtgcaatgcaacaaacatacaattttataaagaaattcaaagcagatcttctgagtgtttttctggggaatctgaacacaactttgcccaaagtcaaggacaactctaaggagcacaaagcctctgagtggaaacactacctccctatctctcacttgggaagaacgtctttgctcacattatcagcagaaaataacaaggacaatcttttctggaccttgttatagtgaaggcttctgggttctccaaaggttatctttgataagcaaaaactatctattgtctcaaactctgtarattactttatgaaaatgaattacaggaagagggggaaaccctacttgctttatggaaagattccttatgaaaattgttttgaatttcccaagattcataatatagatgcaaggcatttctaccatagagatttcagaatatgaattagttagaccccctacttctggggttcattaaaacgaacgaaaaagcaaagtgagcaaggcaactgatatgctagtctaacagctgtccaattttgctaacgtgtcagtgaggtccatttcaacatttctgattcttagaacagcccctgtgggc

SEQ ID NO: 55777 - DNA, 601 bp, Human
agaaccaaaggggatgcagctcaaaggagcagcaatgaccagtctcgaaaccactggcttctttgtaaatctttgggagtcatggaacatttgagaactgaatgcatgtgtgcaccctctccttaccaaaccaaaccaaacaaaaaacatccatatcacacaaacttttgcagacaatgtcagggaattacattcattgcagggcccatgaactccccgttaggcacccattaacccagattaagaaccccatcgtaaaagagtaagaaagttctaagagcaacaatggtaacaaaatggmtccatctaattaaactacaaattacaccgctggtcttaagatgtcatcctttcagcagaagaacttaatagatgaagactcagaactaaaaaaactttcacatgcagtttctcgtgaaacccgtactttgaccacaaactggtccatgaagcctaatccaagagttcctgttctaaccatgctggtttcaaacagtgctggatattcggtattcctgatggtgtgagaaaatgcaagcaaatctgatctgccacatcccttatgtaacaccatccctcatacattgctgattcttcccct

SEQ ID NO: 55778 - DNA, 601 bp, Human
tagtttaaagagttgaccatcaatcctatgtcaaatttacacataaaaatacaggttaacagctttgtctatgggctgataagtaataaggaattgaacactgggaccatgcaagctgtgaaggctggtagaaccaaaggggatgcagctcaaaggagcagcaatgaccagtctcgaaaccactggcttctttgtaaatctttgggagtcatggaacatttgagaactgaatgcatgtgtgcaccctctccttaccaaaccaaaccaaacaaaaaacatccatatcacacaaacttttgcmgacaatgtcagggaattacattcattgcagggcccatgaactccccgttaggcacccattaacccagattaagaaccccatcgtaaaagagtaagaaagttctaagagcaacaatggtaacaaaatggatccatctaattaaactacaaattacaccgctggtcttaagatgtcatcctttcagcagaagaacttaatagatgaagactcagaactaaaaaaactttcacatgcagtttctcgtgaaacccgtactttgaccacaaactggtccatgaagcctaatccaagagttcctgt

SEQ ID NO: 55779 - DNA, 601 bp, Human
atatcccatgaagaaatgatacaaagagtatccagaaatctccagcttggaaatccaaacagtagtttaaagagttgaccatcaatcctatgtcaaatttacacataaaaatacaggttaacagctttgtctatgggctgataagtaataaggaattgaacactgggaccatgcaagctgtgaaggctggtagaaccaaaggggatgcagctcaaaggagcagcaatgaccagtctcgaaaccactggcttctttgtaaatctttgggagtcatggaacatttgagaactgaatgcatgtrtgcaccctctccttaccaaaccaaaccaaacaaaaaacatccatatcacacaaacttttgcagacaatgtcagggaattacattcattgcagggcccatgaactccccgttaggcacccattaacccagattaagaaccccatcgtaaaagagtaagaaagttctaagagcaacaatggtaacaaaatggatccatctaattaaactacaaattacaccgctggtcttaagatgtcatcctttcagcagaagaacttaatagatgaagactcagaactaaaaaaactttcacatgcagtt

SEQ ID NO: 55780 - DNA, 601 bp, Human
caatggctgccagcccactgtgatctcaacatacttctacctttttttgtagggaccacttatgaccaatgtcacttatcatagtatgctctcaggtcattgataaataaaacagtaaactttcattatctttcaaaacccaggctttagcacatggtaagcactcagcaaatgtcaaaataatgttttaattctctgcttttcaatgccacaaaaatattctatgaataacttgcatcatcttgttcactagcttgagaatgcatgtcttaatttccaaaatggactgtaggccaggagyttgagaccagcctggccaacatggaaaaaccccgtctctactaaaaatacaaaaataaattagccgggcatagtagcaggcacctgatactcaggtggctgagacacaagaatcgcttgaacccaggaagtggaggttgcagtgagcccagatcgtgccactgcactccagcctgggctacagagtgagactctgtttcaaaaacaagcaaacaaaaaactgtgcttaacatagacacgataatacacttgatcttagccaaaaggccgggaagtaaacacacacaataaatattgactt

SEQ ID NO: 55781 - DNA, 601 bp, Human
aaatgactaaggtgaaacttggaaaacaaaatccccctggggtggggtcatccctctggatctccagagaaatgactttcttctcctccaggtaagctccaacctctataaagtgaaatgggttctgccaaagaaaagtgccgaaagctgagaaaaagcggctgccaagggaggctgccagggctttcattgtctcagcttttagcttgaagggcttttccaaagaaatgaagcacagaggacacacagaataaagagtgattgtatacagcccctgtcaaaaaaaaaaaaaaaaaaaaaacagggaagaaaaccatgggatggatacaaaaactgtaaccaattttgacagcagatcaaggactattgcaggtcatcactgttgtcattaacatcaccaaaaagcacctgtgaatggagctgcaaaccatggactcaacaaagtcctcttggcacacatgagcccagggcaacatgaacataggagaacaaagggatatataaggaaatattgactagatactttcatacagtctgtctcatactggctttccatacagagcggggaggcaagacccaagaatcacatatttaaacagag

SEQ ID NO: 55782 - DNA, 601 bp, Human
tcactatcaacagaaacaagctataatgtagctcagattctatgaataagatacattaagttgaaccagatgatattgccaatatttgaccattttttactacaaaatggctatttcatattagtcaaccacactaatctcaaccaaagcatgatttagctccctgccaaagaacaaataaacagaacacattttttctttctaaaagtcagcaaaggtggaacaaaagttaccttcccttaggcctgctttaagctttaggtcaaatgactaaggtgaaacttggaaaacaaaatccccytggggtggggtcatccctctggatctccagagaaatgactttcttctcctccaggtaagctccaacctctataaagtgaaatgggttctgccaaagaaaagtgccgaaagctgagaaaaagcggctgccaagggaggctgccagggctttcattgtctcagcttttagcttgaagggcttttccaaagaaatgaagcacagaggacacacagaataaagagtgattgtatacagcccctgtcaaaaaaaaaaaaaaaaaaaaaacagggaagaaaaccatgggatggatacaaaaactgt

SEQ ID NO: 55783 - DNA, 601 bp, Human
agaaatcttagccctggctttccatgaaaatcactcagagcagcctctggaatactttttttgcaactcactatcaacagaaacaagctataatgtagctcagattctatgaataagatacattaagttgaaccagatgatattgccaatatttgaccattttttactacaaaatggctatttcatattagtcaaccacactaatctcaaccaaagcatgatttagctccctgccaaagaacaaataaacagaacacattttttctttctaaaagtcagcaaaggtggaacaaaagttacyttcccttaggcctgctttaagctttaggtcaaatgactaaggtgaaacttggaaaacaaaatccccctggggtggggtcatccctctggatctccagagaaatgactttcttctcctccaggtaagctccaacctctataaagtgaaatgggttctgccaaagaaaagtgccgaaagctgagaaaaagcggctgccaagggaggctgccagggctttcattgtctcagcttttagcttgaagggcttttccaaagaaatgaagcacagaggacacacagaataaagagtgattgtataca

SEQ ID NO: 55784 - DNA, 601 bp, Human
ttgtttttttaataaaatacaaatgacttcattttggagctcactgtgtcactttctcaacaaacagatcctcatatcaggaattaggcctgtgttatatacaaatagtatgggtccgtgcatattcattttgtggtcagggaccacacacccggtagccagttacaatatttacagggctcctgatgccacaaggggggtttcagagctgaaaccaaagctcaggccacacagagtatgacgacaggtcctgctctaatgtgcgcactagaccccagcctctgcccacagaagatgggcrggtgtgtctgctttctgtgaatgcttatctatgtcatcatccaaatatcactaagtgcatcctccaaatttaacactctttggactctggcattatttcagtgaaagtaagcctttatgaaaagtttggcaaagtttaaggaccattatgtccttgtgctaaggatcagtttgggggaggtttaagcacttaccaaaaacagtctggagaccccagtggcaagtctctctgtcttcagatgccacaccagggggtgtggggagttgagcaggaacacaacagacttgtggtggatgtgga

SEQ ID NO: 55785 - DNA, 601 bp, Human
tttgagtaccaactctgcaagtaactagccatgtgatttggcccactacttaacttctctaaatcttagttcttcatctataagaaaggatctacactatggtactgtagaaggctatcgtgagaattaaagtattagagcatttagtgacctgaaatatcctaagtgctaaataaatgtgctagtaataacaactaaataattactgatttttgatttttggcctttttaatatagaataagagttgcaattcccagaaaaggctacaataaagttattgtaatgcccaccttgtaaatrtaccttttgagtttaaatgttttcttttgaaattaatttaaatttacagcaaagttgctagtacaaaggactctactatacccttttaactagattcatcagtttttaaaaccttgccacatttgctttattcttctctatacaacatgtttttttcctgaatgatctgaccttttagcccttaatcttaaagagtattaagtatgtttcctaaggatattctcttacataaaaacaacataattatcaaattcaaggaatataacattgatataatattttaatctataggctcaatta

SEQ ID NO: 55786 - DNA, 601 bp, Human
acccatgaactggcagactgaagaaagaatccaggcagcgataagtacaactatgacatacgtagcccacactttcatctggacctatagcccagagaaacagaaccccttttgatctggggccagccaaactagatatttcataaatacagatgcaaattcaacacccgtcccacatgctctttactgtgactagaaataaataagagcagcaacagcaggtgatgtctataaacattttatatgtgatctcacttactcaagataacagccctatgatgcagggcctgagaaaaatcckgcttagagaaattaatttgcccaaggtcactgcttggatctaaaccaggacatgcactgcctttgctcataatgcctccataacctgcccactgtggtagccactagcctcacatagctactaagcacctgaaatgtggctaagcaggactgaagaactgtaatttaagtagccacgcacagctatttcctatagtattggacagtatagctctacagtatgagggctaaatgtgcatatgactttatgatcagagccattagtattactatcacaagtaactttaattagaggagactg

SEQ ID NO: 55787 - DNA, 601 bp, Human
agaaggaaattagcaaagaaaaaaattatttccagatttttaaatgtaacacaatagaatacagaattttttttaaaaaaagttcccttctccacaagcaaacttgaatgtctgagttattcttagggcgtttttggacagacactacaaccctcagttacacatcacttggcttcatgaaaaggtaacagctggacatgcacggtggtatgggctgtgcgtgtcccttcctagtgctgcactgagcacacatctggggctatttagcaactgattggaaatttagccttctgatttccarttaaatactaggcacaggaaaacaaatagcacttgtttttcactgagtcttgtcagtcatccaaactccagtgcagaccagagaactgcctgtggtttggtggcagaggcccaaaatatttggacctttttttttttaatgcctctagtttaagtaaaaggaataaactagatgttggcagctccagcttcttcacccatccctccccgcttcttgaaaatacaaaactggttttaaatttattaatttacatttttcattaggattaagttttgatttgtttttaatccaaagctaata

SEQ ID NO: 55788 - DNA, 601 bp, Human
agctctctggaggctggccaccacgtcaacaaagggcaccagagatgtgacatttgatacaattgcccaacacttgggaagggcagatgcatctgattaccagattagccttagacaataaagccttaaaagacgttatgggactccacacgaagaaacaccaaccttgcctcctcagtgaaagtgagtttatttgacctcaatttgttgaatgaaagcaaagccttcacagggctgcaacccatgcctgcacacagacatgacgcaagtccagccagagccaggaaaagtctacacttgygtgaaccctcctggacagtaggtcttcctcaggaaaaatacacccaggcaaatctcccaggggccacgggccattcactcactcacaacattcaccagccttaacctagcaagttagaataaatcccagggagtctttcaaaaaccccttctggaccaggtttaccagttgaaactgggctctttccaatgttctaattgccatagtgacatttaggaagagctcaatggccacaatagggccaaaaactcctattcctaggaaacaggaatgacttgtttgaactagggtagttgactg

SEQ ID NO: 55789 - DNA, 601 bp, Human
taaagatggaaaggccagagatcaaatggactgtgagacttttgctagaggtggcagacggatgaccccctgacttccaggtatacactgtgtcattcaccacctcagtgggacaaggcagaggcaaaccaatggtgactccctagcacagtggcattaaggacccacagttgcaacaaagaccctgggtcatctaaggatacagtgttaggaacaaaaggcaaaagcagatcttgagaaaagcaaattctatcctagacacagaaattagaaggctaaagggactccttcctcccctgcraaatcagaagtagcttccaagctagagttagataatgtggactcgaggtgcaagaaccaatttgcctcaaataaacccaacaacctgtgtccaggaaggagttggaccatcctggagttgctttctgagatggagagtgtaggtcacctgtggagaacccttaccaaaggcatcactgtctataatttatgagcggaacaaggcacagccacagccttcaagtcagcctcccagagtctcctggtagacagttggggtttctttcccctcctattacatggaaataaaatattctgcaac

SEQ ID NO: 55790 - DNA, 601 bp, Human
gtatgtatcctcacattgggccatgagatttgtctgacagatgctgaggttgacaggccacgagtcattcctcactacggcaggaccatagccttcttatacaaactgcaagaaaaggatataaaaaccctgttttaatggattggggcaggcttggctccaaacagcagctctgaacatcactctgccatctgtatcacccagaaccaatagaatctcaagaacaggctctctgtgataaagatggaaaggccagagatcaaatggactgtgagacttttgctagaggtggcagacggawgaccccctgacttccaggtatacactgtgtcattcaccacctcagtgggacaaggcagaggcaaaccaatggtgactccctagcacagtggcattaaggacccacagttgcaacaaagaccctgggtcatctaaggatacagtgttaggaacaaaaggcaaaagcagatcttgagaaaagcaaattctatcctagacacagaaattagaaggctaaagggactccttcctcccctgcgaaatcagaagtagcttccaagctagagttagataatgtggactcgaggtgcaagaaccaatt

SEQ ID NO: 55791 - DNA, 601 bp, Human
acttactaagcactgtccctgggttagagcccccgtttactagctatgggaccaggtacatgttaacctctttgtctcagtttcctcatcttaaaacaaagacaacaaaagcacctacttcacaggcttattatgaagactaagctcatacatgtaagtactcagaagagtacctcacacacggcacacactagaagtgcttgttaaacatacacatatgtgtgtatgtatcctcacattgggccatgagatttgtctgacagatgctgaggttgacaggccacgagtcattcctcactayggcaggaccatagccttcttatacaaactgcaagaaaaggatataaaaaccctgttttaatggattggggcaggcttggctccaaacagcagctctgaacatcactctgccatctgtatcacccagaaccaatagaatctcaagaacaggctctctgtgataaagatggaaaggccagagatcaaatggactgtgagacttttgctagaggtggcagacggatgaccccctgacttccaggtatacactgtgtcattcaccacctcagtgggacaaggcagaggcaaaccaatggtgact

SEQ ID NO: 55792 - DNA, 601 bp, Human
tctctagataaatgctgactgatagctcctgggaatggctggtgcaagccctaggagaaacagagctgcatattctggcccaggaaccacagacctaacaacagtttgggaaaaaaagttctaaagggtatttccttggagggcaagaatggaggtgaggcctctagcccgaaataactgtggttggagcctccttgagcttcctaaaattagctctgaagcaaaggcagagccctcttaagcaggccacacccattttgcagtctacattgaagtctctgaagatgatcaaggtggtctyctaggtcaaagcaaagaaggttgaactgcacatatttagcatcaattaacaaacggtccccacagggttcaggatagatgtagatattagggcatcctggtggagctgatccagaaacgctccaactgggaccccagagggaaagctcttgggaaaggggtcaagaaacagttttaaaatctttattcaagtgaaatactgatatgatctagatcccagtactgaaataagtcatgcataaaacactttgctgaaacaagaagtttgctcacctgatgcgatgccctgatttggctctat

SEQ ID NO: 55793 - DNA, 601 bp, Human
ggatcttaaaaatttctgtgatggtcagttttatatgtcaacgtatctaggccatcttccccagctatgcaatcaaacactcatctacacgttactgtgaggtattttgtagacgcaattaaactccataatcaggtggcactaaggaagggagattgtatcagataatctgggtgggcctgattcaatccattgaaagccattaagagcacacccaaggcttccctgaggaagaaaaaattccacctgtggacagcggcttccgctcatgcctgagctgcccttcctgaaggcctccctrcggactttgattgccctgcctgtccccacaatggcataagccaattctttgtaataaatctcttcatatatatatccccgactggttctgtttctctagataaatgctgactgatagctcctgggaatggctggtgcaagccctaggagaaacagagctgcatattctggcccaggaaccacagacctaacaacagtttgggaaaaaaagttctaaagggtatttccttggagggcaagaatggaggtgaggcctctagcccgaaataactgtggttggagcctccttgagcttcctaaa

SEQ ID NO: 55794 - DNA, 601 bp, Human
ttacaggcccttggggctgctctaactcgcacatccaactgcacacatgtccgtgactttggcattggtggaagttcaacacttacacaatgaaaatagactcctccccctcttctgtcctgccctactcccagctttcagtattcctcttcccttttcctgactcctgcacaaacaaatctctttttggagttgcctgcttaggaaaatagaaagagcaaaacaaggaaaacaaagaaagcaaagaaaaacacactgatatttcagaaacacctgccatgccaagaacttgctggctcarttccagggggaaaagacacacggtaaaggagaataggtattcctcaagaatctcagttgaggtttaagtgggatctacagattggccctagaactcatcacagcccccacacagaaaggcattacaaagattatgcttttatgtattttggacacacaaagtccagcaaaaacaaacatactggaacagcactgaaatatttaccttccaaatgaagactgaaccctgcattttaaaagaggaaaatcacacgttctccctacccaattcctgggaggaccccacttgcctatttcctct

SEQ ID NO: 55795 - DNA, 601 bp, Human
aatgccatgagcaaccacgtgtctgccagggggttagcgaaggcatcattgctctacagctgttatccaatgtagtgtccactggccacatggcaccatcaagtacctgaacctgaaatgttgctggttaaattgacctgtgttatataaatgtaaaatgcataccacttagcacaagaaaaatccctatctcattaatttttattgactgattacaagtttaagtgatattattttggatctactgggttaaacaaagtgtcattaatattaattttacttactttttttttttttttttgagacggagtttcgctcatcacccaggctggagtgtagtggcacgatctcagctcactgcagtctctgcctcccaggttcaagcgattctcctgcctcagcctcccgagtagctgggattacaggcacctgccaccatgcccggttaattttttgtatttttagtagatatggggtttcaccatgttgggcaggctggtctcgaactcctgacctcaggtgatctgcccaccccggcctcccaaagtgctgggattacaggcacgaggagccatgcccagccactcagccttcttttact

SEQ ID NO: 55796 - DNA, 601 bp, Human
taagaacttacggctaggcaaccacagccaagtttattattttttctggatcaggttcaacaacctcatccaaaactacatgaaaaaagccaaagaggcaaccagccctttgtttccacacctgtctttaagctttaactcttaaagtcctcagcggatccacggaagcctcaaggttgatctcccaagcctgagtgaagtgtacaagtcccagctaatgagcacagacaccattttcctggcactgaggttctttgctttagcacttagcacatcagctgactcaccacctggcaggttscattgtagcctctctctgggcctccccaacgttggtttagtcttcagtggtgaggagaggaacttgctgtggatagtgccacacatccccatcctcctgcctccttgacccctaccccaaaaagaatgctcccagatgaagtcttgaggaaacttcaggccaccctagatcaaaagtggatattaagtctcatcttaagtttcacctcaacctccttcaagtctattcaaatgttaccttctcaatgggcccatttaaatttacaaccccaccacccagccccactctaggaattctgat

SEQ ID NO: 55797 - DNA, 601 bp, Human
ccatgcacaacatttgtatttgaaattcaggttatgctaccagacttttttaaagagcagaacattactctatctgccaattgctgggagttttattataagaacttacggctaggcaaccacagccaagtttattattttttctggatcaggttcaacaacctcatccaaaactacatgaaaaaagccaaagaggcaaccagccctttgtttccacacctgtctttaagctttaactcttaaagtcctcagcggatccacggaagcctcaaggttgatctcccaagcctgagtgaagtgyacaagtcccagctaatgagcacagacaccattttcctggcactgaggttctttgctttagcacttagcacatcagctgactcaccacctggcaggttgcattgtagcctctctctgggcctccccaacgttggtttagtcttcagtggtgaggagaggaacttgctgtggatagtgccacacatccccatcctcctgcctccttgacccctaccccaaaaagaatgctcccagatgaagtcttgaggaaacttcaggccaccctagatcaaaagtggatattaagtctcatcttaagttt

SEQ ID NO: 55798 - DNA, 601 bp, Human
cccaggaaatgagcttttggccaagctttaaagctaatgatttgatttttcacctaataactccacctaaaaaccaattattaaagcatatttagtaattccatgtcttccccacaacccaatgaactttcctcctgcttgctaattaaaacccaatcctctaacattccctgacatgacaaatgtcttcctgtgggaatgaacagagcactgggctccaagggtcccaattcctagtaaacgtttgttgaaggggaaccatgaagcactttacagtcaaacaaatcctgggatgctgagrtgcaccctggactctcctgaatgctcctccctacttgaaccatgcacaacatttgtatttgaaattcaggttatgctaccagacttttttaaagagcagaacattactctatctgccaattgctgggagttttattataagaacttacggctaggcaaccacagccaagtttattattttttctggatcaggttcaacaacctcatccaaaactacatgaaaaaagccaaagaggcaaccagccctttgtttccacacctgtctttaagctttaactcttaaagtcctcagcggatccac

SEQ ID NO: 55799 - DNA, 601 bp, Human
atttttctctatgctcacaccactctcaatagtttacttctgacatcgcatgtctgggtgtttttcccacaccaactaattctccaactcagaacaccaattgatgctgtgtatttcgatgtaattctgataccatctacctggagataggtcagaccgcacagattaagggctcagtcccacaagactgcccctcttcagatgcttctgatagtggggctataaatcataggttcccatgaccctgaggttcaattattttctagaatggctcacagaactcaaggaaatacttttaagyttattcatttatgataaaggatacaactcaagaacagcagccagatggaagagatgcacagggcaaggtacggggaaggggtgaggagcttctgtgccctctcggagagcgccactcccccacgccccggcacctccacatgctcaccaaccagcagctctccaaaccctaccccacagatcagggatttctagggagccttcattccacaggcatgactgataaaaccattggtcatgtatgattaagtcaatctccagcccttctcccctccttcagaggggtgggctgaaagttcta

SEQ ID NO: 55800 - DNA, 601 bp, Human
aggttgttcagccaactaccaagggacctcacagaaccttcctcatctttgtaagggcatcatgctacaacccgccaagaaccctgctgcattagtccattctcacactgctataaaaaaatacctgggactgggtaatttacaaagaaaagaggtttaattggctcatggttccacaggctgtacaggaagcatggctgggaggcctcaggaaacttacaatcatggtggaaggtgaagaggaagcaggcgtgacttatatggcaggagcaggaggaagagagggagtgggtaggtgctrcatacttttaaataaccagatctcgtggtaaatcactcactatgacgagaacagcacaaaagaggaaatcttcccatccccatgatctaatcacctcctactaccaggccccacttccaacactggggattacaatttattttattttatttattattttttgagatggagtcttgctcttgtcacccaggctgaagtgcaatggtgcgatctcggctcactgcaacctccacctcccaggttcaagagattattctgccttagcctcccgagtagctgggattacaggcgtgtgccacc

SEQ ID NO: 55801 - DNA, 601 bp, Human
agaacaaaccacacaaacatcagggcaaggagcattcacagttgagacgcagcaagtgtaaggtctgacatggtgaaggaagaccaaggaggtcagtgtggctggacacagggctgagaggaggttggtaggacacagggctgaggcaaggttggtaggacacaggtcccagaggagaccagtaggcccaacaggaccttgtagaccgttgtaaggactattgaaacatctaccaaatgttttcgcaggatggctctggctgctatgttgagtctaaggggagacaaaaagcaggagatcrttagtagacttccggaataattcaggtgagaaacagtggtcactcacaccaggaaggatggtagagatgatggtacctaaccccccaaggtcttttcaccagttcgaggcttttctatcctatccttatacccataattctcccaaaataaatgcaaagtcttatagttattcttcagacccatatttcaagtctgaagagaccatgtaaaaatccttattttattagctataaataattaaattttatagcacaccttctgcactttcatctaaatccctgagaggttgaccaagacaa

SEQ ID NO: 55802 - DNA, 601 bp, Human
cataagtaaaagcatcctgaggtctccccagaagcagatgttggtgctatgcttcctgtacagcttgcagaaccatgagccaattaaacctcttttcttataaattgcccagtctcaagtatttctttttagcaatgcaagaacagcctaataaactaatctatgctttaaacatagagccaacaaagatttatggagtgcctgcctactccattgttctccatgctggagacacagtggagagacacagtggagaatatgacagaaaaaattccctgcccttatggagattaaagtctartaagacagccagaggagcacaataaggtcactgagaagttaaagacctaaaggagacgaaagaacaaaccacacaaacatcagggcaaggagcattcacagttgagacgcagcaagtgtaaggtctgacatggtgaaggaagaccaaggaggtcagtgtggctggacacagggctgagaggaggttggtaggacacagggctgaggcaaggttggtaggacacaggtcccagaggagaccagtaggcccaacaggaccttgtagaccgttgtaaggactattgaaacatctaccaaatgt

SEQ ID NO: 55803 - DNA, 601 bp, Human
tttggatgagatttaaatgttagtacattgagtagggcagatttctctccctgacatgtatgggttcatccaatcagttgaaggcctgaatagaacaaaaagctgactctctcacaagtaagaattctacctgatggctttcaaactggaacatcagctcttcccggtgctacagcagcctacaggccttcgaactggaactggggcactggctctgcagattttggacttcttagcctctataattgcatgagacaattcctataataaatctctttctctatatatgtgaacactgcaygaagcatccacattagctttggcatcagctgaaccctgctatgatctcatatttactaattgatatagtttgcatatttgtccccacctaaatctcatgttgaatggtaacccccaacgtttcacatggggcctggtgggaggtgtttggatcatgggggcagatccccccatgaatggcttaggccatccccttggtaataagtgaactctcgtcttgagttcacgtgagatctgctcatttaaaagtgtgtggcacctcccccgacacacgttctctctcttgctcctgcttttgcca

SEQ ID NO: 55804 - DNA, 601 bp, Human
gggacaagattcaaggtctccaggtatggtctgagaagcatactgtgatggttcattttatgtgtcaacttgactgggccacaggtgcccagatatttggccaaacattattctgggtattttggtgaggatgcatttggatgagatttaaatgttagtacattgagtagggcagatttctctccctgacatgtatgggttcatccaatcagttgaaggcctgaatagaacaaaaagctgactctctcacaagtaagaattctacctgatggctttcaaactggaacatcagctcttcccrgtgctacagcagcctacaggccttcgaactggaactggggcactggctctgcagattttggacttcttagcctctataattgcatgagacaattcctataataaatctctttctctatatatgtgaacactgcatgaagcatccacattagctttggcatcagctgaaccctgctatgatctcatatttactaattgatatagtttgcatatttgtccccacctaaatctcatgttgaatggtaacccccaacgtttcacatggggcctggtgggaggtgtttggatcatgggggcagat

SEQ ID NO: 55805 - DNA, 601 bp, Human
ttagaaggtgttgttttagaaggtattgttcagatgttatttccatctgatttgcggaactgtgaggcaggctacggtgacctctacagcagaaaagcggaaacctcagagagtctaatggcctacccaaggccagagagtcatgcaccaggcccagaccagaacttaagacttctgactcctggtcacagctggcctctgcttgcacccttccagaaagaagacctcactagctcccaagacagcagatttctgttctgttagattcattttttatacactagtctgagccatgcctacyagaacaaagaattccttcgtctttcttccatgagacaagacttcaggtgtttaaaggtgtcatctgacctcaatcacatgtttgctttttcagggcaacacccctagcttcttcagttctgccccagataccctggttgtcagagcgtcaacaggatagtctctgaaagacggtgtcgggacaagattcaaggtctccaggtatggtctgagaagcatactgtgatggttcattttatgtgtcaacttgactgggccacaggtgcccagatatttggccaaacattattctgggtatttt

SEQ ID NO: 55806 - DNA, 575 bp, Human
aatgtcagagtgaaacctcaaaatgtgggcaagaaggctcacaaattctcaggtcatagaactataaatgtcttgtattaaatttcacatgaaccatttattcataacgaaaagcatgcagtttctgaagtaagactaagaagcaagtcgagggcagggattttattagtggttctatcacagcagcatttttaacacacacaaaattatattttcccagctactgtgctaggcattaatattttctatacaattatataaacgtatcttctaaaaacgctggcaaaaaaaagtacttcamttaattgattccatgacctactaatgttgcaagctgaaaactagaatcacctgaaaagtttctagatatcctgatgcccgggccacacagatggtacagagctacatgttccactctggttttgtttataactggcatcaggacattcagaaatgatcgtgactacacttgacagcactgatacgtagtaagtgtgcagtcagtggtagctgtgtagaactacacagggctctgtggaagccctgaattaatcactaataaactcggtgtaaac

SEQ ID NO: 55807 - DNA, 601 bp, Human
gcaaaactaccaatgcaggatgtccctctgaactctgaaagaaccttgtgaggacggactgcattgcacattgagtaatcgtaagaattatcactgctatttccaagaaatctaaattgaagaccaatcttacaatgaatgtatttcaagtcaagtgggaagccttgatgaatgttctcgtgggcttataaaaagcttcaggatcaagacaagtgatcccaaagtcctgctagcaactgatcacgactttcaggtcttccacagttgcagcatctgccaacagagtcatcacaatagggamacagcgagagtcctcttggtttatgttcacctcagcactgagataaaaatggccaaaggttgccagcctttctatcacattgctctatttcataagagtgagatgaatgtttgtaacagtttattgtgtaagacccccaaattcccatagataatgaagtcaagaggctgttaaactgatctaataaaactttcaggatgacgtatgcaagtacctcattcttgctgaatgtatttagaccactgctgacctagcatatcatggtatatgtgtaattaacacatccaaaggaggaaaatc

SEQ ID NO: 55808 - DNA, 601 bp, Human
ttcaaggaataatcccaagcctagtcctcccagacaaaggcaaaactaccaatgcaggatgtccctctgaactctgaaagaaccttgtgaggacggactgcattgcacattgagtaatcgtaagaattatcactgctatttccaagaaatctaaattgaagaccaatcttacaatgaatgtatttcaagtcaagtgggaagccttgatgaatgttctcgtgggcttataaaaagcttcaggatcaagacaagtgatcccaaagtcctgctagcaactgatcacgactttcaggtcttccayagttgcagcatctgccaacagagtcatcacaatagggaaacagcgagagtcctcttggtttatgttcacctcagcactgagataaaaatggccaaaggttgccagcctttctatcacattgctctatttcataagagtgagatgaatgtttgtaacagtttattgtgtaagacccccaaattcccatagataatgaagtcaagaggctgttaaactgatctaataaaactttcaggatgacgtatgcaagtacctcattcttgctgaatgtatttagaccactgctgacctagcatatca

SEQ ID NO: 55809 - DNA, 601 bp, Human; identical to SEQ ID NO: 26814

SEQ ID NO: 55810 - DNA, 601 bp, Human; identical to SEQ ID NO: 26815

SEQ ID NO: 55811 - DNA, 601 bp, Human; identical to SEQ ID NO: 26816

SEQ ID NO: 55812 - DNA, 601 bp, Human; identical to SEQ ID NO: 26817

SEQ ID NO: 55813 - DNA, 601 bp, Human; identical to SEQ ID NO: 26818

SEQ ID NO: 55814 - DNA, 601 bp, Human; identical to SEQ ID NO: 26819

SEQ ID NO: 55815 - DNA, 601 bp, Human; identical to SEQ ID NO: 26820

SEQ ID NO: 55816 - DNA, 601 bp, Human; identical to SEQ ID NO: 26821

SEQ ID NO: 55817 - DNA, 601 bp, Human; identical to SEQ ID NO: 26822

SEQ ID NO: 55818 - DNA, 601 bp, Human; identical to SEQ ID NO: 26823

SEQ ID NO: 55819 - DNA, 601 bp, Human; identical to SEQ ID NO: 26824

SEQ ID NO: 55820 - DNA, 601 bp, Human; identical to SEQ ID NO: 26825

SEQ ID NO: 55821 - DNA, 601 bp, Human; identical to SEQ ID NO: 26826

SEQ ID NO: 55822 - DNA, 601 bp, Human; identical to SEQ ID NO: 26827

SEQ ID NO: 55823 - DNA, 601 bp, Human; identical to SEQ ID NO: 26828

SEQ ID NO: 55824 - DNA, 601 bp, Human; identical to SEQ ID NO: 26829

SEQ ID NO: 55825 - DNA, 601 bp, Human; identical to SEQ ID NO: 26830

SEQ ID NO: 55826 - DNA, 601 bp, Human; identical to SEQ ID NO: 26831

SEQ ID NO: 55827 - DNA, 601 bp, Human; identical to SEQ ID NO: 26832

SEQ ID NO: 55828 - DNA, 601 bp, Human; identical to SEQ ID NO: 26833

SEQ ID NO: 55829 - DNA, 601 bp, Human; identical to SEQ ID NO: 26834

SEQ ID NO: 55830 - DNA, 601 bp, Human; identical to SEQ ID NO: 26835

SEQ ID NO: 55831 - DNA, 601 bp, Human; identical to SEQ ID NO: 26836

SEQ ID NO: 55832 - DNA, 601 bp, Human; identical to SEQ ID NO: 26837

SEQ ID NO: 55833 - DNA, 601 bp, Human; identical to SEQ ID NO: 26838

SEQ ID NO: 55834 - DNA, 601 bp, Human; identical to SEQ ID NO: 26839

SEQ ID NO: 55835 - DNA, 601 bp, Human; identical to SEQ ID NO: 26840

SEQ ID NO: 55836 - DNA, 601 bp, Human; identical to SEQ ID NO: 26841

SEQ ID NO: 55837 - DNA, 601 bp, Human; identical to SEQ ID NO: 26842

SEQ ID NO: 55838 - DNA, 601 bp, Human; identical to SEQ ID NO: 26843

SEQ ID NO: 55839 - DNA, 601 bp, Human; identical to SEQ ID NO: 26844

SEQ ID NO: 55840 - DNA, 601 bp, Human; identical to SEQ ID NO: 26845

SEQ ID NO: 55841 - DNA, 601 bp, Human; identical to SEQ ID NO: 26846

SEQ ID NO: 55842 - DNA, 601 bp, Human; identical to SEQ ID NO: 26847

SEQ ID NO: 55843 - DNA, 601 bp, Human; identical to SEQ ID NO: 26848

SEQ ID NO: 55844 - DNA, 601 bp, Human; identical to SEQ ID NO: 26849

SEQ ID NO: 55845 - DNA, 601 bp, Human; identical to SEQ ID NO: 26850

SEQ ID NO: 55846 - DNA, 601 bp, Human; identical to SEQ ID NO: 26851

SEQ ID NO: 55847 - DNA, 601 bp, Human; identical to SEQ ID NO: 26852

SEQ ID NO: 55848 - DNA, 601 bp, Human; identical to SEQ ID NO: 26853

SEQ ID NO: 55849 - DNA, 601 bp, Human; identical to SEQ ID NO: 26854

SEQ ID NO: 55850 - DNA, 601 bp, Human; identical to SEQ ID NO: 26855

SEQ ID NO: 55851 - DNA, 601 bp, Human; identical to SEQ ID NO: 26856

SEQ ID NO: 55852 - DNA, 601 bp, Human; identical to SEQ ID NO: 26857

SEQ ID NO: 55853 - DNA, 601 bp, Human; identical to SEQ ID NO: 26858

SEQ ID NO: 55854 - DNA, 601 bp, Human; identical to SEQ ID NO: 26859

SEQ ID NO: 55855 - DNA, 601 bp, Human; identical to SEQ ID NO: 26860

SEQ ID NO: 55856 - DNA, 601 bp, Human
gaggcagcctgtagctctaatcctgaaatatctaaccccgcttggaatccactttcactctcccagccttctctcagtttgacacccttagatatcaatgttactagatggtgacaactgtaattgcctagatatcccatgtgacatttggttccacccctcagatgctgacagctgcctggtgtgtccttgcttgtttataacccttggagctgtgatgcgggtccttgtcagatgctcttctcaccgcccacagggcctcatatccactcctaacatttgttagggcccagttctgcctctctactgctctggctggccagacccatgccaggtctggctctgccctgcctgtcctctcaggtactgatgccacaccccttagggcacagccttccttttctcacagaagatacagcttgctgaatgttcctgcttgtggagaaagaggcatgcttggctccaagcaacaaatgtgattgtgcaaaattctgaaaactgaattttaagatgcatttgggcagtggttctcatctgttacacctaagatgaataatgttcacatattctcaaaggcatctgcaattttgataaagcaata

SEQ ID NO: 55857 - DNA, 601 bp, Human
ccaggagtttaggcattctcagtcacaggatgggagagaaggtcacaagatacaggtcataaagaccccgctgataaagcaggatgcagtaaagaagccagccgaaactggccaaaaaccaccaaaaccaagatggcaatgacagtgacctctggttgtcctcactgctcattatacactaagtataatacattagcatgctaaaagacactctcaccagcaccatgacagttgacaaatgtcatagcaaagcctagaggttaccctatatggtctaaaaaggggaggaaccctagttccrggaattgcctgcccctttctaggacagctcatgaattacccaccccttgtttagcatatgatcaacaaataaccataaaaatagcaaccagcagcctctggggctgctctgtctatggagtagccattcttttgtttctttacgtctctaataaacttgctttcactttactctgtggactcatccccaaattctttcttgggtgaaatctaagaaccctctattggggtctgaattgggactcctttctggtaacaaaatcactttcatagtacaaaatggagccagctgctgcccaat

SEQ ID NO: 55858 - DNA, 601 bp, Human
tggaagttatactgcggcaatattaatgcctaattattgtctggcatgggaaaaagcaagccgctgccttcaattactagcagaattacctctctcaaaatagttacgagtaacagatggaatccgaggtagctgctcttattgttaaattatcagagacatttgaaccagagcaactctaccttgaatagggctgggtaaaatgaggccgaggcctattgtgctgcattcccaggagtttaggcattctcagtcacaggatgggagagaaggtcacaagatacaggtcataaagaccccrctgataaagcaggatgcagtaaagaagccagccgaaactggccaaaaaccaccaaaaccaagatggcaatgacagtgacctctggttgtcctcactgctcattatacactaagtataatacattagcatgctaaaagacactctcaccagcaccatgacagttgacaaatgtcatagcaaagcctagaggttaccctatatggtctaaaaaggggaggaaccctagttccgggaattgcctgcccctttctaggacagctcatgaattacccaccccttgtttagcatatgatcaacaaa

SEQ ID NO: 55859 - DNA, 601 bp, Human
attgctggaagttatactgcggcaatattaatgcctaattattgtctggcatgggaaaaagcaagccgctgccttcaattactagcagaattacctctctcaaaatagttacgagtaacagatggaatccgaggtagctgctcttattgttaaattatcagagacatttgaaccagagcaactctaccttgaatagggctgggtaaaatgaggccgaggcctattgtgctgcattcccaggagtttaggcattctcagtcacaggatgggagagaaggtcacaagatacaggtcataaagrccccgctgataaagcaggatgcagtaaagaagccagccgaaactggccaaaaaccaccaaaaccaagatggcaatgacagtgacctctggttgtcctcactgctcattatacactaagtataatacattagcatgctaaaagacactctcaccagcaccatgacagttgacaaatgtcatagcaaagcctagaggttaccctatatggtctaaaaaggggaggaaccctagttccgggaattgcctgcccctttctaggacagctcatgaattacccaccccttgtttagcatatgatca

SEQ ID NO: 55860 - DNA, 601 bp, Human
aggtagagacagggtttcaccatgttggccaggctggtcttgaactcctgaccttgtgatccactcgcctcggcctcccaaagtgctgggattacaggcgtgagccactgcgcccagcccacagtctcttttcaaatgactattccaattcaccttgaggcagaaagcacagactccagtggtctgcattgaggataaatgatttagagtcaaaagaaaataaacttaaaaggtgagaggagtcacacacagctgaaacctgccagaaaacttaccccagtaagcgcaaagttagaaagcraatttgcatacagcccctgggaagctggcctacagtttaaccgcctcaatttatttaacaaacctaagtaataaactttcttcacccacatgcttctcaactaaaatctagtctcaattagcaaatctcataaaattgctttgatatttggtaaaactttcctcttgaacttttatacaagaaaacattgaactttcagtacaattatactaagtttaaataaaagtaattacctaatttgcaagagaaattacttagaaaaatgtcaccaggctcaaaagaagaatggatgaattgctg

SEQ ID NO: 55861 - DNA, 601 bp, Human
gaagttgccaaccagagcctttatctgctgtcccagaaaatccaagtgttgaaaaataagatgaaccaaatgaccagagagagctggagttttggcatggccttcaaagagcacctgtgtagtaaaagcacagtgaagcgtcccattggttaggaaatttttacccaaaaagtcacagattctacaataaagagacataaagctgtctggcaggaaggacattcgtgacctgttattattcaaataaaccaatgcaattaggcaaatggtcacagtctcttttctttttttttttttttttgagacagagttttgctctgtcccccaggctggagtacagtggcgcgatcttggctcactgcaacctctgcttcccaggtttaggcaattctctgcctcagcctaaagagtagctgggattacaggcgtgtgccatgacgcctggctaatttttttggttttttttttaggtagagacagggtttcaccatgttggccaggctggtcttgaactcctgaccttgtgatccactcgcctcggcctcccaaagtgctgggattacaggcgtgagccactgcgcccagcccacagtctcttttc

SEQ ID NO: 55862 - DNA, 601 bp, Human
ctcaggaaggttccattaaaaacagtggcccagaggaggaatccagaaacatttttatagtcttgattgcctactttcctgtccacagaagaaacactaaagtatgtcaatgctattggcagtggtggccacagagcagctctctgcccagctgtgaagttgccaaccagagcctttatctgctgtcccagaaaatccaagtgttgaaaaataagatgaaccaaatgaccagagagagctggagttttggcatggccttcaaagagcacctgtgtagtaaaagcacagtgaagcgtcccaytggttaggaaatttttacccaaaaagtcacagattctacaataaagagacataaagctgtctggcaggaaggacattcgtgacctgttattattcaaataaaccaatgcaattaggcaaatggtcacagtctcttttctttttttttttttttttgagacagagttttgctctgtcccccaggctggagtacagtggcgcgatcttggctcactgcaacctctgcttcccaggtttaggcaattctctgcctcagcctaaagagtagctgggattacaggcgtgtgccatgacgcctggc

SEQ ID NO: 55863 - DNA, 601 bp, Human
agggagaagagggccaggtgcagtggctcatgcctataatcccagcactttgggaggccgaggtggatggatcatctcaggtcaggagttcaagaccagcctgtgcaacatggtgaaaccccatctctactaaaaatacaagaattagctgggtgtggtggcaggtgcctgtaatcctagctactcgggaggctgaggcaggagaagcgcttgaacccaggaggtggaggttgcagtgagccgagattgcgccactgcactccagtctgggtgacagagtgagactttgtctcaaaaaaamaaaaaaagaaagaaagaaagaaagaaaagggagaagtggggcaggaagaggggtgtgaagacatagatgcacatgattctagttttcagtaaaaactagaatcaacctccatctggaataaggcatagggtttaagagcacaggctctggaatcacagtgcctgaatttgaatcccagatccaccatttatatgttgtgtgcccttggccaagttatcactatacagaggtgctatgaggataaaatataataatccacataaagcatttagcacagagccttgcacaaagtaaatgctc

SEQ ID NO: 55864 - DNA, 601 bp, Human
attaagcatttctaccatctttccactcagtttcccctcacctcgacctcagctcgaggacaaaacctggctggtcctttagagtatttttattctggaaagatcaaatgtgttccaaaaagtaatgcctctcttggatcaacttccaactgacgttcacaactttcccttcctcaaccctcccttcccaaaaaacctctagtttgctgagaggttgagaggaaggggaggaaattaacatttactgagtatccaagatatgcaggcatttttattttttaaagttaggtggtgaaaatayggagaaaattcagtatctcaaacatttaacttgctaagaattaaacacatctataggtatgtaaatcacggcaaattttggaatgatatttattgctcctgatgacatccacatccatgctcttctgtgtatgtgcactgtttcagagaaatggttactcctctctttcacaatttaaaaaaaatcatcaccgacgtggtgtaatcatttttactgtataagcccaagtgttctcaaatgctgtaaaaagcggtcacagaatccaaggcaaacagcactaatatgcctatacttcaaaat

SEQ ID NO: 55865 - DNA, 601 bp, Human
tgggcgtggtggcaggcacctataatcccagctacttaggaggctgaggcaggagaatcacttgaacccaggaggcggaggttgcagtgagccgagattgcgccactgcactccagcctgggtgacagaatgaaactccttctcaaaattaaataaataaataatgtaaaatacacgatgttaaaaaaaaaaatatgatatccctccttcccttcttggatagagaatgaatgccctggtctgtcaattaagcatttctaccatctttccactcagtttcccctcacctcgacctcagctygaggacaaaacctggctggtcctttagagtatttttattctggaaagatcaaatgtgttccaaaaagtaatgcctctcttggatcaacttccaactgacgttcacaactttcccttcctcaaccctcccttcccaaaaaacctctagtttgctgagaggttgagaggaaggggaggaaattaacatttactgagtatccaagatatgcaggcatttttattttttaaagttaggtggtgaaaatacggagaaaattcagtatctcaaacatttaacttgctaagaattaaacacatctat

SEQ ID NO: 55866 - DNA, 601 bp, Human
ttccagagttctgcctagcaggctaaatgactggtgagcgtagctctgtccctagctggggaagcactgatgaagtaactatttgtgcacagctactcattatcctcagcagtgaggctgagaccagcggttgagatattatggtccaccacctatttttgtatggcccatgagctaagaatgaattttatattttgaaatgattttttaaaaatcaaaaaaggatatttcatgacgtgaaaattatatgaaattcaaattgactccataaatgaagttttatatggatgcagctatgctyatttacatactgtctatggctgctttcatgctgtaacagcagcgttgagttgttgagacagggattgtatgagccacaaataaaaaataatcactatctggtcccttacagaaaaagtgtgctgagtcctgctacagaccttgaccctactctttggagtttaaaagtgatacatgtttagcacctctcttttcatctccattttcattcaccacagaaggaacacacaccttatgtctgaattcacagggaagcaaaaagaacttgggaaaatgtgacccaaacaagcagcatctgaat

SEQ ID NO: 55867 - DNA, 601 bp, Human
cagaattccagagttctgcctagcaggctaaatgactggtgagcgtagctctgtccctagctggggaagcactgatgaagtaactatttgtgcacagctactcattatcctcagcagtgaggctgagaccagcggttgagatattatggtccaccacctatttttgtatggcccatgagctaagaatgaattttatattttgaaatgattttttaaaaatcaaaaaaggatatttcatgacgtgaaaattatatgaaattcaaattgactccataaatgaagttttatatggatgcagctrtgctcatttacatactgtctatggctgctttcatgctgtaacagcagcgttgagttgttgagacagggattgtatgagccacaaataaaaaataatcactatctggtcccttacagaaaaagtgtgctgagtcctgctacagaccttgaccctactctttggagtttaaaagtgatacatgtttagcacctctcttttcatctccattttcattcaccacagaaggaacacacaccttatgtctgaattcacagggaagcaaaaagaacttgggaaaatgtgacccaaacaagcagcatc

SEQ ID NO: 55868 - DNA, 601 bp, Human
tacaagcatgtgccaccacaccagctaatttttatatttcttgtaaagacaggatttcaccacattgccctggctggtctctaactcatgggctcaagcaatccatccatctgcctcgacctcccaaaggccgagggactataggcgcgagccactgcgcccagccttcaaaatattcttttaatttaatatacacattttctaaaagtatctttgttctcctagccttagtgctattatcctatagtttaactccccttcattgctcatcaggattatcacagaggcccccttatctccwccactaccctccccccaattatttcctcctccacatttgcccccagagtgaatattctagagcccagagctgatcatgttataaccctgactaaaccccttgatgactctccttcctttatagggaaaaaaatccacactctttaacatggcacacaaagttctccctcccttctctatcctctctctccagcctcctttcctgatggagtccttcacccatggtgggctccccatacttagtaatttaagcttcccaaattctctatgctgctctttgtcatcatgctttgcaagccat

SEQ ID NO: 55869 - DNA, 601 bp, Human
gtgtagtctaatattattctgctttcaaaatattctttttttttttttttttttgagggtctcactttgttgctcaggctggagggcagtggcgccctcagctcactgcagcctccgcctcccaggcaatccttccattttagcctcccgagtagctggaactacaagcatgtgccaccacaccagctaatttttatatttcttgtaaagacaggatttcaccacattgccctggctggtctctaactcatgggctcaagcaatccatccatctgcctcgacctcccaaaggccgagggaytataggcgcgagccactgcgcccagccttcaaaatattcttttaatttaatatacacattttctaaaagtatctttgttctcctagccttagtgctattatcctatagtttaactccccttcattgctcatcaggattatcacagaggcccccttatctccaccactaccctccccccaattatttcctcctccacatttgcccccagagtgaatattctagagcccagagctgatcatgttataaccctgactaaaccccttgatgactctccttcctttatagggaaaaaaatccaca

SEQ ID NO: 55870 - DNA, 601 bp, Human
gttgacaatcagttgcataggctctccaatttgaagaaaatttgaaggcaaacacctaaacttagggaatttgggtccgacaatttgtgtgtgtgtttgtgtatatctttttatttacttacaaaaaaattcaatacctttaagtaccatgcttttccagtgtagtctaatattattctgctttcaaaatattctttttttttttttttttttgagggtctcactttgttgctcaggctggagggcagtggcgccctcagctcactgcagcctccgcctcccaggcaatccttccattttrgcctcccgagtagctggaactacaagcatgtgccaccacaccagctaatttttatatttcttgtaaagacaggatttcaccacattgccctggctggtctctaactcatgggctcaagcaatccatccatctgcctcgacctcccaaaggccgagggactataggcgcgagccactgcgcccagccttcaaaatattcttttaatttaatatacacattttctaaaagtatctttgttctcctagccttagtgctattatcctatagtttaactccccttcattgctcatcaggattatc

SEQ ID NO: 55871 - DNA, 601 bp, Human
ataaatactgtgagaaagctctgtcaatgatcctctttagatatcaaaactataatgagttacccagaaattttaagcattgcattttgttgacaatcagttgcataggctctccaatttgaagaaaatttgaaggcaaacacctaaacttagggaatttgggtccgacaatttgtgtgtgtgtttgtgtatatctttttatttacttacaaaaaaattcaatacctttaagtaccatgcttttccagtgtagtctaatattattctgctttcaaaatattctttttttttttttttttttgagggtctcactttgttgctcaggctggagggcagtggcgccctcagctcactgcagcctccgcctcccaggcaatccttccattttagcctcccgagtagctggaactacaagcatgtgccaccacaccagctaatttttatatttcttgtaaagacaggatttcaccacattgccctggctggtctctaactcatgggctcaagcaatccatccatctgcctcgacctcccaaaggccgagggactataggcgcgagccactgcgcccagccttcaaaatattcttttaatttaatat

SEQ ID NO: 55872 - DNA, 601 bp, Human
atcacaatgtattctatggagaaccaagatttaagcaaagggtcatcaaagtctcagcagaaactgacacttttccatttggtaataaatactgtgagaaagctctgtcaatgatcctctttagatatcaaaactataatgagttacccagaaattttaagcattgcattttgttgacaatcagttgcataggctctccaatttgaagaaaatttgaaggcaaacacctaaacttagggaatttgggtccgacaatttgtgtgtgtgtttgtgtatatctttttatttacttacaaaaaaattcaatacctttaagtaccatgcttttccagtgtagtctaatattattctgctttcaaaatattctttttttttttttttttttgagggtctcactttgttgctcaggctggagggcagtggcgccctcagctcactgcagcctccgcctcccaggcaatccttccattttagcctcccgagtagctggaactacaagcatgtgccaccacaccagctaatttttatatttcttgtaaagacaggatttcaccacattgccctggctggtctctaactcatgggctcaagcaatccatcc

SEQ ID NO: 55873 - DNA, 601 bp, Human
aacataaatcacaatgtattctatggagaaccaagatttaagcaaagggtcatcaaagtctcagcagaaactgacacttttccatttggtaataaatactgtgagaaagctctgtcaatgatcctctttagatatcaaaactataatgagttacccagaaattttaagcattgcattttgttgacaatcagttgcataggctctccaatttgaagaaaatttgaaggcaaacacctaaacttagggaatttgggtccgacaatttgtgtgtgtgtttgtgtatatctttttatttacttasaaaaaaattcaatacctttaagtaccatgcttttccagtgtagtctaatattattctgctttcaaaatattctttttttttttttttttttgagggtctcactttgttgctcaggctggagggcagtggcgccctcagctcactgcagcctccgcctcccaggcaatccttccattttagcctcccgagtagctggaactacaagcatgtgccaccacaccagctaatttttatatttcttgtaaagacaggatttcaccacattgccctggctggtctctaactcatgggctcaagcaa

SEQ ID NO: 55874 - DNA, 601 bp, Human
ggaaaaaatatgagcaaaaaggggaaaggggaagggggaagggggaatgagagcagaagtctccttatcaaaactcaaagtttggcaaatgttcactaaccaactcattcttaggaaagcccaggaggttttatttcgaaatagttgcataaagacttacgtggagaaattggatttggttccttcatgcttggacctttttctgaaacaaaaacataaatcacaatgtattctatggagaaccaagatttaagcaaagggtcatcaaagtctcagcagaaactgacacttttccatttgktaataaatactgtgagaaagctctgtcaatgatcctctttagatatcaaaactataatgagttacccagaaattttaagcattgcattttgttgacaatcagttgcataggctctccaatttgaagaaaatttgaaggcaaacacctaaacttagggaatttgggtccgacaatttgtgtgtgtgtttgtgtatatctttttatttacttacaaaaaaattcaatacctttaagtaccatgcttttccagtgtagtctaatattattctgctttcaaaatattctttttttttttttttt

SEQ ID NO: 55875 - DNA, 601 bp, Human; identical to SEQ ID NO: 26861

SEQ ID NO: 55876 - DNA, 601 bp, Human; identical to SEQ ID NO: 26862

SEQ ID NO: 55877 - DNA, 601 bp, Human; identical to SEQ ID NO: 26863

SEQ ID NO: 55878 - DNA, 601 bp, Human
aagaccgattttatacattctagttctccagaatgccgcaaaatgcatgtcactcctgcccatagttgaaaggaaactaagaaagaatcaatagcaggacaatccatttgttctttctccattgcactaaagactccctttgctggcctgcattctgtattggggtcagaacaggttctctcatcaggctagtatgtttcaaccttgggattggtagggaggagcacatctgaattttgaagattgagggataatagcttgaaaatgaagtgctctgtttcatcactttttttttttttttcagttcatggaaatctatttagaaaatttaactttatagaaaaacatgaaaattttatgttttatcaaagaagacatagcatgggttaaaaaaaggttgagaaaatctggtttaagtcattgattaaggactctgatggacagtgctcaataccttggcaggtgtggtaataaaatcttggctttctttttcacttcctctcatgtatatgcctatccttaagtctttggttttgacggaatggtttgtatttctgtacgttgtctgcattaactttaaactctaacaacaaagtagctt

SEQ ID NO: 55879 - DNA, 601 bp, Human
gttattcaaattaaggattgtttttcacacagaggcagatgctatctgaacccccaaatacagcatatacgatctgtgagttccacagcttcaatcactgttgaaattgaacggactgagccagtatttgtatcctggctctccccattgcccactgcattataatcttccttattaatctaaattgctgctagctgacccaggtaacaaactgaaggggttctggaaaagaactatcatgtggtcctgaagtgagtcttcttcatgcttgtatgatgctggtattcctcaagagcaatcyataaaatgaaccagaggctacagtttttaataaaaagtaattttgaagctgtctcataagtcatgccaatggattttaagcccaaatgacagtgtctataaaccttttaccttctgaatcagtgtaattcattttgctggaaagcatcacaggagggaggtctttggtttcatttttcttaaatttacttacaaacctatttctacattaacagtacttgaaaggccctcctgaagtctctggcttgggggaaaaaggatcagtaacaacagacttccaaattcaatgaggatgaataca

SEQ ID NO: 55880 - DNA, 601 bp, Human
atccagccttaagggaatatctcttattgtgcccagagttgtcatatgataaagtgggaacccagtctttgtagagtaacacacattccaggtatgtaagtagatatccacaatccaaatttgtgacttggttttgtgctccgtgctgcacatggaatggaaagcgtaaacaaaggaaaagttattcaaattaaggattgtttttcacacagaggcagatgctatctgaacccccaaatacagcatatacgatctgtgagttccacagcttcaatcactgttgaaattgaacggactgagycagtatttgtatcctggctctccccattgcccactgcattataatcttccttattaatctaaattgctgctagctgacccaggtaacaaactgaaggggttctggaaaagaactatcatgtggtcctgaagtgagtcttcttcatgcttgtatgatgctggtattcctcaagagcaatctataaaatgaaccagaggctacagtttttaataaaaagtaattttgaagctgtctcataagtcatgccaatggattttaagcccaaatgacagtgtctataaaccttttaccttctgaatc

SEQ ID NO: 55881 - DNA, 601 bp, Human
ttgcgccattgcactccagcccgggtgacagagcgagactccgtctcaaaacaaaaaaaagaaaaaaaagaaaagaaaattaagctaatggggtagggtggggaaagataataattaattctagggaaaattaaaagtcatgcaggatattatactacatgagttaactgtgattagcatttaggtagtcataataatgtaaacagtaaatgctgctctaaccaaaatgtcagtatatttctattaagaggatggtgggggaaggggacattttccataacaggaggtctagagcaaaggygtaaacctgcaaagtcaaaaagcagcaatatactcaggttatttagaagtatggattaacatccaaaaggatgagctaagcgccaaaaataatgctctggggagtgagaaaagaaggtaaggacagtaggggtgtgatttttttttcataatgagtcttgtaggattatttcaacctttaaactatttgcatgtactactttgatgaagctaaaaagttttactagaaaataaaaataaaagcatttgttcctcccttcaagaaaaaaacagataagattttgcatgtgactttagggac

SEQ ID NO: 55882 - DNA, 601 bp, Human
attaaaaaagttattggaattaaaaaatttgaagccagtattaaaaactcagtaaaaaactgaaagataaagatgagacaatctcccagaaaataaagaaagcagacacatggaaaacaggaaagaaaggaaaattaaaggacaagaggttcaactttcaaataaaatgatttctaaaatgagagaaaacagaaaaaagggggtgagaaaaaaataaatcattcttaaaaatctcagtactgaaagatatgagtttctaaactgaaagggcccaattagtgaccagcataatgtataaacrtacacctaactcaagagatatcattgtaaaatttcttccagaaagaaaaaacaggttatatacaaaagggatcaggaatctgcacagctctgaacttctcaacagcaatcctcagagctagaagacaatgaggagggctttcaaaagtccgaaggaaaaagtgtctataatctaacattctgtaccttgccaaactgtctaccaggtgtttctgttaaatgaggatattttcagacatgcaaggtgtgaaaaacatttgcgtcctctgtacgctttaaaccaggaagaagaaaggcagga

SEQ ID NO: 55883 - DNA, 601 bp, Human
tgggctcagttttctcgctacgtaaaaaggaaatgctgatgcagactagtaattttccaaggactccctttaagaaactgattaaaaaaaaaaaaaaaaaaaaaaaagcaagggtacgactttgcatagagatagtgcatttaaaggcattgacttgcattcctttcccaaatcttaccagaatgacagtaaatggacttttaaaggcataaacacatgaaaacaaagataacaaaagtaaagataacagcaataaaatatattggaagctggtgaggaaatgggtgagtagcaactgacytggcagactcaagagagccgaaacctaagccaacagtgggaaaaactgagaaacaagcaatttatgtcgccgaacccttaaaaaactcagggaatggtggcatcaggcacctctggaaacctcccttgaacatatggctataagcaagaggggttggctgaactatatgagaagcagaatagttctctacatttcctccctcgctccactgggctgagatctgcccttcctaatccaggaagaagacgggaattttactctcttaagaggaggaaactgaaggttccagaaatgatcaac

SEQ ID NO: 55884 - DNA, 601 bp, Human
aagaaaaaccaaaacacatgttaattaatgtttattatctgataagcagaaggaggataaaaagattatggctacgtgacctttgaatttgtaataacagaacaggaagaaaagagtgaactctgaatcaagaaagcaagccttcagtcctggccgctgtgcctgggtaactttgagcttgtcacatcagttctctgggctcagttttctcgctacgtaaaaaggaaatgctgatgcagactagtaattttccaaggactccctttaagaaactgattaaaaaaaaaaaaaaaaaaaaaaaagcaagggtacgactttgcatagagatagtgcatttaaaggcattgacttgcattcctttcccaaatcttaccagaatgacagtaaatggacttttaaaggcataaacacatgaaaacaaagataacaaaagtaaagataacagcaataaaatatattggaagctggtgaggaaatgggtgagtagcaactgacttggcagactcaagagagccgaaacctaagccaacagtgggaaaaactgagaaacaagcaatttatgtcgccgaacccttaaaaaactcagggaatggtggcatca

SEQ ID NO: 55885 - DNA, 601 bp, Human
agaggcaaaaagaaaaaccaaaacacatgttaattaatgtttattatctgataagcagaaggaggataaaaagattatggctacgtgacctttgaatttgtaataacagaacaggaagaaaagagtgaactctgaatcaagaaagcaagccttcagtcctggccgctgtgcctgggtaactttgagcttgtcacatcagttctctgggctcagttttctcgctacgtaaaaaggaaatgctgatgcagactagtaattttccaaggactccctttaagaaactgattaaaaaaaaaaaaaraaaaaaaaaagcaagggtacgactttgcatagagatagtgcatttaaaggcattgacttgcattcctttcccaaatcttaccagaatgacagtaaatggacttttaaaggcataaacacatgaaaacaaagataacaaaagtaaagataacagcaataaaatatattggaagctggtgaggaaatgggtgagtagcaactgacttggcagactcaagagagccgaaacctaagccaacagtgggaaaaactgagaaacaagcaatttatgtcgccgaacccttaaaaaactcagggaatg

SEQ ID NO: 55886 - DNA, 601 bp, Human
aatccattgaataagttgagtgaaagaacgaatacatgagtgaacaaaccaaaaaaatttagctgacactaaacagaggcaaaaagaaaaaccaaaacacatgttaattaatgtttattatctgataagcagaaggaggataaaaagattatggctacgtgacctttgaatttgtaataacagaacaggaagaaaagagtgaactctgaatcaagaaagcaagccttcagtcctggccgctgtgcctgggtaactttgagcttgtcacatcagttctctgggctcagttttctcgctacgyaaaaaggaaatgctgatgcagactagtaattttccaaggactccctttaagaaactgattaaaaaaaaaaaaaaaaaaaaaaaagcaagggtacgactttgcatagagatagtgcatttaaaggcattgacttgcattcctttcccaaatcttaccagaatgacagtaaatggacttttaaaggcataaacacatgaaaacaaagataacaaaagtaaagataacagcaataaaatatattggaagctggtgaggaaatgggtgagtagcaactgacttggcagactcaagagagccgaa

SEQ ID NO: 55887 - DNA, 601 bp, Human
caggaggggtgagttagatgttgttagaagtcacggggaaaagactatatcaagaattaaagtttttcacaatgtcctgcctactactttctttctatattcctgcagtgtggccaacctgtttgtatatggactttggttttctgtggtatcttccctgcctttgtggcccctgaataggatgcaaaatctgataataactaagaagaagaagaaaagcaagagggaaagagaaatcaggtggaggaggaaggctgtcctccacagctatcgctacaaccctgagtcagaaactggactygaagctctggtttgttcaatggctagacttgctaccttagtaggtgtattagttgtgtttccctttagtcaacacagagataatcactacttcacagggttattagggtgagcgtacttaaaacaagaaatgcgtaataaaagctttttcaactttaaggctgctctgatgtgtaagcagaaaaaaaatctaagcgtgtaaggaacactgtttcacagagcataataaaatgctgaagttttgaattaggtgtgcccgtcccaactcatcaggcagttttcaacaaccctccatggaaca

SEQ ID NO: 55888 - DNA, 601 bp, Human
ttttcactgtcaaatggaagtgatgctacagaaaaattcaccatgaggaagaaagttgaatgtacagatgcttctacttaatgggccaacagagacccctgggttttctgagatgggtctttggctgtctgctctccactgcagtggtctctgatttcgtggagcaccaactttctctaaaacatcccttgggtgacaagtataacaaggctgctcctaaaggagatgggcagggaggacctcgtggctaagcagactaggcccaattaacacatctaagaaattcaaggagggcgccttrcttgtaaataaatatcagacttggccagcagaggaaatgtactcagtcttcctgctttcctcctaaaatatcaaaccacattgagggaacagagatttgagaggagggagagtgagtaggggagagaggaatttggtgcctgacatactctggaggaggagagtacactgaggataaggacactaaggattaattccacccatctcacagttagcctatggctgggcctagatactgccagagatgcctcaagaaatagaaaaacaaagccaggtgcagtcacttacagtgccagcttag

SEQ ID NO: 55889 - DNA, 601 bp, Human
cattctctttctggggcccctcaaaagcctctgtgaaaaaagcagttctgcaaaatgtagaactggctcatgtccctgggtctggttacagcttttcctgtcacccctttcatgaaccacacagctatacacacttttgcatcaacctcaaagtatttatgtgcttgttgtaagtttggcccttgttgtacttcctctaattatcttttcttctgggattggcgggatggataggggactggggtcaatattcctgagaagcggagaagcactgcctttttttttttttttttttttttgkgagacggagtctcgctctgtcccctaggatggactgcagtggcatgatcttggctcactgcaacctccaccccccgggttcaagcaattctcctgtctcagcctcccgagtacctgggactacaggcatgtgccaccatgcctggctaattttttgtatttttagtagagacacgatttcactgtgttagccaggatggtatcgatctcctgacctcgtgatcggcccaccttggccttccatagtgctgggattacaggcgtgagccaccacgcccggctgaaacactgcttttgactt

SEQ ID NO: 55890 - DNA, 601 bp, Human
agcaactagactaggtcctagatggctggaataccttctaaaataaggttttgctatttgttgttttatttttaaagcatcatgaatgggaaaaagaagacagctgactgacaggcagctctagtggctaagacccctgagagttgatgacaaagtccctggatttcagggtccacaacctttgatgaaatcaccaccacttggtctgtgtgagctggcaactgaccagcacctgtattcaggaaacactgtccatcttctctcataaagacactgtaggatttggagggtgtgacctttmaattgtagttaagagaaccctggaagtttgggagccttgttctgaatgcacttgttaaaaacaggagtgaaatatagactttgtcctagctacagtagagagagccttgtgtgccaaacagataaattacctgagaaaccggggtgggggatagctgctattggaaaaaccttttggggaaggggtttagctgtttgcacatggggactgcagttgccagcgaatggcctctcttccccactgaggttccctgtggggtgcagtgtgagtatctcctaacactttaagcatcccactttt

SEQ ID NO: 55891 - DNA, 601 bp, Human; identical to SEQ ID NO: 26864

SEQ ID NO: 55892 - DNA, 601 bp, Human; identical to SEQ ID NO: 26865

SEQ ID NO: 55893 - DNA, 601 bp, Human; identical to SEQ ID NO: 39209

SEQ ID NO: 55894 - DNA, 601 bp, Human; identical to SEQ ID NO: 39210

SEQ ID NO: 55895 - DNA, 601 bp, Human; identical to SEQ ID NO: 39211

SEQ ID NO: 55896 - DNA, 601 bp, Human; identical to SEQ ID NO: 39212

SEQ ID NO: 55897 - DNA, 601 bp, Human; identical to SEQ ID NO: 39213

SEQ ID NO: 55898 - DNA, 601 bp, Human; identical to SEQ ID NO: 39214

SEQ ID NO: 55899 - DNA, 601 bp, Human; identical to SEQ ID NO: 39215

SEQ ID NO: 55900 - DNA, 601 bp, Human; identical to SEQ ID NO: 39216

SEQ ID NO: 55901 - DNA, 601 bp, Human; identical to SEQ ID NO: 39217

SEQ ID NO: 55902 - DNA, 601 bp, Human; identical to SEQ ID NO: 39218

SEQ ID NO: 55903 - DNA, 601 bp, Human; identical to SEQ ID NO: 39219

SEQ ID NO: 55904 - DNA, 601 bp, Human; identical to SEQ ID NO: 39220

SEQ ID NO: 55905 - DNA, 601 bp, Human; identical to SEQ ID NO: 39221

SEQ ID NO: 55906 - DNA, 601 bp, Human; identical to SEQ ID NO: 39209

SEQ ID NO: 55907 - DNA, 601 bp, Human; identical to SEQ ID NO: 39210

SEQ ID NO: 55908 - DNA, 601 bp, Human; identical to SEQ ID NO: 39211

SEQ ID NO: 55909 - DNA, 601 bp, Human; identical to SEQ ID NO: 39212

SEQ ID NO: 55910 - DNA, 601 bp, Human; identical to SEQ ID NO: 39213

SEQ ID NO: 55911 - DNA, 601 bp, Human; identical to SEQ ID NO: 39214

SEQ ID NO: 55912 - DNA, 601 bp, Human; identical to SEQ ID NO: 39215

SEQ ID NO: 55913 - DNA, 601 bp, Human; identical to SEQ ID NO: 39216

SEQ ID NO: 55914 - DNA, 601 bp, Human; identical to SEQ ID NO: 39217

SEQ ID NO: 55915 - DNA, 601 bp, Human; identical to SEQ ID NO: 39218

SEQ ID NO: 55916 - DNA, 601 bp, Human; identical to SEQ ID NO: 39219

SEQ ID NO: 55917 - DNA, 601 bp, Human; identical to SEQ ID NO: 39220

SEQ ID NO: 55918 - DNA, 601 bp, Human; identical to SEQ ID NO: 39221

SEQ ID NO: 55919 - DNA, 601 bp, Human; identical to SEQ ID NO: 39209

SEQ ID NO: 55920 - DNA, 601 bp, Human; identical to SEQ ID NO: 39210

SEQ ID NO: 55921 - DNA, 601 bp, Human; identical to SEQ ID NO: 39211

SEQ ID NO: 55922 - DNA, 601 bp, Human; identical to SEQ ID NO: 39212

SEQ ID NO: 55923 - DNA, 601 bp, Human; identical to SEQ ID NO: 39213

SEQ ID NO: 55924 - DNA, 601 bp, Human; identical to SEQ ID NO: 39214

SEQ ID NO: 55925 - DNA, 601 bp, Human; identical to SEQ ID NO: 39215

SEQ ID NO: 55926 - DNA, 601 bp, Human; identical to SEQ ID NO: 39216

SEQ ID NO: 55927 - DNA, 601 bp, Human; identical to SEQ ID NO: 39217

SEQ ID NO: 55928 - DNA, 601 bp, Human; identical to SEQ ID NO: 39218

SEQ ID NO: 55929 - DNA, 601 bp, Human; identical to SEQ ID NO: 39219

SEQ ID NO: 55930 - DNA, 601 bp, Human; identical to SEQ ID NO: 39220

SEQ ID NO: 55931 - DNA, 601 bp, Human; identical to SEQ ID NO: 39221

SEQ ID NO: 55932 - DNA, 601 bp, Human; identical to SEQ ID NO: 39209

SEQ ID NO: 55933 - DNA, 601 bp, Human; identical to SEQ ID NO: 39210

SEQ ID NO: 55934 - DNA, 601 bp, Human; identical to SEQ ID NO: 39211

SEQ ID NO: 55935 - DNA, 601 bp, Human; identical to SEQ ID NO: 39212

SEQ ID NO: 55936 - DNA, 601 bp, Human; identical to SEQ ID NO: 39213

SEQ ID NO: 55937 - DNA, 601 bp, Human; identical to SEQ ID NO: 39214

SEQ ID NO: 55938 - DNA, 601 bp, Human; identical to SEQ ID NO: 39215

SEQ ID NO: 55939 - DNA, 601 bp, Human; identical to SEQ ID NO: 39216

SEQ ID NO: 55940 - DNA, 601 bp, Human; identical to SEQ ID NO: 39217

SEQ ID NO: 55941 - DNA, 601 bp, Human; identical to SEQ ID NO: 39218

SEQ ID NO: 55942 - DNA, 601 bp, Human; identical to SEQ ID NO: 39219

SEQ ID NO: 55943 - DNA, 601 bp, Human; identical to SEQ ID NO: 39220

SEQ ID NO: 55944 - DNA, 601 bp, Human; identical to SEQ ID NO: 39221

SEQ ID NO: 55945 - DNA, 601 bp, Human; identical to SEQ ID NO: 21397

SEQ ID NO: 55946 - DNA, 601 bp, Human; identical to SEQ ID NO: 21398

SEQ ID NO: 55947 - DNA, 601 bp, Human
tgatcaagccattgcactccagcctgggcaacaagagcgaaactctatctcaaaaaaaaaaaataaaaagtgtttccattgtgaattatataatttcctacagggaaaaccacttttatttatagttcaaagtcatgattatgattatcagttatattttcctgtaaacctgagatgcctccaagggctacagtaggtctacaggactgtttgcccttctgtcaccaaatggtcccagattgctatcctttttgagctagttttttctgacatcatgctatatattttcactgatcagtaytgtcatgtgcccagctccttcaataaaccaccattacctcctaattttctttttaaatctgttgtaggatgtaaatcaggaagccataattattagaatttcatgtcaacataagcaaatgaagacctctccaacagaataagggtactgcactttgtgacagctctttcagtgccttatggacccttttccatctactgtgagctctcagctaggaacaacaaagcagaatttgcagaaatctgacctatgaaaaagtgaagtattacttatatatgttacttaccaattttttctttc

SEQ ID NO: 55948 - DNA, 601 bp, Human
cagaggttgcagtaagccgtgatcaagccattgcactccagcctgggcaacaagagcgaaactctatctcaaaaaaaaaaaataaaaagtgtttccattgtgaattatataatttcctacagggaaaaccacttttatttatagttcaaagtcatgattatgattatcagttatattttcctgtaaacctgagatgcctccaagggctacagtaggtctacaggactgtttgcccttctgtcaccaaatggtcccagattgctatcctttttgagctagttttttctgacatcatgctatmtattttcactgatcagtactgtcatgtgcccagctccttcaataaaccaccattacctcctaattttctttttaaatctgttgtaggatgtaaatcaggaagccataattattagaatttcatgtcaacataagcaaatgaagacctctccaacagaataagggtactgcactttgtgacagctctttcagtgccttatggacccttttccatctactgtgagctctcagctaggaacaacaaagcagaatttgcagaaatctgacctatgaaaaagtgaagtattacttatatatgtta

SEQ ID NO: 55949 - DNA, 601 bp, Human
tcacctgaggtcgggagtttgagaccagcctgaccaacatggagaaaccctgtctctactaaaaatacaaaattagtcaggcatggtgccccatgcttgtaatcccaactactcgggaggctgaggcaggagaatcgcttgaacccaggaggcagaggttgcagtaagccgtgatcaagccattgcactccagcctgggcaacaagagcgaaactctatctcaaaaaaaaaaaataaaaagtgtttccattgtgaattatataatttcctacagggaaaaccacttttatttatagttcaragtcatgattatgattatcagttatattttcctgtaaacctgagatgcctccaagggctacagtaggtctacaggactgtttgcccttctgtcaccaaatggtcccagattgctatcctttttgagctagttttttctgacatcatgctatatattttcactgatcagtactgtcatgtgcccagctccttcaataaaccaccattacctcctaattttctttttaaatctgttgtaggatgtaaatcaggaagccataattattagaatttcatgtcaacataagcaaatgaagacctc

SEQ ID NO: 55950 - DNA, 601 bp, Human
ttgggaggccaaggtgggcagatcacctgaggtcgggagtttgagaccagcctgaccaacatggagaaaccctgtctctactaaaaatacaaaattagtcaggcatggtgccccatgcttgtaatcccaactactcgggaggctgaggcaggagaatcgcttgaacccaggaggcagaggttgcagtaagccgtgatcaagccattgcactccagcctgggcaacaagagcgaaactctatctcaaaaaaaaaaaataaaaagtgtttccattgtgaattatataatttcctacagggaawaccacttttatttatagttcaaagtcatgattatgattatcagttatattttcctgtaaacctgagatgcctccaagggctacagtaggtctacaggactgtttgcccttctgtcaccaaatggtcccagattgctatcctttttgagctagttttttctgacatcatgctatatattttcactgatcagtactgtcatgtgcccagctccttcaataaaccaccattacctcctaattttctttttaaatctgttgtaggatgtaaatcaggaagccataattattagaatttcatgtc

SEQ ID NO: 55951 - DNA, 601 bp, Human
atgtataaaggaaggaataggggttccccataattacattttcccaaatttgtctttcccccaccaaatgtggctttaaaatgctttccttctaaataccaaaaaaacttggggtttttaaaaaaatttaattttattgacaaggtcttgctctgtcacccaggctgcagtggagcaatcacagctcactgcggccttaaactcctgcaatcctcctgcctcaacctcccagagggctgggacttcaggcatgaaccactgcacccagataatttttgcatgttttcgattttttttttttgagacggagtctcgctctgtcgctcaggctggatggagtgcagtggcatgatctcggctcattgcaagctccacctcctgggttcaagccattctcctgccacagcctcctgagtagcagggactacaggtgcccgccaccacgcccagctaattttttgtatttttagggagacagggtttcaccgtgttagccaggatggtctcgatctcctgatctcgtgatccgcctgcctcggcctctcaaagtgctgggattacaggcgtaagccaccgcacccagccgtgttttcaatttttt

SEQ ID NO: 55952 - DNA, 601 bp, Human
aatgatagtttcatgtataaaggaaggaataggggttccccataattacattttcccaaatttgtctttcccccaccaaatgtggctttaaaatgctttccttctaaataccaaaaaaacttggggtttttaaaaaaatttaattttattgacaaggtcttgctctgtcacccaggctgcagtggagcaatcacagctcactgcggccttaaactcctgcaatcctcctgcctcaacctcccagagggctgggacttcaggcatgaaccactgcacccagataatttttgcatgttttcgrttttttttttttgagacggagtctcgctctgtcgctcaggctggatggagtgcagtggcatgatctcggctcattgcaagctccacctcctgggttcaagccattctcctgccacagcctcctgagtagcagggactacaggtgcccgccaccacgcccagctaattttttgtatttttagggagacagggtttcaccgtgttagccaggatggtctcgatctcctgatctcgtgatccgcctgcctcggcctctcaaagtgctgggattacaggcgtaagccaccgcacccagccgtgt

SEQ ID NO: 55953 - DNA, 601 bp, Human
aaaacattttccctttcttgttatcaactgaaaaatagctactgcttcaaacatgttaaatcaaaatgaaaaacatgccaaagataaaaatattacaatgatagtttcatgtataaaggaaggaataggggttccccataattacattttcccaaatttgtctttcccccaccaaatgtggctttaaaatgctttccttctaaataccaaaaaaacttggggtttttaaaaaaatttaattttattgacaaggtcttgctctgtcacccaggctgcagtggagcaatcacagctcactgcsgccttaaactcctgcaatcctcctgcctcaacctcccagagggctgggacttcaggcatgaaccactgcacccagataatttttgcatgttttcgattttttttttttgagacggagtctcgctctgtcgctcaggctggatggagtgcagtggcatgatctcggctcattgcaagctccacctcctgggttcaagccattctcctgccacagcctcctgagtagcagggactacaggtgcccgccaccacgcccagctaattttttgtatttttagggagacagggtttcaccgtgtta

SEQ ID NO: 55954 - DNA, 601 bp, Human
gtagctggaattataggcttataccaccatgcctggctggatatatcctttaaggtctaaccctaaattcaaatactgtaactgccaataaagaaatgagaattgatgtcactggtagttatcaacaaatacatcagtctttcctgtaaacaggtcattttttatgtgtattatttcatttgcatcaaaatatcattagacacgtgtcaaaaaggcccattctgtacaatgaactcatttgggtgtaataacaaaatgagtcaggcataacttcattctccattgtttcaggcttgacttygctacaataatcacttggaggaaagctgttgctattgttgcctctttttcttcacaaaccagaaggtcttttcttgcccattcattaagaatcaaagtcctttagataagaagatactgtcattcaggagggggttcatattgccccaatgaaaaatcagaatgaaaatctgaggtgataagctctgtctgcctccaaacccatatccattgtgggaggcactatttacagaagagtaactgccactaggatcagtgccactgggcaccgtttatattggattttaactgtgggaagaga

SEQ ID NO: 55955 - DNA, 601 bp, Human
aaaaaaaaattttttaactcagcttttcttagatcattgtcaaagacttacatataataagaccagtgagcatggaacctcctgggggagggattgaacagaattaagttccaacaatatgagctgtctcaaactggtagggagggaagggtctttgctccaaatctgatcatgtttccagaacagattcactgatcagacggcttgtcaaatgatatagccttttattttttattatttattttttcttttttctttttttttttttgagacggagtctcgctctgtcgcccaggctggrgtgcagtggcacgatcttggctcactgcaacctccgcctcccgcaggttcacgccaccattctcctgcctcagcctcccaagtagctaggacgatgggtgcctgccaccatgcccggctaactttttgtgtatttttagtagagacggggtttcacagtgttagccaggagggtctcgatctcctgacctcatgatccacccgcctcggcctcccaaagtgctgggattacaggcatgagccactgcgcctggcctagacttttattttttctttcttaagacagggtcttcttgtgccc

SEQ ID NO: 55956 - DNA, 601 bp, Human
ttgagatggagtctcactctgtcactgaggctggagtgcactggtgtgatcttggctcactgcaacctgcacctcccaggttcaagtgattatcctgcctcagcctctccagaagctgggattataggcacccgccaccatgctcagctaatttttttgtattttttagtaaagatggggtttcactatgttggccacactggttttgaactcctgacctcaagtgatgcgtccaccttagccttccaaagtgctgggattacaagcataagccaccacccccagacaaagaaaaaaaaawttttttaactcagcttttcttagatcattgtcaaagacttacatataataagaccagtgagcatggaacctcctgggggagggattgaacagaattaagttccaacaatatgagctgtctcaaactggtagggagggaagggtctttgctccaaatctgatcatgtttccagaacagattcactgatcagacggcttgtcaaatgatatagccttttattttttattatttattttttcttttttctttttttttttttgagacggagtctcgctctgtcgcccaggctggagtgcagtg

SEQ ID NO: 55957 - DNA, 601 bp, Human
ctcggctcactgcaagctccgcttcccgggttcacaccattctcctgcctcagcctcccgagtagctgggactacaggtgcccgccgccacgcccggctaattttttgtatttttagcagagacggggtttcactgtgttagccaggatggtctcgatctcctgacctcgtgatccgcccgcctcggcctcccaaagtgctgatattacaggtgtgagccaccacacccggcccttttttttttttttttaaatgagaagatgtcttgctttatcacctaggctcaagtgcagtggtgcaracacagctcactgcaaccttcacctcctgagctcaaatgatcctcttgccttagcctcctgactagctagactacaggaatgagccaccatgcccagtgaattttcaaattttttatagagatggagtcttgctatgttgcccaggctggtctcaaacccctggcttcatgagatcctcccacctcagtctcccaaagcattaggattacaggcctgagctaccccacctattattcaactaaaagtcagatatagttaagaaagagtaggaagaaaataaatgagtcactgtatttgtt

SEQ ID NO: 55958 - DNA, 601 bp, Human
acaccaccaagcccagcaaattttgtatttttagtagagacaaagcggggtttctccatgttagtcaggctggtgatcatctcaggtgatccacctaccttggactcccaaagtgctgggattacaggcattagccacctcgccaagcctttttttttttttttttgagacggagtctcgctctgctgcccaggcaggagtgcagtggcacaatctcggctcactgcaagctccgcttcccgggttcacaccattctcctgcctcagcctcccgagtagctgggactacaggtgcccgcckccacgcccggctaattttttgtatttttagcagagacggggtttcactgtgttagccaggatggtctcgatctcctgacctcgtgatccgcccgcctcggcctcccaaagtgctgatattacaggtgtgagccaccacacccggcccttttttttttttttttaaatgagaagatgtcttgctttatcacctaggctcaagtgcagtggtgcagacacagctcactgcaaccttcacctcctgagctcaaatgatcctcttgccttagcctcctgactagctagactacaggaatgagcc

SEQ ID NO: 55959 - DNA, 601 bp, Human
ctgacctcaggtgatccacctgcgttggcctcccaaagtgctgagattacaggtgtgagccattgcgcccggcctatctcattatttctgtggtttgggactctgagagtggtttaattagacagttttggctctgaggctctcatgagattgcagtcaagatgtaggctggggctgcagtcaatctgaaggcttgactaggcctggaagacccacctccaagatggctcactcaatggttggcaagttgatgccagctgtgggcaggaagtctcagtagctccccgtgtagatcctccayagggctgcttgaatgtctttataacccagtggctggcttcctccagagcagtcaatccaagaagagcagggcagaagcagtaatgtcttttatgactttgttttggaagtcatacactatcatatccctatattctaatgctcatacagaccaaccctgacgaactgtaaaaggggactacacaaaggcatgaatattaggaggtgagcatcactggggggcatcttggaggctggctactgtaagctgtaaccagtatttgtgtaatattttgtggggttttttttccagtataccata

SEQ ID NO: 55960 - DNA, 601 bp, Human
caaaaaaaaagaaaaagaaaaaaagaaaaaaaaaattggctgggcatggtgcctcatgcctgtaaatcccaacacttgggaggctaaggcaggaggatcactggagcccaggagtttgagaccagcctgggcaacacagcaaaaccctattaaaaaaaatttttttttaatgaaaaaattagccaggcatggcagtgcacacttgcagtcccagctacttgggaggctgaggcagaaggatcacttaagcccaggagttcgaagctgcagtgagctagaatcatgccactgcactccagcmtgggtgacagagcaagaccctgtctcaaaaaataaattaattaagtaaataaatacatgtattaagcaataaaaatatttattatctcatcccttttttatttttttgagacagagtctccctctgttgcccaggttgcagtgcagtggcgtgatcttggctcactgcaacctctgcctcctgggttcaagtgattctcctgtcacagcctccgaagtagctgggactacaggcaccccccaccacacccggctaatttttgtatttctagtagagacggggtttcgccatattggccag

SEQ ID NO: 55961 - DNA, 601 bp, Human
ccttactctcccccaacactgacctctgcgcttattcactcatgcccctgccttagggccttcgctctaagctgtccccactgcctagaaattcttttcctatatatccacttgatgaattcctgcaactccttcaaatacttgtttaaaaatcactttcttattgagatctacttaatactataacctctcaccttcacatgctcccacctctacctgctttctcaactccccttactctgatccacttttcttttttccacaccacttatcacattctaacatactggaaagcttactkatatttattgtctgtgttcctctgatagaatataagctcctcaagagcagaaatctttttgtttactggtgtaacccaagaacctagaagagcgtccaaggtggaattcaataaaaactgacaatagaaatgggctagggtttctctcggccttagcgccattttcttggaaacctctgcatcatgagagctaagtggaggaaaaagcgaatgtgcagtctgaagcacaaaagaagaaagatgaggcagaggtccaagtaaaccgctagcttgttgcaccgtggaggccacacaggagca

SEQ ID NO: 55962 - DNA, 601 bp, Human
agaccacatcgtagttaaatgaaatgagccagaaatcaaacccagatggtttaattccagagccacagtcttaactagtaggccacccaagaaggattatctaacagggctcttggaaaagacagatatgggagtggggaggcgagtgtagagcagagaatggtctgagatgaggctggaaagtgagacttccatcaggatgtgaaagtcttacagcagtctgaccttcttacataaaatcaagagcttatttatttatttatgtagagatggagtctcactatgttacccaggctggtcytgaactcctggcctcatgcaatcctctagcctcagcctcctgaatagctgggataacagggttgagccactgtgcccagctaatcaagagattttgaagatcttaatttcctgctgttgaatacatttccagaatccgaccatttctgaccacttccattgctaccaccttcgcccaagccactatcatctttcatgtgatttgctaatattgtcctaacagatcttcctgcttttatcctcactcccctggagtttgtctccttttaacaaacaaccaaagtcatcctttaatataaat

SEQ ID NO: 55963 - DNA, 601 bp, Human
agagagattagaaaaagatgataggaaaagtatcgtttgatttcatttaaaaatttcctcaagagccatatggagtggcacgtgaccatagtcccaggtactcaggaggctgaggaaagagggtcacttcagccaaggagtgcaagtccagcttggacaacacagtgagaccctatccgtataaaaattaaaaatagcgaggccaggtatgatgactcatgcctgtaatcctagcactttgggaggccaaagtgggaggattgcttgaccccaagagtttgagactagcctgggcaacatrgtgaaatgctatctctacaaaatattaaaaaattagcagggtgtgtctgggcgcagtggctcatgcctgtaatcccagcactttgggaggccaaggcaagcggatcacgaggtcaagagatcgagaccatcctggttaacacggtgaaatcccgtctctactaaaaatacaaaaaattagctgggtgtgatggcgggtgcctatagtcccagctactcgggagggttaggcaggagaatgacgtgaacctgggaggccgagcttgcagtgagccgagattgcaccactgcactccagcct

SEQ ID NO: 55964 - DNA, 601 bp, Human
aagggccgggcgcagtagcttacacctgtaatcccagcacttggggaggccaaggcgggcggatcatgaggtcaggagttccagaccagcctgaccaacatgatgaaaccccatctctaccaaaaatttaaaaattagccaggcatggtggcatgcacctgtaatcccagctattcaggggtctgaggcaggagaatcacttgaacccagggggcggaggttgcagttagccgaggtcgcgtcactgcactccagcctgggcgacagagcgagactccatctcaaaaaaaaaaaaaaaaaaggtaaaggaacaaaaacacaggactaactccctagaggatttggaaacgcatcaagaaaagacatttgagaccaggcacagtggctcacgtctgtaatcctagcactttgggaggccaaggcaggcagattgcttgagctcaggagttcgagaccagcctgggcaacatgatgaaacctcatctccaccaaaaatacaaaaactagtcaggcatggtggaatgcacctgtagtcccagctatttgggaggctgaggtgggaggattgcttgagccccctgggaggtggaggttgctgtga

SEQ ID NO: 55965 - DNA, 601 bp, Human
cagcctggccaacgtggtgaaaccccatatctactaaaaatacaaaaattagccaggtgtggtggcatgcgcctgtaatcccaactactcaggagactgaggaacgagaattgcttgaactcaggacgcagaggttgcagtgagccaagatcacaggattgcaccccagcctgggtgacagagtaagactctgccccccacccccccaaaaaaaacaaaggtaggccgggcacggtggctcactcctgtaatcccagcactttgggaggccaaggtgggcggatcatgaggtcaggagttygagaccagactgaccaacatggtaaaaccgtctctactaaatatacaaaaattagccaggcgcagtggcgcgtgcctgtaatcccagctactcaggagggtgaggcaggagaattgcttgaacctggcaggcggaggttgcagtgagccaagatcaagccactgcactctagactgggcaacagggcgagactccgtctcaaaaaaaaaggtaaagggccgggcgcagtagcttacacctgtaatcccagcacttggggaggccaaggcgggcggatcatgaggtcaggagttccagacc

SEQ ID NO: 55966 - DNA, 601 bp, Human
tggtaaagaagctaggcgcagtagctcacgcctgtaatcccagcactttgggaggccaaagtgggtggattacctcaagttaggagttcgtgaccagcctggccaacgtggtgaaaccccatatctactaaaaatacaaaaattagccaggtgtggtggcatgcgcctgtaatcccaactactcaggagactgaggaacgagaattgcttgaactcaggacgcagaggttgcagtgagccaagatcacaggattgcaccccagcctgggtgacagagtaagactctgccccccaccccccmaaaaaaaacaaaggtaggccgggcacggtggctcactcctgtaatcccagcactttgggaggccaaggtgggcggatcatgaggtcaggagtttgagaccagactgaccaacatggtaaaaccgtctctactaaatatacaaaaattagccaggcgcagtggcgcgtgcctgtaatcccagctactcaggagggtgaggcaggagaattgcttgaacctggcaggcggaggttgcagtgagccaagatcaagccactgcactctagactgggcaacagggcgagactccgtctcaaaaaa

SEQ ID NO: 55967 - DNA, 601 bp, Human
ttgtgccagtttgcaactaacagtgtggcattttgctaactcactcccttctctatccttccctcctcccttactctctttttctctgagtacacaattcgttcatctacttttatcatagttaacttccaactagtaggattatcgctcatagggcggaagctgctcagcaactcatttctgtgtttttgttagccaaatagaaaagttaatagcacttctcaataccttccatccctgacacagaatttagaaacctggatggaacataacttggtctcttaaaaaaaaaaaaaaaaaactttagaaacctgggcattcacctgtctagttaataagcatgtactgagtatctaatatataccaggcactgtgctagattcttgatatatacagaggaatccgatatagaagaaatttcagcttactggagaaaacagggctgggcacagtggctcttgtctgtaatcttagcactttggaaggtcgaggcaggaggattacttgaggtcaggatttcaagaccaccttgggcaacacagtgaagctctgtctctacaaaaataaaaaaattatctgggcatggtggcatgcacctgta

SEQ ID NO: 55968 - DNA, 601 bp, Human
tttccccacatttgttatataaaggtgacatttatccaaatgtgtcaagttttatatgctactcaaaatagtgcagataggcgtactttttgtagactagggaggtatgtatacgtcagtacatttaaatctactcctttcacagttggtcttctcattttctcttgctcactatctcttattcaccccccaacaaagccctgtttccaattctttttgttgagactctggtgccagccagtgtttgtcactatctccatctccttctatggtcttttgtgtctctttatacctggagtasacatgaatcctccccactcagctttcccagaacgtcacactctggcttcccttcttccatgtccccggaagcctgagagaccacaatcccagaggacctgggccccattcatgtgctcacctgcttgtgtctgccggttccctgagtccttgctttcgctgcaggttgccttttgctctttgctcctgtttcagctcttcttaatcaagcgagcctcatgaaccgcattcacctttgtgccagtttgcaactaacagtgtggcattttgctaactcactcccttctctatccttccctcc

SEQ ID NO: 55969 - DNA, 601 bp, Human
ggtcaggagttcgagaccagcttgggcaacatgatgaaaccccatctctaccaaaagtacaaaaattagttggacgtggtggcatgcacctgtggtcctagctacttgggaagctggaggtgggaggatctctggatcccgggaagttgaggttcagtgagctgtgactgcactactgcacttcagcctaggtacagagtgagaccctgtctcaataaataaaatatttaaaataactagatttggtcttaggtactaccaaagcagagctggaaccatccgttagaacactattcaaggytgaacttctatcctgtagttaagaataagagctattggttaggagaggaacagacaaaattgtttgaccttttacaatcccaaacaaaggaaacttcatcccaggaaatcaaccactgatacaggatagctgcctggccaggttcacactctggctgattcttttacagcaaatgagctagacatgtagatcaaactaaataactcgaaacagaaacaactcttcagagtctctgagtgttaacagatccttgctttgtccaactctgggtccctcttttccctcagaaagtgaattaat

SEQ ID NO: 55970 - DNA, 601 bp, Human
ttcgacaggccaaggtgagtggattgtttgaggtcaggagttcgagaccagcttgggcaacatgatgaaaccccatctctaccaaaagtacaaaaattagttggacgtggtggcatgcacctgtggtcctagctacttgggaagctggaggtgggaggatctctggatcccgggaagttgaggttcagtgagctgtgactgcactactgcacttcagcctaggtacagagtgagaccctgtctcaataaataaaatatttaaaataactagatttggtcttaggtactaccaaagcagagytggaaccatccgttagaacactattcaaggttgaacttctatcctgtagttaagaataagagctattggttaggagaggaacagacaaaattgtttgaccttttacaatcccaaacaaaggaaacttcatcccaggaaatcaaccactgatacaggatagctgcctggccaggttcacactctggctgattcttttacagcaaatgagctagacatgtagatcaaactaaataactcgaaacagaaacaactcttcagagtctctgagtgttaacagatccttgctttgtccaactctgg

SEQ ID NO: 55971 - DNA, 601 bp, Human
attgcttgaaaccgggaagcagaggttgcagtgagccgaaaccatgccactgcactccagcctgggcgacagagtgagactgtgtctcaaaacaaaaacaaaaacaaaaaatcacttggtagtgttgaatggaataatggcatccatacttcacagttgctttactagcaacttttttccccctctttttttctggatggacattaaatgagaaaccaacaaaaacaattaagtgctttttgttttggtgatttgtatctggcctcctgcaaagctcagactgtgtcctatgatctcatcygtaaaggaaaactggagttcctcaaggtcagggtttcttaatcttagcactgtttacatttaggggccaggagcagtgcctcacacctgtaatcccagcactttgggaggccaatgctggcggatcacttgaggttaggagtttgagatcagcctggccaacgtggtgaaacccccgtctctactaaaatacaaaaattagttagttgtggtggtgcatgcttgtaatcccagctactcaggaggctgaggcaggaacatcacttgaacccgggaggcggaggctgcagtgagtcaagat

SEQ ID NO: 55972 - DNA, 601 bp, Human
tgggtgacaaagcaagaccctgtctctaaaaataaaaaataataattgtagggtggctctcacatactcaaaggctctctgccactctgctcctattgttgagtctaatttcttctttccattttgatgattttccctttagaacataaatatccgtttctccctccctcttttctgactccccatctttttttgagacagggtctcactctgtcaccccggctggagtgcagtggcacaatcacggttcactgcaatcatcacctcccgggctcaagtgatccttcctccttagcctccygagtagttgggattacacgtgtgtgcctccatacctggctattttttttattttggtagagatggggttctgccatattgccctggctggtcttgaactcagcctgagatccacctgcctcagcctcccaaagtgctgggattccaggcatgagccacttcacccagccggatttgttttactggaaaataattttttaaatgtatagggtttttttccatcattctgcaacaaagccattatcatgagtttgaatattattgaaacctgtgataaaaaacatttgtggctgggtgcagt

SEQ ID NO: 55973 - DNA, 601 bp, Human
aaggttacagtgagctatgatcatgccattgcactccagcctgggtgacaaagcaagaccctgtctctaaaaataaaaaataataattgtagggtggctctcacatactcaaaggctctctgccactctgctcctattgttgagtctaatttcttctttccattttgatgattttccctttagaacataaatatccgtttctccctccctcttttctgactccccatctttttttgagacagggtctcactctgtcaccccggctggagtgcagtggcacaatcacggttcactgcaatcrtcacctcccgggctcaagtgatccttcctccttagcctcccgagtagttgggattacacgtgtgtgcctccatacctggctattttttttattttggtagagatggggttctgccatattgccctggctggtcttgaactcagcctgagatccacctgcctcagcctcccaaagtgctgggattccaggcatgagccacttcacccagccggatttgttttactggaaaataattttttaaatgtatagggtttttttccatcattctgcaacaaagccattatcatgagtttgaatatt

SEQ ID NO: 55974 - DNA, 601 bp, Human
taggaagaccacttgagtccaggagctcaaggttacagtgagctatgatcatgccattgcactccagcctgggtgacaaagcaagaccctgtctctaaaaataaaaaataataattgtagggtggctctcacatactcaaaggctctctgccactctgctcctattgttgagtctaatttcttctttccattttgatgattttccctttagaacataaatatccgtttctccctccctcttttctgactccccatctttttttgagacagggtctcactctgtcaccccggctggagtgcrgtggcacaatcacggttcactgcaatcatcacctcccgggctcaagtgatccttcctccttagcctcccgagtagttgggattacacgtgtgtgcctccatacctggctattttttttattttggtagagatggggttctgccatattgccctggctggtcttgaactcagcctgagatccacctgcctcagcctcccaaagtgctgggattccaggcatgagccacttcacccagccggatttgttttactggaaaataattttttaaatgtatagggtttttttccatcattctgcaa

SEQ ID NO: 55975 - DNA, 601 bp, Human
ggtaggaagaccacttgagtccaggagctcaaggttacagtgagctatgatcatgccattgcactccagcctgggtgacaaagcaagaccctgtctctaaaaataaaaaataataattgtagggtggctctcacatactcaaaggctctctgccactctgctcctattgttgagtctaatttcttctttccattttgatgattttccctttagaacataaatatccgtttctccctccctcttttctgactccccatctttttttgagacagggtctcactctgtcaccccggctggagtgcagtggcacaatcacggttcactgcaatcatcacctcccgggctcaagtgatccttcctccttagcctcccgagtagttgggattacacgtgtgtgcctccatacctggctattttttttattttggtagagatggggttctgccatattgccctggctggtcttgaactcagcctgagatccacctgcctcagcctcccaaagtgctgggattccaggcatgagccacttcacccagccggatttgttttactggaaaataattttttaaatgtatagggtttttttccatcattctgc

SEQ ID NO: 55976 - DNA, 601 bp, Human
tttggtttttaaaaatacagagtaattgtacatatttatggaatacatgtgatattttgatatatgcagacgatgtgtaaagatcaaatcagagaatctaggatatctattacaacatttatcattgtttgtgttggaaacatttcaaatcttctagctactttgaaatacacaataaaatattgttaactatagtcaccctactgaactatcaaacactataacttattccttctatttaattgtaagtttgtacccattaaccaagttctcctaatctctccacaccccactagccttyccagcccctctggtaactgtcattctattctacttccatgaaatcaacttttttagctcccatatatgagtgagaacatgcagtatatatctttctgagcctggcgtgtttcacttaacataatgacctttgcttttttttattttattttttttgagacggactctcactctgtcgcccaggctggaatgcagtggcgcaatctcagctcactgaaacctctgcctcccgggttcatgtgattctcctgcctcagcctcctgagtagctgggattacagggacccaccaccatgcccag

SEQ ID NO: 55977 - DNA, 601 bp, Human; identical to SEQ ID NO: 21399

SEQ ID NO: 55978 - DNA, 601 bp, Human; identical to SEQ ID NO: 21400

SEQ ID NO: 55979 - DNA, 601 bp, Human; identical to SEQ ID NO: 21401

SEQ ID NO: 55980 - DNA, 601 bp, Human; identical to SEQ ID NO: 21402

SEQ ID NO: 55981 - DNA, 601 bp, Human; identical to SEQ ID NO: 21403

SEQ ID NO: 55982 - DNA, 601 bp, Human; identical to SEQ ID NO: 21404

SEQ ID NO: 55983 - DNA, 601 bp, Human; identical to SEQ ID NO: 21405

SEQ ID NO: 55984 - DNA, 601 bp, Human; identical to SEQ ID NO: 21406

SEQ ID NO: 55985 - DNA, 601 bp, Human; identical to SEQ ID NO: 21407

SEQ ID NO: 55986 - DNA, 601 bp, Human; identical to SEQ ID NO: 21408

SEQ ID NO: 55987 - DNA, 601 bp, Human; identical to SEQ ID NO: 21409

SEQ ID NO: 55988 - DNA, 601 bp, Human; identical to SEQ ID NO: 21410

SEQ ID NO: 55989 - DNA, 601 bp, Human; identical to SEQ ID NO: 21411

SEQ ID NO: 55990 - DNA, 601 bp, Human; identical to SEQ ID NO: 21412

SEQ ID NO: 55991 - DNA, 601 bp, Human; identical to SEQ ID NO: 21413

SEQ ID NO: 55992 - DNA, 601 bp, Human; identical to SEQ ID NO: 21414

SEQ ID NO: 55993 - DNA, 601 bp, Human; identical to SEQ ID NO: 21415

SEQ ID NO: 55994 - DNA, 601 bp, Human; identical to SEQ ID NO: 21416

SEQ ID NO: 55995 - DNA, 601 bp, Human; identical to SEQ ID NO: 21417

SEQ ID NO: 55996 - DNA, 601 bp, Human; identical to SEQ ID NO: 21418

SEQ ID NO: 55997 - DNA, 601 bp, Human; identical to SEQ ID NO: 21419

SEQ ID NO: 55998 - DNA, 601 bp, Human; identical to SEQ ID NO: 21420

SEQ ID NO: 55999 - DNA, 601 bp, Human; identical to SEQ ID NO: 21421

SEQ ID NO: 56000 - DNA, 601 bp, Human; identical to SEQ ID NO: 21422

SEQ ID NO: 56001 - DNA, 601 bp, Human; identical to SEQ ID NO: 21423

SEQ ID NO: 56002 - DNA, 601 bp, Human; identical to SEQ ID NO: 21424

SEQ ID NO: 56003 - DNA, 601 bp, Human; identical to SEQ ID NO: 21425

SEQ ID NO: 56004 - DNA, 601 bp, Human; identical to SEQ ID NO: 21426

SEQ ID NO: 56005 - DNA, 601 bp, Human
gtttcagtactctcaagttggcagacaatgcactgatcagccaacttgagcattctaggccacttaaattttattttttcacttgtatacagcctccctgctgttaagaggatgtaaaaagcactacatctggtataatagaacatattcatatagttttttgacaggttcgatcttctatcttttcttcatttcctaagaaacacccattagcattgttgctgaagaaactatcctgtggccagtcaccccaaactgctgctctctagatgtttacttcctacttgctatatcctttatmaggaactccttcctctcctggttcatggcctgctagtcctgcaatacttggctctttccctaggtccccacagtatcccagatactcctattgtttatcacttattgcagtacaataaaggagctttcagtgagcattttactgtaagcctatgtcagtgcctaacatagaaagagatggcaagacttaagttctgaattttcagccccatcagttactagttcggtaaccatatcaccgacagtgcaagtcgctacatctcttcaagagtaattttcttgcccaggtgcagcggttcgt

SEQ ID NO: 56006 - DNA, 601 bp, Human
ctgcctcagcctcctgagtagctgggattacaggcatatgccaccacacccggctaatttttttttcttattgttttttttttttttctttttttgagacagagtctcactctgtcgcccaggctggagtgcagttgcgcgatcttggctcaccgcaagctccgcctcctgggttcacaccttctcctgcctcagcctcttgagtaactgggactacaggcgcccgccaccatgcctggctagttttttgtatttttagtagagatggggtttcaccatgttagccaggatggtctcgatstcctgacctcatgatccgcccgcctcagcctcccaaagtgctgggattacaggcgtgagccactgcgcctggcctaattttttgtatttttagtggagatgcggttttgtcatgttggccaggctggtcttgaactcctggcctcaaatgatctgcccaccttggcctcccaaagttctgggatgacaggtgtgagccacgacatgtgacctctacggataattttaaaaattagttgggcatggtcatgtgcacctgtggtcccaggtacttgggaggctaaggcaggaggatcaccta

SEQ ID NO: 56007 - DNA, 601 bp, Human
tctttaccacatctctatttggatgttacttgggcacatgttaaaaaaaggtggctgggcacagtagctcacgcctgtaatcccagcactttgggaggctgaggtgggaagatcacttgcgttcaggaatttgagacctgcctgcactcaatggagtacaatggcgcaatctcggctcactgcaacctccacctcccgggttcaggcgattctcctgcctcagcctcctgagtagctgggattacaggcatatgccaccacacccggctaatttttttttcttattgttttttttttttttctttttttgagacagagtctcactctgtcgcccaggctggagtgcagttgcgcgatcttggctcaccgcaagctccgcctcctgggttcacaccttctcctgcctcagcctcttgagtaactgggactacaggcgcccgccaccatgcctggctagttttttgtatttttagtagagatggggtttcaccatgttagccaggatggtctcgatctcctgacctcatgatccgcccgcctcagcctcccaaagtgctgggattacaggcgtgagccactgcgcctggcctaattttttgta

SEQ ID NO: 56008 - DNA, 601 bp, Human
ctcacacaggaactaatccattcccatgggaactaatccagtctcaaaagagcaagaattcactcactacagcacaaagccattcatgagggatccacccccatgacccaaacacctcccactaggtcccaacactatcacattggagattaaatttcaacatgagttttggtggagacaaaccaaccatatccaagccacagcacctgggtacttatctgttacccataaagactgtcagtttcaggagggttgacactgcatctgtcttgttcacctacttcagagttaaagattaaasctgatcaggactgtccagttatagaaaagtagttagcacaaagctggtactcattaaatcttattgttatgtcattgtaaataacggcacggtgatttctgcctgtagtcccaactactcgggaagctgaggcaggaggatctcttgagcccagttcaagaccagcttggggaacataacgagactccatttctataaataataaacacttattgtttattttcactctttgctattccacaactttatcttaaaactcccaattctactaattcctcttgtactttcaggagctgactt

SEQ ID NO: 56009 - DNA, 601 bp, Human
aatacttaagccaatcaaaatgagcaaactaaaatactcaggactgggatataaaggaaagctgcaatctaataatcttttatcttgcctgaaaagggactctgttaaccagagtatagagctgcatgaagggtgcctgcagcactgcccaggaaaaggtggtggtcctttggtccagcagatagtccttccaaatacctcatctgtttgctcttctattccctaccaaagccatttcaaaccactgacactctcctggagcccatcatgtcttatttatagctatgttcccaataccaayatagtactcggtaggtagtaggtgttcagtaaatatctgctgaataaaatagaagcccattcctgtctgcttcctaccccaaactaggttaagaggcccttttttgtcctctgaaagcagccaatacttcccgtttcaggcttatctctctgtgttgtaattgtttggtatcttattccgttttgtgttgctataacaaaatacctgagactgggcaatttataaggaaaagtagtttatttagttcatgattctgcaggctgggaagttcaagggaatggctctagcttctggcgaggg

SEQ ID NO: 56010 - DNA, 601 bp, Human
gaaaaatgaatgttcataagaactttatttgtagtagcccaaaacttggaaacaacccaatgtctaccattggatgggtgaataaggaaactaatgtggtatattcatacactggaatactactcagcaaaaaaaggaatgacctgctgatacatgcaatataaatagtcataataattatggcaagagacagaagttagataataaaagtacatactgtatgattctacttatgtaacactagagaatgcaaacaaatctgtaatatcagaaagcagaacagtggttacctagggatgamgagggaaactttttggggtgatggacatatgttcattatgttgattgtgatgctattttcacaggtgtatacaaatgttaaaactcatcaaactgcatactttaaatatgtacagattgttttgtgtcaattttattttaataaagctatattgaaatgccataggtacattaaaggaaaaaatgtgttggatagataatatttgatggagtaaaatcagtaaacggggaggatcagtttcaacaagataactctcaaattgtaactcactaaaaaagtctgtatatatgttatcaaagt

SEQ ID NO: 56011 - DNA, 601 bp, Human
tctcgctctgtcatcaggctggagtgcaatggtgcgatcttggctcactgcaacctccgcctcccgaattcaagcgattctcctgcctcagcccgcagagtagctgggactacaggtgcgtgccaccatgcccagctaagttttgtatttttagtagagatgtggtttccccatgttggccaggatggtctcgatctcttgacctcgtgatccacctgcctcagcctcccaaagtgctgggacactaaatttttaaagcggtctatgaaccaaaaaatggtgacctactgtggtacagtgygtgcatacttctgtgtagaaagaatttgagcaatagtccttatttattagattttagatgctggaagtggttgacagacagatgatctgtaaaaaccactctaaaggtcattaagaagaagacaactatctggcagggtcagcagaacctctagaagccatgaaaatgtttgtatcttttgacatggtaatccatttcaggagggaaataatccaaaaggaggaaaaaactagaaagtttcacatacactctgatgacaattatgtaaagaagatagagatacccaaaactatactgaat

SEQ ID NO: 56012 - DNA, 601 bp, Human
ccactaggaaagagacacataatatccctatctattctgtgtgtgtgtgtttattttttttttgagacagagtttcgctcttgtcccccagtctggagcacacagtggtatgatctcggctcactgcaacctctgattcccgggttcgagcaattctcttgcctcagcccttcgagtagctgagattacagacacccgccacaacacccaactaatttttgtattttgagtagagatggggtttcaccatgtcggccagactgatctcgaactcctgacctcaggtgatccacccacctcsgcctcccaaagtgctaggattacaggcgtgagcctctgcacctggcccttattttttattttttatttttttgagacatggtctcactctgttgcccaggctggagtgtagtgtgatcatgactcactgcagcctcaacccccagggcttaggtgattctcccacctcagcctcctgagcagctgggactacaggcacatgctaccatgcccagctaatttttttgtacttttgatagagacggggtttggccatattgcctggctggtctcgaactcctgggctcaagtgatccacctg

SEQ ID NO: 56013 - DNA, 601 bp, Human
caatgcctgcacacactcccagaggcagacggtaggaataaaggtccatgtctttggtgatggatggcatggtctctcccatcatgagggatgtcacactacaggcatgctcaaccacctctggaacacagaagtcaggccatcagctctccacactgtgtactagttagctttgtcctgttctcttcagccctgaggacaggaagtggttcaggccaatgaaggggtgcagggtacactgacttgcccttccaagttaagggtttgtgcaaaatgagattctctgaatgggaaaaatacrgcgatatgtatatacccactggaagatcatttgagtaaagagtaaagtaaatcagtcttagggatactgaatactgccatttttcacaagtattaaaaaagatatcatgggatggcaaaatctatgtaaaggaagaagcaacctcccattctgcgatctttgcctcccatcttcctttggtccttcccaaaagtcccataaggggctcccagcttacgaaggcctcgaaatacatctccttcagcatcagctagggtcttcccttgttccaatgtgattaacttggcaatttctttctag

SEQ ID NO: 56014 - DNA, 601 bp, Human
aggaaggtatttccacacaccatggccatgggaaacatccaaagggggatcatggcaggaaaattgaatggagcaatgcctgcacacactcccagaggcagacggtaggaataaaggtccatgtctttggtgatggatggcatggtctctcccatcatgagggatgtcacactacaggcatgctcaaccacctctggaacacagaagtcaggccatcagctctccacactgtgtactagttagctttgtcctgttctcttcagccctgaggacaggaagtggttcaggccaatgaaggggygcagggtacactgacttgcccttccaagttaagggtttgtgcaaaatgagattctctgaatgggaaaaatacagcgatatgtatatacccactggaagatcatttgagtaaagagtaaagtaaatcagtcttagggatactgaatactgccatttttcacaagtattaaaaaagatatcatgggatggcaaaatctatgtaaaggaagaagcaacctcccattctgcgatctttgcctcccatcttcctttggtccttcccaaaagtcccataaggggctcccagcttacgaaggcctcg

SEQ ID NO: 56015 - DNA, 601 bp, Human
ctttgaatactgaacccttcttttttgtcctttaagaataacaataggcaaggcacagtggctcacacctgtaatcccagcactttgggaggccgaggcgggtggatcacctgaggtcaggagtttgagactagcctggccaacatggtgaaaccccatctgtactaaaaataacaaaattagtggggcacggtggcgcatgcctgtaatcccagctatttaagaggcagaggcaggaaaattgcttgaacctgggaggcagcgggtagagtgagccgagatcgcaccactgctctccagyctgggcgacagagggagactccatctcaaaaaaaagaataacaatatttcctcaatggtgactatgtactgggacactcagacactattgtgttctcatgtaagaggtaatatagtgtagtttttaaaagcaaaaatcagagtcagccttcctggatgggtatacacatcctggctttgacggtttctagcactgtgactttgggctaattaatttcactatgtctcatttttctcttctgcaaaatggaaaaataatacctacctcaaagggtgattataaagattaatagataaaaag

SEQ ID NO: 56016 - DNA, 601 bp, Human
atcagattacagactcgctctttggcctggggagtgatcagagggccaagatcagctccaggctgatctcctgtaaaacaacacagaagaatttaaggtcctcattaacataaattatgactgctgccagggctcatgcctgtaatcccaaagctttaggaggccaaggcaggaggactgcttgagcccaggagttccagaccagcctgggcaacaaagtgagacttcatatttacaaaaaataaaaaaattagccaggtggtggcccgcacctgtggtccaagctgctcaggaggctgasgcaggaggatcacttgagcccaacagtttgaggctgccatgagctaggatggtgccactgcactccagcttgggtaacagacagcctgtgctttaaaaaaaaagactgctaacaagatgactccaaatgacaagtacagtataaagagaggaaatggcaagaatagacatgattgttcccactggccaaggccagtgacagaacccaagagcttaatgccacagatgcaaaatctaagggggcaagtcaggtgattgattacctgcattgactctcaggtttttggcatgctccaccagc

SEQ ID NO: 56017 - DNA, 601 bp, Human
acctccaaataccaaagtgttgacttcttaaccatttggccacactgtcataatgctatgcaatcccattgttaattttttaataacccaaacataaataaaataaaaaagccccacatccctcgccctgtggcagcacatagctggcacagaaaaaaaaaatcaacctataaaaggggagacttgtataacaaaacatgtaatttattaatgaaggtttcaaaatggctctagtcctatgactagaaagaacttcccctagcctatttgttcaacaaatgtttgggcagcctgctctgtkccaggtactgcagataagtagataacaactacagtctgatgagggcttctttaaatggcttaaagagccctacatgactcaacccctgcctgcctctctaacttcatttcttccttttcttctcatttgctcactgtgccccagcccatttccgctgtctgaatgtgccatgcttcttcctgcctcgggacatatgcacctgttggccgatgtggcaatagtaataattcttcttttttttttttttgagatggagtcttgctctgttgcccaggctggagtccagtggtgcaatctcgg

SEQ ID NO: 56018 - DNA, 601 bp, Human
ttgaaccctggaggctgaggttgcagtgagccaagatcatgccactatactccagcctgggtgacagagaaagattccatcaaaaaaaccccaaaacaaaaaaccaaaagctgtgactaatatacaaactatataatcaacctccaaataccaaagtgttgacttcttaaccatttggccacactgtcataatgctatgcaatcccattgttaattttttaataacccaaacataaataaaataaaaaagccccacatccctcgccctgtggcagcacatagctggcacagaaaaaaaaaatcaacctataaaaggggagacttgtataacaaaacatgtaatttattaatgaaggtttcaaaatggctctagtcctatgactagaaagaacttcccctagcctatttgttcaacaaatgtttgggcagcctgctctgttccaggtactgcagataagtagataacaactacagtctgatgagggcttctttaaatggcttaaagagccctacatgactcaacccctgcctgcctctctaacttcatttcttccttttcttctcatttgctcactgtgccccagcccatttccgctgtctg

SEQ ID NO: 56019 - DNA, 601 bp, Human
aggcatagatacgagaattgcttgaaccctggaggctgaggttgcagtgagccaagatcatgccactatactccagcctgggtgacagagaaagattccatcaaaaaaaccccaaaacaaaaaaccaaaagctgtgactaatatacaaactatataatcaacctccaaataccaaagtgttgacttcttaaccatttggccacactgtcataatgctatgcaatcccattgttaattttttaataacccaaacataaataaaataaaaaagccccacatccctcgccctgtggcagcacayagctggcacagaaaaaaaaaatcaacctataaaaggggagacttgtataacaaaacatgtaatttattaatgaaggtttcaaaatggctctagtcctatgactagaaagaacttcccctagcctatttgttcaacaaatgtttgggcagcctgctctgttccaggtactgcagataagtagataacaactacagtctgatgagggcttctttaaatggcttaaagagccctacatgactcaacccctgcctgcctctctaacttcatttcttccttttcttctcatttgctcactgtgcc

SEQ ID NO: 56020 - DNA, 601 bp, Human
gagcccaaaaattcagcatatttaactctctctatatatagatatagtttataagagtaggcttgagcaaaagagaatacattgtgcagatctaacacttatataattactagcaagctagaatgacattttaccagattaccagagtaatttataataattaaactggggggtgcagccaggagcggtggctcacacttgtaatatcagcactttgggaggctgaggtaggcggatcacttgaggccatgagctcaagaccagcctggcccaacatggcgaaacctcgtctctactgggraaaaaaaaaaaaaaaaaaaaaaaaaaaagctgggcgtggtggagcctgaggcagaattgcttgaacctgggaggtggaggttgcaagtgagccgagaatgcaccattgcactccagcctgggcaacagagcaaaactcccatctcaaaaaaataaataaatggagagggtgggcagggaacaatttttaaacaatagttgtactctgttttgcttaaaagaaatgttactagtatcaaattagtcatttttacaaaagctgtgactaggccgggtgcggtgactcactcctgtaatccca

SEQ ID NO: 56021 - DNA, 601 bp, Human
ggtgagagccagcaagtgtctctccccacccctcccactgccctggtttgttttccctttagaactcggtacaggccgggaacagtggctcatgcctgtaatcccagcactttgggaggccgaggcaggtggatcacctggggtcgggagtttgagatcagactggccaacatggtgaaaccctgtctctactaaaaatacaaaaattagccgggcgtggtggcgggtgcctgtaatcccagctactgaggaagctgaggcaggaaaatcacttgaacccaggtggagcttccagtgagcygagattatgccactgcactccagcctgggcgacaagagtgaaactctgcctcaaaaaagaaaagaaaaaaagaagaagaaggcagcagtatagagcccaaggcaggtggaggacaggtagggtggggcatagggagtgaggaaaccaggtaccttttccagcacctcccctgggtacagggggaaggggtcctgggccagccggatctcgaggtcagcgtggcgaagccgaacttgccctgtgacatcaaacagcaccaagccctgggcatcccgagacacagggttggccactgtgcag

SEQ ID NO: 56022 - DNA, 601 bp, Human
aaaagaggcaggtgtgtttggggcatgtgtggaggatgggggtggctggaggtgagtggaggtacagtgagtcaattccacccttggtgagagccagcaagtgtctctccccacccctcccactgccctggtttgttttccctttagaactcggtacaggccgggaacagtggctcatgcctgtaatcccagcactttgggaggccgaggcaggtggatcacctggggtcgggagtttgagatcagactggccaacatggtgaaaccctgtctctactaaaaatacaaaaattagccgggygtggtggcgggtgcctgtaatcccagctactgaggaagctgaggcaggaaaatcacttgaacccaggtggagcttccagtgagccgagattatgccactgcactccagcctgggcgacaagagtgaaactctgcctcaaaaaagaaaagaaaaaaagaagaagaaggcagcagtatagagcccaaggcaggtggaggacaggtagggtggggcatagggagtgaggaaaccaggtaccttttccagcacctcccctgggtacagggggaaggggtcctgggccagccggatctcgaggtc

SEQ ID NO: 56023 - DNA, 601 bp, Human
cagaaaagaggcaggtgtgtttggggcatgtgtggaggatgggggtggctggaggtgagtggaggtacagtgagtcaattccacccttggtgagagccagcaagtgtctctccccacccctcccactgccctggtttgttttccctttagaactcggtacaggccgggaacagtggctcatgcctgtaatcccagcactttgggaggccgaggcaggtggatcacctggggtcgggagtttgagatcagactggccaacatggtgaaaccctgtctctactaaaaatacaaaaattagccrggcgtggtggcgggtgcctgtaatcccagctactgaggaagctgaggcaggaaaatcacttgaacccaggtggagcttccagtgagccgagattatgccactgcactccagcctgggcgacaagagtgaaactctgcctcaaaaaagaaaagaaaaaaagaagaagaaggcagcagtatagagcccaaggcaggtggaggacaggtagggtggggcatagggagtgaggaaaccaggtaccttttccagcacctcccctgggtacagggggaaggggtcctgggccagccggatctcgag

SEQ ID NO: 56024 - DNA, 601 bp, Human
cacccacctgctcaggcccaggcctgaggccaacggggacaagagcctggctgtaggttcaggcctgtgatggcttctcctagaacaggcacagcctggggcctgggcttgtcactgctgctttggcactgcccaccagtgtctggcaccgggtgaatgaactgcttaaccttggcacatgtcatttaatgccagactggctgggcacttctggtaggctctggagcctgggaaggtgagatgggccaacagttctcagaaaagaggcaggtgtgtttggggcatgtgtggaggatggggrtggctggaggtgagtggaggtacagtgagtcaattccacccttggtgagagccagcaagtgtctctccccacccctcccactgccctggtttgttttccctttagaactcggtacaggccgggaacagtggctcatgcctgtaatcccagcactttgggaggccgaggcaggtggatcacctggggtcgggagtttgagatcagactggccaacatggtgaaaccctgtctctactaaaaatacaaaaattagccgggcgtggtggcgggtgcctgtaatcccagctactgaggaagctg

SEQ ID NO: 56025 - DNA, 601 bp, Human
cggggtagtacctctgtggcccaggatggagtgcagtggtgcagtcacagctcactgcagcctccacatcctgggctcaagaaattctcccccttcagccttctgagtagctgggaccacaggtgtgtgtccaaggccaggctaatttttaaattctctgtagagatggggtctcactgtgttgctcaggctggtcttaagctcctgggctcagacgattcacccaccttggcaaagtgctgggatgacaggtgtgagccactgtacctattggcctacatttgtcaattgtatttgaacrtcttctttgttgatccagaatcaggtaagtcatggccactgcccacagctcatggtgaaggtgagggaaggaaaagccacatccgcatggtcatggtcacattttccagcccaagtggaaacagcatgaagcgggggtggggaaggaagagcagtgggtggccctcaacagctttcaaaagataccaggaaagcgcctctctggggctacaggaggctttcctcaaccttcccctgcttcccctgcagtggggacccctcctgcccacccaccatcatcgccccttggtgaccccacctg

SEQ ID NO: 56026 - DNA, 601 bp, Human
ttcccctgggccaagagtggagggtaagggacaagggccccccagcctgctccccacctacccctcccccacagcttagacacaggggattgacagatttcataggcaaaaagatagcactgaccccaggctcaagttcctgactgcggtcctcttattcattcttttgaggccaaacccccaccccagttgaattttaaaagtttttttttttttttttttttttttgagacggagtctccctctgttgcccaggctgtgatctcagctcactgcaacctcagcctcctggattcaagtkattctcatgcctcagcctcctgagtagctgggattacaggcacgtgccaccacgcccggctaatatttgtattttttgtagagatggtgtttcaccatgttgcccaagctagtctggaactcctggcctcaagtgatccgcccaccttggcctcctaagatgcccaagttgctgctatgccaacagcctgttctgccttctctaagctccaaagaccaacttttgtccttctgctaaaacaggcagcagaactgcctctgttagagttgtggatgtcctttggtttactggagaagccag

SEQ ID NO: 56027 - DNA, 601 bp, Human
gtagttgtgggggcccagggtggtgatgggcacaacccccagcacctcctcgtggacatctggcacgtgggcctctgtgtcctgcactgttaccagccactcctccccagtgcggcgggacactcccctgaagtcccggaagttccgccgagcccggaggtgcagggctgtctgcagagcaacatgttgggtatttgagtgacctgcctccaacttcaggggatctgcgagccccattggccaccaaatgctcccaatgctcccagatctcagagacaatttctaccaatccagggattgtttttttttttttttaaatcggagtctctctcttgttgcccaggctagagtgcaaaggtgcgatctcagctcactgcaacttccgcctcctaggttcaagcgattctcctgcctcagcctcctgagtacagctgggattacaggtgggtgacaccatgcccagctaatttttgtatttttagtagagatggggtttcgccatgttggccaggtttgtcttgaactcctgacctcaggtgatcctcccacctcagcctcccaaaatgctaggattacaggcatgagccactgcacccgaccg

SEQ ID NO: 56028 - DNA, 601 bp, Human
agctgcctgcagtattcaggacagtcacatgctgcacaggttggcagcctaggggcaggctacgccatctagactaggtgccatctaggtttgcataagtgcactcttttgcacaaagacaaaatcatctaaggactatttctcagaatgtatccccatcattaagtggcgcatgactgtatcagagtttcagagtctcaggcagcgggtagccaggaggccttcccagaaggggaattaacttcaggtctgaggggtaagtcagaggctgccaggaatcaaatgggccagtgtctcaggygtgtaagaactaagcatgcaaaggcacagaaggtgttcctagaacgtgcgtctggaggagagaaggcagagggcctcatgccactagaggacatacatctcccagggcagtcctctgtgggggtgtagggacctcaccttgaccacgcgcttctgccccagctgattcttgccatccggtccgacagggtcgagaatcacgcagtagttgtgggggcccagggtggtgatgggcacaacccccagcacctcctcgtggacatctggcacgtgggcctctgtgtcctgcactgttaccagc

SEQ ID NO: 56029 - DNA, 601 bp, Human
gggagagggtaaaccaagaggtttattttacaaaagatgacaaagcaaagtgaacaccaggatattaaagatgtgaaatatagtcactgcatgatagttcagtccattacagactgcacatggtggtcccgtaagattataatggagattttttttttttctgagagtctcactctatcgcccaggctagagtgcagtggcacgatctcggctcaccacaggcttgatctccagggttcaagtgattctcgtgcctcagcctcccgagtaactggaattacaggtgtgtgccaccacaccyggctaatttttgtatttttagtagagacagggtttccccacgttggccaggctagtctcgaactcctgacctcaagtgatccacctgcctcggcctcccaaagtgctgggattacacgtatgagccactgtgctggcctataacgaagcttttatattgtatttttaccttaccttttctatggctagatacacaagtacttgccattgtgttcagctgcctgcagtattcaggacagtcacatgctgcacaggttggcagcctaggggcaggctacgccatctagactaggtgccatct

SEQ ID NO: 56030 - DNA, 601 bp, Human
atgaagtagggggtgggagagggtaaaccaagaggtttattttacaaaagatgacaaagcaaagtgaacaccaggatattaaagatgtgaaatatagtcactgcatgatagttcagtccattacagactgcacatggtggtcccgtaagattataatggagattttttttttttctgagagtctcactctatcgcccaggctagagtgcagtggcacgatctcggctcaccacaggcttgatctccagggttcaagtgattctcgtgcctcagcctcccgagtaactggaattacaggtgygtgccaccacacctggctaatttttgtatttttagtagagacagggtttccccacgttggccaggctagtctcgaactcctgacctcaagtgatccacctgcctcggcctcccaaagtgctgggattacacgtatgagccactgtgctggcctataacgaagcttttatattgtatttttaccttaccttttctatggctagatacacaagtacttgccattgtgttcagctgcctgcagtattcaggacagtcacatgctgcacaggttggcagcctaggggcaggctacgccatctag

SEQ ID NO: 56031 - DNA, 601 bp, Human
agcctcccaaggagctgggactacagatgcgcatcaccacacccagctaatttttgtgtgcttcgtagatgatggggtgttgccatgctgcctaagctggtctcaaagtcctagactcaagcgatctacccacctcagctttccaaagtgctgggattatagatgtgagccaccacgcccagcaccgcctgtttcttaaaaaaattttgagatataatccacatatgaaattttcccatctagagtatacaattcacaattcagttgttttagtatactcaaagttgtccaaccatcactrctatgttaagtctagagtattttcgtcatcaccctgaaaagaaatcctgtacctagaagttactgccactccccacctaccccacccaccactagtctattttctttatgtgtttacctattctggacatttcacataaatggaatcatgcaatatgtggtctttgatgtctggcttttttctttttctttttttgagatggagtctcggctcagcagcccaggctggagtgcagtggtgggatctcggctcactgcaactactgtcttccaggttcaagagattctcctgtctcagcct

SEQ ID NO: 56032 - DNA, 601 bp, Human
gtcctgtgctgtttcaggcctgtgtggaggacaagagcaccagaagcccgcccccacccccacatcataatacggtgaggcactgtctggactgtgaggctctacacaaacgcctgccaaatctcatctggtcaaatgtgtccttgaaagattccataactgtcaggacctggatccacgcaagctaaaccattaaaaatcaacctgttttttcttctttctcccaggctttgttttctagagatggtgtaacctagggcttgacaaactctggttttcaggccaaatctggattctgcctttttttttttttttttttttttttgagatagtcttcctctcttgcccaggctggatagtgcagtggcatgatctcagctctctgcagcctcaaccttccaggctcaagcaatcctcccacctcagcctcccaaggagctgggactacagatgcgcatcaccacacccagctaatttttgtgtgcttcgtagatgatggggtgttgccatgctgcctaagctggtctcaaagtcctagactcaagcgatctacccacctcagctttccaaagtgctgggattatagatgtgagccaccacg

SEQ ID NO: 56033 - DNA, 601 bp, Human
ggtgtgagaccttctcctcatcctccccctcctccaggggctgcagggccctcagcagcagcccctgctgctccgacagcacatacacatcctggatgccttgttccagctgctctcctggctggaggaaaaaagacttctctccctagtggggagacgtgaggttagggtcagtgcctttagggttgcgggtgcttccaatggtacctccccagtcctgtgctgtttcaggcctgtgtggaggacaagagcaccagaagcccgcccccacccccacatcataatacggtgaggcactgtytggactgtgaggctctacacaaacgcctgccaaatctcatctggtcaaatgtgtccttgaaagattccataactgtcaggacctggatccacgcaagctaaaccattaaaaatcaacctgttttttcttctttctcccaggctttgttttctagagatggtgtaacctagggcttgacaaactctggttttcaggccaaatctggattctgcctttttttttttttttttttttttttgagatagtcttcctctcttgcccaggctggatagtgcagtggcatgatctcagctctctgca

SEQ ID NO: 56034 - DNA, 601 bp, Human
gggctcgcttctctcggtagtcgtacacctgcaccgcagcgttgtggggcacgcggtagctgaccacacgggtcttgttccggggcgccaagggctggaggctcttagctgtgtccttctcacccctgtctgccagagggtcctgccccttgttcagcagctcctccaccccgggaggcagctctttctcccacaggacttcgtcctgggtcagcatgtaggtgcttccaatcacagcgcgcaccttgggacgaggacagggagggaagctgcccgtaagggtggaagggaggaagatccrcccagctgtcccaaagcagagcccatccagggaaggcgcgccacgaggttaaacaccttctctacggggaggccaggctccaccccgggtttgccatctgctggccctgtcatcgtgggctaactacctcaccccttgggcttcagtttcctcatgtgtcaagtggacttgacggtggctaccttgcagggtctaggggtgaatgacatcttcacatgtctagctcaaacagctcttggcatagagaaggtgctcaatgttatttctagaatcttccttcatggggcagtttggagggca

SEQ ID NO: 56035 - DNA, 601 bp, Human
gctgagttcttatggaagtcatcgaaagtgacagaggccacggccccccgcacccgggatgcgatggctttgcaggcatcacctacaaagtctggcactgaaaagagcttggccgtctcttgggggtccttccggtcattcacctcaaagtgcctgtgaacaaacaggcccagaatggggaagctgctttcacccaggaatctctctttagaagagacaaggtcttgccatgttgcccaggctggtcttgaactcctgggctcaggcaaccccccaacctcagcctcccaaagtgctgggwctacatgtgtgatcacgcccagccagcaactctctccgagaagaacttcaacacccatcctgtgtggccgggcagggtctctcgcaatagagaatgctaatgtatgcctggtaaggtcctaaaaacttaacacacgttctcctttaatcccactcagccaccctatgagatggcaatgatcaccacccccattttacagatgaggaagtagaggtccagggaagtcaagtggctggcccaagacttgccatataacatgtgacaagccagaaagctgaaccaggcagctgcttctggggc

SEQ ID NO: 56036 - DNA, 601 bp, Human
ccatgccatcggggcccttcgcttccgaggtctcaaagccaaagacagcagtgcgaatgatgcgggctgagttcttatggaagtcatcgaaagtgacagaggccacggccccccgcacccgggatgcgatggctttgcaggcatcacctacaaagtctggcactgaaaagagcttggccgtctcttgggggtccttccggtcattcacctcaaagtgcctgtgaacaaacaggcccagaatggggaagctgctttcacccaggaatctctctttagaagagacaaggtcttgccatgttgyccaggctggtcttgaactcctgggctcaggcaaccccccaacctcagcctcccaaagtgctgggactacatgtgtgatcacgcccagccagcaactctctccgagaagaacttcaacacccatcctgtgtggccgggcagggtctctcgcaatagagaatgctaatgtatgcctggtaaggtcctaaaaacttaacacacgttctcctttaatcccactcagccaccctatgagatggcaatgatcaccacccccattttacagatgaggaagtagaggtccagggaagtcaagtggctg

SEQ ID NO: 56037 - DNA, 601 bp, Human
ttgggctgaagccagaaggagaagcctgcctggaagggagctcaggggcggggggaagctttctgggcagcaggaatagccattgcaaaaggccttcaggtgggtccaagctgtgcattgaaggagcagaggaagccagtggggctggaacatgtcagctggaacatgttccagggacgaggagcatggaagggggaggctagaaggcaaatcgggggaggccggctggagctgcaggaaggagtttaggttttatcacatgcaagatgggaggctgcaggagccacatctgatacgtgctttttttttttttttttcttttgagacagggtcagtctcccaggcctgttgcccaggctggagtgcagtggcgcaatcatggctcactgcagcctcaaactcctggcttcaagtgatcttcctgcctcagcctctcacagtgctgggattacgggcatgagccaccgcgcccagcctgattcacattttaagtgggtcacctgatctgttgggtagggaatagatctttgagggtagggatggcagcaggcagtccacaagggatgccaggttatccagttcccagcagtggcctgccatg

SEQ ID NO: 56038 - DNA, 601 bp, Human
cccccactcaccgtttcaatggccaaggcctgtgcttttagcttggcctgcagcacggacccttctccctcaatccgggctgcctccgcacgggactcggcctccgccttggcagtcccggtgctctccacggccatgctggggagaaggcagagtcaggtaagacccgggagacagcccagtccccccacggccttggcttatgctgtagccgtgcactgtctcatcgacaccccacccaggcctgctgcccacaccagctgctgtcctaagaccctcggcccctgccagtctcctcctytagttctcaacccacctcagagcctccagctccaaaagttccttgcgagctttctcggcttctgactggtccaggatcttctgccgctcaagccggccgcgggcttcctgctccagtctctgagcctcatgcctggaggagacggagcgcaggtgagaggctggcatggggccagagcaggaacaggagcgccaagggcagcggccaccaaccaaaccggtgcccaggacagaccccagcccctagaaggcacccaatacgcaactcaacccagaatggtatacgcgccacaagccagtg

SEQ ID NO: 56039 - DNA, 601 bp, Human; identical to SEQ ID NO: 56021

SEQ ID NO: 56040 - DNA, 601 bp, Human; identical to SEQ ID NO: 56022

SEQ ID NO: 56041 - DNA, 601 bp, Human; identical to SEQ ID NO: 56023

SEQ ID NO: 56042 - DNA, 601 bp, Human; identical to SEQ ID NO: 56024

SEQ ID NO: 56043 - DNA, 601 bp, Human; identical to SEQ ID NO: 56025

SEQ ID NO: 56044 - DNA, 601 bp, Human; identical to SEQ ID NO: 56026

SEQ ID NO: 56045 - DNA, 601 bp, Human; identical to SEQ ID NO: 56027

SEQ ID NO: 56046 - DNA, 601 bp, Human; identical to SEQ ID NO: 56028

SEQ ID NO: 56047 - DNA, 601 bp, Human; identical to SEQ ID NO: 56029

SEQ ID NO: 56048 - DNA, 601 bp, Human; identical to SEQ ID NO: 56030

SEQ ID NO: 56049 - DNA, 601 bp, Human; identical to SEQ ID NO: 56031

SEQ ID NO: 56050 - DNA, 601 bp, Human; identical to SEQ ID NO: 56032

SEQ ID NO: 56051 - DNA, 601 bp, Human; identical to SEQ ID NO: 56033

SEQ ID NO: 56052 - DNA, 601 bp, Human; identical to SEQ ID NO: 56034

SEQ ID NO: 56053 - DNA, 601 bp, Human; identical to SEQ ID NO: 56035

SEQ ID NO: 56054 - DNA, 601 bp, Human; identical to SEQ ID NO: 56036

SEQ ID NO: 56055 - DNA, 601 bp, Human; identical to SEQ ID NO: 56037

SEQ ID NO: 56056 - DNA, 601 bp, Human; identical to SEQ ID NO: 56038

SEQ ID NO: 56057 - DNA, 601 bp, Human
gtccccagccaccagcatctgagtcactggaggggctgttaagaggccagtgtctgaggcctctcagatcctactgaaagcattggaatctcaggccagtgctgtccaatagggatactgttaccacaaggaatttaaaattttctagcagccacattttaaaatgcgaaagcaaacaggtgaaattaatgttcctgatatttcttacttaaccctatatatctaaaatagtattatttcaacatgtaagcaatataaaacaattatcaatgagctattgtacagtcttcaagtttgaaayccagtgtgcttcctatacccacagtatatttcagttcagaccccacattttcatccgaaatgcttgttctgcatttagatttcataaaatgtacatgtgaaaatcgattcgcatgcctgtactgtttcaaacattctgcaaaaatttttcaataatgaaatcggggtttacattttaattaaagttaaacaaaatctagaattcttcagtttcactagccacatttcaagcgctcaaagctcctggccactggatcagacaggcctgtattgcggtctttcagtggggcacctcccatgc

SEQ ID NO: 56058 - DNA, 601 bp, Human
ctgtttcaaacattctgcaaaaatttttcaataatgaaatcggggtttacattttaattaaagttaaacaaaatctagaattcttcagtttcactagccacatttcaagcgctcaaagctcctggccactggatcagacaggcctgtattgcggtctttcagtggggcacctcccatgctggagaagcctagcctctccacgtggctgtccaaacccaacacaatctggccccaacctgcttcttctgcctggttggctcccacctgccagcccacccaccagagtacattcctgtgccaytgccagaagtgcctgtcctctcttctccaggtggtgaatgcctcactcagccttcaaggcccaactcaaatgcaacctcctccagaaagccttccctgactcctccaggcaattagttgctcccacttctgtccccctgcttcactcagggcattcctccaccacagctcttcttatactggatattatatttctatacatcgttagtgatggagatagagtatacagtatagcacagtgtgaaagctgaaatgaggaaaattaggaaacaaatttcacaaactgtaaagcactatatac

SEQ ID NO: 56059 - DNA, 601 bp, Human
gtttgaaagtgtctatcacagtccctggcacccagcaaggatgagacagtgtgagtcaaagaagggtctcaaagagcttgcagtctagagggcaagagagctaagccaggagcctgcgtcatgcccaggtagccatctggtacacccaggtgggctgcagggagatgggaaagaggatcccacgggagaacatggtttctaaagggcacccacaatggctggtaagtacagagggagcccttggatccctctgagccaggagggagccagctccaagccgcaggcctggattatgacgcasagggagcggcgggggcggcggcacaggtgcagcggctttacgcagccctcctggggctgagagctgtcctctcctggaggccctgagccctagcaaaaatagcaaaggctaagaaaggatgccgcaaataattttgtccagaggaggtggttatttggtatgttttggacattctctgctttagggatttgtttgactttttctttcttttatttttagtgagtgagaaatgaaaaaagttaatgcagaacaaggatcataaagcagactcagatatagatcacaaacaggtttaggtag

SEQ ID NO: 56060 - DNA, 601 bp, Human
cccagcaaggatgagacagtgtgagtcaaagaagggtctcaaagagcttgcagtctagagggcaagagagctaagccaggagcctgcgtcatgcccaggtagccatctggtacacccaggtgggctgcagggagatgggaaagaggatcccacgggagaacatggtttctaaagggcacccacaatggctggtaagtacagagggagcccttggatccctctgagccaggagggagccagctccaagccgcaggcctggattatgacgcagagggagcggcgggggcggcggcacaggtgyagcggctttacgcagccctcctggggctgagagctgtcctctcctggaggccctgagccctagcaaaaatagcaaaggctaagaaaggatgccgcaaataattttgtccagaggaggtggttatttggtatgttttggacattctctgctttagggatttgtttgactttttctttcttttatttttagtgagtgagaaatgaaaaaagttaatgcagaacaaggatcataaagcagactcagatatagatcacaaacaggtttaggtagatttcaggtctctgttacagtctgttaaag

SEQ ID NO: 56061 - DNA, 601 bp, Human
gcaaggatgagacagtgtgagtcaaagaagggtctcaaagagcttgcagtctagagggcaagagagctaagccaggagcctgcgtcatgcccaggtagccatctggtacacccaggtgggctgcagggagatgggaaagaggatcccacgggagaacatggtttctaaagggcacccacaatggctggtaagtacagagggagcccttggatccctctgagccaggagggagccagctccaagccgcaggcctggattatgacgcagagggagcggcgggggcggcggcacaggtgcagcrgctttacgcagccctcctggggctgagagctgtcctctcctggaggccctgagccctagcaaaaatagcaaaggctaagaaaggatgccgcaaataattttgtccagaggaggtggttatttggtatgttttggacattctctgctttagggatttgtttgactttttctttcttttatttttagtgagtgagaaatgaaaaaagttaatgcagaacaaggatcataaagcagactcagatatagatcacaaacaggtttaggtagatttcaggtctctgttacagtctgttaaagaata

SEQ ID NO: 56062 - DNA, 601 bp, Human
tggattatgacgcagagggagcggcgggggcggcggcacaggtgcagcggctttacgcagccctcctggggctgagagctgtcctctcctggaggccctgagccctagcaaaaatagcaaaggctaagaaaggatgccgcaaataattttgtccagaggaggtggttatttggtatgttttggacattctctgctttagggatttgtttgactttttctttcttttatttttagtgagtgagaaatgaaaaaagttaatgcagaacaaggatcataaagcagactcagatatagatcacawacaggtttaggtagatttcaggtctctgttacagtctgttaaagaataaagaaaagaaagaaggagagaggggactgtggctaggagggatgaagccagactgttcagcctctcaactgcccgggttttgccatcgatggaggaaaagagagatgggaaggaaaagggaatgagggagacagagagagatggagaaactggacagagactgagaggaaggtgcaggaggccctggcagtgccccaggtggcaggtggcagggtggcctcacaggtggtagcaggtttctcatgggctagg

SEQ ID NO: 56063 - DNA, 601 bp, Human
gtgcaggaggccctggcagtgccccaggtggcaggtggcagggtggcctcacaggtggtagcaggtttctcatgggctaggatgagtgacacggaaagaatgctggaataggacctggctacagactcaagttctggtccaagacctgacagtaacttgctgtgtgactctgaggaaatcctttgccctctctggtcccaagtccctggtgccaccagtcacggccgtttcacatttaaaaaagccaaggatgaagagtaggagataggcatactacatccatggatttgacccccagtakaggggaggcacccctttttggccctgcctttaaacccaggcagccaagaacagaggaagagccctgtatactccaacagacttcagctgtggtctccaaggctcgggactgggcccagggcagtgtagaaggtcatggagattgtagctgaggaactggggggagcacacccccatttctgttgccacttgccctcctcaccaacactgattccacaaatcgcaactgaatgcctgttcagcacaggcaatgtgctgtcccagaggacgtagtgatgagcaggacagcctcactgcatgc

SEQ ID NO: 56064 - DNA, 601 bp, Human
ccttggcggggaatccattcctggggagaagatgagaggagaacaatgagaacatacaggagaaggagctgaacaccgtaaatgagtgccaggttaggtgtcatgggaggttaggagaggaagaattactttcatctggaaaaatcagaagccagctatatggacaggtggtatccatggtgcatcataaaaatgagaaaaattaaaaatgtgaaatggaggaacaaagctttccaagaagaaatggaataagcaaaggctttcccaacactgggaagaatgttgggcagagttggcaaaygtaagaggctgtcattaccactgccccttccagtgttcatggcagacatgacaatggatcacagcactgctccatgactaatggatcacagcactgctccatggaagccatgcaccatcagctagtcatagtgggtacaacagataacacttcgctgctctgtctgcagaagaataatgaactatcgaagaggattaggacagaggatctgaaagggaatttgtgggagagaaggcaggaagggcaggttgaaactaaataatagagggtcatccaatccacctgtcattccatattggc

SEQ ID NO: 56065 - DNA, 601 bp, Human
cggggaatccattcctggggagaagatgagaggagaacaatgagaacatacaggagaaggagctgaacaccgtaaatgagtgccaggttaggtgtcatgggaggttaggagaggaagaattactttcatctggaaaaatcagaagccagctatatggacaggtggtatccatggtgcatcataaaaatgagaaaaattaaaaatgtgaaatggaggaacaaagctttccaagaagaaatggaataagcaaaggctttcccaacactgggaagaatgttgggcagagttggcaaacgtaagaggctgtcattaccactgccccttccagtgttcatggcagacatgacaatggatcacagcactgctccatgactaatggatcacagcactgctccatggaagccatgcaccatcagctagtcatagtgggtacaacagataacacttcgctgctctgtctgcagaagaataatgaactatcgaagaggattaggacagaggatctgaaagggaatttgtgggagagaaggcaggaagggcaggttgaaactaaataatagagggtcatccaatccacctgtcattccatattggcaattcc

SEQ ID NO: 56066 - DNA, 601 bp, Human
ggcacggtggctcacacctgtaatcccagcattttaggaggccaaggcaggtggatcacctgaggtcaggagttcaaaacctgaccaggccaacatgatgaaaacctgtctctactaaaaatacaaaaaaaaaaaagagccaggtgtagtggtgggtgcctgtaatcccagctactcaggaggctgaggcaggagaattgcttgaacccaggaggcagaggttgccatgagccgagatcgcaccactgtattccagcctggataacaagagcaaaattccttctccaaaaaaaaaaaaaaagagtttcacgctcaaacttgtcagcttgtcagcaaccaagtcccattcatcctatagaagacacctggagcccagagttatcccttgttttccctaaagacagactgtatcagttatcaattgtgagtaacaaatcattccaaaacttaatggcttaaggaaacaaccatttttttatttctcacagttctgtgggtgggcagggctcagcttggcagtcctgctggtcccactgggggcctctcatgcagctacagtcagatggtggctgaggctgcaatcacctgggggctccaccga

SEQ ID NO: 56067 - DNA, 601 bp, Human
gctcacacctgtaatcccagcattttaggaggccaaggcaggtggatcacctgaggtcaggagttcaaaacctgaccaggccaacatgatgaaaacctgtctctactaaaaatacaaaaaaaaaaaagagccaggtgtagtggtgggtgcctgtaatcccagctactcaggaggctgaggcaggagaattgcttgaacccaggaggcagaggttgccatgagccgagatcgcaccactgtattccagcctggataacaagagcaaaattccttctccaaaaaaaaaaaaaaagagtttcaygctcaaacttgtcagcttgtcagcaaccaagtcccattcatcctatagaagacacctggagcccagagttatcccttgttttccctaaagacagactgtatcagttatcaattgtgagtaacaaatcattccaaaacttaatggcttaaggaaacaaccatttttttatttctcacagttctgtgggtgggcagggctcagcttggcagtcctgctggtcccactgggggcctctcatgcagctacagtcagatggtggctgaggctgcaatcacctgggggctccaccgagctagaaca

SEQ ID NO: 56068 - DNA, 601 bp, Human
aagaatttctcagatgtattttcgaggaatcttcagagcacctgaaggaataattaccatcactgagcaatattaccatcacaatagccaggcattgtgctaagcactgctcaagaggtagtgtgcctgggcaaagtgggtaatcaatcagtatttatttggatgtgtgggtgggtggatggatggatggatgaaaggatggatggatagatggatgatagatgagcaggcagataggtggatagatggatagatgaatgagtggatagatggtgagtgtcagtctgtttttcattgctayaaaggaatacctgagactgggtaatttataaagaaaagagatttattttggttcatggttctacaggctgtataagaagcatggtgcaggcatctgcagctggtgaggcctaaggaagcttccaatcatagcagaaggcaaagggggagctggcatatcacatggcgagagagggagcaagagagctgccgggttcttttaaacaaccaggtctcatgtgaactaacgagcaagaactcactcatgaccacagggagggcaccaagccatggtgaagggtccgcccccatgacccaaaca

SEQ ID NO: 56069 - DNA, 601 bp, Human
tgagcaatattaccatcacaatagccaggcattgtgctaagcactgctcaagaggtagtgtgcctgggcaaagtgggtaatcaatcagtatttatttggatgtgtgggtgggtggatggatggatggatgaaaggatggatggatagatggatgatagatgagcaggcagataggtggatagatggatagatgaatgagtggatagatggtgagtgtcagtctgtttttcattgctataaaggaatacctgagactgggtaatttataaagaaaagagatttattttggttcatggttctrcaggctgtataagaagcatggtgcaggcatctgcagctggtgaggcctaaggaagcttccaatcatagcagaaggcaaagggggagctggcatatcacatggcgagagagggagcaagagagctgccgggttcttttaaacaaccaggtctcatgtgaactaacgagcaagaactcactcatgaccacagggagggcaccaagccatggtgaagggtccgcccccatgacccaaacacctcccaccaggccccatcttcaacactggggatcacatttcaacatgagatttggacgggac

SEQ ID NO: 56070 - DNA, 601 bp, Human
gtctgtttttcattgctataaaggaatacctgagactgggtaatttataaagaaaagagatttattttggttcatggttctacaggctgtataagaagcatggtgcaggcatctgcagctggtgaggcctaaggaagcttccaatcatagcagaaggcaaagggggagctggcatatcacatggcgagagagggagcaagagagctgccgggttcttttaaacaaccaggtctcatgtgaactaacgagcaagaactcactcatgaccacagggagggcaccaagccatggtgaagggtcygcccccatgacccaaacacctcccaccaggccccatcttcaacactggggatcacatttcaacatgagatttggacgggacaaacatcctaaccatctcagtgggttgtggatgtatggatgaatacatgaaagaaaaatgatctcagtcagcaggatccaggccctgggggtttgactagaacctccataaacatggggagtgaatatgacttttccatccctgttccaatcccgaagtcccctaaattcccagccagccaccacctcctggaagccctccaagaagaagtaacatcct

SEQ ID NO: 56071 - DNA, 601 bp, Human
atagaggagaggatcccctccccataaccaaggcgggaaagggactaactaaccaggaagattgaagttggagcctcagccctgcaggccaccacacaggcccctcctgttgatctgattagtctgtacctgcatccacccccttttaatttgaatggcccaggagcactgctagaaagaaaacatctcagaacagtttcaggcattagcaaacagctctgcaacctcccacttggcgggctgtactggtaacaaccatggggagaccagtcatgaagcagctaatttggttcactgctgyttaattgaccagtggaatttttttttttttttttttttgagatggagtctcgctctgtcacccaggctggagtgcagtggcacaatctcggctcactgcaagccccgcctcccgggtttatgccgttctccttcctcagcctcccaagtagctgggactacagacacccgctgccatacccggctaattttttttttttttttttttttttgtatttttagtagagacagggtttcactgtggaccagtggattttacagcctcccatcctttcatcctcatgataccactggaagacgt

SEQ ID NO: 56072 - DNA, 601 bp, Human
gaccagtggattttacagcctcccatcctttcatcctcatgataccactggaagacgttcattgactccatcttacagacaagacagctgaggcttagtgatgctaagtgacatcacccatgtgtaggcagctaggaaggtgcttcatgcatagcagggctcgagagagcttaggtaagcgatgtgaggaacctctgcctgttcaccatccaatccacaggtgctcagtaaattgctgtaggatgcatacgaccgtccaacacccttcagatcataaaacaatagaatttgagagctgcgrctatagcactgccactaagtcactgttggctttaagcaagtcgctcaccttgagggggttgaacgagcgtgttgtgttggtcagcggtgcctaggaacagcagcagcttgggctcaacagggagcttgttagaaatacagagccttaggccccactccagacttggggagtcggaatccctggggcgatgatatggtctggatctgtgtcccctctaaacctcatggtgaaacataatctccaatattggaggtggggccgggtgggaggtgatcggatcacagaggcagatccctcgtg

SEQ ID NO: 56073 - DNA, 601 bp, Human
agctgaggcttagtgatgctaagtgacatcacccatgtgtaggcagctaggaaggtgcttcatgcatagcagggctcgagagagcttaggtaagcgatgtgaggaacctctgcctgttcaccatccaatccacaggtgctcagtaaattgctgtaggatgcatacgaccgtccaacacccttcagatcataaaacaatagaatttgagagctgcgactatagcactgccactaagtcactgttggctttaagcaagtcgctcaccttgagggggttgaacgagcgtgttgtgttggtcagyggtgcctaggaacagcagcagcttgggctcaacagggagcttgttagaaatacagagccttaggccccactccagacttggggagtcggaatccctggggcgatgatatggtctggatctgtgtcccctctaaacctcatggtgaaacataatctccaatattggaggtggggccgggtgggaggtgatcggatcacagaggcagatccctcgtggcttagtgctgtcctcacaatagtgggagagttctcataagatctggttgttgtaaagtgtggcactccaccccctgcccagctc

SEQ ID NO: 56074 - DNA, 601 bp, Human
gtaggcagctaggaaggtgcttcatgcatagcagggctcgagagagcttaggtaagcgatgtgaggaacctctgcctgttcaccatccaatccacaggtgctcagtaaattgctgtaggatgcatacgaccgtccaacacccttcagatcataaaacaatagaatttgagagctgcgactatagcactgccactaagtcactgttggctttaagcaagtcgctcaccttgagggggttgaacgagcgtgttgtgttggtcagcggtgcctaggaacagcagcagcttgggctcaacagggmgcttgttagaaatacagagccttaggccccactccagacttggggagtcggaatccctggggcgatgatatggtctggatctgtgtcccctctaaacctcatggtgaaacataatctccaatattggaggtggggccgggtgggaggtgatcggatcacagaggcagatccctcgtggcttagtgctgtcctcacaatagtgggagagttctcataagatctggttgttgtaaagtgtggcactccaccccctgcccagctctctctcttgctcccactctcaccaggggagacgcctgc

SEQ ID NO: 56075 - DNA, 601 bp, Human
tcataaaacaatagaatttgagagctgcgactatagcactgccactaagtcactgttggctttaagcaagtcgctcaccttgagggggttgaacgagcgtgttgtgttggtcagcggtgcctaggaacagcagcagcttgggctcaacagggagcttgttagaaatacagagccttaggccccactccagacttggggagtcggaatccctggggcgatgatatggtctggatctgtgtcccctctaaacctcatggtgaaacataatctccaatattggaggtggggccgggtgggaggygatcggatcacagaggcagatccctcgtggcttagtgctgtcctcacaatagtgggagagttctcataagatctggttgttgtaaagtgtggcactccaccccctgcccagctctctctcttgctcccactctcaccaggggagacgcctgctctcccttctctagccatggttgaaagctccctgcggcctcacctgaagccaagcagatgccagcaccatgattcctgcacagatcacagacccatgggccaattaaacctcctttctttatcaattacccagcctcaggtatgtctt

SEQ ID NO: 56076 - DNA, 601 bp, Human
gggctcaacagggagcttgttagaaatacagagccttaggccccactccagacttggggagtcggaatccctggggcgatgatatggtctggatctgtgtcccctctaaacctcatggtgaaacataatctccaatattggaggtggggccgggtgggaggtgatcggatcacagaggcagatccctcgtggcttagtgctgtcctcacaatagtgggagagttctcataagatctggttgttgtaaagtgtggcactccaccccctgcccagctctctctcttgctcccactctcaccakgggagacgcctgctctcccttctctagccatggttgaaagctccctgcggcctcacctgaagccaagcagatgccagcaccatgattcctgcacagatcacagacccatgggccaattaaacctcctttctttatcaattacccagcctcaggtatgtctttaaagcaatgcaagaatagcctaatacaggtagggtccagccaccaaggttaacctgacctctaggggattctgacacatgcacgcacacacccaaaagcttgagaagcgggtggcttctgtgagttgaggcttcccct

SEQ ID NO: 56077 - DNA, 601 bp, Human
tcggatcacagaggcagatccctcgtggcttagtgctgtcctcacaatagtgggagagttctcataagatctggttgttgtaaagtgtggcactccaccccctgcccagctctctctcttgctcccactctcaccaggggagacgcctgctctcccttctctagccatggttgaaagctccctgcggcctcacctgaagccaagcagatgccagcaccatgattcctgcacagatcacagacccatgggccaattaaacctcctttctttatcaattacccagcctcaggtatgtctttaragcaatgcaagaatagcctaatacaggtagggtccagccaccaaggttaacctgacctctaggggattctgacacatgcacgcacacacccaaaagcttgagaagcgggtggcttctgtgagttgaggcttccccttgccacccctgcaggtggattttgaagacgtgatcgcagagcctgtgggcacctacagctttgacggcgtgtggaaggtgagctacaccaccttcactgtctccaagtactggtgctaccgtctgttgtccacgctgctgggcgtcccactggccctgctctgg

SEQ ID NO: 56078 - DNA, 601 bp, Human
cataagatctggttgttgtaaagtgtggcactccaccccctgcccagctctctctcttgctcccactctcaccaggggagacgcctgctctcccttctctagccatggttgaaagctccctgcggcctcacctgaagccaagcagatgccagcaccatgattcctgcacagatcacagacccatgggccaattaaacctcctttctttatcaattacccagcctcaggtatgtctttaaagcaatgcaagaatagcctaatacaggtagggtccagccaccaaggttaacctgacctctakgggattctgacacatgcacgcacacacccaaaagcttgagaagcgggtggcttctgtgagttgaggcttccccttgccacccctgcaggtggattttgaagacgtgatcgcagagcctgtgggcacctacagctttgacggcgtgtggaaggtgagctacaccaccttcactgtctccaagtactggtgctaccgtctgttgtccacgctgctgggcgtcccactggccctgctctggggcttcctgttcgcctgcatctccttctgccacatctgggcggtggtgccatgcattaagag

SEQ ID NO: 56079 - DNA, 601 bp, Human
tctagccatggttgaaagctccctgcggcctcacctgaagccaagcagatgccagcaccatgattcctgcacagatcacagacccatgggccaattaaacctcctttctttatcaattacccagcctcaggtatgtctttaaagcaatgcaagaatagcctaatacaggtagggtccagccaccaaggttaacctgacctctaggggattctgacacatgcacgcacacacccaaaagcttgagaagcgggtggcttctgtgagttgaggcttccccttgccacccctgcaggtggatttygaagacgtgatcgcagagcctgtgggcacctacagctttgacggcgtgtggaaggtgagctacaccaccttcactgtctccaagtactggtgctaccgtctgttgtccacgctgctgggcgtcccactggccctgctctggggcttcctgttcgcctgcatctccttctgccacatctgggcggtggtgccatgcattaagagctacctgatcgagatccagtgcatcagccacatctactcactctgcatccgcaccttctgcaacccactcttcgcggccctgggccaggtctgcagc

SEQ ID NO: 56080 - DNA, 601 bp, Human
ttagagggagtcccgctctccaattaaagcggcccagctgcgcctggctgcgcacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaaggtgagtggaaagctgtttgtatttacccagattcttactttttcttgtttccccttcccatctgttcgcggaaacttcccaaaaggtaatgmgaagggaactctttaaattccaaaactgcatggaaaacaaatagttgggaatacatgtttgagctaacaggcacacacaccccaaacccaatgttgtgtaaaatatttgcaaagggtcttatgtctttggtgatgctagttaaagtttaattaaggttttacatatatatacaatatatataaaatgtatataaaatatatatataaaatatatataatatatattatatataatatataaaatatatattatatataatatatattatatataaaatatataatatatattatataaaa

SEQ ID NO: 56081 - DNA, 601 bp, Human
tttttatctcttgggactgcgacaatcaggaggaagatcaccattttgtaggttaaccaatgccttcaactcaaaatgtggaggggagggaggagagccgagaagctccccttgctgaactgaatgtcacagaagtgattaagtactacgtgatatcagcaacacgctgaaaagcttttactgcatatttattttttaaatctgcaacagtatgtgggggaggtttataacatttggcttcaggatgcataatcgcacttagacattttgaaacaatttcatagactcttagagctacaargggcctatttacaaaatgagaaatggtttaaaatggcatacaggctgtttccgcttccctacccccgagggggctggggcgggaatccccaccaactggaaagtcataaaaagatcttcagcaaagaacataaaatctaaaaactggagtagacttaaaggtcatctaaccaaccccagacaggctggggaaagagactcactgggggccacatacatacatcgtggcagagcttacaagttccctaacttctctctttctttctaagtaaaatgcttccaccggctgctcttgaaccat

SEQ ID NO: 56082 - DNA, 601 bp, Human
gaagaaacagtaacagcatctacctcccaagatggctgtgataattaagtgagatgatgtacataaaaggctcagcatatgggcactcagagttagccatggcagtccttggtggtggcggtacatttcagtgggtgcatggatgcggaaaggaattttctggtgaatgaggacacttttatttataactgccccatctgaagagcacctaactttcattcagctgaacctaagccattgctcagctttgacaagctaagacaatgaccaaatgctgttgccttcattctcacccaacggrtgcaaaatctgcttacatggaacagtctttccttctgaacatggattgccagttattgagcatttcactttggagttatataatgttaggcctcgaaggggacttggagtgccttactttttagataaggaaactgaggcccagagggatcaagctccttatcagaagttgcagagaaaatgtactgaagcctattaggctctgcaagaatacagaccccttgactgtcaaggaaccatctgtaggaatttagaagggattagaagaaagagagctaggaacctgttcatagttgactgt

SEQ ID NO: 56083 - DNA, 601 bp, Human
ggacttggagtgccttactttttagataaggaaactgaggcccagagggatcaagctccttatcagaagttgcagagaaaatgtactgaagcctattaggctctgcaagaatacagaccccttgactgtcaaggaaccatctgtaggaatttagaagggattagaagaaagagagctaggaacctgttcatagttgactgtgcagtcaccagtgggctggctccagagggatccaattagaaattctcacccctcaacacaatgcccaaggggcattaaatgatggtacttctaagtccaytgccaggtccacctggatgtctctctccatgcttctctacatcacatccctcttggctttcctgtccttcaggctaggccttccctctgtactcagcccttcctgctttcacctccacttcctgcagtgtgccaaactactggcacatcacccgggtgagctgatccaatgtaaacacagctcctcgtgaattgtcgttggctctctcaatcttaaaaacatattaaactgtcacttaaagaccttaatagccaagacattggagacatgcccataggtgtataagcaacttttttgcca

SEQ ID NO: 56084 - DNA, 601 bp, Human
gagaaccagggttccttctgcctccagcccactgacttttcctttacaccagatcatctcccaaataacaaatgattatgacaaaataggcttaaaacttcgttccactgaaagcggaattgtggagcagcttttcaggacatccaaaatgaagagacagctgttgctcttgaagagccttcgtttagaaatatcctcatatcccctaccatttgataacaggaagaggatttggccagcagctgctactgtctcaccaggtgcagggccaccagccacttttgcaggactccttcaagakcacaacatttccttaaatccacgtggaacaattggtgtgtcccaaaccattgttggatgtttacatatagcaatagcatagatctgcaaaagctctagaaaatgctctctataaaacttttatagaaagagttacatatgaagttgagtctcctgtgttcaccaaggctcctttagtggctgaaacacaaatttagtatctaatcctgtatatttgatgcagaaattgtgttttcacaaaaacagaagagacaaatcaattgtagtgctttgtgaaactcccaaatcaactccttgtctc

SEQ ID NO: 56085 - DNA, 601 bp, Human
ccagcccactgacttttcctttacaccagatcatctcccaaataacaaatgattatgacaaaataggcttaaaacttcgttccactgaaagcggaattgtggagcagcttttcaggacatccaaaatgaagagacagctgttgctcttgaagagccttcgtttagaaatatcctcatatcccctaccatttgataacaggaagaggatttggccagcagctgctactgtctcaccaggtgcagggccaccagccacttttgcaggactccttcaagagcacaacatttccttaaatccacrtggaacaattggtgtgtcccaaaccattgttggatgtttacatatagcaatagcatagatctgcaaaagctctagaaaatgctctctataaaacttttatagaaagagttacatatgaagttgagtctcctgtgttcaccaaggctcctttagtggctgaaacacaaatttagtatctaatcctgtatatttgatgcagaaattgtgttttcacaaaaacagaagagacaaatcaattgtagtgctttgtgaaactcccaaatcaactccttgtctcatatctgctcttctgtatgagaa

SEQ ID NO: 56086 - DNA, 601 bp, Human
tcccaaataacaaatgattatgacaaaataggcttaaaacttcgttccactgaaagcggaattgtggagcagcttttcaggacatccaaaatgaagagacagctgttgctcttgaagagccttcgtttagaaatatcctcatatcccctaccatttgataacaggaagaggatttggccagcagctgctactgtctcaccaggtgcagggccaccagccacttttgcaggactccttcaagagcacaacatttccttaaatccacgtggaacaattggtgtgtcccaaaccattgttggaygtttacatatagcaatagcatagatctgcaaaagctctagaaaatgctctctataaaacttttatagaaagagttacatatgaagttgagtctcctgtgttcaccaaggctcctttagtggctgaaacacaaatttagtatctaatcctgtatatttgatgcagaaattgtgttttcacaaaaacagaagagacaaatcaattgtagtgctttgtgaaactcccaaatcaactccttgtctcatatctgctcttctgtatgagaagcaaacccttttacatttttttctcagaaaagaga

SEQ ID NO: 56087 - DNA, 601 bp, Human
tgtctcatatctgctcttctgtatgagaagcaaacccttttacatttttttctcagaaaagagaaaggagtctgttcttacttttattatctatttggattcttgcctcccaacagacttgttctctgttaggacaggcaagtttggggctaggcaaaagagaggaaggaaagacatctctaagggtccggagatgattgacattttcctgtgtgttagctctttagcttcaaggactaccatgcaaaaatattggtgtccttttttacacatgagtaagttaagactaagagtttgaaaygacttgtctaaggtcacataatgacagattaagaactcaaactcaggcctctctgactccaaaacttcagttcttttcactctgcaagaaacagaaggcattcgtagaaagcagaaatctggtgaggagggactatgattattactgtgactttcatacacagatcaatttcttccagcccactgaactcattgatagtctggttcagaagcttcccagcatttgcaaaatgttgctaggcacctgtatctctttgatatctcttggtcaccaccaggagtatactgtcacctacaccaa

SEQ ID NO: 56088 - DNA, 601 bp, Human
gaaagacatctctaagggtccggagatgattgacattttcctgtgtgttagctctttagcttcaaggactaccatgcaaaaatattggtgtccttttttacacatgagtaagttaagactaagagtttgaaacgacttgtctaaggtcacataatgacagattaagaactcaaactcaggcctctctgactccaaaacttcagttcttttcactctgcaagaaacagaaggcattcgtagaaagcagaaatctggtgaggagggactatgattattactgtgactttcatacacagatcartttcttccagcccactgaactcattgatagtctggttcagaagcttcccagcatttgcaaaatgttgctaggcacctgtatctctttgatatctcttggtcaccaccaggagtatactgtcacctacaccaaatcagagccatttctcgggtatagaataaagactttcttgatttctcctggttttccagaaggctaatggacatctcccggcagaagactagtagagagaccttttaaagaataatacatgttatcctaatactctaaaaataattctagagaccttgtcccagagct

SEQ ID NO: 56089 - DNA, 601 bp, Human
gcaaaaatattggtgtccttttttacacatgagtaagttaagactaagagtttgaaacgacttgtctaaggtcacataatgacagattaagaactcaaactcaggcctctctgactccaaaacttcagttcttttcactctgcaagaaacagaaggcattcgtagaaagcagaaatctggtgaggagggactatgattattactgtgactttcatacacagatcaatttcttccagcccactgaactcattgatagtctggttcagaagcttcccagcatttgcaaaatgttgctaggcayctgtatctctttgatatctcttggtcaccaccaggagtatactgtcacctacaccaaatcagagccatttctcgggtatagaataaagactttcttgatttctcctggttttccagaaggctaatggacatctcccggcagaagactagtagagagaccttttaaagaataatacatgttatcctaatactctaaaaataattctagagaccttgtcccagagctttcaggaaactctgccctggggataaggttggccttgacatgtgcatttctacatgtctagtcagcctgacccat

SEQ ID NO: 56090 - DNA, 601 bp, Human
ataatatacccttgataaacatttcctcctgctgttatggataccccctctcatcagcatgatgcaaaaatcccataggttattaagtattgggatgtggaagaccaaattcagtttacctacatcacatggggcttctaagctctcagactgcaggaccttctctttgtagttaaacttggacctagccataaatatactcaggccacatcacattgcaaaatcatgagaatagccacaattcgtcttgggtgtttggtcgctaccctttccatagcagccctcccctgctccattaccrgtctttccctccaatgtcttgcttataagatagggcaacagtcactcatttctttatatagcaaatatttatttagcatctgttatgtgccagccactgtgctaagtactgaatacatgacaatgaataggaaagctttgatccctgccaagtaaacttgagtctggtagaatttatttttcataaggcaggagacaggccaaataatgtcagtgttctgtgagtctttgtgttccttgacctctcccctccccaacacacacacatacctctccttccttttccaaccaccctcagatt

SEQ ID NO: 56091 - DNA, 601 bp, Human
ttggcagctcttaggtcccaccagcagccagtggtccctcagccttcctacagcgatacagtggtagaccagttgtctttgctcagcatatgttttcagaggcagctgaatgtttgggttgtatttttcacagtactgatgtcagggacaccaaagggcaggagcatagggaaagggctcttggctgactaatgacctcataagaaacctgcccttagaagagagcatctgtttgggctgtatgactcagtggcgtttctaggtactgattcatgaggctgaccatcgaggtgactgaccygtgcaatctgctggctgaaagaggtgaaggcaaagtagatcccagctctgccctcatcctggaggagagccacccctcctaccacggcacacgggtgctccccaccccaaccctggctcggccagccagtctccttgttaagaggatctgacactaatgtgggcagaggtcagcatctgggggcttcttattttagaggaagtataagagagagatgttttgaaatcttgttagtgaatagaggacagccttttaacctaggatctgtagatagaattgagggtgtcagggaacttaaat

SEQ ID NO: 56092 - DNA, 601 bp, Human
cttagtttcttcatcaataaaaggggcctaaaagttattgtactcacaacaatcatctaagttcttggcacagtacttgacatataaggaatgtgtgttaaacacaaggcatcctcaccattaaaagacctaatgaaggtgaaatggtaaagagaataaacacattactttgttgaaactttttaaactcacctttgatttggccaactctaagaatttattttgtctaaacctgtattacacaaatattatatgccagggactgaggtgggaaatgaagaaataaaaggaaaggaatttyaaaatctgatggtctcagaaaaggaatagcctaatcaaatcatcaaagaatcatagcagtgcctaaagaccttgatcggggtacatgtgtgggactgagagagatcagaagaggaaatacttaatcttacctggggaggtcaagaaaggcgtcccaaagaggggacatttgagctgagtgttgaaagacaaggatgaatgagctgttaggatcaggccatagtccagttttatgccttctgaatctgacacccatattctccatcctatttgatttccaacttggggaatatcacccatc

SEQ ID NO: 56093 - DNA, 601 bp, Human
gttccttcttgctgtattctagagcaggcgatgcactgaaatgaaacacatatggcttggatatctcagtgctgctaggatgattgtccttgatttttgtcagttgtacatggtacattaaacagagaaaaataaaatcccagatgattccctggcaattatctgaaaaataacattatggtgatcatccctgtgtttacaaggacatgaagaaagggcaaggtttgatggaaaagctttgtttcctctaatctgtcctcctacacagccaacagacctcaatggcccatggggaagatayaaccctataatgagattcccagctaattaaaatggctgtcatcacccaccttccacatttccatgagcccagcccagaaatgggaccatcacaggggaaatcatcctatatttatttgaataatgtttgtactgtgtatttcagcaattaaaattaacttttaagaggtaggaagaggcttagggattctctaggtcaactgccttctttaacagatgaggaaacagacccagcaaagccagatgacttgcttgaggtcacagagctagttagtgggagaggtaggattagaattcaagg

SEQ ID NO: 56094 - DNA, 601 bp, Human
tatatttatttgaataatgtttgtactgtgtatttcagcaattaaaattaacttttaagaggtaggaagaggcttagggattctctaggtcaactgccttctttaacagatgaggaaacagacccagcaaagccagatgacttgcttgaggtcacagagctagttagtgggagaggtaggattagaattcaaggtactatggcctttcaagttcagaaagacttttaaaaactgtgttgtgtagaatcacttccccataaacacaagatgagctgggcagctagttgctgtcagaataccrctgaggaacactcacacctcctgaagatgtctaatttttttaactcctctgattattggaaagctctttgttattttgagctaaaatttctctgtatgtaacttctccttattggttttctttatttccttggcagattcaaggaggtaatggccatttttttctgaagtcccagtcccagttaacctactaagtcctacatattggtcaggatgaaggtcagagcatctatattttgggtttcttcctaccttcagggagacctggtgtcagttcttagctgagtgagatggccagcac

SEQ ID NO: 56095 - DNA, 601 bp, Human
aagagaagaactccaaacccatgtcataaacactcaagaaaaatcagcactgttctacatgcatacatgtagaacatgactttcaaagaaaaaagggagggatgtatacaaaatcaaagaaggctaaggaggcaaagaagaaatgattgataaatagaggtaatatcaaaaacttttaaaaattatttgtaaagttgtcatcgcttattactatatggaatgctaaaacagtaacagggtaatcaaattttgcatgcttgtgtcttttcctctggaggcagtactcaataaataactatgmaggctggccattaaaatgaacttgctttcatgaaaagataccactaagaaagtgaaaggcaatccacagaaagaaaatatttgcagtatttatatatactgatccccagacaaaccctgggggatgtctgctggccatctcactcagctaagagctgacaccaagtctccctgaaggtgggaagaaacccaagaaatagatgctttgaccttcattttgaatatttatgtgtgtgtgtgtgtgtatatatatttgtgtatatagatagatgattgatagatagatacatacatacataca

SEQ ID NO: 56096 - DNA, 601 bp, Human
gcaaaactaatcaacagtgatagaaatcagaatagcaaccacctttataagaagaggtgtttattgaatagaaagtggcctgagggaactttctgggccactgaaaatattctacgtgtttatctagatggtgatcacatgggatatacatataaagtaatcgagcgaatactggagattggtgcatttcgaccgcatgtaagttttcctttgaagtactgttagataataatagaggcagtatttgataaacagttggaaagtgatatgtatccaggcagcagattaatgtgaggccaamgcatggaaagtgagttcctgctgcagccccctggaggtgtcacgttaggggagaactttgtctccaggagctgccaccaggaccctttcaaatcttgccattgaatttagcctggcatccaggtttctttgtgatgggtcccttttcagccacatcttccactacaacattctgctgccccagaatgtcactcattccctgaacatacttttcttccttgtgggcgtgctgagagggtttcctcctccacggccccaaatcccaccccttcctcagtgccctcctccataaaaccatcag

SEQ ID NO: 56097 - DNA, 601 bp, Human
acagagaccattccgtcttcccctttgggtgtgccctggaaccctggcacatgttatgggctcagtgataataatggatagaaaagggagtgggatggaatcgggaaataggagacggaaaggcatcaaaagaggtaagagcagctttgttctcctttctgacagggacaaggaattctgaggggttagaaagaaggaaagagaccctaagagcgggggatacaaaaacaaaacagctgtggaatagaggaggggagaccattaacctatttaagcacccctcagtgtggccccttcccaytctgcaccaagatcagaactggcaaagtaggagtgggtggggggagtggggaggagacttcgtggtagcatttaggaggaatcttaagatgaaaaggaaatgaaagtgagagaaattggggaagccagcgcaccaaaccagaccctgaatttttttatgctttcaagttttattctccttcttcaagcttgtctacaaaaagatgggctttaggatggtggacgagccaggccttgattcatttccctttttcaaacaactaacttgaaccttcatctgaacctcgaggccctctctttc

SEQ ID NO: 56098 - DNA, 601 bp, Human
aagaggtaagagcagctttgttctcctttctgacagggacaaggaattctgaggggttagaaagaaggaaagagaccctaagagcgggggatacaaaaacaaaacagctgtggaatagaggaggggagaccattaacctatttaagcacccctcagtgtggccccttcccattctgcaccaagatcagaactggcaaagtaggagtgggtggggggagtggggaggagacttcgtggtagcatttaggaggaatcttaagatgaaaaggaaatgaaagtgagagaaattggggaagccagygcaccaaaccagaccctgaatttttttatgctttcaagttttattctccttcttcaagcttgtctacaaaaagatgggctttaggatggtggacgagccaggccttgattcatttccctttttcaaacaactaacttgaaccttcatctgaacctcgaggccctctctttctggctggacatctcttgagaacaaactctagtgatttccgtggtctggggaagcggttggcctggatcacggaacaacagcagctgcatctcaggaggcttggccctcctgagagacaagagccggagg

SEQ ID NO: 56099 - DNA, 601 bp, Human
accagaccctgaatttttttatgctttcaagttttattctccttcttcaagcttgtctacaaaaagatgggctttaggatggtggacgagccaggccttgattcatttccctttttcaaacaactaacttgaaccttcatctgaacctcgaggccctctctttctggctggacatctcttgagaacaaactctagtgatttccgtggtctggggaagcggttggcctggatcacggaacaacagcagctgcatctcaggaggcttggccctcctgagagacaagagccggagggacaaccraaaactggctgaaatttagtgcaaacctctcatagctcagacagctatctactttaagtttctagtccttgatgaatatttataccaaaatagggccagtggaaaagttccatctgcctggattttaagacttttgcctttcctcagccacgttgaccaaactcaggaaagtggcggaatcattgccaagtacatgctctttgaagtgcaagaaatcctgagaaggccttgaattcatcatatttcttcttatcctgaaaacttagagttggcactcctttaaaaaaaaaatgcttaata

SEQ ID NO: 56100 - DNA, 601 bp, Human
tgagaaggccttgaattcatcatatttcttcttatcctgaaaacttagagttggcactcctttaaaaaaaaaatgcttaatatcagcacctctcagtgctttataattttagccaagcccttgacaccatgttgaccacaacactcttgaaggagtggataggtctattcaaagttttgcagggagaaattgctttgttggttgatatttttaaaatccgaatgatccaattattcactttaattctcctctttagtttgctagtaagaaaaatggccccaagttttatccttagtgttaytagtcatcctctactcctcagaaccaaaacaccagaaatttcaaccatgtcgtacctttgatgtgtgaagataaaatagaggccttactctagcacgaggcatagtgagtgctcttaccaagcacaggccaggtgccaggcattgtgctacatcattttttgctgaattttacaatcatcccattttgcagatgagtaaactaagatccagagggattaagtcccatggttacatacttagtcatggtgaatgtgaatgaaatgtgggcaattcaacccatagctcttccttttccttct

SEQ ID NO: 56101 - DNA, 601 bp, Human
gtgtataatgtgtatatgaaacataacaatttcaggttaaggcttggatcttgtccccaagatatcgtattacatatatgcaaatattccaaaactgaaaagtattcaaaatctgaaatacttctggtcctaagcattttggaaaagggatgctcaacctgtactatgtctaacctatatctaacatgttttcagtgttccagaagtttgggtcgtggacttgttggtctaaagatgaatttagttgatacacaggcatgcactgacaacattgaaccatgttagtcagcatctttctctyatttcagttctttcattcttctgattatatcaaggaggaagtctccttctgatgctaaaacgcctttatcatcccaaacacttgctgaacttcactttaaacaattggcaagtagttcccaggctcagaacttttaaaaggcaatcatacctagctagaatttaatgactcatatttattgcatttgttgtggttaccatctaatttttatacactttagagataatttttttcaagaaatatgtttttaaacatgtgtttaaagaaaagtcaataatcacacagatggtatatggagaa

SEQ ID NO: 56102 - DNA, 601 bp, Human
aaaaaaaaagaaaagaaaagaaaaaggagtcttttataagaaggatgcttgtttaaaaccaggaaaacatcttgctgaaggcactacactaaaacacaagtggtattttaccatcaagactccaatgttggttgaaggaaatccttttccatgtgcacacacgtgtgtgtgtgagagagagtgtgtgtgtgtgtgtgtgtcaatgcttccattgtcataatagttaacccaggaatttaggtgtgagattcccagcaggaagcatttgcataagcaaagccttaagacttttaataatagygctgtacgtttatacaacacatttccttttaagatactaagattcagacaggcaagattaaaaatccaccaacttggtgtgttatgtctcccctatttccaaaattaactccaataaaagtgtgttatccttggaaagatcagtaggactgcaaatttggaattcagacacatgcatgcacaaacacacacacacaccaaatgacattcctacaggatgacattcttaagacatcaggctgctaaaatcaggagcatcttataaaactagggaggtataataagtaggtattgctgacct

SEQ ID NO: 56103 - DNA, 601 bp, Human
ctgacagggcatatctagggaaagaaaaagacaactccaagagaaaaaacaattgtgttggagcctctggaagcatttagtttggcaagaaatgccaggtcaacttttgccctataggaatccctttcataggcaattaaaacaatgcccaccctttgggactctgagtgatctcaaaagattcattaaaagtccacaaatggaaggagatcagaggaccatcctctcactgactgaattaagcaggtagcccctcaaataacgggctgacttttctagaaacgtggacaattctgaaacrgcggaaaatggttttgcttcttggctgttttctcagtctgcctttgtacaattcactattcacgttagcctgagcagtgtctgtagctagttcaaagggagctggtgtcaaaggaaaatattagttcagccttaaaaatcctatcacttcagtccagtggggtcccttatacgtaagatttgtgggcctgctttggatacaacaacatgtaaacatcagctgtcagcaagaagctggcagccaaaaaggctggtttcctttccccctcagtcatcttcgtgttcgccctgccaacagaat

SEQ ID NO: 56104 - DNA, 601 bp, Human
caaaggctgtcgcccatgccaactgggagaaggagcccagcctgcgaatgattttatagaattgcttatagctcctctgtccaaacgtccctcacatcaggctgttccaagagttgcaaacccttgaaaaatgtgctgatttgagtcttatcacctctttgtctatttttgatggaagtgctaaaaatacaaaagagtaaaattatccaaaaggcagacagaagaaaaagaaaaaggggcagatagtctcctatcttggctagcagagcactcatggtgtcttctcccttatgccaagtgmtactgtgatgataggtagacagtgctggtagattcggttggtagaccagatgaccgagggaactgtgattgcaatcatagattcttaatcagaaggagagttgttttttcattttggttttggtttttgttttttttcaagatggatgcagatggtggggtcagcttctcaggtggagtacagttttagaaccaccaccatcacccaacccctcaaaaggaagcacaggcttctatacacttacttctttcatggcccagggtctgggtgttttggctttcctggaaccagtctcaaatc

SEQ ID NO: 56105 - DNA, 601 bp, Human
ctgggagaaggagcccagcctgcgaatgattttatagaattgcttatagctcctctgtccaaacgtccctcacatcaggctgttccaagagttgcaaacccttgaaaaatgtgctgatttgagtcttatcacctctttgtctatttttgatggaagtgctaaaaatacaaaagagtaaaattatccaaaaggcagacagaagaaaaagaaaaaggggcagatagtctcctatcttggctagcagagcactcatggtgtcttctcccttatgccaagtgatactgtgatgataggtagacartgctggtagattcggttggtagaccagatgaccgagggaactgtgattgcaatcatagattcttaatcagaaggagagttgttttttcattttggttttggtttttgttttttttcaagatggatgcagatggtggggtcagcttctcaggtggagtacagttttagaaccaccaccatcacccaacccctcaaaaggaagcacaggcttctatacacttacttctttcatggcccagggtctgggtgttttggctttcctggaaccagtctcaaatcagtgaagcttggctagcagaga

SEQ ID NO: 56106 - DNA, 601 bp, Human
tgccccagagaggagtcagccagtcagtgaaatttagaggaagaggaagggttgtggtttcccttcggtctggttaagagaatgactgcatttggcaccaaaacctgtggggcaggcttgtgccagggctgatgctgaaatgacaacaataaaagccagacttgctgtaaaaaactctccttgtagggaatggtggtccacaagctgcttatgaaaagggaatttttttcagccttattgaggtataactgacaaataaaaattgtatgtctttaagaggtataacttgatggatttgtgrtgttgctgttgttgttgttgttgagacagggcttcactctgtcatccaggttggatgcagtggcacgatcacaggtcactacaacctcaacctcctgggctcaagcaatcctcccgcctcagcctcctgagtagctgggaccacagaagtgaaccaccatacccagctaattttttagttttctgtagagatgaggtgtcactatgttgcccagactggtctcaaactcctgggctcaagcaagtcaccctccttggcctgccaaagtgctgagattatagacgtgggccaccgagccta

SEQ ID NO: 56107 - DNA, 601 bp, Human
ataactgacaaataaaaattgtatgtctttaagaggtataacttgatggatttgtgatgttgctgttgttgttgttgttgagacagggcttcactctgtcatccaggttggatgcagtggcacgatcacaggtcactacaacctcaacctcctgggctcaagcaatcctcccgcctcagcctcctgagtagctgggaccacagaagtgaaccaccatacccagctaattttttagttttctgtagagatgaggtgtcactatgttgcccagactggtctcaaactcctgggctcaagcaaktcaccctccttggcctgccaaagtgctgagattatagacgtgggccaccgagcctagcccaaattgatgttttgatattcatatacattgtgtactaatcaaactaatttttttacatggtgagaatacttaagatctaccctgttagcaaatttcaagtatagaatacagtattgttaactatagtcatgatgctttacattagatctccagaacttactcatcctgcctaattgaaactttgtaccctttgaccaacatcctcccatttctcttaatcctcagcctctggcaaccaca

SEQ ID NO: 56108 - DNA, 601 bp, Human
cctgggctcaagcaatcctcccgcctcagcctcctgagtagctgggaccacagaagtgaaccaccatacccagctaattttttagttttctgtagagatgaggtgtcactatgttgcccagactggtctcaaactcctgggctcaagcaagtcaccctccttggcctgccaaagtgctgagattatagacgtgggccaccgagcctagcccaaattgatgttttgatattcatatacattgtgtactaatcaaactaatttttttacatggtgagaatacttaagatctaccctgttagcwaatttcaagtatagaatacagtattgttaactatagtcatgatgctttacattagatctccagaacttactcatcctgcctaattgaaactttgtaccctttgaccaacatcctcccatttctcttaatcctcagcctctggcaaccacagttctcttctgtgtttctatgagtttgactattttagattccacatataaatgagatcattatttgtctttctgtgcctgacttatttcacgtagcataatgtccttgagttcatccatgttgtcatgaatggcattattcttattcctt

SEQ ID NO: 56109 - DNA, 601 bp, Human
gttttctgtagagatgaggtgtcactatgttgcccagactggtctcaaactcctgggctcaagcaagtcaccctccttggcctgccaaagtgctgagattatagacgtgggccaccgagcctagcccaaattgatgttttgatattcatatacattgtgtactaatcaaactaatttttttacatggtgagaatacttaagatctaccctgttagcaaatttcaagtatagaatacagtattgttaactatagtcatgatgctttacattagatctccagaacttactcatcctgcctaaytgaaactttgtaccctttgaccaacatcctcccatttctcttaatcctcagcctctggcaaccacagttctcttctgtgtttctatgagtttgactattttagattccacatataaatgagatcattatttgtctttctgtgcctgacttatttcacgtagcataatgtccttgagttcatccatgttgtcatgaatggcattattcttattcctttttgaggctgaatattattccattgtgtgtgtgtgtgtttgtgtgtgtgtacgtgggtgtatgtgccacattttctttttccat

SEQ ID NO: 56110 - DNA, 601 bp, Human
catataaatgagatcattatttgtctttctgtgcctgacttatttcacgtagcataatgtccttgagttcatccatgttgtcatgaatggcattattcttattcctttttgaggctgaatattattccattgtgtgtgtgtgtgtttgtgtgtgtgtacgtgggtgtatgtgccacattttctttttccatttatttgttgacagacacttaggttgtttccatatcttggctattgtgaatagcgctgcagtgaacttgggaaggcagttatctctttgagatactgatttcatttcctktggatgtatatccagatgtgggatttctggattgtatggaagttctacttttaattttttgaggaacctcatactgttttccataatggctgtaccaatttacattcctcacaacagtgcacaaaggtccaggaagggagattattaagacaatgagctgagagcctaaaagtccaagttggaacggttgaagttacaatggtgagaccaaatgattcccaaacttgtctgaacattggcatcccctgggaactttcagaaatactgatgcctgtaatcaacccccagagattgtggcaa

SEQ ID NO: 56111 - DNA, 601 bp, Human
tgtatatccagatgtgggatttctggattgtatggaagttctacttttaattttttgaggaacctcatactgttttccataatggctgtaccaatttacattcctcacaacagtgcacaaaggtccaggaagggagattattaagacaatgagctgagagcctaaaagtccaagttggaacggttgaagttacaatggtgagaccaaatgattcccaaacttgtctgaacattggcatcccctgggaactttcagaaatactgatgcctgtaatcaacccccagagattgtggcaaaattkgcctggaatgcagcccaagttttggaagcattaaaagatccccaggagagtttaatgttgcagacaagttagggaaccactgttgtagcccctcgatactcaaagcgtggtccctgggacagcagaaatggtttctcctgggaggtaggtagaactatatgtcaggcttgcccagacttgctgaaccagagtgtgcatttgagctagatcccaggtgattttgtgctaatcagagtgtttacttaatttaaggagcactcccctcctcacacacccagaacaggcaaaatcccctgctaa

SEQ ID NO: 56112 - DNA, 601 bp, Human
gtgcaaaccaggacagttagttacccttcagttaactcatatgcaacctagaggcactaacaatgtatcagtggtctcaaactttaattgtttatcaaaatcacctggaggtcttgaacagcgatgtctgggccccacctgcagaatgtttgatttcataggtctggggtgaggcttgagaatttgcagtgctcacaagttcgctgctgctgtgctgctgcttagagaccacaccttgagaaccactgcaacatacctcccttgtagagttgttgtaagatttgtacaaggtcagccttcrcacagtgcctggaaaaccacaaatcctagtacttgttacagctactattgttacttttgattatggaaaagatgggactaaagatggtccctaaagagtcggcaggttttaagttctctgaggtttagatgagcataagcaaaatcccagagtttgcgtggatttagttctgcaagaggctcaggtggttggaaagagaatctgggtggaaacagtaaataatatggaaatagagacaaatttggacaggttactagctgttgaatcttgaagaagagcttaacctctctgagcctcagt

SEQ ID NO: 56113 - DNA, 601 bp, Human
gaaacagtaaataatatggaaatagagacaaatttggacaggttactagctgttgaatcttgaagaagagcttaacctctctgagcctcagtttccttatctgaaaatgaggctaatgaaattatctcataaggttgtcaagaagtttagatgaaatatcatgaaaatgtttggcatgtgcctggcacataggaagtactcaataaatgttaactatgatcatgatcactgggaaagataaaacacttttgattaaaggccagtataggaaaaggtagatttaggataccccaccaccacygccttcaaaggagctccaatggagaccatctggatgggcaagttgcttctccactctcagactcaaggtcattcatcatcttttgactgggaataatgatgataataattatacttcagtgggaagtcatattattaaataagagaattactaagtaaaatcactgagtaaaattcatggcagtagggtagtttcagggtcatatttttaaatacaattccagtcctttcctggaccttctgataattttattccactcaacccatctcactccagcttctctcccagaacccctaggga

SEQ ID NO: 56114 - DNA, 601 bp, Human
aaatatgaagtgaaacttaacaaagattgtgttctacccattaatgagggaacccgtatgatatttaggccagtttaaaaagcgcttgaggagttaggtatttataagtaatttaatgttaggacaagattgatgggttagttacaaaactagttaatgtcttccagaacagtaaaccataacatttggggttatcttttttgaaaggacagaaattgtttgtgtctctattggaccaagatctgcaagttaacgtgttacttcagaaagacttggagctgagcaaagtaaatttctctarataatcctatggggatgaggagagccagtgccatattgcctccatatgacattgaaaggatgtgccactcacctttctgccttatgtctgagttttaagtacttttctagggggccggggggacaggatggagtgcagtggcgtggtcatagctcactgcagccttaaactgctgagttcaagtgatcctccagcctcagcctctcaagtaagctggaactacaggcacatactaccacacctagtttttttttgttgttgttttcctgtagggattggggtctcactatgttgcacagg

SEQ ID NO: 56115 - DNA, 601 bp, Human
aagttaacgtgttacttcagaaagacttggagctgagcaaagtaaatttctctagataatcctatggggatgaggagagccagtgccatattgcctccatatgacattgaaaggatgtgccactcacctttctgccttatgtctgagttttaagtacttttctagggggccggggggacaggatggagtgcagtggcgtggtcatagctcactgcagccttaaactgctgagttcaagtgatcctccagcctcagcctctcaagtaagctggaactacaggcacatactaccacacctagtttttttttgttgttgttttcctgtagggattggggtctcactatgttgcacaggctggtcttgagctcctggcctcaagcaatccccctgcctcagcctcccagagtgctgggattacaggaatgagccaccacatctaattatttttttaacaatggcaaatacttatttcaatttactgccttttaatgttacgtgatgcttacaacagccctattgagacaaagaaagggcagggataattcatttttcagaggaggcaattgagttactccatgaggaagaagctgagctggaagg

SEQ ID NO: 56116 - DNA, 601 bp, Human
aagacttggagctgagcaaagtaaatttctctagataatcctatggggatgaggagagccagtgccatattgcctccatatgacattgaaaggatgtgccactcacctttctgccttatgtctgagttttaagtacttttctagggggccggggggacaggatggagtgcagtggcgtggtcatagctcactgcagccttaaactgctgagttcaagtgatcctccagcctcagcctctcaagtaagctggaactacaggcacatactaccacacctagtttttttttgttgttgttttcytgtagggattggggtctcactatgttgcacaggctggtcttgagctcctggcctcaagcaatccccctgcctcagcctcccagagtgctgggattacaggaatgagccaccacatctaattatttttttaacaatggcaaatacttatttcaatttactgccttttaatgttacgtgatgcttacaacagccctattgagacaaagaaagggcagggataattcatttttcagaggaggcaattgagttactccatgaggaagaagctgagctggaaggagaacccccattttctaattc

SEQ ID NO: 56117 - DNA, 601 bp, Human
tccctgccaccattcagtttcacgataatatcaaatgaaccacatcctactaacccaagccaaggaaaatcgtcaaaacatttctttctgttctcgggagaaaggacagattagatgctgcattccaagaaacctttttttaagtgatggtttcttttaaactcttctattctcagctactgtgagacactgtgccgtctttcaagagacagagcccacatcagaaaaacctactgtttataaaccagagtatctcacttgggactgtggctgactgatgttttcccctcctcagtaaacragatcgttctctctgtgttgaagatagcggggtctgtctggcttctggatgaatggcatgcagtggacaaatgactatttattgcattaaacagtcagccaggaaactagctgcaagtgtggcctgatgacctgaatcaatttcttccttgcaaggccatttatttttctctcccacatacttctgttgccatggaaactgtcccactagcagatggagaccagggccaactctcgcttcctgaacctccatttagtttagcgttcttgcccaactaggccagtcgcctgtgtcttcact

SEQ ID NO: 56118 - DNA, 601 bp, Human
tttataaaccagagtatctcacttgggactgtggctgactgatgttttcccctcctcagtaaacaagatcgttctctctgtgttgaagatagcggggtctgtctggcttctggatgaatggcatgcagtggacaaatgactatttattgcattaaacagtcagccaggaaactagctgcaagtgtggcctgatgacctgaatcaatttcttccttgcaaggccatttatttttctctcccacatacttctgttgccatggaaactgtcccactagcagatggagaccagggccaactctcrcttcctgaacctccatttagtttagcgttcttgcccaactaggccagtcgcctgtgtcttcacttgcctgactgcatgggctttctttgtgcttgttgagattttaacgtcgattctcttcaggtgattggtagcagagcaccgcgagggcaaagggctagggatggcctcacttaatgagttaatcattaagtatgggacatgtgtgagcttattttgtttttacattttgtaggaaaacctagtcagagaggcaactctttttacaagtcaaaaaagtagagaataagaaagtatagg

SEQ ID NO: 56119 - DNA, 601 bp, Human
cccctcctcagtaaacaagatcgttctctctgtgttgaagatagcggggtctgtctggcttctggatgaatggcatgcagtggacaaatgactatttattgcattaaacagtcagccaggaaactagctgcaagtgtggcctgatgacctgaatcaatttcttccttgcaaggccatttatttttctctcccacatacttctgttgccatggaaactgtcccactagcagatggagaccagggccaactctcgcttcctgaacctccatttagtttagcgttcttgcccaactaggccagacgcctgtgtcttcacttgcctgactgcatgggctttctttgtgcttgttgagattttaacgtcgattctcttcaggtgattggtagcagagcaccgcgagggcaaagggctagggatggcctcacttaatgagttaatcattaagtatgggacatgtgtgagcttattttgtttttacattttgtaggaaaacctagtcagagaggcaactctttttacaagtcaaaaaagtagagaataagaaagtatagggggtgtgtatttagaaaaaatagttcctctgaagtcccctagcatttt

SEQ ID NO: 56120 - DNA, 601 bp, Human
ggcgagtgctctgctgtgctctgctgtgctacctacatcactattctaaatcaaaccccgagtttgcagacagattgcagctccactctccaagccaagcatcagaactaatccccttgtagaatgagggttaaatcagcctctcattagaagaacaataaagctgaagtgtgcagggtgctttgccacttggaaatgcttccacctacctctccggtttccagccttctgagtatatctgaaatggtccaacaatgaagccttattcacaagttgtatatctcccaaaataaactttgartgactccaatattaagtgtgtaaggatcactgcatttcaactaggagaactgaaggtgtcaaggggaggtggaaatgagcaaggttatatgccagtggctttagggagcaaagtcctacctgtgaaagaaagctcccagcttaggagaatgagttagcagtgggtgttgtcttaattttcacttttcacatgaatctagcattgaataggcctaaatataaacctgcttccctccacactccacatatgtgcaacatgactctcactccctgaagctgtaaatatgtattgaacaaaatg

SEQ ID NO: 56121 - DNA, 601 bp, Human; identical to SEQ ID NO: 37632

SEQ ID NO: 56122 - DNA, 601 bp, Human; identical to SEQ ID NO: 37633

SEQ ID NO: 56123 - DNA, 601 bp, Human
ctgcctaaatgctgaaacctattggtcttaggagggagagccaaactggttttatataaccttgaacaaaagcaaccagagaaatctcaagtaaatgatcagagaaaccctgaggagggcagaaaggacacaggtccagagagagcaagtgactcacacaaggttacaccctagctgctcgctggaatccccgggacctgcagaaggtctccatacccaggtctcatcccagaccattgagtcagaagctccagactacaaaatccaaatcatcagatgtgaccatttaaatgactccccrtgcagccaccttcaagatccaatgcaccagatcagggctcctacaatctcaacatgggtagatatcacctggggagctcatcagaatgcatccagcaagttcagggccatcctgagataccgcacgcctgacatactcccaggtgatgttgatgctactggtccccagaaccttacatgtggagtaacaagaggctggatgatttctatatgttaatacaatttgtagaaggttcaacaattttaaaaatgcaagcatggcatttaattgaatatctgctggaagaaaaggagtgccttt

SEQ ID NO: 56124 - DNA, 601 bp, Human
agaaaccctgaggagggcagaaaggacacaggtccagagagagcaagtgactcacacaaggttacaccctagctgctcgctggaatccccgggacctgcagaaggtctccatacccaggtctcatcccagaccattgagtcagaagctccagactacaaaatccaaatcatcagatgtgaccatttaaatgactccccgtgcagccaccttcaagatccaatgcaccagatcagggctcctacaatctcaacatgggtagatatcacctggggagctcatcagaatgcatccagcaagttyagggccatcctgagataccgcacgcctgacatactcccaggtgatgttgatgctactggtccccagaaccttacatgtggagtaacaagaggctggatgatttctatatgttaatacaatttgtagaaggttcaacaattttaaaaatgcaagcatggcatttaattgaatatctgctggaagaaaaggagtgcctttggagcccttcatggccctatccttcaggctcctccatggctcccatcactgtgctctcactcccaacatctcaacaccttaagacactctgacttcctcctt

SEQ ID NO: 56125 - DNA, 601 bp, Human
catacccaggtctcatcccagaccattgagtcagaagctccagactacaaaatccaaatcatcagatgtgaccatttaaatgactccccgtgcagccaccttcaagatccaatgcaccagatcagggctcctacaatctcaacatgggtagatatcacctggggagctcatcagaatgcatccagcaagttcagggccatcctgagataccgcacgcctgacatactcccaggtgatgttgatgctactggtccccagaaccttacatgtggagtaacaagaggctggatgatttctatawgttaatacaatttgtagaaggttcaacaattttaaaaatgcaagcatggcatttaattgaatatctgctggaagaaaaggagtgcctttggagcccttcatggccctatccttcaggctcctccatggctcccatcactgtgctctcactcccaacatctcaacaccttaagacactctgacttcctccttccagtgctagaacacaccaagctcctgccctccttggggccttcgcacgtcctgctccttttctgaaaggttctttccttgctcttcccaaatagtccttctccagata

SEQ ID NO: 56126 - DNA, 601 bp, Human
tgcatccagcaagttcagggccatcctgagataccgcacgcctgacatactcccaggtgatgttgatgctactggtccccagaaccttacatgtggagtaacaagaggctggatgatttctatatgttaatacaatttgtagaaggttcaacaattttaaaaatgcaagcatggcatttaattgaatatctgctggaagaaaaggagtgcctttggagcccttcatggccctatccttcaggctcctccatggctcccatcactgtgctctcactcccaacatctcaacaccttaagacastctgacttcctccttccagtgctagaacacaccaagctcctgccctccttggggccttcgcacgtcctgctccttttctgaaaggttctttccttgctcttcccaaatagtccttctccagatattcagtttacaatagatgtcacctgccatcctatcacattttttatttcttttcgtttctttaacaacttttattgcaaacagattatcttttttctgtgcctagatatgagggcagacaccctgcctgtcctgtaaaccgtaacatccctgcacccaggacggtgcagggtgcag

SEQ ID NO: 56127 - DNA, 601 bp, Human
aaaaccccaaacacattgaccccagactaatcaggggaagccatcgtcaggcagtgattaatgctggctcataaaaccacatggctgtaaagaacccctctgtctgctcttcatctgggcgtccagggcaagtcccatttctgagattggacaactcccccttcccactcaccttcccaacatttttattattattattattattattattattattattattattattgtactttaagttctagggtacatgtgcacaacgtgcaggtttgttacatatgtatacatgtgccatgttggygtgctgcacccattaactcatcatttacattaggtattctcctaatgctatccctcccccaggcccccaccccaccacaggccccagtgtgtgatgttccccatcctgtgtccaagtgttcttattgttcaatgcagccataaaaaaggatgagttcatatcctttgtagggacatggatgaagctggaaaccatcattctgagcaaattatcgcaaggacagaaaaccaaacaccgcatgttctcactcatagctgggaattgaccaacttttttttaattaccgaatgatcaagactg

SEQ ID NO: 56128 - DNA, 601 bp, Human
caaagaaggaaactgaggctcagagagatgatgcaacgatgcagctagcccaatgtcccacagccgatgtaagtgacagagccaggtcttgaactcaggccaccctgactccaaagtttgggctcttccctaccaatccaggccaggccaggcgaactggcaggtgggaggggaggcaggaaggagcagataccctgggttagcattttcagggaaggctatcatgaacaggaagcagcttgagtgtggctttgaaagctgccaggatttgggggaaggaaagagggagaagacaaaggaraccagcatccactgagcatttgtatgtgtatctcatgaacacctcaccgcgccctatgtgctgagtatgttacaggctcattttacagaggagcagacagaggcccgtgaggagccaatgcaggggtggcacttactcatacctcgccctctgcttccagacccatggcaggcattacttatcagtcagagtactgtttcccattgacttcttatcggccctcaggatccttcttcacatagcactctcggtcaccactatggactggggttgacttgtcagatgaagcccatttactgt

SEQ ID NO: 56129 - DNA, 601 bp, Human
ccaatgtcccacagccgatgtaagtgacagagccaggtcttgaactcaggccaccctgactccaaagtttgggctcttccctaccaatccaggccaggccaggcgaactggcaggtgggaggggaggcaggaaggagcagataccctgggttagcattttcagggaaggctatcatgaacaggaagcagcttgagtgtggctttgaaagctgccaggatttgggggaaggaaagagggagaagacaaaggagaccagcatccactgagcatttgtatgtgtatctcatgaacacctcaccrcgccctatgtgctgagtatgttacaggctcattttacagaggagcagacagaggcccgtgaggagccaatgcaggggtggcacttactcatacctcgccctctgcttccagacccatggcaggcattacttatcagtcagagtactgtttcccattgacttcttatcggccctcaggatccttcttcacatagcactctcggtcaccactatggactggggttgacttgtcagatgaagcccatttactgttcttggctgccagcagaagaatcaggaagagaagaatcagaacagggtc

SEQ ID NO: 56130 - DNA, 601 bp, Human
tgagtgtggctttgaaagctgccaggatttgggggaaggaaagagggagaagacaaaggagaccagcatccactgagcatttgtatgtgtatctcatgaacacctcaccgcgccctatgtgctgagtatgttacaggctcattttacagaggagcagacagaggcccgtgaggagccaatgcaggggtggcacttactcatacctcgccctctgcttccagacccatggcaggcattacttatcagtcagagtactgtttcccattgacttcttatcggccctcaggatccttcttcacayagcactctcggtcaccactatggactggggttgacttgtcagatgaagcccatttactgttcttggctgccagcagaagaatcaggaagagaagaatcagaacagggtctccggattccagagcccatgtgtgtttcactgcctaatccagggtacaggagtgccttcccttccactttgctttgcatttttagtttctttcctgatacaggcagattcctggaacctctccacccaagatgtcccgaccaggttgcagagcaccaagtaactcagaaaggtcctcagggggccaggtgc

SEQ ID NO: 56131 - DNA, 601 bp, Human
ctggagctttgagctgcaaaaggatcactgggtccttgggaagggaaactccctttctccaaggctccagccaggaagcacattagccctgcagccacagacacccaatgccagtgcagagccgtgaaaggacaccgtgaacgcaggggtcaactaacatctggctggcgaagccgctgccccaggatccctagcacaccatttattgtaaagctcagaagaaaagggtgcaggccctggaaagccagagaaacagacacatccagggaatgggggatcctgttaccacttgatgcttacmcagcccgctcactctgaaatgatgacaaaaggaaatgcctccagagattggggaatatttttcctcttggaaaatcatccgtcttctagagaggcagcagagaagggcttgagacccatgctgctgggttcatagctgtctctatcacatactagctgtgtgaccttggggaggttacttaacttctctgtgcctctgttttccaaaaggtaacattagtaccttcctcctagggttgttgtgagaattaaatgggttaacgtgtgtgaagcacttggaagagtgcctggatcatagcaa

SEQ ID NO: 56132 - DNA, 601 bp, Human
aatatttttcctcttggaaaatcatccgtcttctagagaggcagcagagaagggcttgagacccatgctgctgggttcatagctgtctctatcacatactagctgtgtgaccttggggaggttacttaacttctctgtgcctctgttttccaaaaggtaacattagtaccttcctcctagggttgttgtgagaattaaatgggttaacgtgtgtgaagcacttggaagagtgcctggatcatagcaagccctccctaagagttggctgttcctatcatctcttcaactgctgaacatggakaagtcagcagtcttcccaggaagggcaattactctcccatgagccgaatcagcctggatggggctgcttcggaacttggtgttagtaagatgctagtcaggcctgatccccactctggcagagtgagccaagctcttctttccacttctccgaaatccttctttagattctggaagcaggggcaggccctgggcaagaaataggaaggggacggtgtgagcaaagttgccacccaaggctacaccctaacgcatctctgcagggctctgtgcctgccctcgcctgttggccgtccggctg

SEQ ID NO: 56133 - DNA, 601 bp, Human
cagggctctgtgcctgccctcgcctgttggccgtccggctgccacttctcactgtctctgatggtcacatcctctttccccactcactgcccccagagaagccccaaccctggggtatcctgtgtcagagccacccaggagaaactgttttaaactgctgatagatagatagatagatagatagatagatagacagacagacagagagatagacagacagacagatagacagacagacagacagatagatagatagattttgagacatgctgcccaggctagactgcagtggtgtgatcayagctcactataaccttaagctcctgagctcaagcgatcctcccacctcagccactgaagtagccaggtctacaggcatgtgccaccacacctggctgatttttcagtattttgtagagatgaggtctctctgtttcccaggttggcttcaagcaatcctcctgtgtcagccttggaagtgctgagattacaggcatgtgccaccgctcctggcttaaagtgctcatttctagggctctccagacctcctaaatcagaacctaaggatagacccagaaaacttttcacaaggtctcccagt

SEQ ID NO: 56134 - DNA, 601 bp, Human
agacagacagatagatagatagattttgagacatgctgcccaggctagactgcagtggtgtgatcatagctcactataaccttaagctcctgagctcaagcgatcctcccacctcagccactgaagtagccaggtctacaggcatgtgccaccacacctggctgatttttcagtattttgtagagatgaggtctctctgtttcccaggttggcttcaagcaatcctcctgtgtcagccttggaagtgctgagattacaggcatgtgccaccgctcctggcttaaagtgctcatttctaggrctctccagacctcctaaatcagaacctaaggatagacccagaaaacttttcacaaggtctcccagtgattcttatgcaccctaaagtttgaggttcttcagacctacctgactgacatatttgtgctaaaagccacctgtaatttcatactgatcaagaagaaaactaccagataccccagtctcctaagacggggtcaggacgaagcccttcccagatgttgctgcagttgtgtgatgcacaggggcttctgctcgtccacatggttggtggactatcttggcctctttgacaggaatc

SEQ ID NO: 56135 - DNA, 601 bp, Human
cctgtaatttcatactgatcaagaagaaaactaccagataccccagtctcctaagacggggtcaggacgaagcccttcccagatgttgctgcagttgtgtgatgcacaggggcttctgctcgtccacatggttggtggactatcttggcctctttgacaggaatccaccgtctccttcccctttcctgaactgtaacctcgggttagtgatattgctcttctctctctcttggttatggtgaccattgaatgagattgccagggacttctcatgacggtcagaaccctagggattacatartctaccctgaactttgtagatgaggaaactgaggcccaggagatactttctcagtctgacatagagagcagcaggagaactggacctaaaaccctgacttccagacactccaccacccaggtcttctcttctgtctgagaaagcaccttgaaaagcattcagaggtgtgcagacatacctgggattagctgggtatgctgtgagcttacagtgccagaaggtgtctcagataggtgtcctctgggatttagggcagagtgaccaatggggcgtctgcagccacccctcaattggagtccc

SEQ ID NO: 56136 - DNA, 601 bp, Human
tgacggtcagaaccctagggattacataatctaccctgaactttgtagatgaggaaactgaggcccaggagatactttctcagtctgacatagagagcagcaggagaactggacctaaaaccctgacttccagacactccaccacccaggtcttctcttctgtctgagaaagcaccttgaaaagcattcagaggtgtgcagacatacctgggattagctgggtatgctgtgagcttacagtgccagaaggtgtctcagataggtgtcctctgggatttagggcagagtgaccaatggggcrtctgcagccacccctcaattggagtcccacaggagctcaggtcacctgcctttcccctttctatgctgtttcccagaatttatttactatgaatcccagcaggtaccaagccctagacttgtactcccccaccccacaacaaccctagcttcctcaccactgctccctaaaatcagacagcaacagggtctgtacaatatgcatttcagcatgaatttccatgttcactcccacagttcccaaatgagtccagccccaagcgataagctatgggccagatgggttctaggaggatgaacc

SEQ ID NO: 56137 - DNA, 601 bp, Human
gtgtcctctgggatttagggcagagtgaccaatggggcgtctgcagccacccctcaattggagtcccacaggagctcaggtcacctgcctttcccctttctatgctgtttcccagaatttatttactatgaatcccagcaggtaccaagccctagacttgtactcccccaccccacaacaaccctagcttcctcaccactgctccctaaaatcagacagcaacagggtctgtacaatatgcatttcagcatgaatttccatgttcactcccacagttcccaaatgagtccagccccaagcrataagctatgggccagatgggttctaggaggatgaacctagcagcagccacctcagtgataggaatcaggagactgggtactaaggttcagagtcagggtcaggcacagaaatggaaaatggttgtccaggatgagcaatttgcctctcacggtttctcaggccgtggtcctgacctgtatcttcccctaatctccccgtccctgggactcacccatgcataagaattacgttcaataaaaacaaatatataaatgaggccaaattggacagttacttgtgaacacattaatattcagac

SEQ ID NO: 56138 - DNA, 601 bp, Human
gtgaccaatggggcgtctgcagccacccctcaattggagtcccacaggagctcaggtcacctgcctttcccctttctatgctgtttcccagaatttatttactatgaatcccagcaggtaccaagccctagacttgtactcccccaccccacaacaaccctagcttcctcaccactgctccctaaaatcagacagcaacagggtctgtacaatatgcatttcagcatgaatttccatgttcactcccacagttcccaaatgagtccagccccaagcgataagctatgggccagatgggttmtaggaggatgaacctagcagcagccacctcagtgataggaatcaggagactgggtactaaggttcagagtcagggtcaggcacagaaatggaaaatggttgtccaggatgagcaatttgcctctcacggtttctcaggccgtggtcctgacctgtatcttcccctaatctccccgtccctgggactcacccatgcataagaattacgttcaataaaaacaaatatataaatgaggccaaattggacagttacttgtgaacacattaatattcagacagttaccagtcatattaatgggga

SEQ ID NO: 56139 - DNA, 601 bp, Human
agtcccacaggagctcaggtcacctgcctttcccctttctatgctgtttcccagaatttatttactatgaatcccagcaggtaccaagccctagacttgtactcccccaccccacaacaaccctagcttcctcaccactgctccctaaaatcagacagcaacagggtctgtacaatatgcatttcagcatgaatttccatgttcactcccacagttcccaaatgagtccagccccaagcgataagctatgggccagatgggttctaggaggatgaacctagcagcagccacctcagtgatrggaatcaggagactgggtactaaggttcagagtcagggtcaggcacagaaatggaaaatggttgtccaggatgagcaatttgcctctcacggtttctcaggccgtggtcctgacctgtatcttcccctaatctccccgtccctgggactcacccatgcataagaattacgttcaataaaaacaaatatataaatgaggccaaattggacagttacttgtgaacacattaatattcagacagttaccagtcatattaatggggaaatgttactgacctgagaccttgtcgattctactatt

SEQ ID NO: 56140 - DNA, 601 bp, Human
tagatggtgtagcctgctacgcatctaggctacgcagtatagcctattgctcctaggccacaaattgtacagcatgtgactgtactgaatactataggcaattgtaacacaatggtcagtcagtatttgtgtatataaacatatctaaacctagaaaaggtatagtgaaaatagagtatgataatcttatgggaccactatggtatatgtggcccatcgtggactgaaatgccgtcatgtagcacacgatcatacagtatgcatatggcaaagtgcgtgcatctgatgtgtacagcttgaygagctttgacacagatacatttccatggccctttcaccaagattgagacacagaacactccctacatacacaaggtagctaagggatgcgtgtttttcctttactaaagttttttctctcatgtgtgttttatttgtcacaatggacagtattgcttttgtaattttctaaaattacaaaagtaatctaactgcattaagttaagaaaataaagactgtgggtctttcagttgctgagaatgctggaagagaatgcattttcagttttaggtagattctgtcatagtttctttgactgat

SEQ ID NO: 56141 - DNA, 601 bp, Human
ctattgctcctaggccacaaattgtacagcatgtgactgtactgaatactataggcaattgtaacacaatggtcagtcagtatttgtgtatataaacatatctaaacctagaaaaggtatagtgaaaatagagtatgataatcttatgggaccactatggtatatgtggcccatcgtggactgaaatgccgtcatgtagcacacgatcatacagtatgcatatggcaaagtgcgtgcatctgatgtgtacagcttgatgagctttgacacagatacatttccatggccctttcaccaagaytgagacacagaacactccctacatacacaaggtagctaagggatgcgtgtttttcctttactaaagttttttctctcatgtgtgttttatttgtcacaatggacagtattgcttttgtaattttctaaaattacaaaagtaatctaactgcattaagttaagaaaataaagactgtgggtctttcagttgctgagaatgctggaagagaatgcattttcagttttaggtagattctgtcatagtttctttgactgatgaagccccatccacatcatgttgtctcttcctcctcctcctcc

SEQ ID NO: 56142 - DNA, 601 bp, Human
agttggggagatgaaagcctcatggcttggtttgtcttaaactgccccacagaaggcgaaaggaatgcttgaggctggaccacgtgggtctagcgtgtactgcgtttctggtccccagcccctgttttaccttttgctcctcctgccccatcaaccaagtgtcttcatttgtttctatggcaattaacttttggagatagaagtcccagcacacgagatccccaagcacattatctaccttgctgaacaggctggcagtcacacatgagccaggcgacccagggaaatgccagcccaaacraagctgctgccacatccagagagggccggactctttctcccttgtagtcactcaagctaatcatccaaaacctgcatcctccatctccaagccccatcttattagcaccatctgggattgccaaccaagaaactgttttatctgagaactctaagaccaaagaacaagatttatttcctctactacagatttggcagtgacgcataaaaggcccatttctcaggaagaatacatgtcctaaggatgtaaaaaagaaaaaaatattagatctagttaccatggtctataaactggtctttt

SEQ ID NO: 56143 - DNA, 601 bp, Human
ctcccaggcacactcaccctccccacaaagccccaatcctaactgaagctgaggaacaacatgagttgaggtccaccttgtcatggtttctgagcaggccagtgaaaatgttactggcagtaaaagacagataaaggagccccagatggaaagaggatgacaaacagccaggcactggctacattaactgctgagaggccctgtagggaagctgcttctcacctctagccattgggcatgctgctcctttgccatgccagaatgcattctcctgggagccctcctagcccttcagacaatwccctgagtttagtctccccacccgacccagctcagttcccatagaaagccacagagccaagggcggcagtttgaatcccagctctgtttcttggctgtgccccccttcacaagctattttgtctccttgggcctcgctggtcttatctataaaatgagtgcatttcctgtgtacctacatctcctatccagaggattgctgtgagataaataggaatgtggttgatccctagagcccctcatccctcagagaggcctctcctgctaaggtggtccctgctatccacccccaaagtcactc

SEQ ID NO: 56144 - DNA, 601 bp, Human
atcccagctctgtttcttggctgtgccccccttcacaagctattttgtctccttgggcctcgctggtcttatctataaaatgagtgcatttcctgtgtacctacatctcctatccagaggattgctgtgagataaataggaatgtggttgatccctagagcccctcatccctcagagaggcctctcctgctaaggtggtccctgctatccacccccaaagtcactctccattcccttaccctgtgattgttttcctagtatttatcacactccatgattatctcatctgtttttttatatrtttattttctgcctccacacacacaaagctccagtttccctgaaggctctggcattatctgcctgggtcactgctgtatccccagcatctagtccagggcctagcacacagtagatgctcagtaaacatggatgagcccctgaaaggcaagagtgttttgaaagctcccaagaactttccacaactgtctctggagcccagctctctgctgcacttagtctaaacctgtctctaaggtgcagacagatgcatcatctgctagtgtcttccacactcatctgttgtcccctaagtaggaag

SEQ ID NO: 56145 - DNA, 601 bp, Human
gggcagaggtttccaaatatttattgttcatctactatgtgcctggcaccgaggagatgtgaaagcaagcatagttggatgtggctcctgcttccatctagtgtagaaagaacaggtatcaaacaaccatacagagaaaggtaagcagagaagctttattatggacttaattgcccctggaaggaggtcagagaagatttcccagaaccaaagatctttaagtctcacatctgaagaatgaaagggagttaatcaggcaaacaggaacgggaacaatgtaccagacatcctgaacagcaasggcaaaggcctcatggcagggtggagcattccttcattcagcaactattgatggggaatttatgtgtgcggggcccagtagagggtcctgggtcagagctgcaaccaagcagcctctctctgccctctgcagctagccgcttagtggagagaacagatataaattagataattccataggtatttaaaaaataatgttagctaacatacatggagtccttttgggggatctgccaaaatcatgcatgggttccaaataacttatgtagatacttggccctggaggagatggagcactctt

SEQ ID NO: 56146 - DNA, 601 bp, Human
atgtggctcctgcttccatctagtgtagaaagaacaggtatcaaacaaccatacagagaaaggtaagcagagaagctttattatggacttaattgcccctggaaggaggtcagagaagatttcccagaaccaaagatctttaagtctcacatctgaagaatgaaagggagttaatcaggcaaacaggaacgggaacaatgtaccagacatcctgaacagcaacggcaaaggcctcatggcagggtggagcattccttcattcagcaactattgatggggaatttatgtgtgcggggcccartagagggtcctgggtcagagctgcaaccaagcagcctctctctgccctctgcagctagccgcttagtggagagaacagatataaattagataattccataggtatttaaaaaataatgttagctaacatacatggagtccttttgggggatctgccaaaatcatgcatgggttccaaataacttatgtagatacttggccctggaggagatggagcactctttagacatggagggcttggtgacttccttccaaagaggatagtatggaagtggggagaagagtcactttacagtgaaga

SEQ ID NO: 56147 - DNA, 601 bp, Human
aacatacatggagtccttttgggggatctgccaaaatcatgcatgggttccaaataacttatgtagatacttggccctggaggagatggagcactctttagacatggagggcttggtgacttccttccaaagaggatagtatggaagtggggagaagagtcactttacagtgaagaatctgacaaacactgcctccaccagaaggtcaaagtcaaccgcaacagtgacaagtgagggcgacagtatgtacccttgaaggatgtgataagaggagcagtttgccccgtgatcttcctcccarcgtactcatcatagtaacatcaggcaaatcccaactgagggacattctacaaaacacctgaccagtactcctcaaaactgtcatggtggccaaaaacaaagtctgagaaactgtcccagctaggaggagcctcaggagacatgacagttaagtgaatctgggatcctggaatagaaaaaggacattgggtaaagtttatgaacacgtgaataaagtttggactttagttaataatagcatatcaatattggttaattaattatgacaaatataccttattaatgtaagatgctaataact

SEQ ID NO: 56148 - DNA, 601 bp, Human
ctccagcagtcctcccacctcagtcttctgagtagctaggactacagatgagcaccatcacaactggctaatttttcaatttttttgtagagatggggtcttgctatgttgcccaggctggtctcaaactcctggcctcaaatgatcctcctacctccagttcccaacgtgctagaattaaaggcataaggcaccacttctaggcaaaaatattatttattaaatattatttaaaactcttcatgcacgggtaaaaagatccattcaaagtgcaaggtaaacaaacaggttttaatgtaamcaaatatgaaaggttcactgatgtgctttcagatttcacactgcaactaacttgagaaagtatcctgtgtcaaattttactgtagtatcaaagaagaatatccacagttgcctggaaggtcctttaaaatgcatcgtcctcctttttccaactttatgtcagtgtgagttcagattttcttcatgtatttcaaccaaaacaacagcatgcaaaagatgggctgcagaagcagttatgggaatccagcaatcttctgcaagtcattgaagagatttgcagatatataaaacaatgtcttaa

SEQ ID NO: 56149 - DNA, 601 bp, Human; identical to SEQ ID NO: 37634

SEQ ID NO: 56150 - DNA, 601 bp, Human; identical to SEQ ID NO: 37635

SEQ ID NO: 56151 - DNA, 601 bp, Human; identical to SEQ ID NO: 37636

SEQ ID NO: 56152 - DNA, 601 bp, Human; identical to SEQ ID NO: 37637

SEQ ID NO: 56153 - DNA, 601 bp, Human
cacaaccttagactctccactgtcactgtcttgtgctcaagtcaacgctgcagaacacaggaaacgggggctggccgggaaatccgcgcatccggccccagggcgccccagcctccccggctcgttgcagttaccggttgctggctcgaaagctttctcggtaccggaggcgtccgccggctccacgcgggccccgccgcggtaattgagcggctgcgacacgacgaaggtgccagtgctcatggcggcgacaggagagggccgaagactgcgaagaagcggggagagcgcggccaggcckgctcggagaaacatgagtggcggacgcagctccgcggcagaggctgacgggccgcgggaggggcggggccgcgggaggggcggggccgcgggatcggttctaggagattttaggggcagtcactcgattcctctgcggtccaggccaggccctcccctcgccaggagggtggagcaagacaccacattctccccaccaccccgccataccccacacagtctccaggcgggaagaggacttccttcttcgtgatcaatatttgcgtagcactttgcaagtgttttcgggttcatcattgca

SEQ ID NO: 56154 - DNA, 601 bp, Human
gtagtctttttttttttttttttttttttgagatggagtcttgctctgtcacccaggctggagtgcagtggcgcgatctcggctcactgcaacctctgcctcctgagttcaagcgattcccctgcctcagcctcctgagtagctgggactaccagtgcacgccactacgcccagctaattttttgtattttttagtagagaccgggtttcaccatgttgaccaggatggtcttgatctcctgaccttgtgacccacccgcctcagcctcccgaagtgccggaattacaggcgtgggctacygtaacttcttgtttttatgtatggtttgatttagtgaccatctctatactagcaggtttttttgttttgtttttttgttttttaagacggagtctcgctcttgttacccaggctggagtgcaatggcacgatcttgactcactgcaacttttgcctcctgggttccagcaattctcctgcctcagcctcccgagtagctgggattacaggcgcctgccaccacacacagctaatttttgtatttttagtagagacgggatttcatcatgttggccaggctggtcttacattcctgacctc

SEQ ID NO: 56155 - DNA, 601 bp, Human
tctcttagtagtagtctttttttttttttttttttttttgagatggagtcttgctctgtcacccaggctggagtgcagtggcgcgatctcggctcactgcaacctctgcctcctgagttcaagcgattcccctgcctcagcctcctgagtagctgggactaccagtgcacgccactacgcccagctaattttttgtattttttagtagagaccgggtttcaccatgttgaccaggatggtcttgatctcctgaccttgtgacccacccgcctcagcctcccgaagtgccggaattacaggmgtgggctaccgtaacttcttgtttttatgtatggtttgatttagtgaccatctctatactagcaggtttttttgttttgtttttttgttttttaagacggagtctcgctcttgttacccaggctggagtgcaatggcacgatcttgactcactgcaacttttgcctcctgggttccagcaattctcctgcctcagcctcccgagtagctgggattacaggcgcctgccaccacacacagctaatttttgtatttttagtagagacgggatttcatcatgttggccaggctggtcttacat

SEQ ID NO: 56156 - DNA, 601 bp, Human
tatctatcaatattctcttagtagtagtctttttttttttttttttttttttgagatggagtcttgctctgtcacccaggctggagtgcagtggcgcgatctcggctcactgcaacctctgcctcctgagttcaagcgattcccctgcctcagcctcctgagtagctgggactaccagtgcacgccactacgcccagctaattttttgtattttttagtagagaccgggtttcaccatgttgaccaggatggtcttgatctcctgaccttgtgacccacccgcctcagcctcccgaagtgycggaattacaggcgtgggctaccgtaacttcttgtttttatgtatggtttgatttagtgaccatctctatactagcaggtttttttgttttgtttttttgttttttaagacggagtctcgctcttgttacccaggctggagtgcaatggcacgatcttgactcactgcaacttttgcctcctgggttccagcaattctcctgcctcagcctcccgagtagctgggattacaggcgcctgccaccacacacagctaatttttgtatttttagtagagacgggatttcatcatgttggccag

SEQ ID NO: 56157 - DNA, 601 bp, Human
aacagccaaatttacttccttttctcctgaacatgtgaaagtagctatcactcggcctataaagagcggaaacatcagttttaactcaaattgttgccacatatttaaataaaatattatctatcaatattctcttagtagtagtctttttttttttttttttttttttgagatggagtcttgctctgtcacccaggctggagtgcagtggcgcgatctcggctcactgcaacctctgcctcctgagttcaagcgattcccctgcctcagcctcctgagtagctgggactaccagtgcacrccactacgcccagctaattttttgtattttttagtagagaccgggtttcaccatgttgaccaggatggtcttgatctcctgaccttgtgacccacccgcctcagcctcccgaagtgccggaattacaggcgtgggctaccgtaacttcttgtttttatgtatggtttgatttagtgaccatctctatactagcaggtttttttgttttgtttttttgttttttaagacggagtctcgctcttgttacccaggctggagtgcaatggcacgatcttgactcactgcaacttttgcctcctg

SEQ ID NO: 56158 - DNA, 601 bp, Human
tgccagatttttgactccatattttaaaagcagcctttgcattttgaacagccaaatttacttccttttctcctgaacatgtgaaagtagctatcactcggcctataaagagcggaaacatcagttttaactcaaattgttgccacatatttaaataaaatattatctatcaatattctcttagtagtagtctttttttttttttttttttttttgagatggagtcttgctctgtcacccaggctggagtgcagtggcgcgatctcggctcactgcaacctctgcctcctgagttcaagcrattcccctgcctcagcctcctgagtagctgggactaccagtgcacgccactacgcccagctaattttttgtattttttagtagagaccgggtttcaccatgttgaccaggatggtcttgatctcctgaccttgtgacccacccgcctcagcctcccgaagtgccggaattacaggcgtgggctaccgtaacttcttgtttttatgtatggtttgatttagtgaccatctctatactagcaggtttttttgttttgtttttttgttttttaagacggagtctcgctcttgttacccaggct

SEQ ID NO: 56159 - DNA, 601 bp, Human
tggtttaaaaagaaagaaaggctgggcacagtggctcacgcctgtaatcccagcattttgtgaggccgatgtgggtggatcacttgaggtcaggagttcaagaccagcctggccaacatggtgaaatccatctctacgaaaaatacaaaaattagccaggcatggtggcacacacctgtagtcccagctacttgggaagctgaggcaggagaattgcttgagcccgggaggcgaaggttgcagtgagccgagatcactccactgcactccagcctgggcgacagagcaagattccgtctcmaaaaaaaaaaaaaataaaaataaaaaaaggacgatgagctataaagagtgcattataattcaaaacaaagctttacaaacatgaaaacctgccaaaggagatgtccaagagccaacatccagatgggaagtattgaacaaaaacttgttttatatactaaggtgagcatgtggaaatgtttttccattttataaaaacgttacggcctaatgttgcaacaaagtcgaactgcaaacatcacaaagaaacctcagagcaatgtctgagttctggaaggaaataaattggaacataccctta

SEQ ID NO: 56160 - DNA, 601 bp, Human
ggggggctgggggagggatagcattaggagaaatacctaatgtaaatggtgagttgatgggtgcagcaaaccaacatggcacttgtatacctatgtatcaaacctgcacattgtgtacatgtaccctagaacttaagtataaaaaaaaaaaaaaaaggaggcaggattatcacttgttcctcgcagctctggactcccaggaagaggcagcctggtcagattctgggaaacaaaagaaaccttttgtttccgtcaagtttcaaacagaggaccttccgtgtgttaggccagcgtggtaacyactacaccacagaaaccctttgcattgcaggctttttatgttttgcgatgagtattaaatacttgtttttacaattttttttagttgacaaataaaaattgtatatatttatgatgtaaaaaaaaagtttaactctcttttttttaaagggaacatctacaaatctatgaaatcttcccaattaaagtaacgatacttaaaaccctatctgaaaacaaatctgaaaaagaaaggtagacttgagaatcatcaaaataaagaataaaaaggaaacaagtaaaccacatggtttaaaaagaa

SEQ ID NO: 56161 - DNA, 601 bp, Human
agcgtgatcaatgcagaagacggtgatttctgcatttccaacagaggtactgggttcatctcattaggactggttcacctgggaagcacaaggggtcagggaattccctttcctagccaagggaagccgtgacagatggtacctgggaaatcgggacactcccaccctaatactgcgcttttccaacagtcttagcaaacggcacaccaggagattatatcctgcagctggctcggcgggtcccccacccatggagctttgctcactgctataacagcagtccaagatggaactgcgaagktggcagtgaagctgggggaggggcgtctgccattcctgaggcttgactaggtaaacaaagcagccaggaagctcgaaccgagtggagcccaccacagctcaaggaggcctgcctgcctctgtaaactgcacctctggcggcagggcatagctgaacaaaaggcagcggaaacttctgcagacttaaacgtccctgtctgacagctttgaaaagagtagtggttcttccagcatggagtttgagatctgagaatggacagactgcctcctcaagtgggtccctgacccccaagtagcctaa

SEQ ID NO: 56162 - DNA, 601 bp, Human
gtataattatgtatatgtatattatatgtgttttatatgtatatgtatgtaatatatacacatatacacacacactcttgaaagcagggaaactctcagacccgtcacagtttctgacgtaacatacttatgacaaaaagtcaccacagacctaccactcagctatccatgattcttattttgatgtattctcttctgaattttctttctataatgaacatctggtacttctgatctttaagactataaaaagtttaactatcagagtccagaatcaagatggccgaataggagcagctcygatctgcatctcccagcgtgatcaatgcagaagacggtgatttctgcatttccaacagaggtactgggttcatctcattaggactggttcacctgggaagcacaaggggtcagggaattccctttcctagccaagggaagccgtgacagatggtacctgggaaatcgggacactcccaccctaatactgcgcttttccaacagtcttagcaaacggcacaccaggagattatatcctgcagctggctcggcgggtcccccacccatggagctttgctcactgctataacagcagtccaag

SEQ ID NO: 56163 - DNA, 601 bp, Human
aatctcaatctctctcactctctccccagagaagaggatgggcagatgtgccagtagtttctatttaaatgaatctcagaagtttagggttcttctcctttggtgcaacttcctgcatgcacagggatctcacctggttctcatcccatcccctcactcaccgtggtgaccggtgctttgaaaacaaaaaaactaggccggatgcagtggctcatgcctgtaatcccagcactttggaaggccaaggcaggcggatcacctaaggtcaggagttcgagacgagcctggccaacatggggaractctgtctctactaaaaatacaaaaaatagccaggcgtggtgtcatgtgcctgtaatcccagctattcaggagtctgaggcaggagaatcgcttgaacccaggaggcggaggttgcagtgagccaagattgtgccattgcactccagcctgggtgacagagtgagactccatcacaaaaaaaaaataataataaataaacagaaattagtgctaaggtattgctatggctgctgcattttgctgtaataaaccatccttctctgtgatccaaaaagcctcatgtctcttgctagaatat

SEQ ID NO: 56164 - DNA, 601 bp, Human
tacagtcccagcactttgggaagctgaggcaggaggatgacttgagcccaggagatcaagaccatcctgggcaacatgaataaacccgctctctacaaaaaatacaaaaattagccaagtgtggtgacatgagtctgtagtcccagctactcaggacgctgaggtgggaggatcgtttgagcccagaaggtcaaggccatagtgagctatgattccactactgtgcttcagctggggagacagagcgagaccttgtctcaaaaaacaaaacaaaacagaaaagaaatgctgaagaaattcsttctagcagaagagaaaatgacagcagacagatatctgggtctacacaaatgacttatgagcaccagaaatggtaaatatgtggacaaatgtgaaatattttaccttattcttaaaatattttaaaaaataattgtttacagcaatacttttttttaaattccagcctgggaaacatggcgtaaacctatctctacaaaaaatacaaacaaaaagtagccaggtatggtggtgcacatatacgggaagctgaggcaagaggatcccttgagcccaggaggttgaggctgtagtgagccat

SEQ ID NO: 56165 - DNA, 601 bp, Human
attacatacaaagatacaaaaataaaaatgacagtaaatttctcttctgaaacaatacaaatcagaagacagtggagcaacatctttaaagtactgaaagaaaaaactatttacctacaattcattcaaaaattaatgcaaaagaaagacttttttagacatacagaatctgaaagagtaccaacagacctgcactataagaaatgctagcctggcggggtgcagtggctcacacctgtaatcccagcactttgggaagccgaggtgggcggatcactggaggtcagcagtttgagaccascctggccaacatggtgaaaccccatctctactaaaaatacaaaaattagccaggcatggtggcacacatttgtaatcccagctactcgggaggctgaggcaggagaatcacttgaacccgggaggcggaggttgcagtgagccgagatcatgccactgtactccagcctgggtgacagagagagactcctctcaaaaaaaaaagagaaagaaaagaaaagaaaagaaattaattctaggctgggtacagtggcacacacgtacagtcccagcactttgggaagctgaggcaggaggatga

SEQ ID NO: 56166 - DNA, 601 bp, Human
gcaaaaaaaaaaactaaagaaatcatggccaaattttttttccaaatgaaacaaatttacagatccaagaggatcaataaacctcaggaaaaatacatatgaagaaaactgcaccaaaagacatcataatcaaattgcttaaaaccagtgataaggagaaaaatattaaaacagccaggggtggggggtagagggagtacattacatacaaagatacaaaaataaaaatgacagtaaatttctcttctgaaacaatacaaatcagaagacagtggagcaacatctttaaagtactgaaagaaaaaactatttacctacaattcattcaaaaattaatgcaaaagaaagacttttttagacatacagaatctgaaagagtaccaacagacctgcactataagaaatgctagcctggcggggtgcagtggctcacacctgtaatcccagcactttgggaagccgaggtgggcggatcactggaggtcagcagtttgagaccaccctggccaacatggtgaaaccccatctctactaaaaatacaaaaattagccaggcatggtggcacacatttgtaatcccagctactcgggaggctgaggc

SEQ ID NO: 56167 - DNA, 601 bp, Human
cagataaaacactatagaagaccgatgaacttgagtcataacaatagaaattacctgaaaacaaaacacacacacacagcgggtgggagggaaggctcagaaggagaaaaaaacccataaacacacccaaaaactggaaaatgaactgagcatcagtgacgtgggatagcttcaggcagcccaatatatgtgtaattggaggccctgaaggagaagtgatggaagagggggcaaaaaaaaaaactaaagaaatcatggccaaattttttttccaaatgaaacaaatttacagatccaagargatcaataaacctcaggaaaaatacatatgaagaaaactgcaccaaaagacatcataatcaaattgcttaaaaccagtgataaggagaaaaatattaaaacagccaggggtggggggtagagggagtacattacatacaaagatacaaaaataaaaatgacagtaaatttctcttctgaaacaatacaaatcagaagacagtggagcaacatctttaaagtactgaaagaaaaaactatttacctacaattcattcaaaaattaatgcaaaagaaagacttttttagacatacagaatct

SEQ ID NO: 56168 - DNA, 601 bp, Human
gaacacatatataaaagacccaaattaatctagagatgaaaatacactagatgagattaacagcagataaaacactatagaagaccgatgaacttgagtcataacaatagaaattacctgaaaacaaaacacacacacacagcgggtgggagggaaggctcagaaggagaaaaaaacccataaacacacccaaaaactggaaaatgaactgagcatcagtgacgtgggatagcttcaggcagcccaatatatgtgtaattggaggccctgaaggagaagtgatggaagagggggcaaaaawaaaaactaaagaaatcatggccaaattttttttccaaatgaaacaaatttacagatccaagaggatcaataaacctcaggaaaaatacatatgaagaaaactgcaccaaaagacatcataatcaaattgcttaaaaccagtgataaggagaaaaatattaaaacagccaggggtggggggtagagggagtacattacatacaaagatacaaaaataaaaatgacagtaaatttctcttctgaaacaatacaaatcagaagacagtggagcaacatctttaaagtactgaaagaaaaaact

SEQ ID NO: 56169 - DNA, 601 bp, Human
ccacagaacacatatataaaagacccaaattaatctagagatgaaaatacactagatgagattaacagcagataaaacactatagaagaccgatgaacttgagtcataacaatagaaattacctgaaaacaaaacacacacacacagcgggtgggagggaaggctcagaaggagaaaaaaacccataaacacacccaaaaactggaaaatgaactgagcatcagtgacgtgggatagcttcaggcagcccaatatatgtgtaattggaggccctgaaggagaagtgatggaagagggggcaaaaaaaaaaactaaagaaatcatggccaaattttttttccaaatgaaacaaatttacagatccaagaggatcaataaacctcaggaaaaatacatatgaagaaaactgcaccaaaagacatcataatcaaattgcttaaaaccagtgataaggagaaaaatattaaaacagccaggggtggggggtagagggagtacattacatacaaagatacaaaaataaaaatgacagtaaatttctcttctgaaacaatacaaatcagaagacagtggagcaacatctttaaagtactgaaagaaa

SEQ ID NO: 56170 - DNA, 601 bp, Human
aagtaacttcactgtgtcccagaacaaagcttaagaatattttttaaagtacaagactatccagcacccagcaatataatgtgccctagtgattcactagagatcatatgtctagtgatcaaaaactaccaggcatgcaaaaagtagaaaaccgtaacatttaaccaggaagcgaaactaaccaataaaaacacattcagaaataacacaacagaactagtagacaagaacattaagttatgatagctatactccgtatgttcaagaaggcacagaaaaacataagcatgttaaggagagycacagaacacatatataaaagacccaaattaatctagagatgaaaatacactagatgagattaacagcagataaaacactatagaagaccgatgaacttgagtcataacaatagaaattacctgaaaacaaaacacacacacacagcgggtgggagggaaggctcagaaggagaaaaaaacccataaacacacccaaaaactggaaaatgaactgagcatcagtgacgtgggatagcttcaggcagcccaatatatgtgtaattggaggccctgaaggagaagtgatggaagagggggca

SEQ ID NO: 56171 - DNA, 601 bp, Human
cccaccagccatagtgagaaaacctcattaacacccggatcacagggttaagcagtcagaagggtattgaataacatggcgaaatttgctgatctaaaagcaaatcttccaaggatcaaactgattccaagtaacttcactgtgtcccagaacaaagcttaagaatattttttaaagtacaagactatccagcacccagcaatataatgtgccctagtgattcactagagatcatatgtctagtgatcaaaaactaccaggcatgcaaaaagtagaaaaccgtaacatttaaccaggaagygaaactaaccaataaaaacacattcagaaataacacaacagaactagtagacaagaacattaagttatgatagctatactccgtatgttcaagaaggcacagaaaaacataagcatgttaaggagagccacagaacacatatataaaagacccaaattaatctagagatgaaaatacactagatgagattaacagcagataaaacactatagaagaccgatgaacttgagtcataacaatagaaattacctgaaaacaaaacacacacacacagcgggtgggagggaaggctcagaagga

SEQ ID NO: 56172 - DNA, 601 bp, Human
ggagggaaccaatgaggtgagccctacaattgctggagtctactgcctagagaaagttttcaggccacagagcagggaggaggaagctaggtggcgcccagcagacacatgagttgagaagatagggtgggagtttagggaactttgagtggctacagttcttcaagactgagtgtggaagggaaaagagctgcacagatagagaaccccagaaatctgcagattcccctttgagtaccagtgtgagaaaactacccaagactgggaaaaggactacccaagaagaaaaggtttttttttaaaaaaaaaaaaagccccagaactcacacagggccaggtatagttcatgttcccaccagccatagtgagaaaacctcattaacacccggatcacagggttaagcagtcagaagggtattgaataacatggcgaaatttgctgatctaaaagcaaatcttccaaggatcaaactgattccaagtaacttcactgtgtcccagaacaaagcttaagaatattttttaaagtacaagactatccagcacccagcaatataatgtgccctagtgattcactagagatcatatgtctagtgatcaa

SEQ ID NO: 56173 - DNA, 601 bp, Human
aaggattcaaagtaaaaatgagaaaatatggaaaaaaatgttcatttccactaggaatcaatgagcttctagccaagatggattaacagggaccagattcactctcccaccttaaacaactaaaaacaccagataaaatacatgaaccattttcagacatcagacattaagcaactcaaggcagtggtccctggaggagggaaccaatgaggtgagccctacaattgctggagtctactgcctagagaaagttttcaggccacagagcagggaggaggaagctaggtggcgcccagcagayacatgagttgagaagatagggtgggagtttagggaactttgagtggctacagttcttcaagactgagtgtggaagggaaaagagctgcacagatagagaaccccagaaatctgcagattcccctttgagtaccagtgtgagaaaactacccaagactgggaaaaggactacccaagaagaaaaggtttttttttaaaaaaaaaaaaagccccagaactcacacagggccaggtatagttcatgttcccaccagccatagtgagaaaacctcattaacacccggatcacagggttaagcag

SEQ ID NO: 56174 - DNA, 601 bp, Human
cagactagctcttatacttactagttatatgatctaagacaagctatttaacctttttgagcattttctcatttctcaaataggtaaaatagctatatacatctcaagatgcttttgctaatacaattatgtacaacaatcaccttgtccagaaggaaaaaatggagggagggagggataaattacagtacagaccactaaatgctaaacatgtaagcacaagaggcaagaaaaacaaaagaatagcaccaaactcagcgtcatggcattgtaaaagcatgaggtgtgacagtatacacayggtaaacgaggaaggaccagtagtgcaggagagctgggtcttatggtgtgtgaagagaaaagacgaggctggagaaacagggcctgagggccatgttaaggagggggaccatggccagttttacccaaggatgtaccatgatcaaatgtgcttctgtaggaggaccactctggtggcactgtacaagacaaaccaacctgggccagggctggaggcaagaagataacctacatacacaatctcttctttatttagatagttttgtcattgttttaagtaacattctccctcctcttttaa

SEQ ID NO: 56175 - DNA, 601 bp, Human
gaacatttcaaatacagggaagagatattacactggcaatagtgaaacacggttctgcttacactttagtgtaagagtgaacaaataggaagtaatctgtgattctatcgctgctaagccctggaacatttactaagagaatagaaacttttactctggagatttttttctcttttaaaataatggataggcaagtggttttgggggctgttttggggtttcaactctcagagaaaattcagttaattagatggccttgggaaattttttctgtgttattctattattctccatccttacaaaaaaaaagttatctactaagagcattaggagatcttctgatatagtacgtaaggattatcaaagatgtctctgacaaaaatttctgcctgctactattgcaagagtaaccataagataaaattgttcaccataacaacatactgctacaagtatttcttaggaaatacatgtgttgttcccaaccctgttcctcctctatatcaccctgctttacaatatgacttgaccaggtgttcactgggatgaaagattagaagccaagagtaggtccctcacttctccctttcactttgaaccc

SEQ ID NO: 56176 - DNA, 601 bp, Human; identical to SEQ ID NO: 19949

SEQ ID NO: 56177 - DNA, 601 bp, Human; identical to SEQ ID NO: 19950

SEQ ID NO: 56178 - DNA, 601 bp, Human; identical to SEQ ID NO: 19951

SEQ ID NO: 56179 - DNA, 601 bp, Human; identical to SEQ ID NO: 19952

SEQ ID NO: 56180 - DNA, 601 bp, Human; identical to SEQ ID NO: 19953

SEQ ID NO: 56181 - DNA, 601 bp, Human; identical to SEQ ID NO: 19954

SEQ ID NO: 56182 - DNA, 601 bp, Human; identical to SEQ ID NO: 19955

SEQ ID NO: 56183 - DNA, 601 bp, Human; identical to SEQ ID NO: 19956

SEQ ID NO: 56184 - DNA, 601 bp, Human; identical to SEQ ID NO: 19957

SEQ ID NO: 56185 - DNA, 601 bp, Human; identical to SEQ ID NO: 19958

SEQ ID NO: 56186 - DNA, 601 bp, Human; identical to SEQ ID NO: 19959

SEQ ID NO: 56187 - DNA, 601 bp, Human; identical to SEQ ID NO: 19960

SEQ ID NO: 56188 - DNA, 601 bp, Human; identical to SEQ ID NO: 19961

SEQ ID NO: 56189 - DNA, 601 bp, Human; identical to SEQ ID NO: 19962

SEQ ID NO: 56190 - DNA, 601 bp, Human
cggaggtgggagataccgagcggcagggtggtgggtcagcccatcatgccccctgctccgtgaagccctcatggtcttggactgggccttctgacactctcccgctgattgcaggaagttggccgcatgaagatcgagctctttgcagacgttgtgcctaagacggccgagaactttaggtaaggacgtgctccagctccgctggattagctgaggcagaagtcgggctccagtcagccgcctgaaatagcctgtctacctctgtccgtccgctcactgctcttgagacctgattcctccrtgcattgctctgtctggttgccgtttggattgttcccgtgttaatttacgttgttagtctgtgtgactgcgtgtctggacgtctggctggccgattggtggacttgctggctccagtgtttattctttcccgtatttagaggcgctcacgactgtgacatcatagtgattgaatcattcattttttgtccctttcaggcagttctgcaccggagaattcaggtcagtttcagatgtgtttgacttctttgcctgctccagaggggtgttctggggctgcagtgagggtatcggtgaacca

SEQ ID NO: 56191 - DNA, 601 bp, Human
taagacggccgagaactttaggtaaggacgtgctccagctccgctggattagctgaggcagaagtcgggctccagtcagccgcctgaaatagcctgtctacctctgtccgtccgctcactgctcttgagacctgattcctccatgcattgctctgtctggttgccgtttggattgttcccgtgttaatttacgttgttagtctgtgtgactgcgtgtctggacgtctggctggccgattggtggacttgctggctccagtgtttattctttcccgtatttagaggcgctcacgactgtgayatcatagtgattgaatcattcattttttgtccctttcaggcagttctgcaccggagaattcaggtcagtttcagatgtgtttgacttctttgcctgctccagaggggtgttctggggctgcagtgagggtatcggtgaaccacctgctggccttgaatgattgctggtgacagtgatagaaggtaatgccccaagggtctgtccctagtttatttgccttctttatgtctgtcaaccatctttaggagagtccttttggctccagtgcatggtaaactggaaaggccttgtgctacctgc

SEQ ID NO: 56192 - DNA, 601 bp, Human
agtgtattttgaaatcaacgttaatctaatacaataataacaacatctatgtttttctaaaccataaaatcttctcagtattctttgctctctgtttcagggtcataaaggatttcatgattcagggtggagattttgttaatgtaagtactattcctttcctatcaaagacccgtagttttagtttttgttgttattgttgcaattgctgtttttactacagagacccagtcttcaggcttgagaacaatagccaggtttgatgtgggtgttggagagaatggtgatggggaagttcttraaagtggctgggtacgactgactgtagataaccgactttagcactttgattgaggcattaaattccatggtccaaatctcagcctttttgagccagaaattggactttttaagaatacctatagatgatctatgataggttcacactaattagtcatatgaaacttagtcagaaatcagctgtggtttttgtttttttctgaatggaggtaagtctccttctagtgggctaaatgcttgtttcattttctcttttacttctgggtgtcacagtgcctggaaagctgagtttttcataaga

SEQ ID NO: 56193 - DNA, 601 bp, Human
ataataacaacatctatgtttttctaaaccataaaatcttctcagtattctttgctctctgtttcagggtcataaaggatttcatgattcagggtggagattttgttaatgtaagtactattcctttcctatcaaagacccgtagttttagtttttgttgttattgttgcaattgctgtttttactacagagacccagtcttcaggcttgagaacaatagccaggtttgatgtgggtgttggagagaatggtgatggggaagttcttgaaagtggctgggtacgactgactgtagataacmgactttagcactttgattgaggcattaaattccatggtccaaatctcagcctttttgagccagaaattggactttttaagaatacctatagatgatctatgataggttcacactaattagtcatatgaaacttagtcagaaatcagctgtggtttttgtttttttctgaatggaggtaagtctccttctagtgggctaaatgcttgtttcattttctcttttacttctgggtgtcacagtgcctggaaagctgagtttttcataagaagttgatttgtgggcaaggaatcagagcaagag

SEQ ID NO: 56194 - DNA, 601 bp, Human
tttctttcttaaacctgcttttgtccttaccccccacttctgaatggtctttctttactcttattaatatcatttggttagttgtgttgctgttttcttggatctgggagacatgtgttctcttttatgtgtttatttagtctgaatctcatgagtttttaagacctctttcctttcctatgcaatacagggttgcagagtggcaggttttaggccgaattacgtttttacctatgttttgattcatctgcatggtgttgtataactgtgaaatggcacaaaaaaatcctagtttttttttctctttaaaaaatggaaagtggaagtatgctgggcctgcatttctcacagtggcagtgacagtgacaattggttggaatcaaggaactggtccctttggacatggcatatctttgccatttcaccagtctccacaactgtttcccttatttacgttgcctgctcctgtgggcatttgtttgcagccccgggaaacagataatggtagtagggtttgttagctggtaagaagggctgagaagctatcctctgccttctttccttttttttcccctaggcttccctgttgccttacaaggag

SEQ ID NO: 56195 - DNA, 601 bp, Human
ctctggggttagacaatagttgctcagtctgaaggccgagttaaaagcaattgctggtagggctcacatctgtaatcccagtaccttgggatgctgggaggattgcttgatcccaggagtttgagaacagcttggcaacatagtaagaccctgtctctacaaaaataagaaaagttattttttatttttttatttttggtggtgtgcgcctgtagtcccaggtacttggtaggctgaggtaggaggatcccttgagcccaggaggtcaattcaaggctgcagtgagccatgttcataccaytgcactccagcctgggcgacagagcaagaccttgtctaaagggaaaaaaaaaaagcttgcttagaaccttccttggggaaggcaaaatggaatgagcaagagtcagaaaaatcagaatttgagaccttccaaagtttgaccaagaatatttgtttgttcatttatttttggttttaatagtatttattattttggttgcaaaagaaaagtgcaaagaagaaaataaatcaccaaatgaattaccctcattctcacctcacaatatactattggcattttggtttacagttgtcagtctta

SEQ ID NO: 56196 - DNA, 601 bp, Human
ggggtctcaccatgttggccaggctggtctcaaactcctgacttcaggtgatccacccgcctcagcctcccaaagtgatgggattacaggtgtgagccaccacaccaggccaggtctttctaatatacagacttgattttattttataatatttaggcaaacaaaggtttgaatttggacagtttttctttattctctggcttatattaatggtagttcttttccaaaaagggacccttgattcctcactgggtcagtgttttccctttctcccatgtactctttctctttactaactggygaggagagcttgatctttttggcactcctcaatattgcctttaaaactcagggattctatttaaggcactgcaaatatggccttggtcaaattgttttattacccagacttcagtttcctcacatgaaaaatggggaagatgataatgcttattcctcaaggttgctggaagagcaaggagataatgcaaataaagctagtttaagcagaaattgggagtttataataaagggagtgtttcatggaactaaaggaagaaatagaactaggaactagaaccatagagaaccaaggcagttc

SEQ ID NO: 56197 - DNA, 601 bp, Human
cttgatctttttggcactcctcaatattgcctttaaaactcagggattctatttaaggcactgcaaatatggccttggtcaaattgttttattacccagacttcagtttcctcacatgaaaaatggggaagatgataatgcttattcctcaaggttgctggaagagcaaggagataatgcaaataaagctagtttaagcagaaattgggagtttataataaagggagtgtttcatggaactaaaggaagaaatagaactaggaactagaaccatagagaaccaaggcagttctttatctcygtttctctagtgctcgctacacatctgtgttgtgttctctctctgttctctagcccagcttgcaaatggtagtcacatccagctttcaggtttacatgttacaaatttagcctcaaagagagcatctatcccacctccagattcccagagaaggaactctagttggcccagagtgagttaggcatccttccctagatcaatcaactatgaccaggagggtggtatcatgttgtacatacagactgccaagagctcacccaccctcttagatagtttaggggaatggggtggtagtcactt

SEQ ID NO: 56198 - DNA, 601 bp, Human
aaggttgctggaagagcaaggagataatgcaaataaagctagtttaagcagaaattgggagtttataataaagggagtgtttcatggaactaaaggaagaaatagaactaggaactagaaccatagagaaccaaggcagttctttatctccgtttctctagtgctcgctacacatctgtgttgtgttctctctctgttctctagcccagcttgcaaatggtagtcacatccagctttcaggtttacatgttacaaatttagcctcaaagagagcatctatcccacctccagattcccagaraaggaactctagttggcccagagtgagttaggcatccttccctagatcaatcaactatgaccaggagggtggtatcatgttgtacatacagactgccaagagctcacccaccctcttagatagtttaggggaatggggtggtagtcacttaagtgggtacttttatgtgactgaaggcatgagagtcttcaggaatggcaaggattgagtatgtgatcaccttgttgctgttccctactttgtctgcatcttaattgatcgttctagaggcccagctgtgacctcttttatccagtctat

SEQ ID NO: 56199 - DNA, 601 bp, Human
accgcatcttaatttcctaaagttagtatgagggtttaatgagaaaatagctaagaatgggctttggaagctggaaaatgctatgtaaacaagaataaagtccagctcatgctcttcctacaggaaaaatcatcgatggacttctagtgatgagaaagattgaggtaagtactgctttgatttttctgtttctctgccattgtggtctggtactgtctgactagcgtgcaggagctagagaagggggaatgagctccagtttgttaggctgtcttcattgccccaggaaaagggaagagaaccacctaagttagcctgtctggccaacactgaggtttggcctctgatgatcctgttgcctacttgataaaattctactcctcagcattgcgttcaaggtccttcatgattagtccctgtctacctctccatggccccttcttctgccattgcctcttccatgttccagtcacatcaggctactagctcttctctaaatctgccatgcatgtccctgctgcttgctctttcctgcccctgagcctttgctcacacagtttcctctagccggaatgctcttctttccttccctcctgatgga

SEQ ID NO: 56200 - DNA, 601 bp, Human
gactagcgtgcaggagctagagaagggggaatgagctccagtttgttaggctgtcttcattgccccaggaaaagggaagagaaccacctaagttagcctgtctggccaacactgaggtttggcctctgatgatcctgttgcctacttgataaaattctactcctcagcattgcgttcaaggtccttcatgattagtccctgtctacctctccatggccccttcttctgccattgcctcttccatgttccagtcacatcaggctactagctcttctctaaatctgccatgcatgtccctgcygcttgctctttcctgcccctgagcctttgctcacacagtttcctctagccggaatgctcttctttccttccctcctgatggaatcccattcatccttctaggcacagttcaaatacccctcttttgtgaatccttccctgacctctttaagccccaatttagttgcctatctaacccttatccaattctctcttataactttttcttatataatcataagtttgatattttctaagtgttttgcattttctctttgataggtattatatgctttacctgtctgccaggacatggactgtt

SEQ ID NO: 56201 - DNA, 601 bp, Human
tccacaactaagcgctgatgaattaagatagttcccatgctgcatatgaggctacagatttgaaaagtcagttccatccttcaaggaactcagtctcttgggagaactgacaattacagtacaataaagccctgtattggaggttttagaacaaggtgaggaaagcataaatgcccggatcttcccagagtggttgagtagactacagaagagatgatgcttcagtttagtacaagaaagaatataacttgtcaggtggctaaaactgggcagggcattccaggcagagggaacagcctaygcaaagtcacaaaggcaggaaacagcaggaagtgtagaggaagctgcaaataattcaatatgactgaagcaggaagatatgaaaagcaaatggtgagaaggttggagagaggccagggccagtagtgaaagccagtgccaagtttagcagttcatatgttattctgagggcagaggctgactttcaggcatgaagtaatttttcccttttggggaaggagtccactgtgctcctgagattctcaaaaggggcactgaccctccaaaaaagaatcaggccaatatgaaccacttaaggatt

SEQ ID NO: 56202 - DNA, 601 bp, Human
ttattttgaatgactttcaggaatctctgcagtgatatatagcagactgtggataatacttctgcagagtagagatagcaaagagacttttcagttgccttatttaagcttgaattttctaccttgaacatgtatcttgtaatagaaatacatactgtttatatgtagtgttaactaatcctaaatcctcccagcacttcccaggagcctgcccacagctgtggctaacatcaggtgtgaatccattgctgatccctccacctcctcttccaggtctaagcccagacagtgggtgctcccmcagcacttggttcatctctccactgtggcatttaatatactgtatcacaaatatgtaagtctgtttttctctggactgagaacttgttgaagcaaggatcatgctgactaacatagtgcctggtatgacagagcttaggtcctggcacaccatgcagcttacaaagtacatttatacattttcatacactttgcttgagggcccacagttaaacttcagtctgtgcctgcagtacgatgccagtacccattgtccactggagcaaggtgtggcatgtttgaggaatggcaagaggagggg

SEQ ID NO: 56203 - DNA, 601 bp, Human; identical to SEQ ID NO: 35381

SEQ ID NO: 56204 - DNA, 601 bp, Human; identical to SEQ ID NO: 35380

SEQ ID NO: 56205 - DNA, 601 bp, Human; identical to SEQ ID NO: 35379

SEQ ID NO: 56206 - DNA, 601 bp, Human; identical to SEQ ID NO: 35378

SEQ ID NO: 56207 - DNA, 601 bp, Human; identical to SEQ ID NO: 35377

SEQ ID NO: 56208 - DNA, 601 bp, Human
aaggaaattcaaggccaagtatagtatttcatgataagtgagaataaaggcactcaatccctggagccggcgattcctgttcctgtctctagactggactcggtaaaagcccgaggcgaaacctcccgtttatctcctacaggaccccagcaccttaggggatggctccacagagccccaccgggaccccccatcgcggggaccagaggggcggaggagggagacactctccaaaacaaagcgccgctcgccccacgcggaggcaggcgcacctttcgccctgacaggacgcagacacacrtgtgtcacctgtgcgggaagggggagcagcgacatcctcggaggtgcgtgccacgggcagcggtcggcggctgcgctggccccgatgcctggtgcccgccgctcattcccgggctggggaaaactttcggccgcctcccccaaggcgcgcccccacctcccgggacccccggggcacgcgccccgaccgcgacgccccgccccaggcccgcccctccgcgcccacggctgcggccccgcgcccccagccccgcgcgggcacccgcgtgccctcaggcgcgcccccgcgccgggcccggcc

SEQ ID NO: 56209 - DNA, 601 bp, Human
attcaaccaacatttcctaagggcccactatatgccaagcaacccgcttagcacttttccaacagtgtctcattcaattctcacattttatagattaaagatgtgaatctgaaagggtgaagtgacttgccgatgtctacatattaagctgcagagacgggatttagaatcatgtcttccaactccatgtcctttcatgggacgttttttgctttttcattcatcctatggaatacaataaagtgttctgcacaaatgagccaccaccaactgccagcctgatataactagatgcttatcyacattctgagacgggaccatatcagatcaaattactctggtgcctattatagatcatgtgctgaaagaagtgcagttggctgaagatgagcaactctttcaagttatattttaacagtgtttttgaccactatatccggtcagttgttccagtgttcagtaataaatcaaaatgattgttcgtttcctttgacagttaacagtactaatgaattcagtataatctcaccatccatcagaaaaatttctaaaatgcgaacttgaagctgatgattcacacagttagaagagagggggaaat

SEQ ID NO: 56210 - DNA, 601 bp, Human
gctaaacactaaatgagtgatttgtttcccaaattacactggattaattcacacacttcaagataagatactattatggaatgatttttatatatacattcaaccaacatttcctaagggcccactatatgccaagcaacccgcttagcacttttccaacagtgtctcattcaattctcacattttatagattaaagatgtgaatctgaaagggtgaagtgacttgccgatgtctacatattaagctgcagagacgggatttagaatcatgtcttccaactccatgtcctttcatgggacrttttttgctttttcattcatcctatggaatacaataaagtgttctgcacaaatgagccaccaccaactgccagcctgatataactagatgcttatctacattctgagacgggaccatatcagatcaaattactctggtgcctattatagatcatgtgctgaaagaagtgcagttggctgaagatgagcaactctttcaagttatattttaacagtgtttttgaccactatatccggtcagttgttccagtgttcagtaataaatcaaaatgattgttcgtttcctttgacagttaacagt

SEQ ID NO: 56211 - DNA, 601 bp, Human
ctgatgcatgctacaaatggattaattttgccgggcaggttggctcacacccgtaatctcagtactttgggaggcccaggtgggatgatctcttgagcccaggagttggagaccagtgtgagcataatgagatcctgtctctacaaaaaaataataaattagccaggtgtggtggtgcatgcccgtagtcccagagttactcaggaggctgaggcaggaggatctcttgagcctaggagtttgaaattatagtgagccatgatcgcaccactgcactccagcctggatagattccgtctcyaaaaaaacaaaacaacaacaaaagacatggcatggtaggttccacctcgctgtctctcagatcacttgtttttggggaaaccagctgcctgtcatgagaatgctcaagccacgctatggagaggcccacatggcaaggaacctgccaacatgtgagtaagccatctcggaaggggaatcactagacccagacaagtcttcaggtgactgcagtcctggccaacaccttgacttcaacttcatgagggtctctgagttagaatcaagaagcttcctgtgttaattcacttaggattaaaaa

SEQ ID NO: 56212 - DNA, 601 bp, Human
aggtaaacccagactttgtttagctttgttttaacaagtgatccagcagttttactgctgttacatacccaagagaaataaacataggtccacacaaaaacttgtccacaaatgtgcaaagcagcattatttacaatagccaaaaggtggaaacaacccaaatttcaaacaagtggtgaatgcataaacaaaacttggtatatctatacaatggaacacaatttatcaacaacaacaacaaaatgaagtactgatgcatgctacaaatggattaattttgccgggcaggttggctcacacycgtaatctcagtactttgggaggcccaggtgggatgatctcttgagcccaggagttggagaccagtgtgagcataatgagatcctgtctctacaaaaaaataataaattagccaggtgtggtggtgcatgcccgtagtcccagagttactcaggaggctgaggcaggaggatctcttgagcctaggagtttgaaattatagtgagccatgatcgcaccactgcactccagcctggatagattccgtctccaaaaaaacaaaacaacaacaaaagacatggcatggtaggttccacctcgc

SEQ ID NO: 56213 - DNA, 601 bp, Human
ggatatttacatgcagaagaatgagtctgaatcactacctcacatgatatccagcaattaccttaaaatggatcaatgatctaaatgtaacagctaaagccataaactcttagaagaaaacagagacatcaatcttcataatcttgaattagtcaatgatttcttagacacaagaataaaatgaaaaagaaaaaaaaaaggtttcatcaacattaaagacttttagggccaggagcggtggctcacacctgtaatcccaacactttgggaggctgaggcaggtggatcccttgaggacagragttcaagatcagcctggccaacatggtgaaacctcgtctctattgaaaatacaaaaattagccaggcatggtggcactcgcctgtaatcctagctactcagggggctgaagcatgagaattgctggaacccaggaggcagaggttgcagtgaggcaagatcatgccactgcattccacctgggcaacacagcaagactctgtctcagaaaaaaaaaaaaaaaaaattaaagacttttaggccaggcacagtggctcacacctacaatcccaacactttgggaggccgaggagggagaat

SEQ ID NO: 56214 - DNA, 601 bp, Human
atctctatccatggctaacacaatcttataaatagaaaatcctaaggtgtccactaaactattagaaccaataaactagttcaccaaggttgcaggacacaaggtaaaaactgtacctctatactcttggaatgaacaatccaaaaataaaagtaagaaactagttccttttactatagcatcaaaaaataaataaataataaaatacttagaaataaatttaacaaaagtgcaaatttatactccttaaacggaaaaacgttgttgaaagtaattgaagacaacctaaataaatggaaasacatctcatgttcatagatcagacgacttaacattgctaagatggcaacactgccaaagtttaactaaaaattcaatgagatccctatcagaatgccactgagttggcttctttgcagacactaacaagctgatcctagaatccatatggaaatacaaggaatccagaataaccaaaacaatgttgaagaataagactcacacttctcaatttcaaaacttactaaaaaactgtagtagtcaagacagcatggtactgctataaggagagacatatagatcactggaagagaactgagag

SEQ ID NO: 56215 - DNA, 601 bp, Human
accaaaatgtcattatgcagctcatgaatatatacatttacatatgtatagtataaaaaggagagctgcactgtactcatacataactacaactgtcactgaaatctttcaaagtttcttactgggctgcctataatctcagcactttgggaggctgaggcaggaggattgcttgaggccagaagttcaaggccagcctgggcaacatagcaagaccctatctctacaaaaaataaaaagaaaattagccaggcatggtggtatgtgcctacagtcctagctacttgggaggctgaggcasaaggttcacttgagcccaagagtttgaagctgcggtgaactattatcaccactgtattccagcctgggcaacagaggaagaccttatcttcaaaaataacaaaaacaaaaacaaaaacaaagcatcttattggcttgttttttgtttgtttgtttgtttttggcacagtctgactctgtccctcaggctggagtgcagtggcacaatctcggctcactgcaacttccgcctcccaggttcaagcaattctcttgcctaagcctcccaagtagctgggattataggcatctgccaccatgg

SEQ ID NO: 56216 - DNA, 601 bp, Human
atcaaaccacttgtgtctccaggaagctgaggcttcagaatatttccttgctttggagcagaggttaatgttgggtctgatacagtattagacttaacatctgaggcttttccccgctacagactacaaatacaaactatacctgaatcccccttgacagaagggataagatgtcaccttctttgacccattagatcattttcttaatctctaaaattcatggtagaaagttaagaagggattttcttttaaggtctaggcactagggaaccaaattagagtactgttaataatctattcrtattttaaccatcccaatgtatcctataaacaaaagatagagcacaagttcttcctactcttctcaaagtgaggaaaatgtgaaaaaaagagacaagtcggccgggcgcggtggctcacgcctgtaatcccaccactttgggaggctgaggtgggtggatcacaaggtcaggagatcgagaccatcctggctaacacggtgaaaccccatctctactaaaaaatacaaaaaattagctaggcatggtggcgggcgcctgtagtcccagctactcgggaggctgaggcaggagaatggcgt

SEQ ID NO: 56217 - DNA, 601 bp, Human
taaagtcaaatatcttcccatattttccctactacttatgtttatatataaatgtacttatttaattatatgtttacctaatccttgccttggtccagaaaagatgtaaggcaaattaccagcattaattaaaccataagaaaataagaagaaagaacaagggcacaaaacactgccaggataagactcaatatgcatgccaaaccatacttctaagtggtgtaggcctgagatttgacactttctaaccaccaacttggtaagaggtctgctcagccacccacttcagagcactcctatsaaaaacagaacagctggtcaaaagcagcacagctagccttggtgctaagatcagaaaggaatgtctccctgcagattcattagagaagacaccattctacttctacaaagaatgacacgtgttaccattttctggcaaaacagttgtttaaataactgactgcttcacattctgttatcacccttagtcacccatatcttggggcaaaattatctcctggttaatccaatcttagtaagttgtattagtttcctgtaactgcggtagaaaattaacataaacctcacggcttactaacac

SEQ ID NO: 56218 - DNA, 601 bp, Human
ttatcattacgtattttctaaaattaaaagtgcttctaattaatcagagaccttactacttctctttttcaaagaaatataaaaatagcatgaacaccatatgacaaagattttatttaagaagcaaaacaggcccggcatggtggcttacgcctgtaatcgcagcacttctctgggaggccgaggcaggtggatcacttgagctcaggaggtcattgaggctgtagtgagctgtgatcacgtcactgcactacagcctgggcaacagaacaagaccctgtctccaaaaaaaaaaaaaaaagaagaagaagcaaaacactggacataaagtcaaatatcttcccatattttccctactacttatgtttatatataaatgtacttatttaattatatgtttacctaatccttgccttggtccagaaaagatgtaaggcaaattaccagcattaattaaaccataagaaaataagaagaaagaacaagggcacaaaacactgccaggataagactcaatatgcatgccaaaccatacttctaagtggtgtaggcctgagatttgacactttctaaccaccaacttggtaagaggtctgctcag

SEQ ID NO: 56219 - DNA, 601 bp, Human
gtatgattctccacccttttacctctagcattcttttaagtatgcccccattttattgtttatcattacgtattttctaaaattaaaagtgcttctaattaatcagagaccttactacttctctttttcaaagaaatataaaaatagcatgaacaccatatgacaaagattttatttaagaagcaaaacaggcccggcatggtggcttacgcctgtaatcgcagcacttctctgggaggccgaggcaggtggatcacttgagctcaggaggtcattgaggctgtagtgagctgtgatcacrtcactgcactacagcctgggcaacagaacaagaccctgtctccaaaaaaaaaaaaaaaagaagaagaagcaaaacactggacataaagtcaaatatcttcccatattttccctactacttatgtttatatataaatgtacttatttaattatatgtttacctaatccttgccttggtccagaaaagatgtaaggcaaattaccagcattaattaaaccataagaaaataagaagaaagaacaagggcacaaaacactgccaggataagactcaatatgcatgccaaaccatacttctaag

SEQ ID NO: 56220 - DNA, 601 bp, Human
atctctatacccactctcctcacagaaataggagtcatcttgttacaaagcaaaactaatctcatcattcttcaactggaaatctttcaatggcttcacatgacactcaatgtctaaactctagaaacccctgcatgaaatggccctggctcccttctcagccccatttcctgtgactctcctgcttgaatgtcacactcaagccagacaccttccttccagtaactccagtgtgccaagccatttcccattgtgttggaagaccatctgtgttgcttcctttgatagaaaggctttgtcyccccgctcttcaccccacaacaaccagggcctcagcttcaacacgactgcttcccagaagcttgccatcatcccttttgggttctctcacagaactgtgtatttcttaactgagttcatcataatcgcaatcatagggttagttatttagtgattatgtatttaaggtctctctcttaggtattatacaataagcgtggcagccaggtctaatatgctccctactaaaacccagcatctagtgcagtgccagacacacggtaggaattcaataaacccttatgggtgaataaaactggct

SEQ ID NO: 56221 - DNA, 601 bp, Human
aatctctatacccactctcctcacagaaataggagtcatcttgttacaaagcaaaactaatctcatcattcttcaactggaaatctttcaatggcttcacatgacactcaatgtctaaactctagaaacccctgcatgaaatggccctggctcccttctcagccccatttcctgtgactctcctgcttgaatgtcacactcaagccagacaccttccttccagtaactccagtgtgccaagccatttcccattgtgttggaagaccatctgtgttgcttcctttgatagaaaggctttgtycccccgctcttcaccccacaacaaccagggcctcagcttcaacacgactgcttcccagaagcttgccatcatcccttttgggttctctcacagaactgtgtatttcttaactgagttcatcataatcgcaatcatagggttagttatttagtgattatgtatttaaggtctctctcttaggtattatacaataagcgtggcagccaggtctaatatgctccctactaaaacccagcatctagtgcagtgccagacacacggtaggaattcaataaacccttatgggtgaataaaactggc

SEQ ID NO: 56222 - DNA, 601 bp, Human
gcaattctcccactcagcctcctgagtaactgggattacaggcacctgccatcatgcctggctaatttttgtatttttagtagagatggggtttcgccgtgttggccaggctggtctcgaatctctgacctcaggtgatctgcctgccttggcctcccaaagtgctgggattgcaggcatgagccaccgcgcctggcctttgctgattcttatttcctaagtgaatctcaaacacattcacaattgttaatctcaattgttacctattctaaacctttatattccatttgaatttccacartagtttcctacctggtttcccttcatataatctctatacccactctcctcacagaaataggagtcatcttgttacaaagcaaaactaatctcatcattcttcaactggaaatctttcaatggcttcacatgacactcaatgtctaaactctagaaacccctgcatgaaatggccctggctcccttctcagccccatttcctgtgactctcctgcttgaatgtcacactcaagccagacaccttccttccagtaactccagtgtgccaagccatttcccattgtgttggaagaccatctgt

SEQ ID NO: 56223 - DNA, 601 bp, Human
atggatgctattacaagccactacatttgtggtaatttgttatgcagcaatagaaaataattacatcatttcaataaacagcatcttcaaacacacatttgttccagccacaaaaccccatgtcaatacaataccaagttctgctgattcttttttttttttttttttgagatggagtcttgctcagtcacccaggctggagtgcaatcaacggcgtgatcttggctcactgcaacctctgtgtcccaggttcaagcaattctcccactcagcctcctgagtaactgggattacaggcacytgccatcatgcctggctaatttttgtatttttagtagagatggggtttcgccgtgttggccaggctggtctcgaatctctgacctcaggtgatctgcctgccttggcctcccaaagtgctgggattgcaggcatgagccaccgcgcctggcctttgctgattcttatttcctaagtgaatctcaaacacattcacaattgttaatctcaattgttacctattctaaacctttatattccatttgaatttccacaatagtttcctacctggtttcccttcatataatctctatacccactc

SEQ ID NO: 56224 - DNA, 601 bp, Human
gctgggcatggtggtgggcacttgtaatcccagctacttgggaggctcaggcaggagaatcgcttgaacccaggaggtggaggctgcagtgagtcgagatcgcgccattgcactctggcctgggcaacaagagtaaaacgaaagagagaaagagatgggggagagagggggagagagagagggagagagagagagaaagagagagaaagagagagagagaaagagagagagaaagatagacaaagaaagaaagaaagaaagaaagaaagaaagaaagaaagaaagaaagaaagaaagaaaaaaaattacccaagtaggcctaacctaattacatgagtccctttaaatctgtacctagaggtcagacagaagggggtttagaagtcagaaagttaaagtatggaaaggatttgacacacttttactggattaaagattgaagacccaggctgggtgcggtggctcacgcctgtaattccagcacttttggaggccgaggcgggtgaatcacgaggtcagcagttcgaaccagcctggccaacatggtgaaaccccgtctgtactaaaactataaaaattagccaggtgtggtggcaggcac

SEQ ID NO: 56225 - DNA, 601 bp, Human
ttaatctgcaacccagacctcttttacaagctcctgacccatatcctactgatcccactaagcacagtgctttagatgggccttgtggccaaactgcttcagtttcacaaccgattcttctacttacttcttgagtaaccctgaacaagccggtgagcacactaagactcagttttcctatacgtagattggaagaagaataataataattctcacttcactgggttgctgtttaggttaaatgagttgatgaaagcacctactatctagcacattatctatgattacttataccatagawgtccatcagaatatgtcaaaggcatctcaaacttactttgataggtacaaaactggatcctatcttttctgcccaccccgatacgcatttcccctggttcactatcttctgtgacttctaaggaggaattcttagatgaccccaatgaccctagcctttgtataatctcctccccttgagtgagtgaatatcacgaaatcacacacttgtgataaagggattttgcagatgtaattatggtcctaaatcaactgaccttacgataagaaaattatccaagtaggcaggacgcagtggctc

SEQ ID NO: 56226 - DNA, 601 bp, Human
gttagattcaaactgagacatttccaccagattaggaacagggagacattagtaactttagtgaaagcagtttcagtggagtgcttgagatggaagcctgatcttccagcagatccagtgaatggggcataaagaagtagaaacagctggtatcaactgctcttgcaaaaactagtggaaggagggataatagaaataactagagggcgacagagaattttttttttcttttttctttttacaaaaagactcaaatgtgtttgtgggaaggagaacctgaggatcaggaaaaggggagaamaacatggagtaaagtctctgaggaagcagaagatttcaaaaacaggtgcaaagcacaatctgactcaatcatccttatttaataggcttggattcgctttcaatatgccaactaggaaatatgtatttagtctctcatttactgggacaacaactttttttcatttcccttgtcttttttactcaacatcacaaaacataagcttcttagactaatttagcttcagtcaaaaggtgacaattgtatgcagagagaaaaaaatctttttctgctatttgagattatttttttctttttgtc

SEQ ID NO: 56227 - DNA, 601 bp, Human
cacaagcagagatagcagctaatgtaaggagatgaggcagtcaccgattgagaagaaccaggtagaagagcacagtttgtcactgggcaaggggaggaaagtaccaatatccaagcactgagtgctctacagaaattaggttagattcaaactgagacatttccaccagattaggaacagggagacattagtaactttagtgaaagcagtttcagtggagtgcttgagatggaagcctgatcttccagcagatccagtgaatggggcataaagaagtagaaacagctggtatcaactgctyttgcaaaaactagtggaaggagggataatagaaataactagagggcgacagagaattttttttttcttttttctttttacaaaaagactcaaatgtgtttgtgggaaggagaacctgaggatcaggaaaaggggagaacaacatggagtaaagtctctgaggaagcagaagatttcaaaaacaggtgcaaagcacaatctgactcaatcatccttatttaataggcttggattcgctttcaatatgccaactaggaaatatgtatttagtctctcatttactgggacaacaacttttttt

SEQ ID NO: 56228 - DNA, 601 bp, Human
aactaagccttggaggagtcaaaagcctgggacggaaagtaaacaatgtgcagcaatatgtgcttaaaaccaggtgccatcaccttgaagtgagctgaagcccaaacagaactgtttgtcacagcccacagccacagcttgactccagagtaaggcagatagaaggatgaggttgcgcaccacaggtgtcaaatacagtacccatcacataggtgtgctgtgaaaattaagtaagataggcaaaatcttggaagaggcctgacacataaagctaaataaatgatagctattatcattagaktagacactgaacttagactatggtaatggcaatgatgagcaagaaacaaataaaggaggtattaatatttcagagttataactgacacaactaggagagtaagttggtgggtggggagaatgtgagagagaggaagaagtctggatgtttctaactagagtcctggcagaatagtgaatggcatgccactaaataaaacatggggccaggtgaggtggctcacgcctgtaatcccaacactttgggaggctgaggcgggcagatcacttgaggtcgagagtttgagaccagcctagaacc

SEQ ID NO: 56229 - DNA, 601 bp, Human
atcaatacaaataagcatttattttcagctctcatactccattagttgaaggttgccccagtgggacatcaaggtccttatgtttctgagatgcacatttatgcttcctgagccagttcccaccagagaactaagccttggaggagtcaaaagcctgggacggaaagtaaacaatgtgcagcaatatgtgcttaaaaccaggtgccatcaccttgaagtgagctgaagcccaaacagaactgtttgtcacagcccacagccacagcttgactccagagtaaggcagatagaaggatgaggytgcgcaccacaggtgtcaaatacagtacccatcacataggtgtgctgtgaaaattaagtaagataggcaaaatcttggaagaggcctgacacataaagctaaataaatgatagctattatcattagattagacactgaacttagactatggtaatggcaatgatgagcaagaaacaaataaaggaggtattaatatttcagagttataactgacacaactaggagagtaagttggtgggtggggagaatgtgagagagaggaagaagtctggatgtttctaactagagtcctggcagaat

SEQ ID NO: 56230 - DNA, 601 bp, Human
atcccaaagacaatctggaacccatgaggacaaacaagagtccatgtctgtctctcaccaccttcaggcttccaaactcaatgattcagataacctgcagaaaagctgtacacactggcccagaattgccagaagctgatggcagtgatgcaacaagagctgaaggagccgcagacctggctactgctccaaaccaacaatatgacacagcagcttagcaatcatgtgtgggagttacaacagtgcctagtaccagcaccaatctttagccataaaatatatccagctgctgctgcttcayttctgtcttccaaatctcactcaaaatgtctcatggccagtgctaatctagagcctagaagggagttctgggaaacataattccagtttagcccagttgacacagtacaaacccaccacagaaggtatacagctctttcacccttatgattaaatcttcagcctgatttttggcataatctgtcctatagtcacaagcaatggggatctttccaaatgctgccataggccctcttttcacagtgtaccctgcattgataactggctgatctcttgtcctcaagatttcaaaagctaaaag

SEQ ID NO: 56231 - DNA, 601 bp, Human
ttcatccttattattccgccagcccactccaggcaagacctgcaagatccacctccctaaatgttccttctgttcctactggtacatattagccaggtcctgggattacgtgcttgagtatttactcccagaataagaaaaacatccctgattaggctatgctgagattgtgtctagctattgttctggaggaaataggggtgagagatgggacagagcttaaggagaacaagtatcaccttgtaagaaatccatctctatgtgatctctgcctggtttccaaacaaggaaaagttattcwctctaacaaggtgttgatcctgcctatccagaggactcaggaaaattaaggagttcaagattctcaggtcatccacttagaagtctccttctgagatttcatcagggtcctactcttcccatgttagggtcagactttggccctgaacacctgtcaagggtgtatgagaggtaggaccactatgaattatacaataagagacttatataggagtttggcctcacacaggtgtgggagttggttaaagagtctgtataagactgcttccacatctggagttgtaaaggaaagagtaataca

SEQ ID NO: 56232 - DNA, 601 bp, Human
tcaagacaagacactgttgggataacatgagtcaaagcttgcatgagggagtttgaagatgacgtcaaatggtgcttaagagagagttaacagaatacagcttgaatcccctcctgcctttggtcactgagtcttcaaggagaaactactacctaatggggacaggaaagaacttatcttgaactcaagggatatagtggaatgttttttattgcttccatgcctgctgaataattctaaacaggcactggaagcaaccacagcccaacaacagcaaggcaagagaagatcccccagagaygaaggtctgaatcatacaagtcaactaacatcctagttggctgtcatctttcttgccccatgacctatcctagtcactgccccaaatctctgtggataaagacaccctgaatgccactgtggcccattatggtaattacatccaccctagccctaatggtatcaccatctggcctatgccattccaaaatcctatcattgctatggatactagggaacatagctccatggaagcatctcctatcaactccagcctgtgtcccctcaccagtgcattcttaattaccttggtgaatgaagt

SEQ ID NO: 56233 - DNA, 601 bp, Human
tgctctcagaattgtcaattgtctgtgcaaggacaaggaaaagaatttctctactggctcctgccccctctagttcagggttgcccaaggggagcattaacttcctagcacttccaggctgcacatgcctgtatgctctctcacctgtaccttctgctgggtggacagtggagacgccttggagcagaaaggaaaagatgcacagtgagcatgctcaagacaagacactgttgggataacatgagtcaaagcttgcatgagggagtttgaagatgacgtcaaatggtgcttaagagagagytaacagaatacagcttgaatcccctcctgcctttggtcactgagtcttcaaggagaaactactacctaatggggacaggaaagaacttatcttgaactcaagggatatagtggaatgttttttattgcttccatgcctgctgaataattctaaacaggcactggaagcaaccacagcccaacaacagcaaggcaagagaagatcccccagagatgaaggtctgaatcatacaagtcaactaacatcctagttggctgtcatctttcttgccccatgacctatcctagtcactgccccaaa

SEQ ID NO: 56234 - DNA, 601 bp, Human
aaggcaggtagacaaacagatccatgcacacaaataacaaatgtacttgtatgagcctgggttcttccccaaagcagcacatcagaaaaggacatttacatgcagataatttagctggaaggtgaagtaaaggaccaaggaacatgaaactggaaaggagcatatgccaataaaaagctacctttatcgaggtcactgctgtgggtaactggagctcaattttgccaggattccctaaggaaccattagagtgctctcagaattgtcaattgtctgtgcaaggacaaggaaaagaatttcyctactggctcctgccccctctagttcagggttgcccaaggggagcattaacttcctagcacttccaggctgcacatgcctgtatgctctctcacctgtaccttctgctgggtggacagtggagacgccttggagcagaaaggaaaagatgcacagtgagcatgctcaagacaagacactgttgggataacatgagtcaaagcttgcatgagggagtttgaagatgacgtcaaatggtgcttaagagagagttaacagaatacagcttgaatcccctcctgcctttggtcactgagtcttc

SEQ ID NO: 56235 - DNA, 601 bp, Human
agagtgaacggaatcaattaaaaaaaaactataatacctaactatgcactacagccaaaatgtggtgctgcatgaattccaaagaggcaggggcaacacatctagttggaacatcagagatagcttcatgcttgacggctatgggtcctgaagaactgagtgagttttaacaggaatatatagtccacatcaaagaaacaacataagcaaacatgcacgggaaagacagaacactttcaagaaaagcaagacttctgagttgccaaagaactgctacacagaattcatagaaaaaaaaaaagaaaaacatacaacagaaaaataggaaaaagacataagcacttcacaaaagaaatctaaacagccaataaacatatgaaaaatggtcaaccttggctgggcgaggtggctcacacctgtaatcccagtactttgggaggctgaggtgggcagatcgaggtcaggagatcgagaccaggagattgagaccatcctggctaatacggtgaaactccgtctctactaaaaatacaaaaacaattagctggacgtggtggtgggcatctgtagacccagctactcgggaggctgaggcaggaga

SEQ ID NO: 56236 - DNA, 601 bp, Human
gctaagtgaatgaaaagactggggtaatttaactccaggaaaaacaaccaaaaaaaacttatttaaggaaggaaaaaaaacataaaacacttggccccacaatgaatatttatatagccattaaaaactgaatgtggattcaaccaaaattataatataacttcattaagtagacaggcagggaaataaaacaggtctaaaattgatgactcaagagttttaaaatgccacttgaaattggtagaaaatattagaaaaaagtagaaactgggaataaaatccctcttgtactatttgactwagtatttatatggatcgttttaataaaaattttaaaattaaacaaagaatatttattgagtactctttgcgggcgacattataggcaggtccacttaaacaccgttctcaccattctcaactaccttctccccttgggaagctcaatatctgatttcatagcctcccttgcagaatgatgaccatgtgataccatgtgaccaaaaattcaacatacagaaaagtctagtaaagaggatttcaaaacctacattagaaactgttttcctcttctcccatattcttttgtgaatgtgaataa

SEQ ID NO: 56237 - DNA, 601 bp, Human
aagctgttaaaacatgtagaaacacttagagactcaaagaaagctaagtgaatgaaaagactggggtaatttaactccaggaaaaacaaccaaaaaaaacttatttaaggaaggaaaaaaaacataaaacacttggccccacaatgaatatttatatagccattaaaaactgaatgtggattcaaccaaaattataatataacttcattaagtagacaggcagggaaataaaacaggtctaaaattgatgactcaagagttttaaaatgccacttgaaattggtagaaaatattagaaaaragtagaaactgggaataaaatccctcttgtactatttgactaagtatttatatggatcgttttaataaaaattttaaaattaaacaaagaatatttattgagtactctttgcgggcgacattataggcaggtccacttaaacaccgttctcaccattctcaactaccttctccccttgggaagctcaatatctgatttcatagcctcccttgcagaatgatgaccatgtgataccatgtgaccaaaaattcaacatacagaaaagtctagtaaagaggatttcaaaacctacattagaaa

SEQ ID NO: 56238 - DNA, 601 bp, Human
attttataaagctgttaaaacatgtagaaacacttagagactcaaagaaagctaagtgaatgaaaagactggggtaatttaactccaggaaaaacaaccaaaaaaaacttatttaaggaaggaaaaaaaacataaaacacttggccccacaatgaatatttatatagccattaaaaactgaatgtggattcaaccaaaattataatataacttcattaagtagacaggcagggaaataaaacaggtctaaaattgatgactcaagagttttaaaatgccacttgaaattggtagaaaataytagaaaaaagtagaaactgggaataaaatccctcttgtactatttgactaagtatttatatggatcgttttaataaaaattttaaaattaaacaaagaatatttattgagtactctttgcgggcgacattataggcaggtccacttaaacaccgttctcaccattctcaactaccttctccccttgggaagctcaatatctgatttcatagcctcccttgcagaatgatgaccatgtgataccatgtgaccaaaaattcaacatacagaaaagtctagtaaagaggatttcaaaacctac

SEQ ID NO: 56239 - DNA, 601 bp, Human
agaacataatgaagacattttaatatctgaaaaagcttttccaaaaaaaaatctcctatgcaagctttctcagcaatctactggaggatgcgccacagatataatactaaaaaagaggacagccattggatccaggaaacaggattaagcacataattcccaggatgatagtgaaggaaaatcccattatgacagttacacaaagttgagaaagaaaccaatccagaatggaagagacggaacagagttccacaaaggactgtctttaagaaaaaaagaactcatgggttatctaacctayagaaaatcataatgaaaagtattttataaagctgttaaaacatgtagaaacacttagagactcaaagaaagctaagtgaatgaaaagactggggtaatttaactccaggaaaaacaaccaaaaaaaacttatttaaggaaggaaaaaaaacataaaacacttggccccacaatgaatatttatatagccattaaaaactgaatgtggattcaaccaaaattataatataacttcattaagtagacaggcagggaaataaaacaggtctaaaattgatgactcaagagttttaaaatgcca

SEQ ID NO: 56240 - DNA, 601 bp, Human
gaaactgttcatgtgagcaagctaaatcacccccagagaaccccaaaaggctccaaattatagaagcacctgtaatcaccaaaggcagaggactggggagggcaagataaagaatgcaaacaggggaaatgtctgaaacggatttaaggagttttattccccaagtcctcacactcgtaacacttaggattaataatttcctgggagaagaaccagatttggggtcactgggtatagagagaagcaaggatgaggtaagaacggaaaatgcagaataatatataagtctacacacgcgctrttggtttcagaaagcagagagccaggctaatgttccccaagaagtccagaggatccttttatggaaaaatgaacaaacttgggtaaaagttgttgatattgacatatggagctcccggtgaaaaactataccatgtaagcctccagccagcaagacagagtttctaaccagcattttggtgtcttattcacattaacagtcaaggatcaccagacaattgagagaaatccctaacatgcaagacaccaaaataaacagaaaaaaaaaaaaaaaaaaaaaaaaaaaaggaagttcagaaga

SEQ ID NO: 56241 - DNA, 601 bp, Human
atccttcctctttagcctcccaaatgttgggattacaggcatgagccaccatgcccaacatacgtacattttctttatctaatccaccaatgacgggcacccacactaattccatgtctttgctatcgtgaatagtactgtgatgaacatacaagtgcatgtgtctattgtgatattcatttaggcacatactcagtaatgggattgctagatcaaatggtagttctaagttttttcagctttccacagtggctgaactaatttacattctcatcaatagtgtgtaagtgttcccttttckgtacagcctcaccagcatctgttatttttttactttctaataaaagccattctgactggtgtgagatggcatctgtggttttgatttgcctttctctgatgattagcgatgttgagcattttttcatgtttgttggccacttgcatgtcttcctttgagaagcgtctgttcatgtgttttccgcactttttaatagggttatttgttgtttgcttgttgaattgtttaagtcctttatagattctggatattaggcctttgtcagatacatagttgcgaatattttctcccattgagtat

SEQ ID NO: 56242 - DNA, 601 bp, Human
gtaccaatgtttagctcccacttacaagtaagaacttcatataggtttagatgttaattctgttccggaattaaattctcttctagtataatggcatccaactgcatccatgttgctgcaaaggacatgattttgttattttttatagccgcatattccatggtgtatacgtaccacatttttattttgttctctgttgccctggattttttgttctcactctgttgcccaggttggagtgcagtggcatgatcacggctcactgcagcctccgtctcctgggctcaagcgatcctctcayctcagcttccctaggagctggggcaatggctgtataccaccatacctagctaattttttttttcccagtagagacgaggtctcacaacattgcttaggctagaatccaactcctgagctcaagcaatccttcctctttagcctcccaaatgttgggattacaggcatgagccaccatgcccaacatacgtacattttctttatctaatccaccaatgacgggcacccacactaattccatgtctttgctatcgtgaatagtactgtgatgaacatacaagtgcatgtgtctattgtgata

SEQ ID NO: 56243 - DNA, 601 bp, Human
agtgaccatagtatccaacaggtagtttttcagccttttccctcttctttctctctactgtctatcagtatctattgttcccacctttatgtccctgtgtaccaatgtttagctcccacttacaagtaagaacttcatataggtttagatgttaattctgttccggaattaaattctcttctagtataatggcatccaactgcatccatgttgctgcaaaggacatgattttgttattttttatagccgcatattccatggtgtatacgtaccacatttttattttgttctctgttgcccwggattttttgttctcactctgttgcccaggttggagtgcagtggcatgatcacggctcactgcagcctccgtctcctgggctcaagcgatcctctcacctcagcttccctaggagctggggcaatggctgtataccaccatacctagctaattttttttttcccagtagagacgaggtctcacaacattgcttaggctagaatccaactcctgagctcaagcaatccttcctctttagcctcccaaatgttgggattacaggcatgagccaccatgcccaacatacgtacattttcttta

SEQ ID NO: 56244 - DNA, 601 bp, Human
aattttctctttctcttcactggtcacatctccaaggtaccaaccccttttctatttatctgattcccctctaaatgcaaggcttctcagaggctgccccttctggttctgctcactttaacacccttttccttagccacaggtgtaaactaacaagtcccagaccagggttctgtattttggcacatattgctgacattttctctttctgagaatgatttctgtatgtgttttgtctaaagttttggggactctcgcctttttttcatagagccaattttttttttaaattttttttgaraccaagtctcgctctgtcacccaggctggagtgcagtggtgtgatctcagctcactgcaacctctgcctcctgggttgaagtgattctcctgcctcagcttcccaatagctgggactacagatgtgcatcaccatgccagtctaacttttttttttaggggggatggagtctcattcagtcgcccaggctggagtgcagtggtacgatctcggctcactgcaacctcagcccccagggttcaagcaattctcctgtctcagccccccgagtagctgggactacaggcgcctgccaccatg

SEQ ID NO: 56245 - DNA, 601 bp, Human
accacgttggccaggctggtcttgaacttctgacctcatgatccacccacctcggcctcccaaagtgctgggattaccggcatgagccaccgtgcccaacctcaaactttgttttatagccttaatcttgaaggcagttagttggatataactcttgctttgtactttctttccctaagtttctttaaaaaaaaaccaccaccacaaagttgctccagtgctgccttgctttgtatgtcacttttaagaagttggatgccaacctaactatccttccgtttataatttattttatcttttkgcctaaagccctgaggattttttaaaatattaaaatctaacaatatcactcaatattgaagtctaatagtattaataggatatatctcagagctgtttgttatgagaactgataattgtatcattatcaattttccccagtacctagtaagccatttcaatgtgtatactcaagtcttcttttattctcagaattacatttgctgaataatttttcttctttaaggactccagttctacatgttacattttctttgcctgttctccatttcagccactttttctctgacattttttcttt

SEQ ID NO: 56246 - DNA, 601 bp, Human
atttttagtagagatggggtttcaccacgttggccaggctggtcttgaacttctgacctcatgatccacccacctcggcctcccaaagtgctgggattaccggcatgagccaccgtgcccaacctcaaactttgttttatagccttaatcttgaaggcagttagttggatataactcttgctttgtactttctttccctaagtttctttaaaaaaaaaccaccaccacaaagttgctccagtgctgccttgctttgtatgtcacttttaagaagttggatgccaacctaactatccttccrtttataatttattttatctttttgcctaaagccctgaggattttttaaaatattaaaatctaacaatatcactcaatattgaagtctaatagtattaataggatatatctcagagctgtttgttatgagaactgataattgtatcattatcaattttccccagtacctagtaagccatttcaatgtgtatactcaagtcttcttttattctcagaattacatttgctgaataatttttcttctttaaggactccagttctacatgttacattttctttgcctgttctccatttcagccac

SEQ ID NO: 56247 - DNA, 601 bp, Human
ccaaatattataatggggatccaatggaatgtgaagtatatcaataatgtccatgtctctacctagtatgaaagcctggtctgctacccatcactaaaccacttatgaaacaacctgtctgctcacttctctgtgtctttccaataaatatcagagtggcagcaactagaggatggttggtggcagttaaagcagaaaaaaaaggttgagcatctaagaattcaggtcctacctcagtttcctaccacatttttagactggaaataaatgcctgaatttgaaaatgtttacatggtttgcrtggtttctgattctgtttctgtgtgttacatttcaaggaactagatgtttgctatgacttcaagtgaaattgaaattgaaactaaaatcgggaacaagtatgcacatgtacttatgctcttgcatacttatgtaattacaaatatatattcaatataatttaagatttgtgtactactgtccgggcgtggttgctcacacatgtaatcccagcactttgggaggccgaggcaggcagatcaccaggtcaggagttcgagaccagcttagccagcatggtgaaaccccatctctactaaaa

SEQ ID NO: 56248 - DNA, 601 bp, Human
ggtatgcgtgtttcataatattataaggaatgccttattcagttgacttgtaaccatttgcttttaatttcctcatgcaggaaactatttgaatgtgaaactgactttaaacttgtttactgattgaagtcatcccaaatgaaccaaaaagcatatagccaacttactcagaacaagaatatgatgtacaagaataatgatcaaattgaatggtgaaacccaaatattataatggggatccaatggaatgtgaagtatatcaataatgtccatgtctctacctagtatgaaagcctggtcygctacccatcactaaaccacttatgaaacaacctgtctgctcacttctctgtgtctttccaataaatatcagagtggcagcaactagaggatggttggtggcagttaaagcagaaaaaaaaggttgagcatctaagaattcaggtcctacctcagtttcctaccacatttttagactggaaataaatgcctgaatttgaaaatgtttacatggtttgcatggtttctgattctgtttctgtgtgttacatttcaaggaactagatgtttgctatgacttcaagtgaaattgaaattgaaa

SEQ ID NO: 56249 - DNA, 601 bp, Human
gaattcaaccaattatagatttaaaatattcaaaaaaagtgatgaaacataatgatacaacaataagaaataatacagtataacaataatttacatacaatttacattgtattaggtatttaaagtaatgtagagatgatttaaggtatgtaggaggatgtatagattatatgcaaatactatgccaatttatataagggacttgagcatccacagattttggtatctataggggatcctgaaaccaatctcctatggatgctaaggaatgactgtgtgtgtgtgtgtgtgtgtgtgtgtttttatatgtgtatgtgtatgtatatatcctattgtgtgtgtgtgtgtgtgtgtgtgtgtgtgtgtgtgtgtgtgtttatatgtgtatgtgtatgtatatatcctattggtcctggtctctggagaagcctaatacattattacagcactttttccttgagtataaaatccagtatataatcagatattgcctttattttgtcatgtctctttggtctcatttcatctggaagtttctcaatttctgtcttttaggactgactttgttgaggaatattgttttttatttaaatataatttt

SEQ ID NO: 56250 - DNA, 601 bp, Human
tgtcctctcctgagcaagaaagaattcttcagcacagtcttcagactttatatgcaacactagctcttcctgattctacagtagaaggtctccagactcaaatgggaccactaactttcctgggtctccaccctgcctggccaccatgcagagtttggacctgccagtctccataatcacaggagccaattccttataataaatctttttatatttatacacacacacatagtcctttacttacaatgattctatttacagttttttttacttcataacactgcaaaagtaatacacatayagtagaaacggtacttctctcacaatgcttggcagtagcggtaagccatagctcccactcagccagacattttcatcttaggatattttcaacttataatggtgttatcggaacataacctcattgtaagtcaagtagcatctgtacatacagtcatgcatcacttaacaatggagatattgtctgagaaatgcatcattaagcaactctgtcattgtatgaacaccatagaatgtgcttactcaaacctagatggtacagcctactatacacctaggctagatgatctagcctattgct

SEQ ID NO: 56251 - DNA, 601 bp, Human
ctgtatactctgctggcttagaagtcttagttccaagggcaagatgtttccaccaggagacacaacaatgattccactgaactggaagttaagactgccacatggccactttgggctccttatgcctttgtatcaccaggcaaaggagggagttacagtgttggctcaggtgactgatcctgaactgctactccacaataaaggtaaggaagagtatgcttaaaatacaggcaatctcctttggatgtctcttggtattaccatgccttgtgattaaagtcaacagaaaactacaacaacscaattcaggcagcaatactaatggcccagaaccttcaggaataaaggtttgggtcacctcccaggtaaaaaaccacaaacatctcaggtgctggctgaaggcaaaggcatacagaatgagtaatggaaggagatagttataaataccagctaggacacagaaatggggactatggttgtcatgaatatttccttattttgtttaaaaaatatttgtgtctatatattaatatatgtactaatcaagtctttgttctctactgtgatggttaatagcaggtgtcaacttgattggattgaa

SEQ ID NO: 56252 - DNA, 601 bp, Human
gttttgttcttgctgtaacagacacttactctggatacagatttgccttccctgcacacaatatttctgtcacaactaccatccatggtattacaaaaagccttattcactgtaatgatattccacacagcattgcctgtgatcaaggagctaacttcacagcaaatgaagtgtgacagtaggcccacactcatggaattcactggtcttaccatgttctccaccatcctgaagcaggtggcttgatggaatggcctctggaagactcaggtacagcaccagatggatgccaattccttgmagggctggggcaaggttctccaagaagctgtacatgctctgaatcagcatccagtaaatagtgccacttctcccatagccagagttaatggattcaggaatcaaggggtggaaatttgagtggcaccactcactattaaccctagtagcccactagcaaaatgtatgcttcctgttcccacaactgtatactctgctggcttagaagtcttagttccaagggcaagatgtttccaccaggagacacaacaatgattccactgaactggaagttaagactgccacatggccactttgggct

SEQ ID NO: 56253 - DNA, 601 bp, Human
ttttccttcagatttaaataactttgttgttgttttcttcataaaattatccaggttcactgttttttgaaaaaataggcctaaagcagaccttaaaaatctcccataatcccaacactcaaaggtaactattgttaacccttggcatggtcttccaggatttcagccacaaacctatgattgataaatggcttcctaactttctaagcaatgctattgtaagtataatttgtataataattttttaaagttgtgagatgtttaacttggaacttcccactcctatggaggaaaatgatcrgtaaaaatgcatttttcactctgttgccatagtttcagctaagctgcacaaatgtaattgcacagagcatgtgctgaaatcatttgattagatccaatgattcacttatgttaaaggcttaatttaaaagcacttttacaattaaggtagaaataaagagaacaataatgcttttgaagccatttcaaatacatttcacagtatatgctaaggcactcatatgccagattttattcaatgaattaatcatttattaaacttgaaataagatatgagaaatgtaagttaataaacaggcct

SEQ ID NO: 56254 - DNA, 601 bp, Human
caataaatattttaaatcttttcaaggtctacttcaggcttatctctgttgtgaatcagcttaaaccatgctcctctcaaaagctcttagaatttttttatattaatgccttaagtttaatcatttagggaaaaagaggtgtaaatagttttaatgctctcacaaagcaattttaaccattttttccatgaattttgtgaaatcccctcacaggtaccttttcacattcccatcaacagtgcaagagggttccaatttctccacattctgtccaatacttactattttgttttttttttttggtagtagccatcctagtagatatgaggtggtgattgatgtaattttaaaaacagtaaacttaaggataaaaggaaaattgtcttttccttcagatttaaataactttgttgttgttttcttcataaaattatccaggttcactgttttttgaaaaaataggcctaaagcagaccttaaaaatctcccataatcccaacactcaaaggtaactattgttaacccttggcatggtcttccaggatttcagccacaaacctatgattgataaatggcttcctaactttctaagcaatgctat

SEQ ID NO: 56255 - DNA, 601 bp, Human
tataattttatagtaagaacaagtcaatgtacatggcccagcctagagttcacattgacatcagtatagatctaaaatgaatatcaaaaacataggtagtattctaaaataaacgatggcttatctttaatatgtcaagtagattttataaaaagccaaactcataagagacaaccacttttgaaacaatgatttggctctcttctaatgttaaattctattattttattatgtaaaaaagcttaagagattattaaagagtcatgtgtcaaaaataattactcctggttcttactattasgaatccttttttatttactgagatatgtacaagcccagctttccaaaagcattgttcatatactagattatatctatatttatatttgctttatatttatatattacttatctatatttgctgctacactaagaagataaggaattattttttgatacacagaattaactttcataggaaattaaaagaggttataaattaattacactttcttttacaaagtatagtacccaggaaaccctagtcattcacaaaggttgttcagatgatctgtgaagggctgtttttgttcataatcta

SEQ ID NO: 56256 - DNA, 601 bp, Human
taccagcgacgctctatttcttgacttgagtgattaaccagggtttgctttataattatttgttaaacagtatagcatattttgcataaatttctgtatgttatgcattacaataaaactttttttggaatttaggaactatatatatcatttgtaccaaatattaacataaattaaagtgtttattagactctctactgaccaatatactccaaaaataaataaaaattctaatatgtagatagatacatagtggggaaaaaactggatggattgagaagatgtatttatgattcgacaracatttactgagtatctattaaatgccatccccaggttctagggtaagttctagttccatttctgccactaaatacctggacacgatatagtatgcattcgtcacttcaatactctatgtctccattactacatctctgaaatgaaagtgttggtctcaatgaactctaggatccctgtcagctctaaaattctaggactatgtttaaaaatataaactcttcaaagatatattgtcttgaataaataaaattaggatctcttataaattagcattttccataacatattccattgaatt

SEQ ID NO: 56257 - DNA, 601 bp, Human
gatccatgttccatttaaccaaagccctattgttgggtttctaaacagtcctgggtttttcattattacaaattacgttcattgagtatcaactgagttgaacaaagattgaataagacaatcaatacaaagccctccacagagtacttggcatctaacaagcactctatcaatgttagtgattttttaaaatattgtgtcctggctgggcgcagtggctcatgcctataatcccagccctctgggaggcagaagagggcggattacttgaggtcaggagttcgagaccaacctggcctcraacaacatggtgaaaccccgtctctactaaaaatacaaaattagctgggcgtggtagaaggcgcctgtaatcccagctactcaggaggctgaggcaggagaatcgcttgaacccaggaagcagaggttgcagtgagctgagatcacgccaccacactccagcctgggcgacagagctagactccgtctcaaaaaaaataaaataaaataaaatattgtgtcctgtgtaaaggctgaactaatttacattcccaacagcagggtaaaagggattggtttccctaaatccttgccaattctt

SEQ ID NO: 56258 - DNA, 601 bp, Human
ttctgtagctttttaaaaacttattttggagagctttccaaaatattaaataaaagtagatcattttaatctattatatacattatagaacatagagatccatgttccatttaaccaaagccctattgttgggtttctaaacagtcctgggtttttcattattacaaattacgttcattgagtatcaactgagttgaacaaagattgaataagacaatcaatacaaagccctccacagagtacttggcatctaacaagcactctatcaatgttagtgattttttaaaatattgtgtcctgkctgggcgcagtggctcatgcctataatcccagccctctgggaggcagaagagggcggattacttgaggtcaggagttcgagaccaacctggcctcgaacaacatggtgaaaccccgtctctactaaaaatacaaaattagctgggcgtggtagaaggcgcctgtaatcccagctactcaggaggctgaggcaggagaatcgcttgaacccaggaagcagaggttgcagtgagctgagatcacgccaccacactccagcctgggcgacagagctagactccgtctcaaaaaaaataaaata

SEQ ID NO: 56259 - DNA, 601 bp, Human
ctgcatacaaatatacacgcagatattttccatatccatatacacatgtagatatttatatttattcatataatgttttgtatattgtacattctcttctgtagctttttaaaaacttattttggagagctttccaaaatattaaataaaagtagatcattttaatctattatatacattatagaacatagagatccatgttccatttaaccaaagccctattgttgggtttctaaacagtcctgggtttttcattattacaaattacgttcattgagtatcaactgagttgaacaaagaytgaataagacaatcaatacaaagccctccacagagtacttggcatctaacaagcactctatcaatgttagtgattttttaaaatattgtgtcctggctgggcgcagtggctcatgcctataatcccagccctctgggaggcagaagagggcggattacttgaggtcaggagttcgagaccaacctggcctcgaacaacatggtgaaaccccgtctctactaaaaatacaaaattagctgggcgtggtagaaggcgcctgtaatcccagctactcaggaggctgaggcaggagaatcgctt

SEQ ID NO: 56260 - DNA, 601 bp, Human
tggaacaatatggtacgtgagttatatctcaataaagttgttaccaagaaagccacatacagacaaaacagataaaaacatgcagataaaacagctattataaaaacaatctataatatatatcaaccttaagaacttttgaccagatgtcacaaagcactatttttaagggaactgagtcaccacagaactgtgatcctctttcccctttgagtagatattgcctttgaaacaggaaacaaaggtaggaataaagggtattattttgatattttgaaagcatgatttcttaggaatacartggggtagagcttggatttttaaaaaatacatttgaacaaattatttgaaggtggaaatgtacaataacatctccaagttgacagttacactaaatttctgacaataacatgcttagttgatgggaataaactattcattttgcttattcactggtagctgtaaagattgggcctatatggcatgctaaactactcagggaggttataaagacctcatacagcagggccgtagacatgaaggctcattactaaatgacctaaagacagcttacataagcgaacttagacatgaggcaggc

SEQ ID NO: 56261 - DNA, 601 bp, Human
agtatactcatccattcattcaaaaatatttgagaaactgctatgcataagttaacccactaagaaaatttgtttacccaaaccctatttttctggcaattttacattactgaattatagatgagttagatggaattctgccatctaaataaatggcagatggcaagaaacatgccaagacactatgaactcttcaggcaatatagattatgattaaagtataagcatataatatttttctatcacagacttcttcctgttttaaaattgtttaacctaacctgtagtaaaaaaggaagamgaccattcagatttcttcctgttttaaaattatttaacctgacctgtagtaaaaaaggaagaagatcattctcacttcaaagattactttaaacagaacttgagagaatttatagaaccttgtattcaaaatatttaaaagtgtgcatgactttttataaagtacctgaaaatgaaaaaaacatatgttcatacaaaaacttgtacatgaatgttcatagcagcattatattcatgtatttgtttatcttttagagagacggtcttgctctgttgcctagggtggagtacagtggcacaa

SEQ ID NO: 56262 - DNA, 601 bp, Human
cctgtctctactaaataagtaaataagcaagcaagctgagtgtggtggcacatggttgcagtctcagctactcacgaggtggaagtgaaaggactgcttgagcccagaagttcaaaactatagtgagacagggtctcgctctatctcccaggctggagagcaatggcacaatcatggctcactgtagcctcaaccttccagactcaagagatattcctacctcagcatccctagtagctgggactataagcgagtgtcacaacagcccaggctaatttgttttttttgtttttttttttgktttttttttcagtagagatgaagtctcgctatgttgcccaggctagtcttgaactcctgggctcaactgatcctcccacctcagcctctcaaagtgctgagattacaggcataagccattgcaccaggcctgcatgcattaaattaacagatcaatgaataggattagtctcatggttcttgttatgtactataaaattcaatggtgaaattaatcattaatattacattttaatagtgtccttgaaagttctgtagatgctatgtctattttgctatagagaagttatctgttattaca

SEQ ID NO: 56263 - DNA, 601 bp, Human
cccattttattttttcaagcttaagaattttccttacttttgccaggtaatctaagcagttgatagaaagactactcaactgcatagatacctggcaagagtaaggaaaattccttatctagcactttagaggtttaataatgattgtggctacatgcagtgactcatgcctgtaatcccagcactttgggaagccaaggcaggaggattacttgggcccaggagtttgaagccagcctgggcaacataacgagaccctgtctctactaaataagtaaataagcaagcaagctgagtgtgktggcacatggttgcagtctcagctactcacgaggtggaagtgaaaggactgcttgagcccagaagttcaaaactatagtgagacagggtctcgctctatctcccaggctggagagcaatggcacaatcatggctcactgtagcctcaaccttccagactcaagagatattcctacctcagcatccctagtagctgggactataagcgagtgtcacaacagcccaggctaatttgttttttttgtttttttttttgttttttttttcagtagagatgaagtctcgctatgttgcccaggct

SEQ ID NO: 56264 - DNA, 601 bp, Human
aaactttgaggaacattacttcaggaaactaactcctgtcacctcccaaattaaatgctattttgtccaatttttcagttttcttttttcaactccacaaatgagacatcgtgaccagagctttacacagtcagtatgctttagactgtttgttcagtaattctttttgcatctcggaaaattctccagggattattttccttcttcctaaaactacttcttttaaaattctcataggggacctattggtagaaaactcactcagcttttgtatgtttgaaaatgttggctgggcgtggtrgctcacacctgtaatcccaacactttgggaggccgaggtgggcagatcatgaggtcaggagttcgagatcggcctggctaatatggtgaaaccccatctctactaaaaatacaaaaattagccagccatggtggcatgagcctgtagtcccagctactcagggggctgaggcaggagaatcacttgaacccaggaggcggaggttacagtgagctaagatcgtgccactgcactccagcctgggtgacagagcaagactccgtctcaaaaaaaacaacaagacagagcaagactccgtct

SEQ ID NO: 56265 - DNA, 601 bp, Human
tcagaattatctatgccttgaatgtgtggcagaactcattcttaaaactgtactgagtgtcttcccagcaagaggatttttgcttactgaccaatctctttaacagttataggactatgtaggtttctcacaccttttttcaatcagtttggtaatttacacatttcaagattactgtgcatgttaaactttgaggaacattacttcaggaaactaactcctgtcacctcccaaattaaatgctattttgtccaatttttcagttttcttttttcaactccacaaatgagacatcgtgacsagagctttacacagtcagtatgctttagactgtttgttcagtaattctttttgcatctcggaaaattctccagggattattttccttcttcctaaaactacttcttttaaaattctcataggggacctattggtagaaaactcactcagcttttgtatgtttgaaaatgttggctgggcgtggtggctcacacctgtaatcccaacactttgggaggccgaggtgggcagatcatgaggtcaggagttcgagatcggcctggctaatatggtgaaaccccatctctactaaaaatacaaa

SEQ ID NO: 56266 - DNA, 601 bp, Human
acacacacaaaatggaaatacaaaggtaaaacattacaggtaaactgtttccttacctttacagaattgtcttcaaggcctgtaaccaaactactcagtgcagatgtataatagataatgagtcaaagtattcaatgtgttgaaagaaaatacacacaaggtttgactatataaatttgatattaaaaatttcacatatataaaatgggctgataatctgccttctttatactgtcctagtgtgttttttggaatcaaggttacactggactcatacaatgagttggaggaaataatcccycttttcctgttttctgaaagagtttgtggaagatcagaattatctatgccttgaatgtgtggcagaactcattcttaaaactgtactgagtgtcttcccagcaagaggatttttgcttactgaccaatctctttaacagttataggactatgtaggtttctcacaccttttttcaatcagtttggtaatttacacatttcaagattactgtgcatgttaaactttgaggaacattacttcaggaaactaactcctgtcacctcccaaattaaatgctattttgtccaatttttcagtttt

SEQ ID NO: 56267 - DNA, 601 bp, Human
gacatctgatgaggctttcctattattctaagtagtgctgaaaaaaatttatcttaaaaaggtaatgaaactgaaagattagtggtaaaatttttgaataaaaattgagattttattatattcataataaaagcttccacctactccatttagtcatcaaaactgtgattttttaaaggcagatatacttacaatgacatttcttagttatcccatcttctcataagagactacactgtcagctggcaaaaaggaaaagcagtctccatggctgacaactgatccattataaaacagtgcrcacacacaaaatggaaatacaaaggtaaaacattacaggtaaactgtttccttacctttacagaattgtcttcaaggcctgtaaccaaactactcagtgcagatgtataatagataatgagtcaaagtattcaatgtgttgaaagaaaatacacacaaggtttgactatataaatttgatattaaaaatttcacatatataaaatgggctgataatctgccttctttatactgtcctagtgtgttttttggaatcaaggttacactggactcatacaatgagttggaggaaataatcccc

SEQ ID NO: 56268 - DNA, 601 bp, Human
acagaaaggcagacaggttaagacaccccttgaaagaatccatgcataaggtaaaatgagtgatggcactttccgttcttaggcccagaaaaggtaaatccaaggatcactttaaggggaaaattataggactttgtgagaaaatagaagtaaagaggctgggctgggcgcagcagctgatacctgtaatcccaacactttggaaggccgaggcaggtgggtcacttgaggtcaggagtttgagaccagcctggctaacatggtgaaaccctgtctctactaaaaatacaaaaattatccrggcatggtggtgcacatttgtaatcccagttactcgggaggctgaggcaggaaaatagcttgaacttgggaggcagaggttgcagtgagctgagatcacaccactgaacttcagcctgggtgacagagtgagactccatctcaaaaaaaaaaaaaaaaaaagaagagagataaagaggtcaaaatagatagagaagaatccaaaaagaatccaaaattatttaaaagtttctagctcagaaaactgatcaagattagtgataggccaaaggaaaccagatagttcaagagaagcaagtca

SEQ ID NO: 56269 - DNA, 601 bp, Human
agaaaaactgcacgaaaatgttgtattttagcaagactgtatattacgtataacagcatatgatattaaaatgcacaaatggaagagagcctacagaaaggcagacaggttaagacaccccttgaaagaatccatgcataaggtaaaatgagtgatggcactttccgttcttaggcccagaaaaggtaaatccaaggatcactttaaggggaaaattataggactttgtgagaaaatagaagtaaagaggctgggctgggcgcagcagctgatacctgtaatcccaacactttggaaggcmgaggcaggtgggtcacttgaggtcaggagtttgagaccagcctggctaacatggtgaaaccctgtctctactaaaaatacaaaaattatccgggcatggtggtgcacatttgtaatcccagttactcgggaggctgaggcaggaaaatagcttgaacttgggaggcagaggttgcagtgagctgagatcacaccactgaacttcagcctgggtgacagagtgagactccatctcaaaaaaaaaaaaaaaaaaagaagagagataaagaggtcaaaatagatagagaagaatccaaaaaga

SEQ ID NO: 56270 - DNA, 601 bp, Human
agggctattattcaaaagccaaaaaataacagatactggtgaggttgtggagaaaacaaaatgtttatacactgctagtgggaatgtaaattacatcagccactgtggaaagcagttgaaatttttcaaagaacttaaaacagaaataccactcaacccagaaatcccattactgggtatatacacaaaggaatataaatcattctaccaaaaagacatatgtactcatatgttcattgcatgttcactgcagcactattcaaaatagcaaagacatggaatcaacctagacgcccatcartggtggactggataaagaaaatatggtacatgtacaccacagaatactatgcagccattttaaaaaatgaaatcatgtcctttgcagcaacacggatacagctggagaccattttcctaagcaaactgatgtaggaaaagaaaatgatctcacttataagtgggagctaaatattgagtacacatggaaataaaaatggaaagaatagatactagggcctacttgaggggagagggtaggagaagggtgatggttgaaaaactacatatagggtactatgctcactacctaggtgacaaa

SEQ ID NO: 56271 - DNA, 601 bp, Human
acattcacttatgtataaagctaagctgaaagcttggtaatgtattacatcagctcttttagaagctgaactacattccctttcagcttccccaataatagctaaaactgaaaaacaaaatagctaaaacttacatagcatttattatgtgtcaggcaatcaaaacattttattactcatatcatgtatatcttaggagaggaatgttaacctatactacactaagatggttcagaatctaagatgcttgaatacatttgtttgatacaaataagaggctgggcatggtggctcacacctrtaatcccagcactttgggaggccgaggcgggtgcatcacctgaggtcaggtgagaccagcctggccaacttggtgaaacgccgtctctactaaaaatacaaaaattagccaggcatggtggcgggcgtctgtaatcctagctactcaggaggctgaggcaggagcattgcttgaatccgggaggcggaggttgcagtgagctgagatcatgccactgcactccagtctgtgcaacagagcaagactccatctcaaaaaaataaataaataaataaataacaaagaaatataatctttcca

SEQ ID NO: 56272 - DNA, 601 bp, Human
aatctgtagtaaaaaaaagattggagggaaaaaaagctatcttatcaggaatattcatagagtctgggaccaatgagtaaagaaatatcacaaattacatttcaagatggcactgaaggctggggaaagcagcccaaagaccgcctcaactggaaaaacagtatttccacagagcaaacttacaagatctgctgttgattagatgacagcagcagcagcaacaacaacaacaacaacaacaacaacaaaggatatccacataaggaaaaagtgaacttcttaaagaggacaccagggaccraggtagacacaaatggttactgctcattagacactatcataagcaaggccctctgaatttctatactttgccagcactcactccaaggtttcataaactcacaaataactctgcattacatgaagaccagctccatactattccatttacaaggttctatgttgtatggtgtgtgtgtgtgtataacatatacatacttaatactcactactcttatctccagcacccagaacagtgtctgcctcttggtaaatacaaatgaatgaatgaatcccaagaccaacgggaatgaactgaaag

SEQ ID NO: 56273 - DNA, 601 bp, Human
tgacaattttgacaatttaatgaatacatgcttttaaaggtattattttaatacggatactttccaaacacttaaaagaataaaatgacaaatgatgactaagtcatcatactttttaaaacactcttttaaatgactcaaccaaagtatttttccctctatcatgtcatcaaaaagtagcaatgtctttaagttgcctagtgcaatttacagcatcctctagtaacaaattacccatgagaaacaagtatgtctcatttaataaatgaaatgtgttactctaaatctgtagtaaaaaaaagattggagggaaaaaaagctatcttatcaggaatattcatagagtctgggaccaatgagtaaagaaatatcacaaattacatttcaagatggcactgaaggctggggaaagcagcccaaagaccgcctcaactggaaaaacagtatttccacagagcaaacttacaagatctgctgttgattagatgacagcagcagcagcaacaacaacaacaacaacaacaacaacaaaggatatccacataaggaaaaagtgaacttcttaaagaggacaccagggaccaaggtagacacaaatggt

SEQ ID NO: 56274 - DNA, 601 bp, Human
aatagaatgtttactagccatgctgcactttgggttcataacaaacttattaactattgaacttgaactaccacttaaaaaatacagtagaaatgctcttaagtgacttatacttagccagctcctaagaccaacttagtcttatactcccctttccctctgaaaacacccactgcacactgacaatctatgactagtttacatgtgtatttctgcacccatgcagttccatgccagtcactgatacttgttgctttgcctatttctacttgttgtatctgttattcttattatgtaaatwcattaaatattacatgaaccactgaaatgtgcatgccaaagagaaaaatgaggatgaatgctttgaaaggactagataaaagcaaaacactttaaagaaaggaactgctgaaaaattaggtgtgagtgaaacaactataaaaggctagggggagtattcagactacttaaaatctggctagttctcactctaaagaacctgaaactgttatttttagatgatggattcaaccgtggtttatgcaaaataaactgtttattaacctacattcagagtcctgtgcttacatccaaagattca

SEQ ID NO: 56275 - DNA, 601 bp, Human
tatttgagaccaaatgaatgacgtaaatctttcaattcatggccctacagacaccattttgaatgctgctgaaaacctatgtgctcttttagctaaacagccatttcagaagagagaactggatcaactatgtaaatttttccaaagctggatatacatttctataggttggaagaacactgcagacatcttatgaaggtcgcttctgttcaaactgaaatgtggatttataattctattctacctgatgtagacagcaaaacgttgacaatctttgctgataatgatttcagtggcttgmcgataagaaataatatatactgaaccaaaggaagtgtcatagaaaaatttctggttccttggagtaggtttcttttcagcttgcttttccaaatgtgtggctcttattccatttgccacaattattgtgaaccaggttttaagcacttatggctataataaagaaaagttaaaaatgactgacagttttaaaacaagaagacatccatgctgccatgtcagaaaccactgcacaattccaacttattttttaagccaagccaaagcagtcttcttgagcataaacttatctttcatttta

SEQ ID NO: 56276 - DNA, 601 bp, Human
caggctggtctcgaactcctgacctccggtgatccacccgccttggcttcccaaagtgctgggattacaggcgtgagccaccacactcggcctgagatcatgaagttcactggtattccagaggactagtcctgcagtgtttgactgaacttgaggtagaggttctactttttgagactgagggaaagtacattctaagaacaaatgacaggaaggattacttactgatttagcttggctgatatttgagaccaaatgaatgacgtaaatctttcaattcatggccctacagacaccattytgaatgctgctgaaaacctatgtgctcttttagctaaacagccatttcagaagagagaactggatcaactatgtaaatttttccaaagctggatatacatttctataggttggaagaacactgcagacatcttatgaaggtcgcttctgttcaaactgaaatgtggatttataattctattctacctgatgtagacagcaaaacgttgacaatctttgctgataatgatttcagtggcttgacgataagaaataatatatactgaaccaaaggaagtgtcatagaaaaatttctggttcc

SEQ ID NO: 56277 - DNA, 601 bp, Human
aaaaaaaaaaaagaaagaaagaaaaaaatatgagcaaagtatgggcacagtggctcatgttaaaatctcagaaatttgagaagcagaggcaggcaaatcacttgagcccaggagtttaagacaaacctaggcaacatagggagaccccgtctctacaaagaacacaaaaattatgtgggtgtggtggggcatgcctgtggtcccagctacttaggaggcttaagtgggagaattgctggaacccaggaggcagaagttgcagagagctgagatcgtgccacttgcactccagcctgggcamcagggcaaaactctgtctcagggggagaaagaagaaagaagagagagagaaagaaaaggagaaagaaaaagaaaaaggaagaaggaaagaaaagggaagggaaggggaggggaaaggggcatcgggaaaggggaatggggaaatgaaaagcaaaagagaacatgaagttctaaacacactttctttctttcctttctttctttctttctctctctctctctctctctctctctctgtctctctctctctctctctctctctctttctttctttctttctttctttctgaccaagtcttgc

SEQ ID NO: 56278 - DNA, 601 bp, Human
tgtgtggggttgtaaatatttttttctttgatttctttctgttactttaaaaactattgtatttcactcaaaatatgcatgaagtagcataggatgtcaatatatatgatcaaataatataaaatcatcctgattgctatgttacaatctatatggtcaaataatacgcaatcatccttgccatgtgataacatcaagaagtttcccaataatatgaattaaagaccacgtactctgccaacgcaattgtgttcatctatcagacaatgtcagggaaaaactataatgaagctcacaaatrttttgtttttacttttataattgccatgattaacatttaagctacaatgcttcaccacatggtaagtgccagtggatgcttattaccaacattcaaggagtgccttacgacattccaaacaataagtatttcagataacgatcttacttctaagaaggctgtgtaactaaaacatagttgcctccaaacagttttgtttttgaagcacccataaagctgtttatcacattgccaaatgggaagaaaacacattccatactggagagaacttaaagaagccaccttacctggttaagctgg

SEQ ID NO: 56279 - DNA, 601 bp, Human
tatagaagagttgggtcacttgtcctagatcacacttgccattcagtctgactcctgggccagtcttacctgtggtctacctgcttcacttaagtgaatgacctcataggcaaataaatagggaaccagagattaaatagaagtcacaatgcaagttaggtgttttaacagtgaatggacccagtgctccctcttccaagaggaggaagttttgcaaaacggcccattttattgatgggaggctctgtttgaaaatcttccttatattgccaggcgtggtggctcaggcctgtaatcccarcactttgggaggctgaggcaggtggatcacctgaggtcaggagtttgagaccagcctgatcaacatggagaaaccctgtctctactgaaaacacaaaattagccgagcatggtggcctatgcctgtaatcccagctcctcgggaggctgaggcaggagaattgcttgaacctgggagatggaggttgcagtgagccgagagcgtgccatcgcactgcagcctgggcaacaagagtgaaacttagtctgaaagaaaatcttctttatattgactggaagcaggccattttataattttcat

SEQ ID NO: 56280 - DNA, 601 bp, Human
acatctgagtacttgtcaggcacttatgatataaactcattcgattcttacaacattcctataaggaggtgagaactattatctccattttataaatgaagaaactgaagtatagaagagttgggtcacttgtcctagatcacacttgccattcagtctgactcctgggccagtcttacctgtggtctacctgcttcacttaagtgaatgacctcataggcaaataaatagggaaccagagattaaatagaagtcacaatgcaagttaggtgttttaacagtgaatggacccagtgctccytcttccaagaggaggaagttttgcaaaacggcccattttattgatgggaggctctgtttgaaaatcttccttatattgccaggcgtggtggctcaggcctgtaatcccagcactttgggaggctgaggcaggtggatcacctgaggtcaggagtttgagaccagcctgatcaacatggagaaaccctgtctctactgaaaacacaaaattagccgagcatggtggcctatgcctgtaatcccagctcctcgggaggctgaggcaggagaattgcttgaacctgggagatggaggttgcag

SEQ ID NO: 56281 - DNA, 601 bp, Human
cacaagcagccctgaaacttctgtgttccttacatacacatggcacttactctaaattcttgttatcccaggttcctaactccagagcactatggtttttagaaattagggaatccatctatgctctcaaaaccaggaattctttccacaagatcaccaaacatggctgttcagcttcttcctagtacatctgtccgcaacataggtgttgaccatgtgacacacaggctgctgggtgttcgaacctaacatctgagtacttgtcaggcacttatgatataaactcattcgattcttacarcattcctataaggaggtgagaactattatctccattttataaatgaagaaactgaagtatagaagagttgggtcacttgtcctagatcacacttgccattcagtctgactcctgggccagtcttacctgtggtctacctgcttcacttaagtgaatgacctcataggcaaataaatagggaaccagagattaaatagaagtcacaatgcaagttaggtgttttaacagtgaatggacccagtgctccctcttccaagaggaggaagttttgcaaaacggcccattttattgatgggaggc

SEQ ID NO: 56282 - DNA, 601 bp, Human
ataaaaaaatgtttatctattcagaagcaacaaaatgaagctagaaaatattatgcactacaccttccaacagggaaagccactatataaactcaggagaaggtaaagtcttccacaagcagccctgaaacttctgtgttccttacatacacatggcacttactctaaattcttgttatcccaggttcctaactccagagcactatggtttttagaaattagggaatccatctatgctctcaaaaccaggaattctttccacaagatcaccaaacatggctgttcagcttcttcctagtayatctgtccgcaacataggtgttgaccatgtgacacacaggctgctgggtgttcgaacctaacatctgagtacttgtcaggcacttatgatataaactcattcgattcttacaacattcctataaggaggtgagaactattatctccattttataaatgaagaaactgaagtatagaagagttgggtcacttgtcctagatcacacttgccattcagtctgactcctgggccagtcttacctgtggtctacctgcttcacttaagtgaatgacctcataggcaaataaatagggaaccaga

SEQ ID NO: 56283 - DNA, 601 bp, Human
tatcgattcacttaatcctcaaaacagccagtgaagctggtgcttttagcaattctacttcacccatgaggaaatgtgttcagaatagttacagaactggcccaaagactgaggcaagaagcagcagaactgattcaaatgcaaggagtgtgactccagggaccacactctgaaccataaatgaacaaaaaagtgattcctcacaagcgctagtaatcagacattctggatcttaatataaccagtactgtaaacgtactgaacacattccagggcacagaaaaagttcacaaaggtttgygtattagctcatcggaaatccaataattataggttgagaccttagtaaggcagaagtgaatcaacaagatgaaatgacaacttttggaacctaacaaattagggtatacaaataaaaaaatgtttatctattcagaagcaacaaaatgaagctagaaaatattatgcactacaccttccaacagggaaagccactatataaactcaggagaaggtaaagtcttccacaagcagccctgaaacttctgtgttccttacatacacatggcacttactctaaattcttgttatcccaggttcc

SEQ ID NO: 56284 - DNA, 601 bp, Human
catgttttataaaaaaattacaattttaaataattttaaaaagcatattgagtatagttaagagaacagaaaaaaaaaaaaaaaaaaagagaggagacagaaagggcgggggcaggctagagagtaatggtgcagagtccaggaacctgttttcttaccagcttctgactcggacaaccttagacacatgatttaacttttatgagtttattgtcaagggagaaacttgaaaagataatcatttctcaaacagtcctcatggacttcctaaggctttcctggaaattctagggtaaagaayagaaataaaccggtagggcttggtacccttaggcccagatacaagcagagctactcctttccatttgttttccatttgaatttctgtgtgttcatttgagggaagggtcctgcactaaaaatgtttgaaaccgctgtattagaatgctctgtcacctacaacagtcttgttgttcatgtgggtagatactgaagacatatatatcaaaaaaatcaataacatagcagatacacacaggaggcagaatgaagggccaaattatattgactcactggaacaataggcaaatgataacattaa

SEQ ID NO: 56285 - DNA, 601 bp, Human
agtggcacattgatcttggacttccagcctccagtactgtgagaaaataaatgtctattgtttaagccacccagccctagcaaactaatatagggaccaagtgtatagcacgatatttgggaaactgacctagtgtgcattagggcactgcaaacaaataactgaaccattaaaacagtctatggtcctcttctaaattcctgaaaagttttcatctttaaaagtcaactgctgaaacaggcacaaagaataattgtgttaaataaattaatgtgaacagaagatagaagggcatgatttytaaatgcaatgcctcactcactgtggaatgaatatgttgtccagttcacgttccattcttgacttagcataaaaaaatgggttttcttgttttgttttggatttgtttatttagggccaatgacaaaggccaaaagtaatggagagccaataacgaaaaagcaacatgattaaggactactgttttctagtctaatacaaaatatttcactcttatctatttacttctaaatttaacatgttttataaaaaaattacaattttaaataattttaaaaagcatattgagtatagttaagag

SEQ ID NO: 56286 - DNA, 601 bp, Human
actttagatctagcttcccaattactactagaattcagcagaggcaggaataagttaaaagatactataaggacacaaccaagtgagcattcctggattggacaaacagctgtaaagcataattatgttacaattagtaaaatatgaaaatggacttgtgtgacaaatggccatgaattctttctagttcccctcttcaagaggtgaagtctatttctgcatcccgtgaatccaggctggtcttgtgttgacagtgaagctatgtgagttccagtgtccaggctcaggaggccctgcagcytccacttttgccctcttggcagtagttgctagctgccctgatactaccatgctatgaaaaagctgatctactgtactggaggatgagaggccatatggaggagaaaagaggtggcccagctaacagctagcaccaattaccagacatgagaatgaaaccatcttggacctcacagcccagccaactctccatctgaacaccaggtgagtgagcccaggctaaccattagagaactgctcagccaacccatgggatcatgagaaaataaatcattgtttaagctatgaaattttaggtggt

SEQ ID NO: 56287 - DNA, 601 bp, Human
gacactactactcacctatgagacaggcaaatgcccagaagtttgagaatacgttctgtggagaaacaggcactctcaaacaatgctgatgggaatgtaaaatggtacaacttctatggaagtgtatttggcaaaattagagatggcaaaaaaggatgggtgtggtggcccatgcctgtcatcccagcacttttggaggccgaggtgggcagatcacttgaggtcaggagttggagaccagcctagccaacatggtgaaaccctgtctctactgaaaaaatacaaaaattagccaggtgtrgtggcatgcatctgtagtcccagctactcaggaggctgagtcaggagaatcacttgaacccaggaggcagaggttgcagtgagccgagatcaacatcactgcgctccagcctgggcaacagagcgagactccatctcgaaaaaaaaaaaagaagagatggtgaaaacacagacccagcaatctcccttcatcaagcctacaggttttttcccccaaacaagtagaaaatgacatacgtgcaagttatccctgaagcatcctcataagaaaagataataaacaataacccaaggatccctt

SEQ ID NO: 56288 - DNA, 601 bp, Human
attttaaaaataaattttactatacataaatttttgcatggtaaatgcatcataaccaaactcaaaaaaatacatgggaaacgggaaagtatttacaatgcataccagaaatgattaattactttatgagctcctagaaattgagaggaaaaaaagaggcaaagggtacaaatagataattctcagaaaaaatacatatggctttttaagcatgtgaaaagatgttcggcctcattcagtaaagaaaaaaagaaaattaactctacaatgagacactactactcacctatgagacaggcaratgcccagaagtttgagaatacgttctgtggagaaacaggcactctcaaacaatgctgatgggaatgtaaaatggtacaacttctatggaagtgtatttggcaaaattagagatggcaaaaaaggatgggtgtggtggcccatgcctgtcatcccagcacttttggaggccgaggtgggcagatcacttgaggtcaggagttggagaccagcctagccaacatggtgaaaccctgtctctactgaaaaaatacaaaaattagccaggtgtggtggcatgcatctgtagtcccagctactc

SEQ ID NO: 56289 - DNA, 601 bp, Human
ggaaaattagctatttgaaaaagattaagttggatccttatttcatgtcatacgccatccacatggatccaagttctctatgcaaaaaataaaaccatgcaagtactggaagaagacatcagttaattcctttataaactcagtagaggagtagaggaggtcttctgactatgactcaaaatcacaagccataaaaataattttaaaaataaattttactatacataaatttttgcatggtaaatgcatcataaccaaactcaaaaaaatacatgggaaacgggaaagtatttacaatgcmtaccagaaatgattaattactttatgagctcctagaaattgagaggaaaaaaagaggcaaagggtacaaatagataattctcagaaaaaatacatatggctttttaagcatgtgaaaagatgttcggcctcattcagtaaagaaaaaaagaaaattaactctacaatgagacactactactcacctatgagacaggcaaatgcccagaagtttgagaatacgttctgtggagaaacaggcactctcaaacaatgctgatgggaatgtaaaatggtacaacttctatggaagtgtatttgg

SEQ ID NO: 56290 - DNA, 601 bp, Human
aaattaaaacagtatagtactggtacatgacttaacaaaccaaacagaaaaaaatcaaatagacccaaacatatatgagaatttcatagaggaaaaaggaagcacctcaactcaatgtaaatgtggacttttaactaaacagtgttgggaaaattagctatttgaaaaagattaagttggatccttatttcatgtcatacgccatccacatggatccaagttctctatgcaaaaaataaaaccatgcaagtactggaagaagacatcagttaattcctttataaactcagtagaggagtaraggaggtcttctgactatgactcaaaatcacaagccataaaaataattttaaaaataaattttactatacataaatttttgcatggtaaatgcatcataaccaaactcaaaaaaatacatgggaaacgggaaagtatttacaatgcataccagaaatgattaattactttatgagctcctagaaattgagaggaaaaaaagaggcaaagggtacaaatagataattctcagaaaaaatacatatggctttttaagcatgtgaaaagatgttcggcctcattcagtaaagaaaaaaagaaa

SEQ ID NO: 56291 - DNA, 601 bp, Human
aggaaaatgtagtaagatagcaggatatagaactaatatataaaagtaatagctttcagctagaaggtatggtggaagagaagaccccatttacaaaagcaacagatgacagaatatctaagattcagttaagaaacatggctaggaagtaaatgctaaaacacacctgaaggtcttagaaggatttcaacatcagcaaacataccatgttcttgaattggaataaccaatatcataaaaatgtcaagtctccctaaattaattttttaatttacagcaattccagtgaaaataccttacrgtttttccccccaaaaccagacaatgtgattctaaagttcatgctgaaaaataaaccaacaggaagagtcctccaaaaagctctgaaaaataaaggcaatgaaagatcaggggcagagggcaactaaccttaccaagaattaaaatacattgtaaaaccttgataaattaaaacagtatagtactggtacatgacttaacaaaccaaacagaaaaaaatcaaatagacccaaacatatatgagaatttcatagaggaaaaaggaagcacctcaactcaatgtaaatgtggacttttaact

SEQ ID NO: 56292 - DNA, 601 bp, Human
agacatgatctccacgttacaagatttgggaaaagtaaaagaaatataaagggaaaaatccaccaaatccaatatcattagctataaatcagaggcttaaaagatattaatgttgtagaattaaaaaaaaaaaaccagaaatgtgacttaacaatagataactttaaagcaggggtcaacaaattacagaccagaggccaaatctggtccaccaccatttttgtaaataaaattttattggaacttgggccaggcacggtggctcatgcctggaatcccagcactttgggaggccagggcragcagattaccgatgccaggagttcaagaccagcctggccagcatggtgaaaccctgtccctactaaaaatacagaaattagccaggtgaggtggcacatgcctgtaaacccagctactcgggaggctgaggcaggagaatcgcttgaacctggaagggagaggttgcaatgagccgagatcacgccactgcactccagcctaggcgacagtgaactccatctcaaaaagaaaaaaaaattattggaaccctaccatgcctatttattcactactgcctatggtcaaagagaccttaagg

SEQ ID NO: 56293 - DNA, 601 bp, Human
gataaaaatatttttatatctcttgttgtaaccatgcacaggtacagaaaaagttataaaaggagacatgatctccacgttacaagatttgggaaaagtaaaagaaatataaagggaaaaatccaccaaatccaatatcattagctataaatcagaggcttaaaagatattaatgttgtagaattaaaaaaaaaaaaccagaaatgtgacttaacaatagataactttaaagcaggggtcaacaaattacagaccagaggccaaatctggtccaccaccatttttgtaaataaaattttaytggaacttgggccaggcacggtggctcatgcctggaatcccagcactttgggaggccagggcaagcagattaccgatgccaggagttcaagaccagcctggccagcatggtgaaaccctgtccctactaaaaatacagaaattagccaggtgaggtggcacatgcctgtaaacccagctactcgggaggctgaggcaggagaatcgcttgaacctggaagggagaggttgcaatgagccgagatcacgccactgcactccagcctaggcgacagtgaactccatctcaaaaagaaaaaaa

SEQ ID NO: 56294 - DNA, 601 bp, Human
agaaatctctccattgttctgcagttcatacacttttattagcagatggagaaagtgaaattcacagagacattgggttacataagctttaaagtattactaaaaactacagcctaaatagcccattttccatttaagatgcaaaaggataaccacagaaagggctagcaagcttattttaaggctatgtcttgctcgtgcaattgcatggaagtcagcttgtaggaggggaagtcgtagagttaacagaaatcctacatctcctgctttcaaggaaagattctgttctgctttcactctycaaacacccaaacacctacttatttccagtaatactctggctgacctctagacatctaagctttctatttcaaattctcctacttagaatttctctctctcatatttcttcttaaatggtggcaccttccaaagagctgttattaattcccacatgccccctatgattcagaccacttctctctttttttctctctctctctgcactgttacttggtcttctttttattttttttcctacaaattttcctcttccttctgatatgcttcacttccatgaactcccatacctcctgttctc

SEQ ID NO: 56295 - DNA, 601 bp, Human
tatatttcatttcaatgacacataatttatgcagatatttaacagtagcaagtagatttcactttgttattatgaaataatatttccttcttggattcagaatagcaagccgtgtgtgtgtatgtgtgtttgtatgtatatggaaaggcaggtagagaatggaggagagaaaaatagcctttaaaccagtaaatttgtttcttaaaacagtaaattaattctgagaatttgaactgaagatctctacaaaatttccaagattcttaagcaactcatatcattctgacaattaataccttayggaattaacgttagggtaaaacagcacgtgctctccatcaaaattctgactttctaagtacatactgttgcacagtttcaggctgctcgtctttgcacatctgatttgacttaatgttgaactcagaaatctctccattgttctgcagttcatacacttttattagcagatggagaaagtgaaattcacagagacattgggttacataagctttaaagtattactaaaaactacagcctaaatagcccattttccatttaagatgcaaaaggataaccacagaaagggctagcaagctta

SEQ ID NO: 56296 - DNA, 601 bp, Human
tgaaaattcaaaaacataaaatttctcccattttaaaacacactaccatcctccctaaatcccacgtgtcccatcttgtctttcttctttattttactgccaaacttctttaaagcgtggtctacatggctgatgctccttacccactgttcccttcatattgctgctataggaagttaccacagacttagtggcgtaaacactatgaatttattattttataattttgtacactcgaagtctgacatggacatcactggactaaaatcaaggtgtcagcaggactgcgtttcttctgggrctccagggaaaaatctgtttcctggccttttctagcttctagatacaggccacccacattccttggcttctggtcccttccctcatcctaaaaggcagctatggcagctgagtcacttctcacattgcatcacctgaccttctctgtagacacatctccctctcaccctcctctctcctccctccctccctcttcctattgtgtaaggacccttgtggttacattggccccacaccagataattcagaataatctctcaattttagagtcagctgattagtggtcttaatttcatctgta

SEQ ID NO: 56297 - DNA, 601 bp, Human
agcaatgccagtgtgccagccaaggcagattctaggttagtaagggtgcagatggaacccaaaggaagtaggagaataggaaaggctcaaaagaaggtagggctcagaggggatttaaaaaatgctcggggagtatgagaaaggaaaatgatggaagattatggttaaagactttgaggtcttagaggtgcaactggtttgactgataaggcctaatgtgcagctatacttgtaaatgaagcaaaagaagtgaaagaggtttggcatggtattgaactggttatcaatactggtactaaarttgtagaaagtgatgggaggaaactggaggaaagggaaactacgtctgatgaatgtcactggaaacgcagatatgtgtcctgggagtcaattagctacagaattgagggaagtggcttagaaaagctctttgaaaaacaagactctgttgagaaatgattttttaaaatgatgtttaactatcatcatgttgttgagtacaggaaggtggtcttctgtgacaggggctgctagagaagcaacatcctccaaaaacagaaggttttactttagaggaaaggataaataaagcatttcagga

SEQ ID NO: 56298 - DNA, 601 bp, Human
tgcatgtggtggctcacatctgtaatcacagcactttgggagactgagatgggaggatcacttgagcccaggagttcacaaccagcctgggcaacatagtgaggctctgactttgcaaaatacaaaaaaatttagccaggagtggtggtgtgcacctatagtcccagctacttgggaggctgaggcaggaagatcatttgagcccaggaagtcaaggctgcagtgggccatgatagtgccactgcactccagccttggcaagagagtgagaccctgtctcaaaaaaaaaaaaaaaaaaaaaccaaaaaaccaaaacaaacaaacaaacaaacaaacttggattggcaagtcacaacaaacatacatattaaattttgataactgttgccaatttttggtaagtacctccaaaaaaaggctgaagccatttatatcacccaccaacagtgagtaaatacctcttaaaaagttctcgtatcggctgggcgctgtggctcatgcctgtaatcccagcactttgtaaggcaggcagatcacgaggtcaggtcgagaccagcctggccaacagggtgaaacccagtctctactacaaatacaaaaa

SEQ ID NO: 56299 - DNA, 601 bp, Human
tgaggctgcatgtggtggctcacatctgtaatcacagcactttgggagactgagatgggaggatcacttgagcccaggagttcacaaccagcctgggcaacatagtgaggctctgactttgcaaaatacaaaaaaatttagccaggagtggtggtgtgcacctatagtcccagctacttgggaggctgaggcaggaagatcatttgagcccaggaagtcaaggctgcagtgggccatgatagtgccactgcactccagccttggcaagagagtgagaccctgtctcaaaaaaaaaaaaaacaaaaaaccaaaaaaccaaaacaaacaaacaaacaaacaaacttggattggcaagtcacaacaaacatacatattaaattttgataactgttgccaatttttggtaagtacctccaaaaaaaggctgaagccatttatatcacccaccaacagtgagtaaatacctcttaaaaagttctcgtatcggctgggcgctgtggctcatgcctgtaatcccagcactttgtaaggcaggcagatcacgaggtcaggtcgagaccagcctggccaacagggtgaaacccagtctctactacaaata

SEQ ID NO: 56300 - DNA, 601 bp, Human
agccattaaccacgataaaaataccatttcctaatttgcattccctattcaaatttggccatttaccccaataatgctctttgtggctacttttttccagtccaatttctagttcaatttcatacaacgcattagaaatcacatctctttagtctggaatccatggtctttctttcttggtatctttgaagaggacagacctgatattttgtggactaactctgaatctgggttttatcttttgttttctcatgatgcaggttatgtattcttggaaggaatagcaataaaatgatgttaycctcactacgacatctcaggaagcacggatgttagtttacccaacattggtgttaactttgagaacatcattaatgtggagtcactaaagtggagtttgccacgtttctccactatgaagttactatgtttccctttataattaactggtaaattttagggagaggaattgagactatgtaaaaatctcctcctcctcatgtcacccactcattttagcatcaagtgatgattttccaactccatcattcctctatgttagttggcattctcccataaggaagagctttcccttcgcccc

SEQ ID NO: 56301 - DNA, 601 bp, Human
agaaataatacatataaaggacaatgcatatgatcaatacatctctcttgatacactatattatgactttggaccaagagcagcagaaagctataaacacagattacactgttttggaaaaattatactctccccttgtgttccacgggcttacattatgaagcctgaagagtggcatgaaacttcttattattgttagtctaggaagtacatagtggctcctaaatgaagccctattaaagaattttttcctaagggtttttttttacaaaaaacttatcttggtacagtttttttttttgagacagagtctcactctcttgcccaggctggagtgcagtggcactatcacagctcactgcagccttgacttcctgggctcaaatgatcctcctgcctcagcctcccaagtagctgggactataggtgcaaaattttgtacttttagtagagacagggtttcgccatgttagcctggctggtctcgaactcctgacttcaggtgatctgccctccttggcctcccaaagtgctgggattgcaggagtgagccaccatgcccggcctagattttttttttttttgagatagggtctcgctc

SEQ ID NO: 56302 - DNA, 601 bp, Human
aaatgttcagttgttagaaataatacatataaaggacaatgcatatgatcaatacatctctcttgatacactatattatgactttggaccaagagcagcagaaagctataaacacagattacactgttttggaaaaattatactctccccttgtgttccacgggcttacattatgaagcctgaagagtggcatgaaacttcttattattgttagtctaggaagtacatagtggctcctaaatgaagccctattaaagaattttttcctaagggtttttttttacaaaaaacttatcttggyacagtttttttttttgagacagagtctcactctcttgcccaggctggagtgcagtggcactatcacagctcactgcagccttgacttcctgggctcaaatgatcctcctgcctcagcctcccaagtagctgggactataggtgcaaaattttgtacttttagtagagacagggtttcgccatgttagcctggctggtctcgaactcctgacttcaggtgatctgccctccttggcctcccaaagtgctgggattgcaggagtgagccaccatgcccggcctagattttttttttttttga

SEQ ID NO: 56303 - DNA, 601 bp, Human
tggaagacagcttccaagtatttaaatgacttagaaccaataattctatatatcttatataattttgcagtcttacatgctttttccagttaaattttggagggctcatctgaatgtcacagtaatcaaaagtagacattctatgtctactgagattttttttttaatggctacagtaaacaatcagtttaaatctttttttagactgccaagctaaaattatcgctcatagattttatggcacagaacttaaggacagcaatttacatcttgcagtagtgaaccctgggctgttttctcraaaaaagtactgtaccttgaatggaggaatatctacaaccttgcaaaaagttccttaatttttcctaagaggttatcattttaacccacctggctgttaaggcagaggatctgaatttggcaacatagaagagctacattcatggttcttgccagagattagaacctcaaagtatctgcagaccaaatatcattaaatgttcagttgttagaaataatacatataaaggacaatgcatatgatcaatacatctctcttgatacactatattatgactttggaccaagagcagcagaaagc

SEQ ID NO: 56304 - DNA, 601 bp, Human
tttctcttagcaacgcattataatctacagaataagactcctacttctggactacattttgatctctgattttgcatatccttagaaaggaatatttttatctttagaaaggaagactgatgcagtagataagcacatctttggtgtcagaaagtccaaaaatcttagctataccttttatcaattgtgtgactttgagcaagatgtttaatctctctgaatctaaatctgtgttttaaaagaatatatcttcctaaggtttgttcattttattcaacagatatctgagctcttattatgyatcagcctctcttctaggcactgcacacacagcattgaaaaaacagacaaaaatctccaacctagtgaagcttgcattccagtgaggatcctagtgaagcttgcattccattcaggaaaaaaaaataagtaaattagatattattaatgagttggaaggtcatgattactatggaaaaagtagcatagatacaaaggtctagggtagagatgaggactgtgtttaaataaggatggttagtataggcctcagcgaggtgacttttgagcaatgactttaaaagggcaagaacatgagctg

SEQ ID NO: 56305 - DNA, 601 bp, Human
ggactaaaccccacgacttggattaagtctatggggagctccactgtagtaaattttggaattatgtttctctgtttaatcggcttgtttttagtgtgctggaccagtcaaagaatcctgcgtcaaaaccaagaaaacgaacaagccttcagcaccatggcacatttatataaaaagaaagggagagatgttgcgagaaatcagggaccccgaatggagggaccagctggagccgtggcagaggaacataaactgtgaagatttcattttaatatggacatatatcagttcccaaataatwcttttataatttcttacacctgtttttacttcaatctctgaacataaattgtgaagatttcatggacatttatctggacatttatcagtttccaaataatactcttataatttcttatacgtgtcttaatctcttgatcctgttatctttgtaagatgaggatgtacatcacctcaggaccactatgatatttgtattaactgtacaaattgattgtaaaacgtgtgtttgaacaatatgaaatcagtgcaccttgaaaaagaacagaataacagtgattttcaaggaacaagggaagat

SEQ ID NO: 56306 - DNA, 601 bp, Human
ccccctcagtacatttaattaatgaagtgttacaacgaattctcaaaagatctaagagatttgttttcactttaatcactgtgatcatgggcctaattacagtcattacactggccaccactgccagaatggcattacatcaatctattcaaacagctcattttgttaatgattggcaagccaattccacccaaatgtggaattctcaacaaggcattgatcaaaaattggctaatcaaattaatgatttaagacagtctgttatttggcttggggatcggctaatgagtctcaaacatcrcatgcaaatgcagtgcgattggaatacttctgatttctgtatcacaccatattcctacaacaagactgatcattaatgggaaatggtcaaaggacaccttctgggtagggaagataatttatccttggacataactaaattaaagaaacaaatttttgaaggctctcaagctcatttatccattgtgcctggagctgaggcgttagatcaggtggcacaaagtctttctggactaaaccccacgacttggattaagtctatggggagctccactgtagtaaattttggaattatgtttct

SEQ ID NO: 56307 - DNA, 601 bp, Human
agacctgggaatcttccccctcagtacatttaattaatgaagtgttacaacgaattctcaaaagatctaagagatttgttttcactttaatcactgtgatcatgggcctaattacagtcattacactggccaccactgccagaatggcattacatcaatctattcaaacagctcattttgttaatgattggcaagccaattccacccaaatgtggaattctcaacaaggcattgatcaaaaattggctaatcaaattaatgatttaagacagtctgttatttggcttggggatcggctaaygagtctcaaacatcgcatgcaaatgcagtgcgattggaatacttctgatttctgtatcacaccatattcctacaacaagactgatcattaatgggaaatggtcaaaggacaccttctgggtagggaagataatttatccttggacataactaaattaaagaaacaaatttttgaaggctctcaagctcatttatccattgtgcctggagctgaggcgttagatcaggtggcacaaagtctttctggactaaaccccacgacttggattaagtctatggggagctccactgtagtaaattt

SEQ ID NO: 56308 - DNA, 601 bp, Human
ccgctcctctccctatcaatgtacattcaaacattatgctttgtttacctccaacctgactcttcctatatagagttgtgttaagcctccttacatgctattagtgggaaatatcaaaatttggacaaacaatcaaactgtccaatgcattacctgtcatttatacacttgtattaactcccgttttgactccaggaaaagtacaatgttggttcgagttcaagaaggaatctggatatcggtaactttacccagacctgggaatcttccccctcagtacatttaattaatgaagtgttamaacgaattctcaaaagatctaagagatttgttttcactttaatcactgtgatcatgggcctaattacagtcattacactggccaccactgccagaatggcattacatcaatctattcaaacagctcattttgttaatgattggcaagccaattccacccaaatgtggaattctcaacaaggcattgatcaaaaattggctaatcaaattaatgatttaagacagtctgttatttggcttggggatcggctaatgagtctcaaacatcgcatgcaaatgcagtgcgattggaatacttctg

SEQ ID NO: 56309 - DNA, 601 bp, Human
tctgagcccagaacacccagacctttggaaattggctattgccatgtccggactgcgagtatgggaaggggaaacttttctgtctgttgtccccactaccacccctcacatccgtgattctgaccaccaagataaatcccctttgaatccttttcctctttttgatgccaatacccctttatgggacttcaattggcattatgataattcttctcaacccaggtatgcccctctacttctttggcatccccaggcaccttggattgcttctttacgggagagaacatcaggcattgccacygccgctcctctccctatcaatgtacattcaaacattatgctttgtttacctccaacctgactcttcctatatagagttgtgttaagcctccttacatgctattagtgggaaatatcaaaatttggacaaacaatcaaactgtccaatgcattacctgtcatttatacacttgtattaactcccgttttgactccaggaaaagtacaatgttggttcgagttcaagaaggaatctggatatcggtaactttacccagacctgggaatcttccccctcagtacatttaattaatgaagtgtt

SEQ ID NO: 56310 - DNA, 601 bp, Human
gctggttaattttttaaaaaaccaaaatagttatgttgatacatggctctaataagatatttcttcataaacgcagaacttatttatcattcattattttaggtaacaactatacaaattaatgttagaaactgctcaaaatcctatagaataaactttttaccaaataagtgttgcaaaaaagctttaaattgtagttacatcagaaacactgagccgggcgcagtggctcacgcctgtaatctcagcactttgggaggccgaggcaggcggatcacgaggtcaggagatcgagaccaasctggctaacacggtgaaaccccatctctactaaaaatacaaaaattaatcgggcgtggtggcagttgcctgtagtcccagctacttgagaggctgaggcaggagaatggcatgaacctgggaggcggaggttgcagtgagcggagatcgcgccaccgcactccagcctgggcgaaagagtgagactctgtctcaaaaaaaaaaacaaaaaaaccccaaaaaacacaacaacaaaaaaaaccactgacacattaacacacaggatttgcgtgtgagaaaccactgacaactagaaaagtca

SEQ ID NO: 56311 - DNA, 601 bp, Human
agctggttaattttttaaaaaaccaaaatagttatgttgatacatggctctaataagatatttcttcataaacgcagaacttatttatcattcattattttaggtaacaactatacaaattaatgttagaaactgctcaaaatcctatagaataaactttttaccaaataagtgttgcaaaaaagctttaaattgtagttacatcagaaacactgagccgggcgcagtggctcacgcctgtaatctcagcactttgggaggccgaggcaggcggatcacgaggtcaggagatcgagaccawcctggctaacacggtgaaaccccatctctactaaaaatacaaaaattaatcgggcgtggtggcagttgcctgtagtcccagctacttgagaggctgaggcaggagaatggcatgaacctgggaggcggaggttgcagtgagcggagatcgcgccaccgcactccagcctgggcgaaagagtgagactctgtctcaaaaaaaaaaacaaaaaaaccccaaaaaacacaacaacaaaaaaaaccactgacacattaacacacaggatttgcgtgtgagaaaccactgacaactagaaaagtc

SEQ ID NO: 56312 - DNA, 601 bp, Human
tgtagtcctagagctactcgggaagctgaggcaggaggatcacttgagctcagggtgtttggggccacagcaacctatgatagcattccagcctgggcaacagagcgagaccatatgtctatttttagacccaatgtctctatttttttttttttaaaagaacagaataaaaaacggacaagtgtgggtggcccatgcctgtaattccagcagtttgggaagccaagatgggaggatcatctgagctcaggagtttgaaactagcctgggcaacatggcaaaaccctgtctctacaaaaawtacaaaaattagccaggtgtggttgcgcatgcctgttgtcccagctactcaggaggctgaggtaggaggatcacctcagtcaagcaggttgaggctgcagtgagctgtgatcgtgccactgcactccagcctgggcaacagagtaagaccctgtatcaacacaacacaacagaacacaaaagtactaggcaattttcctttaagagccccagtgttctacaagacagacaggaaggaaaatgtctagagcttatattgaacagacattgacttggagcattatatgcatctaacaaccag

SEQ ID NO: 56313 - DNA, 601 bp, Human
cgggaggctgaggcaggagaatcacttgaacccgggaggtggaggttacggtgagctgagatcgtgccactgcactccagcctgggcaacaagagcaaaactccatctcaaaaaaaaaaaaaattagctgggtgtggtggcacacatgtagtcctagagctactcgggaagctgaggcaggaggatcacttgagctcagggtgtttggggccacagcaacctatgatagcattccagcctgggcaacagagcgagaccatatgtctatttttagacccaatgtctctatttttttttttttaaaagaacagaataaaaaacggacaagtgtgggtggcccatgcctgtaattccagcagtttgggaagccaagatgggaggatcatctgagctcaggagtttgaaactagcctgggcaacatggcaaaaccctgtctctacaaaaattacaaaaattagccaggtgtggttgcgcatgcctgttgtcccagctactcaggaggctgaggtaggaggatcacctcagtcaagcaggttgaggctgcagtgagctgtgatcgtgccactgcactccagcctgggcaacagagtaagaccctgt

SEQ ID NO: 56314 - DNA, 601 bp, Human
acagactttcaatcaatcctcctgggtcctgcatcacttgcatgcctacttcgagggatacctgctgtctccagttattgaacctttttagggggtcagaagtacagagagcctgcttttaggcttcccatgttactgtcatccatcttctaaaatgtagttgctattttctcttttccctttggagtgcatgtctatcttatccctttccttttatccttgtgggatttattaaggaggcaacggtaaacagatataatctgctacaatttgctgaagtcatcactaaaatttttacaamggcataaaaagttttaaaaatcaaatttagaagtaaactcaaaattcatctattttataactacgatatttgtatcaaagatgatcaatttactgtaataacttcagcttcatgaaggcagagatcattttcacttcatttattattgtattgtccagtacccagcatagtagaggggataaataaatatttattttataagtaaactgaatgaatatagatgcgattaaaaaattaggatctttaatttttataatttcagcacttatctcactcacctaggactgctttagcaatata

SEQ ID NO: 56315 - DNA, 601 bp, Human
gtgaacaggggcagagataggatctgggggttacctgtttcttacacagactttcaatcaatcctcctgggtcctgcatcacttgcatgcctacttcgagggatacctgctgtctccagttattgaacctttttagggggtcagaagtacagagagcctgcttttaggcttcccatgttactgtcatccatcttctaaaatgtagttgctattttctcttttccctttggagtgcatgtctatcttatccctttccttttatccttgtgggatttattaaggaggcaacggtaaacagatwtaatctgctacaatttgctgaagtcatcactaaaatttttacaacggcataaaaagttttaaaaatcaaatttagaagtaaactcaaaattcatctattttataactacgatatttgtatcaaagatgatcaatttactgtaataacttcagcttcatgaaggcagagatcattttcacttcatttattattgtattgtccagtacccagcatagtagaggggataaataaatatttattttataagtaaactgaatgaatatagatgcgattaaaaaattaggatctttaatttttata

SEQ ID NO: 56316 - DNA, 601 bp, Human
cttctcagagaaaactcctccagactcctgcctgggaagccactgtgctcagtgaagtgctagaaagccgccgagggagtttgcacagttctgtgtgtccattttcaccatacctgtcattttctgtatggtatcctcatccttagctgtgcccattgtccctgaatgcacagaccttgtcagtcttcccttagggtgaggaaggcacagctgcctatgtgaacaggggcagagataggatctgggggttacctgtttcttacacagactttcaatcaatcctcctgggtcctgcatcacytgcatgcctacttcgagggatacctgctgtctccagttattgaacctttttagggggtcagaagtacagagagcctgcttttaggcttcccatgttactgtcatccatcttctaaaatgtagttgctattttctcttttccctttggagtgcatgtctatcttatccctttccttttatccttgtgggatttattaaggaggcaacggtaaacagatataatctgctacaatttgctgaagtcatcactaaaatttttacaacggcataaaaagttttaaaaatcaaatttagaagtaaa

SEQ ID NO: 56317 - DNA, 601 bp, Human
ctggagtcccagctacttgggagtctgaggtgggaggatggcttgaccccaggaggcagaagttgcagtgagccgatcttgccacgctgggtgacagaccaagaccccatcttttaaaaaaaaaatacaaaaacaaaaaacccagaaataattatatgaatatttgacaaatatctctagaatacaggctcaggagggtaaggaatttgttatgttcaccattatatttgtagggtctagtgcaatacctggcaatggtaagtactccaagattttttgaattactaaattaatatatatmcagagataagtataatatcatgagcagaaacatcaaacatacataaaaagtaaattcctgaagattaaatatatttcccagaccaaatgaggccagaatttataatataaaattgtgatatactgacagaaaggcagattttggtggaagattacttctgttttgaaaatgttcagtttgaggagcctgtgaaagtgtcaagtggagataaaacattcacatatttgggtcttgagcccagaagagaaggttggccaagagaaggctgggaatgagcagcatgtaagaagagtacagcat

SEQ ID NO: 56318 - DNA, 601 bp, Human
tccctactatacttgtcttcttgcaacttattgctatctaacatactacagaaatacttatttcttattgtctgcctccccgtgtaaaggaagaatttgtgtccattttgctcattcattgcaagatctcaacactgagatagaacagtgcctggatcacaggagacattcaatgaatattcactgaattaatggaaaaaattataaaattttcataactgaaaatgtgaagagtgggcacataaactcagttatattattttctatttttattgtgctttatagcataaaaatttaaagwgaaatttggaaaatataaacatttattattcacatttatgaattcttattattctaggatatcttttgcccttatggactttaaagtccctgacactcagcatagttctgaatcattttcctttctttcttagaaaatagataaaaataaactgtgactgctaaatatagttatcaagtaaatttaaaaacacatatttaacattatttgaacaaatgaaatatatacttggaagtttctgtgaaaataatctcatttcaaaagttgtccctgcttgttctgtgttgttactcacactga

SEQ ID NO: 56319 - DNA, 601 bp, Human
tctgctatgctcttcacagaatttcactattccttttaacagaaaaccccaagttgtctacatatgtggaagacaataaggctactgctattctctttcctaaggttaaaactgagccaatcaatgctcaatcttcagtccccatcttatttaacctaacaatagcatttgacacagttaatcattttcatccttgaaacattttttcacttgtcttctgagacaatccaccttgttttccaaattccaaattcatagatccagaccagacttctctcccaaattccagactcatatagcycactgcttaacatctctgctgtgtgtctaataaatgtctcaaacttaacctgtccagctgaacttctcctcttgtaaccccagatagctccccatcagcagcctaccccatattagttgatggaaatttcatccttccagctgttctggccaaaaaccttggggccacactagatttcttctgaattctcataccccacatctaactcatcaaaaaattccattagatctaatgtcaaaatagtcctaaaatctgctactccatagtctaggccagttccatctcttgctgggattactt

SEQ ID NO: 56320 - DNA, 601 bp, Human
atcagtgtatctaccccacttccttttgaggactattctaactagtgtatgacatctgtaatttctcccatcttaggggaaaaaaccctcttttcatcctcacttcatcctctgctatgctcttcacagaatttcactattccttttaacagaaaaccccaagttgtctacatatgtggaagacaataaggctactgctattctctttcctaaggttaaaactgagccaatcaatgctcaatcttcagtccccatcttatttaacctaacaatagcatttgacacagttaatcattttcawccttgaaacattttttcacttgtcttctgagacaatccaccttgttttccaaattccaaattcatagatccagaccagacttctctcccaaattccagactcatatagcccactgcttaacatctctgctgtgtgtctaataaatgtctcaaacttaacctgtccagctgaacttctcctcttgtaaccccagatagctccccatcagcagcctaccccatattagttgatggaaatttcatccttccagctgttctggccaaaaaccttggggccacactagatttcttctgaattctc

SEQ ID NO: 56321 - DNA, 601 bp, Human
cgaatcagaattacaatgagatttcaccttacactcattaggacagccactataataacaaaaacaccaacataacaagtgttggcaaagatacggagaacctggaactttttagcactgctggtgagaatgtaaaatggtgcagctgctatggaaaatagtataaatgttcctcaaaaaattaaaagtagaactaccatatgatctagcaatcccccttgtgggtatatatccaaaagaattgaaggcaggcctcttgaagaaatatttgcacaaccacgttcactgtattattcacaayagccaagaggtgagagcaatccaaatgtccatcaacagataaacgaataaacaaaatgtggcatataaataccatggaatattattcagccttaataaagaaggaaatcttgtcacatgctacagcatgcatgaaccttgagaactatgctaagtgaaatagtcacaaaaataaaataaatactgtacaactccactgacatgggatatcataagtagtcaaactcacagaaatagaaagtagaatggtggctgctgggggttaggggacgggggaaaaggtatagagttttaattttgc

SEQ ID NO: 56322 - DNA, 601 bp, Human
ttgggaacttagttatatgacagaagttgcatttcgaataagcagagaaaagattaactgactagtcaacaaatacttaaaaggtaattgggttatttgtattaaaaatataaaatatttccacctgattttataccctaaatgtaagacctagaactgtaaaaatcctggaagaaaatacatgggaaaagcttcatgacattggatctggcaacgatttcttagatatgacaccaaaagcacagacaacaaaagcaaaaatagacaaatgggactatatcaaatttaaaaacttctgaawatcgaaggaaagaaacagaatgaaaggcaacctacagaatgggagaaaatatttgcaaatcatatatctgataaggagttaatatctagaatatataaagaactcctaaaaacaacaaaacccacaaataacctgattttaaaatgagcaaaggactctaatagacatttctccaaagataacatacaaatggttaacagcatatgaaaagatgctcaacatcactaatgattagagataaacgcgaatcagaattacaatgagatttcaccttacactcattaggacagccactataat

SEQ ID NO: 56323 - DNA, 601 bp, Human
atattccagtttttaaaggtaattcttataattgaaacaaaatgtataaatagaaataagtctaataatatatgtataaaatattacagataatagtacaaaatatttttgaaagacataaaaaactaaataaatgagaagatctgaacattcactgatgcaaattcattgactggaagggtcaatattcaaaaattgcagttccctccaaattaatttatatattcgattccacaattcatgtggaggaacacaaaaagccaagaatagagaagacagtgaagagggaggacgaaggtcrggggaaaggagagggaggtagggtgagggtgaagaggaaaaagatctcaccttttcagaatcaagacttactataaaatgataggcttttttttcttttcttttttgagataaagtcttgctctgttgtctaggctggagtgcagtggcatgatcgcagctcactgcaacctcaaattcctgggttcaagtgaaccttctgcctcagcttcccgagcagctgggactaaaggcatgcaccaacacactcaactaattttttaaatattttgtagagatgaattcttgctatattgcccag

SEQ ID NO: 56324 - DNA, 601 bp, Human
aatgtactttatcttacataaaccattctaaatccatttcatggtgctaggacaaccttgatactaaaatgtgacaaatgcaattttatacaggaaaattataggtcaacttagaaaataaaatcctaagtaaaatattagcaaataaaatccagcaatgtataaaaaatacatatcatggaaagttaagtttgttccaggaattgaaagatggtctaacactgaaaaaggaaacaaaaatctattcatataattcacatcattatgtggttaaagagaaaaaccataagaatttacttayaacaataaagatactaaaaatataatttatctaccaaaaacctacagcaaataccatactaaatgactaaaatacatgttctttaatgtaaaaaatacatatacacataaaacttggtagacaaatcaataaaaccaagccaaacctaaacaaaataaccatccccaaacacacagaaactaaaaggtatgagaaatgaaaagaaacaaagccattattacttacaaataatggttctgacttttttctttttaatgtagtcatctatacaaaaatccaagtcaatctataaatttgtgc

SEQ ID NO: 56325 - DNA, 601 bp, Human
agaatcaaatagagctgtgcaaataaagaaacgaggcaataaaaaaggcagactaaacgtattagacacagctgaagaaagacagtaaattagaggatacttttgcaacattctggataatcttctcaagacttagtaaaattgctgggcatggtggctcacacctgtaatcccagcactctgggaggctaaggtgagcggatcacttgaggtcaggagttcgagaacagcctggccaacatagctcaaatcctgtctctactaaaaatgcatggtggcacgtgcctgtagtcccagctaytcaggaggctgaggcaggagaactgcttgaacctgggaggtggaggttgcagtgagcagagatcgcaccattcaactccaacctgggccacagagtgagactctgtctcaaaaaaaaaaaacaaaaaaaaagacttagtaaaatttactaaagacttagtaaatttgagaaaattatccagaatattgcaaaagtcctaagcagattaaataaaaatatattcctgattggccacattctatttcttcacttgagtggtggttacaagggtgctgtcttataataattcactgagccata

SEQ ID NO: 56326 - DNA, 601 bp, Human
taaaaaagaataaaaatttttttttctaccttaccatcttgtgtaggtttgacaacgctaatgttatgtttaacgatggtaaacaaaactgtctttaaaaaaagattatttcttaaagatagatgtttcctttttatagaattttaaaaattcaaaagggctaatatatcatgcctgaaagttaacctaaaaattattttttagataatcaattatgcaattacgtagctcatttattatctcaacttagaggaagctcacaaccaccccaagttaagtgcttaaaagatttttcttctaycttttccaagtaatttttggcctctcttatagttcattttagcttatctggtgctttgggggaggagttgatagggtatacattaataaatatttatttatttgatagaaattccagaatatagaaaaactaaagcttaaatgttgagaagtcccaatcactgagaatagtagtaaataaagacaaacatctcttaattctctcaattattttaaacccttgccatcttacccagttctaaacctatatttgcttcctcctgtgttattccctctgggttctaacttttaggtctctgcc

SEQ ID NO: 56327 - DNA, 601 bp, Human
aatggcgaacagataacttaaataatacattactttgaaccatttcaaacaaaaaatacggaaagtatgcagagttcagggaagatcataataattaatgaatggaaaaattcaatgatgataaaaagcctgagctaattaagacactggggacagataatggcacatttatctaaatgatacatacaagatttatgccaggaaagatactcagaatgattattttgaaaggaaaatgtagtgtaggataatttagttatcacattgtttgtaaatttctgtcacacacacacacacacaaaaaaccatgaaattacaggttgacaccatgacaaagtggataattaattgattaaagggaaggaatcctatttaaattcttgaaaagtctatttgctttagttgtaaggttttaaacaatctgattcaggctctctttctctttctaaaaccagaatgccaattgattgatataaagggaataaaagcaatttaaatgtgaacattactttgttcagaatattcttgccatcataagaaatatacttctctccacactcagacctacagtggaaaggaaaattattttataaagattgcc

SEQ ID NO: 56328 - DNA, 601 bp, Human
cctcccaaatgctatataaataaatgttcttaggacaaggactttaccctctatttctctttctccttaggagtaaagaattattcaacaaatagtccactgattaatgaaatcaattccctgcagtccgtgggccagtacttcccagtcttttacctgaaataagcacctgccagacttggaaagaaaacagcagcatggaaacaagtgatacccgtgaagacagcatggagtaactttccagtaactctgtatttgatcccagtccaacctcacagtagcattgagtcccaggcaagtyacatcctagtttcttcatctgtaaaactgcatatgctaccacttatttttcagggttctgaggattccagaatacaatgtgggtgacttctcagcacagaggctggcacacagcggtccccaggtgaacggtgctgttgatgtcactctatagtagtctgtcttcctttagctatgagacaggctgtcacttcacttttggtgttactgagttcttccttgatccacttaacctgtgtttccctaggccacaccagccaggtcattaataataataaattgagattatttggctggtatc

SEQ ID NO: 56329 - DNA, 601 bp, Human
tgatgggagaggtacagatacataggcagacaggaaataagcaaggatgatgaaatattcatggtagaatttaggtagtgagtgtgtgagtgtccactgtaacaaatgtttgaaaacttttataataaaatgttttagaaaaagtaaacctatgaagctttgtacatgtgtttttgtgtgttcactaaaatataacaaagacctgtctcaaaaaaaaaatcactgacctttaagcacaagtcttagtaacaataggcgatgctcacttcttttattattatcattattattattattattwtttttttttgagacagagtctggctctgtcgaccaggctggagtgcaatggcgcgatctcagctcactgcaagctccgcctcccaggttcacgccatcctcctgcctcagcctcctgagtacctgggactacaggcgccctccaccacgcccggctaattttttgtatttttagtagagacagggtttcaccgtgttagccaggatcgtctcgatctcctgacctcatgatcctcccacctcggcctcccaaagtgctgggattacaggcgtgagccactgtgcctggggatgctcttaa

SEQ ID NO: 56330 - DNA, 601 bp, Human
ctatgatgggagaggtacagatacataggcagacaggaaataagcaaggatgatgaaatattcatggtagaatttaggtagtgagtgtgtgagtgtccactgtaacaaatgtttgaaaacttttataataaaatgttttagaaaaagtaaacctatgaagctttgtacatgtgtttttgtgtgttcactaaaatataacaaagacctgtctcaaaaaaaaaatcactgacctttaagcacaagtcttagtaacaataggcgatgctcacttcttttattattatcattattattattattwttatttttttttgagacagagtctggctctgtcgaccaggctggagtgcaatggcgcgatctcagctcactgcaagctccgcctcccaggttcacgccatcctcctgcctcagcctcctgagtacctgggactacaggcgccctccaccacgcccggctaattttttgtatttttagtagagacagggtttcaccgtgttagccaggatcgtctcgatctcctgacctcatgatcctcccacctcggcctcccaaagtgctgggattacaggcgtgagccactgtgcctggggatgctct

SEQ ID NO: 56331 - DNA, 601 bp, Human
cttcacaacataaaacactcttaacaaattcaggtaagggaattgagcactcagatttaaaaggacaaaagagaacaaccatctttacctcactcctcttcccctgagtgccagcaaacctaaggggcccataagaatgcagagggaagtccaccgagacaagtggggtcagacccacttggagatggttcaacccttgatatctagaaatgggcactacagctggggattttcatggggtaaaagtacctgcttcaatgtttgctgctataaaacagccagacaagccctatgaggcagrtagagctcagagatggagtaaaatccacaatttattatggaaaataaaaacataagatggtaataaagtttcttgatgagaaatttattctaaggatacagaagaaatcaatccaatccaagtgtacctttctccctcttaacaaccagatcaataatttagtaagaaatattaaaaggattgactgaaattaagaaccttaacacaatatatatgaagacagttactccattaattgggtttgcaaaaagattccctattgtgcattaaaatattaataaccattatggaacaacaaca

SEQ ID NO: 56332 - DNA, 601 bp, Human
cctacaggtctcctactaccacattttttcaaatctaagatgccattactgatagtaagatacacaattattttatgtatcattaagaagaaaaaagtattaatcataagaatataagatgatggccactgtaacatgcatactgatttcagtgacagtaaaatatgaaaatgtgcacttcttggttgataaaatttagtaagtttaatcaactaccataaattttttttttttttttgagacggagtctcgctctgtcgcccaggctggagggcagtggcgcgatctcggctcactactrcaagctccacctcctgagttcacgccattctcctgcctcagcctcctgagtagctgggactacaggcgaccgccaccatgcccggctaattttttgtatttttagcagagacagggtttcactgtgttagccaggatggtctcgatctcctgacctagtgatccgcccaccttggcctcccgaagtgcttcagaaaggtgttaagccaaaaagaaaacaaacaaaaaacccaaaacaaaataattacaggtgtgagccactgcgcctggcccataaaatgttttttattatgctgtcttg

SEQ ID NO: 56333 - DNA, 601 bp, Human
gcatgtgcacaggatgggaaattacctgaaacagcttctcagaactctggggcagggctgcgggagaataagtgggatccatttctgtgaactcttctgcaaagttactcacatctaattcatctcgaatgactggcttaaatggtgcaggcacttttttggcggctaaatcatcccaatttattttctaaaacaaagaaagttggtacaaagtagaaatcaatagtcaaaatgtactttctaagaataacaaagataaattaggattttgactggtagggagagaggataaaaataagakaacatatttcaaatcaataataaaaaacatattttctccaaacaagatcacagcagtttatagctccaaccaatgctgtgcctcaaagatgagactatcgctgttgaatctcagagtgtcctctggggggcaccaagacaccctagtttacctttaaagacaacagaagaatacttttgtcctgagcctcctcagaaaggtgttaagccaaaaagaaaacaaaaaacccaaaacaaaataaaaaactgaaataaagggtttccaaaggctctacagatgtggatattagctctaaaagaa

SEQ ID NO: 56334 - DNA, 601 bp, Human
atggtgggtagaagcggcactggcaacaagcacattgtagccagtgactgcaccactgagctcctggccctccgtcttcctgtcataggtggttaactgctgagtgagaaaagcatgagaggtgaagggataacctgatttggggttgggaaacagtgtgtggttggggaggggtttgagagggtggtttcactgccctttctggtggctgggtgatgttctatatccctgactctgacccagcagcaccaacaaaacgcgtgaaaagtacaaccctgtaagtgaattagtacacatgggraaaaaaaaaaaaaaaaagtaggatacctgatcatgaaaaacttcatgcaacttcacaatattggggtgtccttcacagagtttcagagctgttatttccttttgagtattggcttccatcctgcaagatgagacacttagcatccacatgtctcttcaagaaagtttttatatcagtactgccccaagactaattttgtcttatttacagtgcattcagaatatacatgttacagtatactgtaatgaggtttccatgaaagtaatgaattataccacacactagaaaaagtaatattct

SEQ ID NO: 56335 - DNA, 601 bp, Human
agaagtgaaagggaagttggaggctcaaaattcctgagtcctgagaggtactccaggattaagtgatggtgggtagaagcggcactggcaacaagcacattgtagccagtgactgcaccactgagctcctggccctccgtcttcctgtcataggtggttaactgctgagtgagaaaagcatgagaggtgaagggataacctgatttggggttgggaaacagtgtgtggttggggaggggtttgagagggtggtttcactgccctttctggtggctgggtgatgttctatatccctgactckgacccagcagcaccaacaaaacgcgtgaaaagtacaaccctgtaagtgaattagtacacatgggaaaaaaaaaaaaaaaaaagtaggatacctgatcatgaaaaacttcatgcaacttcacaatattggggtgtccttcacagagtttcagagctgttatttccttttgagtattggcttccatcctgcaagatgagacacttagcatccacatgtctcttcaagaaagtttttatatcagtactgccccaagactaattttgtcttatttacagtgcattcagaatatacatgttacag

SEQ ID NO: 56336 - DNA, 601 bp, Human
taagacaatacatgcagagtgcctggtacagaacctagaccacacaagatatgtgataataaatggcagcagctattatggttatggtgctactgctgctgctgcctggtctcaccatgatgtatcattcctggcaatagcactcgaggatatttcaatgtggtagagaactgggccccatcgatcctaggtcacagatattacaacagcacaacaaagagagcccagaactggagtacaggttctccttattagattcgcattgacatgctatgtgaccttagacaagttttatgaacaytcaaaatctcagtttctttattggtaaaattagggcaaagcacattcaggattggtttgtgctcttgtgcctccaagttgtcttaagtaggactgcatcaccccacctggtctcaggggcagagaagtgtaatggagcaatttctgtcatgtgtgaggtgaacagacacgaactggacacactggcatcctcccatagttcctgctgcaaagcaggactgagagcagaagagggggcagcatgatctggccagggttctgagcagaatttaccacctggagctagaagataaaaggagta

SEQ ID NO: 56337 - DNA, 601 bp, Human
tatattttagtaactcctgaatatataaatagcaaaacatctacttaatttgtgacacaaataaaaaattagaaatgttgttcatgggacctgacattagtctgaaggtcagagatcaagtatcttgtctgggatgtagttatgggcacagctgcaaacccagaggagagcatctaagatcacccgttgattccttgaatgatgtgaatttcctctatatcatcttcaacaggagactgtctagtgagcctcttcttaagcaccttcgtggccaggggactcattacctcctcttgtgtcragtggcttgatgaggcaagaggaggtagaggatcagggagagcggttccccctgagtccttgcttcagtggcatttcttttctgactacaagaaccaaagagtgagtagaggatgatgccattttgggatgcttactgccagatgtgattctgccttccctaaggcagtagtttaaagtaaataaaagcttgttgggctctgaagttggactgtgtggattcagatcccagccttaccacacttaccaactgtaagacctgttacttaacttctatgagtgtccattttctcacctcatg

SEQ ID NO: 56338 - DNA, 601 bp, Human
tcaagagggaaccagctctggtgacagcttgactttaagccaatgggcctgattttggacttctgacctccagactgcaggataataaatttgtattgttttaagtttgtggtgatttgttgcagcagcaatagcaaactcatggagtacgtgaaacgcatatcatggcacacaaaatgaactatgctattgcacaaaggctgaagacccaccataaccaatttcacccattagttgaagaaaagactggatacagggatgatctaggcaactgtgccaccattatgagaaaacccaagayacattacaactgcatattagattgataatgtatttatactagtttgtataggattatatcatgtgacaatttatattttagtaactcctgaatatataaatagcaaaacatctacttaatttgtgacacaaataaaaaattagaaatgttgttcatgggacctgacattagtctgaaggtcagagatcaagtatcttgtctgggatgtagttatgggcacagctgcaaacccagaggagagcatctaagatcacccgttgattccttgaatgatgtgaatttcctctatatcatcttcaa

SEQ ID NO: 56339 - DNA, 601 bp, Human
gggagaatcacttgagctcgggaggtcaaggctgcagggagccgtcactgtgccactgcactccagcctgggtgacagagaccctgtctcaaaaaagaaaaaaagcaaaggacttaatcagctctcaaatgaacacaaatggtttagaaaaagatatcatggcaatatactgaattcaggtgctatgcattataaggccaacatcacttcacaaacaaaatgtttctttctgtattagcaaaactcagaataaactgcttcataaaaaagacaattataagtacattatcctgaaagcatkagacaaattgcagagtgaacaacccttctaacaagaaaattgctcccagcctactagacatcaagctaacttgagtttctacatcagataaagttgagcttgcaggtctgctacaactgtaggctggtgagctttaaaaaagatgtaaggcaatacttgcagtggtgtacgaacagatttagagttcaacctggatttgaaggtcagttctgttatttattcatgatcttgggatgctactttatcttattaattctaggatccttatcaataaaatgcagatagcaatgagaaaatgta

SEQ ID NO: 56340 - DNA, 601 bp, Human
gaggactgcttgaggtcaggagttcaagaccagcttggtcaacacagtgagactgtctgtacaaaaaaaattaaaacataaaagtttaaaaaggtattgtttgatattgtcattttgaacctcctgttaggactcaacagattagtttcagggttcctgttaatattcattacaaatacccataactcactatgggtttttgctttaatcccaacaatattatcttaatagttactttgtaagttatatgtttaccatcctttctcttcttctccacccaggctcttttctgtcagaatgsataatttccaaaaaataatacaggaattatcaaaaagcaaagggctatagatcccagcacatttagaggccagggtgagaggactgcttgagcccagaagctcaagaccagcctaggcaacatagtgagacctcatctctacaaaaaataataacaaaaattagccagacatggtggcgcacgcctacagtcccagctactcaggaggctgaggtgggagaatcacttgagctcgggaggtcaaggctgcagggagccgtcactgtgccactgcactccagcctgggtgacagagaccct

SEQ ID NO: 56341 - DNA, 601 bp, Human
atttagatcacttccatttgtcattgtaaaatttgccccttaaagaaacattaattatatattatttgctgctttgtagttttcataattcttgcccgtaagtaaattattgtcatcttcccatgctattcatactgttcccccattgtcttattagctggatctctgtttatacttttcatatgtgacataaagaatataaaattgtttaagagagtacatctcaacattttttattccaagatgtacttaaatgtagaagtatttgtaagtaagtaaaataatgtggttctcacacatrtgaattaaaactgatgtatgaaaaggactagcagtgaagaaagtagaaaaggcctattctcttctattgtattctattctattgtattctgtaagtagagatggggtcctgctatgttgcccaggctggtattgaactcctcgcctcaagcaatattcctgcctctgtctctcaaagtgctaggattacaggcatgtaataggcaaggcctatttcagaaatatgataatgatttctcatctccctatctacagcgtctaacacaatccttcatacattatagtaggtactaaaaaaatt

SEQ ID NO: 56342 - DNA, 601 bp, Human
tcctgagagtttgctgaatttgcttatcagcttaaggagattttgggctgagacgatggggttttctagatatacaatcagacatgattttttaaatggtatcatatcatagagtgtgagcataaaataatgtaatcaggcatttaaaatcacaaaataatgtaatcaggcatttaaatttttctcaattttagattaccataaaaatgctacaataattgttaagcaatataaatttccttaatatatattcataaaagtgaagtagggggtcaaagggaatacactgtattaatttatrctcccatcttcagtttgtacaagcattcattttactatttttatgaacattcacaattctctttttctttttttttgagacaacatctcactcccgtcacccagactggagtgcaatagcagaatcacagctcactatagcctctgctttccaggctcaggtgattctcctacttcagcttcctgagtagctaggacgacaggcatgcatcaccacgcccagctaatttttagtagagtcagggttttgtcatattgcccaggctggtctcaaactctcctcccacgtttgcctgccaaa

SEQ ID NO: 56343 - DNA, 601 bp, Human
tagattaccataaaaatgctacaataattgttaagcaatataaatttccttaatatatattcataaaagtgaagtagggggtcaaagggaatacactgtattaatttatgctcccatcttcagtttgtacaagcattcattttactatttttatgaacattcacaattctctttttctttttttttgagacaacatctcactcccgtcacccagactggagtgcaatagcagaatcacagctcactatagcctctgctttccaggctcaggtgattctcctacttcagcttcctgagtagytaggacgacaggcatgcatcaccacgcccagctaatttttagtagagtcagggttttgtcatattgcccaggctggtctcaaactctcctcccacgtttgcctgccaaagttctgtgattacaggtgtgagccaccatgcttggcctcgcagttatctttaagaaaaaaataaatgcttatataatagtaattcattatttggctttttttttgtaattaggttgaatattttgccttatttattggttctttatagtacataattgcctatttgtgttatttgaccaattttatattga

SEQ ID NO: 56344 - DNA, 601 bp, Human
aatttccttaatatatattcataaaagtgaagtagggggtcaaagggaatacactgtattaatttatgctcccatcttcagtttgtacaagcattcattttactatttttatgaacattcacaattctctttttctttttttttgagacaacatctcactcccgtcacccagactggagtgcaatagcagaatcacagctcactatagcctctgctttccaggctcaggtgattctcctacttcagcttcctgagtagctaggacgacaggcatgcatcaccacgcccagctaatttttastagagtcagggttttgtcatattgcccaggctggtctcaaactctcctcccacgtttgcctgccaaagttctgtgattacaggtgtgagccaccatgcttggcctcgcagttatctttaagaaaaaaataaatgcttatataatagtaattcattatttggctttttttttgtaattaggttgaatattttgccttatttattggttctttatagtacataattgcctatttgtgttatttgaccaattttatattgagttaataagaattcatttaaataaaaatttaaatctttgtct

SEQ ID NO: 56345 - DNA, 601 bp, Human
ttatcaaacttcttaattctgaacatgaagatgttcaggaacaggtacgtctctaatttgtattgttgtatgtactagaattcagttttctcttgaaagtaccatttgtaattacgatgtgtaattcatttttgtttctaattgctgtatattgcattaaattgtagtagtgttttggtgttaagttagaagggaggaagaatgaacagttccagacataatcctgggttctctgtgagtgtgatcacagctagcataggaattactattcctgtttataaaagtgcatactgaggctggscatggtggctcatgcctgtattctcagcacttgggaaagctgaggcaagcagatcacttgaggccaggagtttgagaccagcctggccaacatggcaaaatcccagctctgctaaaaatacaaaaattagccaggcgtggtgccacagctcctcaagaagctgaggcacaagaattccttgagcctgggaggcagaggttgcagagagccgagatcatgccactgcactccagcctgggcgacagagcgagatttgtttcaaaaaaaaagtgtatactgagactcaaaagttagtaactt

SEQ ID NO: 56346 - DNA, 601 bp, Human
tggcagtaattattcttccatggaaattttactgattactcaatatctgctcagatatgtaccataatttgccatctgttcaattgttgtacatttggattatttctagcttattggtggtgttaataatattgtgatgaatatcattatatgtcatcactctttatgtaccttttgattattttactaggaaaaatgagtaccctgtcaaaagataaattttttttttttttttgagatgaagtcttgctctcgtcccccacgctggaatgcaatggcgcgatctcggctcactgcaacytccaccttccaggttcaagcgattctcctgcctcagccttccgagtagctgggattacaggcgcctgccaccacgcccggctagtttttatatttctaatagagatggtgtttcaccatgttggccaggctggtttcgaactcctgacttcaggtgatctgcccacctaggcctcccaaagtgctgggattacaggtgtgagccaccgcgcccggccaaaagataaaatttttaaagctcttactatgtatttcaaagtcagactccaagaatattataccaattaagatctccaccaac

SEQ ID NO: 56347 - DNA, 601 bp, Human
accaccacctcctgggtttcaagcagttcttatgcttcagcctcctgaatagctgggattacaggcacctgcaatcacacccagctagtttttgtatttttagtagagatggggtttcaccatgttggccaggctggtcgcaaactcctgacctcaagtgatctgcccacctcacctcccaaagtgctggaattacaggcatgagccactgcacccgacctactatagacaattgtatatacagtggtaagtatttgtgtatctacacatgcaaaaggtacagtaaagataatggtgttayaatattatgagactaccatcttatgtgcagtctgtcatcgactaaaatgttatgcagtgcatgattataattggaaaatttgctaaatagatgtattttgtctctccatgtaaattcatagtaaactatgctctttgttgaacagtatagatatttcactaatatgcaaggaaaactttttttttttggagacagggtttcgctctgttgcccaaggtggagcaaggctccttgcaacctctgcctcctgggctcaagtgatcctgccaccttagcctcctaagtagctgagatgacagg

SEQ ID NO: 56348 - DNA, 601 bp, Human
gcctcctgaatagctgggattacaggcacctgcaatcacacccagctagtttttgtatttttagtagagatggggtttcaccatgttggccaggctggtcgcaaactcctgacctcaagtgatctgcccacctcacctcccaaagtgctggaattacaggcatgagccactgcacccgacctactatagacaattgtatatacagtggtaagtatttgtgtatctacacatgcaaaaggtacagtaaagataatggtgttataatattatgagactaccatcttatgtgcagtctgtcatygactaaaatgttatgcagtgcatgattataattggaaaatttgctaaatagatgtattttgtctctccatgtaaattcatagtaaactatgctctttgttgaacagtatagatatttcactaatatgcaaggaaaactttttttttttggagacagggtttcgctctgttgcccaaggtggagcaaggctccttgcaacctctgcctcctgggctcaagtgatcctgccaccttagcctcctaagtagctgagatgacaggtgcgtgccaccacacccagctaatttttgtcatttttca

SEQ ID NO: 56349 - DNA, 601 bp, Human
agacagtatatttaggatgtcagtatgttttaaattttattaaaagaaccaagattttaagatagagatttttctttcaggattagagttttacttcaagtgatttatctagtagtttcttctactactttacgtatttttttaaaaaagaaattaccctataatgtaaggtcctttatagaaatgacataaaattttttgaaatacaggtttatacatattgtttatgattaagaggatctttatgtaggataaatgctaatggcaggtagtgaagaaaaatactaatcgaggagatggytagaagtaaatattttactcttcatttctgcatggaggtgcgttttccatgctctccagctgaggaattgaataggaagaatacatttctagacactagttttcaaaaaacattttactctagctttctgtggacagaagttatttcttggcatggtttcacttaaccaatattaatcgaagatctgtgtacaaaccactgaactactcactataatttcatttattatgggcttaaagttaatggtccatagtaattgagaatttagctgagctataaaagaaagtactgatttagagt

SEQ ID NO: 56350 - DNA, 601 bp, Human
gataataataataatttccaaaaagggtattaaaaagttggaaagtttcagagtttcattataaaacttcgtcttagaaagtttcaaagtatttaaaaaaataagaaaagtaattaaaaggaagttaagttagatactctctctggagttgggcaaaaggaaaaattttcagcttaaaaaatgattatgcaggccgggcgcagtggctcacgcctgtaatcccagcactttggggaggccgagttgggtgggtcatgaggtcaggagatcgagaccatcctggctaacacggtgaaacccsatctctactaaaaatacaaaaaattagccaggcgtggtggcaggcgcctgtagtcccagctactcgggaggctgaggcaggaggatggcttgtacccaggaggtggagcttgcagtgagccaagatcacgccactgcactccaacttgggtgacagagcgagagactgtctcaaaaaaaaaaaatgattatgcattatttgttgttcacattgtaattcacatttagtaatgcttaagtaaatgtaaaacttattaatgtatcattttatctgtttgagtgatattttaatttattttat

SEQ ID NO: 56351 - DNA, 601 bp, Human
aaaaattgtcaactcttagcatacaaaagcagtataactattttatttctaaatctgttgtattttggggaaatctaacatctatttttaggaaagcctttagaacagaaactttttttagtgtaatagaatacatgtaaccagtttaaccattttaaagtatacaatttagtggcagtaagtagatttacaacattgtacaactatcactgctatctagttccagaatttttttaccaccttaaacagaaacccagtacccattaagcagtcacatcccgttttgccatcaccttgtgcsttggaaactacaaatctgttttctctctctatgtatactgtatatatcacataagtggaatcatacaatatattacctttgtgtctggcttcttttagcttactgttttcaaggttcatccatattatagtgaatgtatcaggatttcgttctttttatggctgaattatattccattttatgcatgtgccacattttgttcattcattaatagatggacacttcggtgtgtccaccttttgactactgtaaatagtgctcctatgaacattcatgtacaaggttttgtctcagtactgg

SEQ ID NO: 56352 - DNA, 601 bp, Human
accaaactttttcacagcagctgtaccattttacattgtcctagcaatgtatgagtgttctaatttctctatatcatcaccaacacatattatctgttattctgatttagatcatcttagtgggtgtaagttgactttttcatttctataaaaaagtcattgtcattttgataggggtttcatttactctgtagatcactttgagcagtattgccatcttaataatattaaggcttccaattcatgaacctgggaaatcttttaattaattaaggtctttaattttaacaacattttgtasattttagtaaacaggtcgtatacctctttggttaaatgtattccaaagtattttattcttttttattcaaatgtaaatgaaattgttttcttaatttcttttttgacttgttccttggtagtgtatagaaatacaactaactgatttttgtgtgttgattatttatttttttatttaatttgagacagggtcttgctctgtcacctaggctggagtgcagtggcataatcttggcttactgcagtctgtgcctcccaggttcaagcgatgctcgtgcctcagcctcccaagtagctggga

SEQ ID NO: 56353 - DNA, 601 bp, Human
tctcagatacttgggaggctgagtagggagggtcgtttgaggtcaggagcctcctgggttcaagcggttctcatgcctcaactctcccaagtagctgggaatacaggcgtgcaccaccatgcctggctgatttttgtatttttggtagaaatggagtttcatcacattggccaggctggtcttgaagtcgaatttgaggtcaagatcatttgaggctgtagtgcactataataatgcttgtgaatagtcattgcactctagcctgtgcaacatggtaagactccatctctaaatttttttwaaaaaaagatagtttcatttcttgctttccaagttggctgtgtgaattctttttgttgcacagttgctttggatagagcttccattacaatgttatttagaagtggcaaaaatgagtgtctttgtcttctttcttatctcagagtaaaaactaactctttcaccattcagtttgatgttagctatggtttttgataaatgccctttatcctgttgaggtagtttccttctatttcttttttttttttcgagacggagtcatgctctgtcgccaggcttgagtacagtggcatgatcttgg

SEQ ID NO: 56354 - DNA, 601 bp, Human
ttacaggcgtgagccactgcgctaggcctagaccatgtaagtttttaagtgatacttctttttctttttgagacagaatcttgctctgttgcccaggctggagtgcagtggtgcagcctcggctcattgaacctccgcccccaggtttaagtgattctcctgcctcagcctcctgaatagcagggaccacagacacgtgccaccatgcctagctaatttttgtatctttagtagagatgggtctcaccatgttggtcagactggtctcgaacttttggcctcaggcgatctacccaccttrgcctcccaaagtgctgggattacaagcatgagccaccacatctgacccatgtgttacttcttcctgatagattgactttttatcaatatatgatgttcttctttgtctctgaaaacaatttttgacttacagtctagtttgtctcattagtgtaactattcggatctctgttattatttgcatggaaaatcgcttctcggccttttggctaagatcaagtgtattatttgcatggaaaatctttttctatttcactttcaacctatttatgtctttgattctaaaatgagtcatttgtag

SEQ ID NO: 56355 - DNA, 601 bp, Human
attatgatagctaaagaggaaaaatgaatgtaaggtgataattcttttttttctttttcttggcaggttattaacaaattcaaacagactcacaacaacaagaaatgccgtgtgggccctctcaaatttatgtagaggcaaaaaccctcctccaaactttagtaaggtatgagtaaaatacacaaattaaaatatttgtttccataaacctaagtttctatataatagctttttgatgtttaaggaactccactttttgtttagtaattattttctttattgaccaatgtttgcacatatrcagtattcaaaagctttacaatataaaggaagtgtcccttgtacttttcctcacacaccttaaattcctgtgcccagaggcagtcactgcaaccacatgtatcaaggaattgatttcagaaatcttctagtctagctctctcatttataggaaaataagtcccccaaaagattaaataattcctttatgttcaccatttgtactttttcattgtaacttttatctcttaggatatctgtttccctatctactgatattttgcctctagaaatacagatgattaattaattcccagtttag

SEQ ID NO: 56356 - DNA, 601 bp, Human
gatgattaattaattcccagtttagttgtattgtttaagatgctgttaggaaggtagaaagggggtaaatttttagaataccattgtacttcttttgaatttagtatctaaaatggcacaatgactctagcactaagagaagtttaaactttggtaaagatctagtgataaagtttctggggataaaaaataatacatttctaattcacaaaggtaatgcatgaactagtatgccttctcatttttacttttcatttcatttcataagatattcaaaagacacaaactcaagagttgagatttaataaaagtagtaatttttactgcctattcacgttaactcttaaataaaactggctcttccccacccactgcccttttaaccgaggtgaagaatacaaagataggtagtacattttgatactactgccgtgatttgtgctaacatgccaacagttttacctgccagtgtttttgtacctttagtgcaaatgtcaacaaaatgagaaagacgaatgatgtcttagtattattatgaaaatagttttgacatcacatatacccccaaaagggttttaggaatcccccaggggtccatgga

SEQ ID NO: 56357 - DNA, 601 bp, Human
agatgtaatgtgataattgccaaaccatcacctgacattcctagtgggtgggggagcagccctctcatgccctgcttaagcgtgtctacctactgtaacaactgccctcaccccatgagtatacctgaccttcttcatttttactctgtttctttcaaatcaccttttaacataatatatgtgtttttctatgtcttttaattttttttttcttttttttttttttgagatggagtctcgctctgtcacccaggctggagtgcagtggcacgatctcagctcactgcaacctccgcctccygggttcaagctattctcctgccccagcctcttgagtagctgggattacaggcgcatgctacctcgcccagctaatttttgtatttttagtagagacagggtttcaccatgttggtcaggctggtctcgaactcctgacctcaggcaagctacctgcctcggcctcccaaagtgctggcattacaggtgtgagccaccatgcctggcccttatttatgtattttaatttttaaaaatcttccactaaaatgtgaactcctgagggaaactttgtctgttgtttacttatgtgttccaaact

SEQ ID NO: 56358 - DNA, 601 bp, Human
tgttggtcaggctggtctcgaactcctgacctcaggcaagctacctgcctcggcctcccaaagtgctggcattacaggtgtgagccaccatgcctggcccttatttatgtattttaatttttaaaaatcttccactaaaatgtgaactcctgagggaaactttgtctgttgtttacttatgtgttccaaacttatgaaataatatcacattttggggcttaagacttgtttgttaagtacattttctgtaattttatatgagagatttgttttttaatcattcactttttttgaaattttyttttttttttcttctttttttgagatggagtttcactctgtcgcccaggctggagtgcagtggtacgatctcagctcactgcaacctctgcctcccgggttcaagcaattctcctgcctcagccccccaagtagctgggattacagacacctgccaccatgcctggctaatttttatattttattagagacggagtttcaccatgttggccaggctggtgccaggttggccagctcaagctcccgacctcaggtgatgatctgtccatctcagcctcccaaagtgctgggattacaggca

SEQ ID NO: 56359 - DNA, 601 bp, Human
cttccacttgagtacccttcacaaatatatttatttttgtactttctgtaccttagttcctcaaatgattattagatttatttccagttaagtacatgtaatgagtacagtgaggctcattaaagttagattatattctgtgatcatcatatcaaacacttaactggaacatttgaacttctcagttttggtatgctttttttgtgggggtgtgtgtgatttagacacagacaagagatctcaaatattttactattttttaaaacaaatttaactacatatcttattcaatataacatamtagtagtcataatcagcttcatattcatacatctgattataattttaaaacaatataaattttctggtatttttataacattaaatttttgttttaaaatgaatttctatatttttctaaggaaacttggttttaaatagagaaaaaatttaaatatgctctttcttcccttacaggtttcaccttgcttaaatgtcctgtcacgactgttgtttagcagtgacccagatgtgttagcagacgtgtgttgggccctttcttatctctccgatggacccaatgataaaattcaagcagtca

SEQ ID NO: 56360 - DNA, 601 bp, Human
aaccgctgaacataatcaaatattctgcaatagtgaaccacagcagaagatcccaagtcatgcccgcaaacattctggcttcaggacacatccttcattttcgatatgaatttagaataactttaaaaaatgaattgaggttttgaatctttcaccttttttttttttttttgagacagagtctcgctgtgttgcccaggctggagtgcagtggtgcgatctcagatcactgtaagctctgcctcccgggttcacaccattttcctgcctcagcctccggagtagctgggactacaggtgyccgccaccatgcccggctaatttttttggtatttttagtgaagatggggtttcaccgtgttagccaggatggtcttgatctcctgacctcgtgatctgcctgtcttggcctcccaaagtgctgggattacaggcgtgagccaccacgcctggccgaatctttcatcttgtaaaaaagaaaaacagattctgaatggtttcaaagttgacagctttttctacatataatgtcttataacatttgtaaagacaacctttccaaaacactgtgctggtgttatcatgctataattcagtcagt

SEQ ID NO: 56361 - DNA, 601 bp, Human
gattacaggtgtgagccacctgacccctccaatgccagatctaatacatgataaggcaacatctccagccctctgctaccccctctctctatccctcccctaagagtgagttaggatgatagtaaggaagagccggctctttagcactcaaggagacctcccctaccaacagtctctccaagaatggctgtcagcattagtctcactttgcccactggagcctgacttagacaacaaaatagaacggtgtgcaaagcagtatagtacagggggtaatataccatctttgtagtcaggctgyctgggactaaattccaacacacttgtcaattatgtgacttggacgagtgaattaacttctcacctgtgaaacgaaaataataatagacaacccccaccagttgttatggtgtgtaatgagataatgtttgtataaagggattaccctgaccctggcattcagctaaccaaatgtgagctttctaggtatcttttagtatcttaaccctttactctctgtgcctcatatagatttaaatacatttctggttaaatcacttggtatccaaactcttgatacttatcacttgaacctgaaaaa

SEQ ID NO: 56362 - DNA, 601 bp, Human
ggattacaggtgtgagccacctgacccctccaatgccagatctaatacatgataaggcaacatctccagccctctgctaccccctctctctatccctcccctaagagtgagttaggatgatagtaaggaagagccggctctttagcactcaaggagacctcccctaccaacagtctctccaagaatggctgtcagcattagtctcactttgcccactggagcctgacttagacaacaaaatagaacggtgtgcaaagcagtatagtacagggggtaatataccatctttgtagtcaggctscctgggactaaattccaacacacttgtcaattatgtgacttggacgagtgaattaacttctcacctgtgaaacgaaaataataatagacaacccccaccagttgttatggtgtgtaatgagataatgtttgtataaagggattaccctgaccctggcattcagctaaccaaatgtgagctttctaggtatcttttagtatcttaaccctttactctctgtgcctcatatagatttaaatacatttctggttaaatcacttggtatccaaactcttgatacttatcacttgaacctgaaaa

SEQ ID NO: 56363 - DNA, 601 bp, Human
caaggtgtggtggctcatgcctgtaatcctagtactctgggagcccgaggcgggtggatcacttgaggccaggagttcaagaccagcctggccaacattaacagggtgtagtggtgtgcgcctctaataccagttacttgggaggctgaggaaggagaatcacttgaaccggggaggcggaggttgcagtgagatcacaccactgcactccagcctgggtgacagaatgagactttgcctcaaaaaaacaaaaacaaaaacaaaaaaccagggagggaaggataaagtgggggcatggagagtgggtttggctggtggactgtagttggccagcccctggtctaaagtaaacctcaggcaatctttagagagacactttccctggggcctcaaggtcaagctaattccaaggaaggttaattcacttgaatgctggactctctcaaatgccttttgggggttgacataaaaaacactcagggtctgtgcctttaaccagatgcagtgggagaccctcccttatccctggcagtgacctcaggcgtactggtccctcctactgtccagtcccaaagaatctgccagaagcctcatcagaagc

SEQ ID NO: 56364 - DNA, 601 bp, Human
tttcagggggaaagcagcctcagaaatacgtaaacaaatgagcacagctgtgttccaatacaattttactagtaaaaccaaggaggggcaaggtgtggtggctcatgcctgtaatcctagtactctgggagcccgaggcgggtggatcacttgaggccaggagttcaagaccagcctggccaacattaacagggtgtagtggtgtgcgcctctaataccagttacttgggaggctgaggaaggagaatcacttgaaccggggaggcggaggttgcagtgagatcacaccactgcactccarcctgggtgacagaatgagactttgcctcaaaaaaacaaaaacaaaaacaaaaaaccagggagggaaggataaagtgggggcatggagagtgggtttggctggtggactgtagttggccagcccctggtctaaagtaaacctcaggcaatctttagagagacactttccctggggcctcaaggtcaagctaattccaaggaaggttaattcacttgaatgctggactctctcaaatgccttttgggggttgacataaaaaacactcagggtctgtgcctttaaccagatgcagtgggagac

SEQ ID NO: 56365 - DNA, 601 bp, Human
gagtcacttacgttcttaactgcttatgttcttaactactctcctacctctggcgacacatcagacttttccccaaggcatggggcctggagaatgtaaacaaggaatactctacagcagcctttctcacaaagcttttctgatgcaacttctcaactctgctgtttcagggggaaagcagcctcagaaatacgtaaacaaatgagcacagctgtgttccaatacaattttactagtaaaaccaaggaggggcaaggtgtggtggctcatgcctgtaatcctagtactctgggagcccgasgcgggtggatcacttgaggccaggagttcaagaccagcctggccaacattaacagggtgtagtggtgtgcgcctctaataccagttacttgggaggctgaggaaggagaatcacttgaaccggggaggcggaggttgcagtgagatcacaccactgcactccagcctgggtgacagaatgagactttgcctcaaaaaaacaaaaacaaaaacaaaaaaccagggagggaaggataaagtgggggcatggagagtgggtttggctggtggactgtagttggccagcccctggtctaaagta

SEQ ID NO: 56366 - DNA, 601 bp, Human
aactcctgggctgaagtgatccacccacctcagcctcccaaagtgctgggattacaggtgtgagcccccacacccggcctgcattttttttttttttttggtcagggcacaatgcaaagcagtacaatctgattttagcttgaggtttaatccccatcttttccctcaaaccaacaatgtccattcaaaccagttaaagacatgctttcaggatctagctttcaagattaagtcactggatgcctagaagatggtggtgctggtagcagcatagtttttggatttccctgaatcctcacayaaaaatagaaagcacagctagagaggcgaagcgaaaaatccatggacaaaatttacaacaaaatgctgtgggaagacgttgccaaggacccccaaatataagcaaggaggcaaaccaccaagagccataagacctctatacggggaaaaagcagtggggagaaatggggtatgggagggatctgagaactggaaagcccccaaatggccaaaggtatcctctggaaaatgtgaaccttttcctccaggctcactgggggagagcagctgaaacagggaggggatgtgtccgtttccatac

SEQ ID NO: 56367 - DNA, 601 bp, Human
gtcttgctctgttgcccaggctggagtgcagtggcacgatctcagctcaatgcaacctccgcctcccaggttcaagtgactctcctgtttcagcctcctgagtagctgggattacaggtgcacaccaccacactcggctaatttttctttttttttttaaagtagagagggggtttcaccatgttgcccaggctggtcttgaactcctgggctgaagtgatccacccacctcagcctcccaaagtgctgggattacaggtgtgagcccccacacccggcctgcattttttttttttttttggtcagggcacaatgcaaagcagtacaatctgattttagcttgaggtttaatccccatcttttccctcaaaccaacaatgtccattcaaaccagttaaagacatgctttcaggatctagctttcaagattaagtcactggatgcctagaagatggtggtgctggtagcagcatagtttttggatttccctgaatcctcacataaaaatagaaagcacagctagagaggcgaagcgaaaaatccatggacaaaatttacaacaaaatgctgtgggaagacgttgccaaggacccccaaatat

SEQ ID NO: 56368 - DNA, 601 bp, Human
ttttttttgggacagagtcttgctctgttgcccaggctggagtgcagtggcacgatctcagctcaatgcaacctccgcctcccaggttcaagtgactctcctgtttcagcctcctgagtagctgggattacaggtgcacaccaccacactcggctaatttttctttttttttttaaagtagagagggggtttcaccatgttgcccaggctggtcttgaactcctgggctgaagtgatccacccacctcagcctcccaaagtgctgggattacaggtgtgagcccccacacccggcctgcattttttttttttttttggtcagggcacaatgcaaagcagtacaatctgattttagcttgaggtttaatccccatcttttccctcaaaccaacaatgtccattcaaaccagttaaagacatgctttcaggatctagctttcaagattaagtcactggatgcctagaagatggtggtgctggtagcagcatagtttttggatttccctgaatcctcacataaaaatagaaagcacagctagagaggcgaagcgaaaaatccatggacaaaatttacaacaaaatgctgtgggaagacgttgcc

SEQ ID NO: 56369 - DNA, 601 bp, Human
ttccccaaccatgtcccactccttcttactctaacttcaaataccagtaagaccacatcagcctattgctgtgttgctctaggccaaccaagaaaggtctataactgggtatttcgagatacctggaattggccatgacttgcaacttcaccccctctcctcgaagatcatagaagatgagctttcccccagaagctcttttggcatggatcctacctagaaaaagaagagcaaaaatactgactgacagaaccagaagtcattttatggtatcagtgtcaaaaaaaaactccctctgcatttttttttttgttttttttgggacagagtcttgctctgttgcccaggctggagtgcagtggcacgatctcagctcaatgcaacctccgcctcccaggttcaagtgactctcctgtttcagcctcctgagtagctgggattacaggtgcacaccaccacactcggctaatttttctttttttttttaaagtagagagggggtttcaccatgttgcccaggctggtcttgaactcctgggctgaagtgatccacccacctcagcctcccaaagtgctgggattacaggtgtgagcccccaca

SEQ ID NO: 56370 - DNA, 601 bp, Human
tctatctatctcatacaaagagatccagaatatcttaagtgaaataaaagcaggtccatcacaatacacatagtgtgacttcattcatatttaaaccaaaaataaaactcctccaaaatgtttacatatgtgcactccatctgcaacatgcatatgtacatacgtatatatgcccagtaaatggtgtggaaggatacatatcaaactcaagtttgggtagggaagttagtcagaaggagtgaaagagcactttcagttttgcttctatttaatttattgtttgaatttgttttatggtacrtgtgtttgcctttctcatataatcaaaaaatatttcttaatgctacaaaaaagcaaaatgacgtgaatacatattgaatgtgacatcattagcatgtggatggccctataccttgtccattatcttggaagtcaggtcctgccttcctaatcaggacaaggtagaacagagacgatggcaagaaaaggggacattctcattaggcatgaaggatcctgacacaggatacgctttggaaaaggaaggcaagggagaggaggaggcaagcattgcaaggcagctcatcacgtcaggcaagga

SEQ ID NO: 56371 - DNA, 601 bp, Human
caaatacacctctcttggtgtgcaggtgatcggacactcagcaggactggcaaaacagagtatctgtgtttcagtgtacgttttattcatccatcgtttaggtcagggtctgcaggcagacccccgcagctaatgccctcttgtgaggagcaatacctcacctatagagctgaataaatttttattttgcttaaactagttataacagtttctgttgtctgcaactaagaatcctgaataataatcttcaatatttacctgggaatttgacaagacatctttatagtgatttgaagatacttttttttttttttttttttgagacgaagtctcattctgtcacccaggctggagtgcagttgcaggatctcggctcactgcaacctccgcctcccgggttcaagcaatcctcctgcctcagtctcccaagtagctgggattacaggcacatgccaccacgcccagctaatttttgtatttttgtagacactgggtttcaccatgttggccaggttggtttcaaactcttgacctcaagtgatccatccgccttggcctcccaaagcgctgggattacaggtgtgaggcccgcgccaggcct

SEQ ID NO: 56372 - DNA, 601 bp, Human
tgctccctaatggtatttactttagaccatggtacctggactttaataattcctagaactcctctcttacgatgttaattatccacaagtgtgtttactcaaagcttctgttgttaattctatactaaataaatgcctggagtgagagctgctcagggtcggccgcaatgacaaatacacctctcttggtgtgcaggtgatcggacactcagcaggactggcaaaacagagtatctgtgtttcagtgtacgttttattcatccatcgtttaggtcagggtctgcaggcagacccccgcagmtaatgccctcttgtgaggagcaatacctcacctatagagctgaataaatttttattttgcttaaactagttataacagtttctgttgtctgcaactaagaatcctgaataataatcttcaatatttacctgggaatttgacaagacatctttatagtgatttgaagatacttttttttttttttttttttgagacgaagtctcattctgtcacccaggctggagtgcagttgcaggatctcggctcactgcaacctccgcctcccgggttcaagcaatcctcctgcctcagtctcccaag

SEQ ID NO: 56373 - DNA, 601 bp, Human
tggggggaggttgaccaaagatactgctccctaatggtatttactttagaccatggtacctggactttaataattcctagaactcctctcttacgatgttaattatccacaagtgtgtttactcaaagcttctgttgttaattctatactaaataaatgcctggagtgagagctgctcagggtcggccgcaatgacaaatacacctctcttggtgtgcaggtgatcggacactcagcaggactggcaaaacagagtatctgtgtttcagtgtacgttttattcatccatcgtttaggtcasggtctgcaggcagacccccgcagctaatgccctcttgtgaggagcaatacctcacctatagagctgaataaatttttattttgcttaaactagttataacagtttctgttgtctgcaactaagaatcctgaataataatcttcaatatttacctgggaatttgacaagacatctttatagtgatttgaagatacttttttttttttttttttttgagacgaagtctcattctgtcacccaggctggagtgcagttgcaggatctcggctcactgcaacctccgcctcccgggttcaagca

SEQ ID NO: 56374 - DNA, 601 bp, Human
cttggggggaggttgaccaaagatactgctccctaatggtatttactttagaccatggtacctggactttaataattcctagaactcctctcttacgatgttaattatccacaagtgtgtttactcaaagcttctgttgttaattctatactaaataaatgcctggagtgagagctgctcagggtcggccgcaatgacaaatacacctctcttggtgtgcaggtgatcggacactcagcaggactggcaaaacagagtatctgtgtttcagtgtacgttttattcatccatcgtttaggtyagggtctgcaggcagacccccgcagctaatgccctcttgtgaggagcaatacctcacctatagagctgaataaatttttattttgcttaaactagttataacagtttctgttgtctgcaactaagaatcctgaataataatcttcaatatttacctgggaatttgacaagacatctttatagtgatttgaagatacttttttttttttttttttttgagacgaagtctcattctgtcacccaggctggagtgcagttgcaggatctcggctcactgcaacctccgcctcccgggttcaag

SEQ ID NO: 56375 - DNA, 601 bp, Human
attggggaaagttataaggaatagtcacaaaccttttggaaggccgaaaggttacgtagcttgtaataactgaacaggctgaaggcagccagttcttaccgtacagcattaggtcatagggtaaatactacggaaaatagaggcttccccagttaagtctgtttaccctacctccattaactaacctttcagccagatggccctcttggggggaggttgaccaaagatactgctccctaatggtatttactttagaccatggtacctggactttaataattcctagaactcctctcttacsatgttaattatccacaagtgtgtttactcaaagcttctgttgttaattctatactaaataaatgcctggagtgagagctgctcagggtcggccgcaatgacaaatacacctctcttggtgtgcaggtgatcggacactcagcaggactggcaaaacagagtatctgtgtttcagtgtacgttttattcatccatcgtttaggtcagggtctgcaggcagacccccgcagctaatgccctcttgtgaggagcaatacctcacctatagagctgaataaatttttattttgcttaaactagt

SEQ ID NO: 56376 - DNA, 601 bp, Human
ccatgtagaactcacaggtggtgaactcaggattgtgcgtcaaatcaatcccctcattccggaactggcgtccaatttcataaacccggtcgatgccaccaaccacaagcatctaacaacaacacatggccacggtcatgacagctaatctttttttttttgagatggagttttgctcttgttgcctaggctggagtgcaatggcaagatctcagctcaccgcaacctccgcctcctaggttcaagcaattctcctgccccagcctccctagtagctgggattacaggcatgtgccaccaygcctggctaatttttttgtatttttagtagagacagggtttctctgtattggtcaggctggtctcgaactcccgacctcaggtgatctgcctgcctccgcctcccaaagtgctgggattacaggcatgagccaccgcgcccggccccatgacagctaatcttgtattaacagctctgggaagtttcagtctccaaaagccgtaacttggttttcacaggttaggtatactctcaggtctctggtcaaattgccaagcaccctgctctctttatacccttgtagtgtggatagttacccct

SEQ ID NO: 56377 - DNA, 601 bp, Human
gacagggtttcaccatgttggccaggctggtttcgaactcctgacctcaggtgattcatctgcctcggcctcctgaagtgctgggattacaggtgtgagccaccatgcccaccctaccctatagctttttaaaagctggacgggattaactgagatcacacacataaattatttggcacagagcttagtatgacagttaaaagtctgttaattctcttgttctctctctagggttttcctgtgaagctgcagaaatgaactctccccagtggggttcattttcccagggaagagggaaccrttcagcaccagatgaggacatgtacaagaaggcagggccttctcaccttgtcaaggagcctggctgtggtccgaggtggagggcattcaacagcttttgccacacagatatcatcaagaattttgcgagtttctgggacacaaatgcaaaagttagggcaggagacatcacactagccaagtaaaaatgtacataaagagaatagtgtgggaaattctagctctgacccaatcaaattcagagctgaacaggaaggagggccttacaacggaggagtgagtgttgtcactttaccttcag

SEQ ID NO: 56378 - DNA, 601 bp, Human
gaccaccagtcaaaccacaaaatcttgacaataaattgttaacaccactaagttttggggctgttatgcagcaataggtaactggaatcttaccatttagccaaagggctcattatctgtgggtgatcacagatgaatgtaggattgatgcaagtcacttccaggaactccccaacaagcttaatgagaaagcaaagcagagtcagtcaccatttctgaatagtatttgatcgtcccagcccagacagaagatctcagctcccatccagatgggtttatcctatagctttttatttatttattattattattattattattattgagatggagtctcgctctgtcgcccaggctggagtgcagtggcatgatctcggcttgctgcaacctccgcatcctggttccagtgattctcgtgcctcagcctcctgaatagcggggattacaggtgcccgccaccatacccagctcatttttggattttttgtagagacagggtttcaccatgttggccaggctggtttcgaactcctgacctcaggtgattcatctgcctcggcctcctgaagtgctgggattacaggtgtgagccaccatgccc

SEQ ID NO: 56379 - DNA, 601 bp, Human
ctgattgcagtcagaagcctgcatgcagtctcagcaacaaatcatttggtacaacggtgaggagggtgagagagaccaggaaggtttaatgatcttcctaacaggccagcgggcagactgttaaaatggaccacacctcttgcattcatgcccatgtgtagtctccttcacctggactctgcgctggcaacatgtcttggtttggccaatgggttatcaccagaggcttgatacgtgtttgcacaatgaggtctgttcttttggaagcttccccttagagcccaaccaccatgctgaaggsaagcccaggctgtgctgccagacaggccacatgaagaggccctggaggataagatcgtatgtggagtgaccacgtggaggagaaccaaagtgccctggcagaatccccagttgaaaaaaagccacttgggttaccctggtcaacaccacccagcagaaagaccaccagtcaaaccacaaaatcttgacaataaattgttaacaccactaagttttggggctgttatgcagcaataggtaactggaatcttaccatttagccaaagggctcattatctgtgggtgatcacagatgaatgta

SEQ ID NO: 56380 - DNA, 601 bp, Human
gcgtttctcttatggatccccattcataacagcagaggaattaaagttagaatcatggcgtttgtgatgcgagtctcttctcaccatgtttttttgtttttgttttcatttttgttattgtttttggacagagtctctgtctcccaggctggagtgcaatggtgcaatcacggcacactgcaactgtgacctcccaggttcaagccatcatcctgccttagcttctcaaaagtagctgggactgtaggcctgcagcactgtgcccagctaatttttgtattttttgtagagacagggtttyaccttgttacctaggctgatcttgcacccctaaactcaagcgacccgcttgcctcggccttccaaagtgctgggattacaggtgtgagccactgcgccttgctctcttctcatcatgttatattttagtatttgtgcaacatgagatgagctgggagctctgtggtgacctgataaatgcaaaccagacaagagggtgcagtcacctggaggaggcctgcaagcttctctgagcttcgtgtctgtgggaggcccagctcagctccatctccagccaaggggattggattccctctcaagt

SEQ ID NO: 56381 - DNA, 601 bp, Human
gaagcagatgagtgggttaatgggcctgccacctcactttgtgcttttattatatttttgaggtaggaaacccagccattctgttatttttcttaccttaatcccaatataaataagactaaaaataaacaccagtggtcctcacttgccccaactcctcctgttttctgaccttgacctgctgggtcacatgatgtctgttcactggaggccagccctagagaggcttcaggggaacagagtccctgtgcaggaggcctgcatagaggtggcaccgtattggactcagaagtttggggtycatctgtgactcttgctccttacaagctttccttcgatccaatcacttaatctcctgcctgctttcttgtccgcaccctggcctccccagagtgctgtgttcagtgtggtaacctgtgtccccagacgaacgttgctgccgctgatggagcctatgagcagcagcgatgtttgtgctttgtgggagttgagatcgccaggaattcatggccattcacaattgtttctttgtgagcctggtgtccctttgggaaacatgataaaaggcaacatgtacacctgtggaaatgcagccctggct

SEQ ID NO: 56382 - DNA, 601 bp, Human
gcctcaacctcccaagcagctgggactacaggtgcatgccaccatgcgcggctaatttttgtattttgagtagagatggggtttcaccatgttggccaggctagtcttgaactcctgacctcaagtgattcgtccacctcagcctcaaagtgctgggattacaggtgtgagccaccacgcccagccagttggagtagttctttagtccaaacctcatggtgacttgtgttcagatcacacccatcactggctagggtattaacttagcaaatttatctcctgatttctacatgtgagtgargtaatgattttacaggcctgaacaagatgcaatgatgcactgaaataaagcctcgctgactgacctcttaccaccagtgtggtccctcctcctgtctgtttagctctcgcttccggcacactggggaatgctattccacagatgtaaattgcactgtcatttgaagtcactctgtttacagtgagggaaacttggttttctttgagggcctccctcactgtgaacttgtctgcctcacttttgcacccgtccaagcacaggttctcaggctggtgagcaccgtagcgaaaccacaggcat

SEQ ID NO: 56383 - DNA, 601 bp, Human
tggattggagtagttcttttgtttttctgagatggagtcttgctttgttgcccagactggagtgcagtagtgcgatctcggttcactgcaaccttcgcctcctgggttacaagcgattctcctgcctcaacctcccaagcagctgggactacaggtgcatgccaccatgcgcggctaatttttgtattttgagtagagatggggtttcaccatgttggccaggctagtcttgaactcctgacctcaagtgattcgtccacctcagcctcaaagtgctgggattacaggtgtgagccaccaygcccagccagttggagtagttctttagtccaaacctcatggtgacttgtgttcagatcacacccatcactggctagggtattaacttagcaaatttatctcctgatttctacatgtgagtgaggtaatgattttacaggcctgaacaagatgcaatgatgcactgaaataaagcctcgctgactgacctcttaccaccagtgtggtccctcctcctgtctgtttagctctcgcttccggcacactggggaatgctattccacagatgtaaattgcactgtcatttgaagtcactctgttt

SEQ ID NO: 56384 - DNA, 601 bp, Human
acttatttataatttagctgacagatgagaataaactaaggttaaatgacatttgaatatcaaaagcccattagaaccctcgtagtttaaaagcacaggttataatactggatggtctcccttcctcagagtcctattttgaaatcgaagggctggttgattttgagttcatgttttaacaatctctgctcatcataccagggtccttcctaagggaagagaccccaacaaggcgaggagttgctgctgttctcttttttccttcagaatcatgtaaagctttttctctgaaattcccccttttttttttctcgggaatgtcttaatctcagtttactcaagggaatgacttggtgaaattactgataggatttagctatgtttgatgtcctcgctcggctgaggaattgtcatgggttttatcaaatctcaggaagtgagagtcatcactttccgttcactgatgtccaggcagaatgggaagggtcagggatccctgagtagcttctctccaaatctgtgcttattctccatgttgcatagtttctgtgggtccaatttattgatcttttacacttctctagtgctttgttctaggtgg

SEQ ID NO: 56385 - DNA, 601 bp, Human
agccacaatttaaaaaatatttttcaagtgttggtctgtaccttttgtgagtcttcttttatttctttgtttcttagagggttggattttgactgccaagaagagaaggaaagtctatgaaacattttatgtactcataacaatggtggcagatatctcatgccctaataagattaaactaacttaatatttaagtgatatacaatgagacttaatttttacatcatttttgagatgcttttactccattaaaaactaattgaacaaactgacgttgattgtaggatttatagtaatcctracacaatggtatacatctcccttcttatacacatagccaaaaggtattcttttttaataactttagccctttttgaagattttaaggcggcttttagtttcttcatcaacccatttttgttcttaaagactgttcttaaggctttcgtagataacagtaatatctcgccctccacctgcccacacctcacccctacagcagaaagatagcatagtggatggctctcttcttaatcccatgctactgggctttaaagagaaaacagcaaactatgtcccctggctaataatttcagtgatg

SEQ ID NO: 56386 - DNA, 601 bp, Human
caaaatgaatgtctctaactcaaattttgtcacgttgtccctcccaacttattttaattgtgccatgatttccacaaaccataaaggtgattcttccactcaagactgaggcacatggtttggcttcagatcttcaggatggcagtcatcacacatctcatgttgaatgaaacagactcaggatacaagtttaaaatagaattttttttcttggcaaatttggaaggtatttttcagttgcattttgttgggttttagtattttggtaatgactattagttatagtttccttacattctgrcatccttctttgtagccagttgtcttttcagtttacctttatttttttttaagacctgatgatatatgttcattaacactgccatagctcctggagttggattttcagtgacttcattgaaaattaaaacgtttctatggcctttcatagttggaaagtactcttctgttttcataagtgttgttatctttctcctgcaataataaataaatagaaagccatgtttaaggttatgtaaccaatgaagccaactgccaaggaacatgcaaaccactgggccatcttggattctgggtccta

SEQ ID NO: 56387 - DNA, 601 bp, Human
acgtgattacaaaagcagagatacatttttttgaagatcgaggaagaggctacaaaccaaggaatgtgggtagcctctagaagaggaaacagaatccatggaaaaggcaggaaaacacaatctctcatagagtctccagaagaaacagccacactgacacctcgactttagcccagtgaaaccgatttcagacttctgacctccacaacttcaagataatacatttgtgttgttttaagccaataaatttgtggtaattttttacagcagcaagaggaaatcagttacgtagaatagtagrtcctgtctctggctaatcattagaatcactccagaagcttgttacatacagacccagagccagtgaatcaaggatttggtggtggggcccagagcctgaatattaagcaagttcttcgttttagaaatgaggaaaccaaggttgggagaagctaagcaacttactcaaatacatagggtatttcattttaaatttaattttattactttatcttttgaattttcttaccccagttgtacttttgtgtaaatgtgatttcatttacggctttgtgttgacatattcattaaaatgaagaaa

SEQ ID NO: 56388 - DNA, 601 bp, Human
gctttatgcattaaacttcatacgagtttaagggtcaattatttagacaaaatatcttagtttcaaagtggctatgaggtagatagtattttaaataccaattcacatttttccaccctaaatgcctccctcccttcctgtccctggtagagaggggtggtaacattcaagcagatgcttatttcgctgagatttccataattaagacaagagagagaactgggcaggaaaccaaaggtgtctataaattattttgacttttgtcttataaaaagtctaagcacttaggggagggagattkgcaggtatagacaaaatgtcatggtaaacaaaggggaagcaggagatttccttgggttgtggaaagtggcggggtggggagagagggaggagagagagagtaggagggagggaaagagggcagaagaagccttcagagtaaaaaataatataaaatgaagaaataaagttacctgaataatgtaaattcaggtaaatataaatagctgtatcagaatcatggttcttgcctatcacatgccaggcattgtatgaagcaggttcacacctattctctcataatcttcacaatagcactgtg

SEQ ID NO: 56389 - DNA, 601 bp, Human
agattagttcattaaattctgagacttcagaaattagaggcagacacataaaattaggtatacttcttatgtgaggtattaattaattgaatttatgtcctcaggctgaatttaaatacactcaaaaagaggttgcattaattcttggataactgattaaatatacactaaagaaaatgaaggctttagggggagcagcccccagtcttcctgagagggtatcaaggatgacagtgatgatcacatattgcaagatgctgcctttgggactaaatgttacactggaggaatcatcaggcartcctcaggtcttcaaattcccagagatgactaatgtggatagttggtgaagctgatgaagtattggatttggtctatgacaggtgaagacatacctatcacacaggcttcagctgggaaggactgtcagagggtgcctaaatataattttctcagcctttcttgctgagagtctggagtacatatttggaggaggttatgagggagaaagtgatgaatgcaaaatgctgtggttaaataatgaagtataaaattggaaagagatattaacttgtaaagaaggtgtaaaagaaaagacaaa

SEQ ID NO: 56390 - DNA, 601 bp, Human
gttaactctgtgttagtggaattactgggcattgacactttaatgtaagttttaaataaaaatatgtattaattagagagtgatgcactattgtgtaaagagggtataaatattttcaatagagtcatctgggcaggctgaattgcatagggttaaagagtgaatgagggtgataaagtgggtttagattatttctcaaggagtctggctgtgactaggacagacttgggcaagagaggcagaaaaatccaagacatttgtggagggaaggggatttcaggatggcaaaacctggaaagtytgacaaattagacagcaaataccctgtaagggtatattgttttgaaacttttttttataatttgcatgtactagagacagaaggcattttatgatatgttctttaattagctttgaggtatttctcacttgatccaaattatactggttaagaaccaagaggtaattttctcagctgagtcttaactgagtcaagaatctgatttttcaacaatcaagaggttagaatgaaataataagaaaaataaattttaaaggactcttaaagagaagtgctaattcaggaattctagctgaaatc

SEQ ID NO: 56391 - DNA, 601 bp, Human
ttatttacatatatgtacaaaaagaaaggactggaaagaacccaaaacattagaagttgttaactctgtgttagtggaattactgggcattgacactttaatgtaagttttaaataaaaatatgtattaattagagagtgatgcactattgtgtaaagagggtataaatattttcaatagagtcatctgggcaggctgaattgcatagggttaaagagtgaatgagggtgataaagtgggtttagattatttctcaaggagtctggctgtgactaggacagacttgggcaagagaggcagraaaatccaagacatttgtggagggaaggggatttcaggatggcaaaacctggaaagtttgacaaattagacagcaaataccctgtaagggtatattgttttgaaacttttttttataatttgcatgtactagagacagaaggcattttatgatatgttctttaattagctttgaggtatttctcacttgatccaaattatactggttaagaaccaagaggtaattttctcagctgagtcttaactgagtcaagaatctgatttttcaacaatcaagaggttagaatgaaataataagaaa

SEQ ID NO: 56392 - DNA, 601 bp, Human
gaggaggataagaaagacagtaaggaagaggaggggaagagagagagtaagtacttccccttctctcagaggggagatgatgacaagggggaggtgagagttgtgttagtccatttttatgctgctgataaagacattcccgagaaggagtaatttataaaggaaaaaggtttaattggacttacagttccacgtggctaggaaagcctcacaatgatagcagaaggcaaggaggagaaagtcacatctcatttgggtggcagcaggcaaagaaagagcttgtgcagatagactacctccyaccaggtccctcccgtaacacgtgggaattcaagatgagatttgggtggggacacagtcaaactatatcaagattctagttcaggaccttgaagaatacttattttgcaggtttgggaatcatgcaatgtcatggaacccagggaaaaaaggggattcaggaagaaaagaaggaggtctgttgttccaggctgggatgtagaggagaaaaggattatatttagcgtggatttactacataatagcaaaaatggaaaaaattcaaatatctcacaatattaggaattgttttataaacatt

SEQ ID NO: 56393 - DNA, 601 bp, Human
gcagggtagcaaggccctgggcctggcccacaaaatcattcttccctcctaggcctctgggcctgtgatgggatgaactgccccaaaggtctgtgaaatgcctttgaggcctttcccacattgtcttggctatcagcatttggctcctttttatttatgcaaatttctgcagcctgtttgaattcttctcctgaaaatgggcttttcttttctaccacatggccaggctgcaaaatttcctaacttttacactctacttccctttaaatacaagttaaaatttaaatataggtttaaatcyaaacttatttttaaatttaagttccaacttcaggtcatttatttgctcatgcatgtgggcataggcggttagaagcagcctggtcacatgttgaatgctttgctgcttagaaatttcttgtaccagacaccttaaatcatcattctcaagttcagagttccacagatccctagggcaggagcacaatgcagtcaagttctttgctaaggcataacaagtttgacctttgatctagttcccagtaagttcctcattttcatttgagatctcctcagcctggactttattgttcatgtcact

SEQ ID NO: 56394 - DNA, 601 bp, Human
gtcttaacaccacatggaagctaccaaggcttatggcttgcaccctttgaagcggtgcttggatccctttgagccacaggaggagctggagcagctgggatgcagaaaacagtgtcctgaggctgtgcagggtagcaaggccctgggcctggcccacaaaatcattcttccctcctaggcctctgggcctgtgatgggatgaactgccccaaaggtctgtgaaatgcctttgaggcctttcccacattgtcttggctatcagcatttggctcctttttatttatgcaaatttctgcagccwgtttgaattcttctcctgaaaatgggcttttcttttctaccacatggccaggctgcaaaatttcctaacttttacactctacttccctttaaatacaagttaaaatttaaatataggtttaaatctaaacttatttttaaatttaagttccaacttcaggtcatttatttgctcatgcatgtgggcataggcggttagaagcagcctggtcacatgttgaatgctttgctgcttagaaatttcttgtaccagacaccttaaatcatcattctcaagttcagagttccacagatccctagg

SEQ ID NO: 56395 - DNA, 601 bp, Human
tgtccccaagatccaatcacctcctgccaggccccacctccaacattagggattataatttgatatgaaatttgggtagggacacagatccaaaccatattattctgcccttggctccttccaaatctcctgtccttctcacatgtcaaaatataaccatgccttcccagcagtgcccaaaagtcttaactcattctagtattaactcaaatgtccaaagtctcatctgagacaagttaagtcccttccacctatgagcctgtaaaatataaaataagttagttacttccaagatacaatrggggtatagacattaggtaaatacttccatttcaaaagggagaaattggccagaacaaagggtctataggccccatgcatgtctgaaacacagcagggaagtcattaaattttaaagctccaaaaaaatctcctttgacctaatgtcccacatccagggtacactggtgtgaggggtgggctaccaaggtcttggtcagccccactcaggtggctttgcaggattcagcacctgcggctgctctcatgggctgccattgagtgcctgtggctttttcaggtgcacggtgcaatctgtgga

SEQ ID NO: 56396 - DNA, 601 bp, Human
atcatagtgtacatattagtctgttctcacattgctataaagaattacctgatactgggtaatttataaagaaaagaggtttaactggctcacagttcttcagactgtacaggaagcatgatgctggcatctgctcagtttctgaggaggcgtcaagaaatgtacaatcatgacagaaggtgaagcaggagaaggcatggcttacattgcaggaacaggagtgagagagagagagagagaaagagagagagaaagaaagagagagagagaggtgggaggtgccacacacttttcaatgacyagatctcatgagaactcactcactatcatgaggacagtaccaacagggatggtgctaaaccattcatgagaaactgtccccaagatccaatcacctcctgccaggccccacctccaacattagggattataatttgatatgaaatttgggtagggacacagatccaaaccatattattctgcccttggctccttccaaatctcctgtccttctcacatgtcaaaatataaccatgccttcccagcagtgcccaaaagtcttaactcattctagtattaactcaaatgtccaaagtctcat

SEQ ID NO: 56397 - DNA, 601 bp, Human
gtggaaaaggttgagccagagagactgatgggttgaccaggtcagctggtcatttttcaaggtcttctgtagcacattagccctcaagtcatgagaacagagagcctgaggtggtggaagaaaatgcaactacatttcatagtgaagagaacataccttcaatagggcccacaatctggaagaagcaacgaccttgacgaaccttctctaatgcaaaaaatgatccccaccaaatgacagagatagtatagggagaggagtcatttatctgttggccctgatggcagaagattatacagartctatattcagatcatactgggcctgtatcatgaaggataagaaaatccccaaggtggttctgataaactcagtactcacaagagaaagcagagattttggtcaggagcgctgatgtgatattttgataagtgtgaggagggagatttgagcagaggattaataggaagagtccatggagtgcatggtacaaacatctactaaagccagctgcagctttattgtatgctgtggagcagtaactctctgagccaaggccagaccaaaaggagagtgcactgaagacttggtttttgctact

SEQ ID NO: 56398 - DNA, 601 bp, Human
gagactctgtctaaaaaacaaaaaacaacaaaaacaacaacaacaaaacaaacaaacaaacaaaaaccttgctgtgagtggtaataaagtcctggccctcagagaaggggtttgtcttctttgagtggaaaaggttgagccagagagactgatgggttgaccaggtcagctggtcatttttcaaggtcttctgtagcacattagccctcaagtcatgagaacagagagcctgaggtggtggaagaaaatgcaactacatttcatagtgaagagaacataccttcaatagggcccacaatcyggaagaagcaacgaccttgacgaaccttctctaatgcaaaaaatgatccccaccaaatgacagagatagtatagggagaggagtcatttatctgttggccctgatggcagaagattatacagagtctatattcagatcatactgggcctgtatcatgaaggataagaaaatccccaaggtggttctgataaactcagtactcacaagagaaagcagagattttggtcaggagcgctgatgtgatattttgataagtgtgaggagggagatttgagcagaggattaataggaagagtccat

SEQ ID NO: 56399 - DNA, 601 bp, Human
atatctttgtacatctgcctgatgttaaaatacctgtggtaaggccaggggcggtggctcacgcctgtaattccagcacctttggaggccaaggtgggtggatcatgaggtcaggagttcgagacaagcctggccaacatagtgaaaccccatctctactaaaaatacaaaaattagctgggtgtggtggcatgcacctgtagtcccagctactcaggaagctgaggcagaagaatcttctgaacctgggaggtggaggttgcagtgagccaagacctcaccattgcactccagcttgggygacagagtgagactctgtctaaaaaacaaaaaacaacaaaaacaacaacaacaaaacaaacaaacaaacaaaaaccttgctgtgagtggtaataaagtcctggccctcagagaaggggtttgtcttctttgagtggaaaaggttgagccagagagactgatgggttgaccaggtcagctggtcatttttcaaggtcttctgtagcacattagccctcaagtcatgagaacagagagcctgaggtggtggaagaaaatgcaactacatttcatagtgaagagaacataccttcaatagggc

SEQ ID NO: 56400 - DNA, 601 bp, Human
tcatcagacatcagacatcaaagtgagaaaaaggttaaaagcccccgttctagccaaaagaaaggaacttaagtaagaaaatgttcaattgtcattggcctttctgagatataaatagttcatgaataccctctggtgtcaggggccatatggtttctgtaagtaagacatccctccgccagcccccaaagcatacgcaggtggttttgtctctgctgcctcctgatagggctgcttctgcttggcattcaggctgcaaatggttggctcactcaccacagaagagaggagagcagtaggragggtgtggatgggactgacttacactcacaaagtctactttcttctgagatgcttttggaatctcaaatggtttccatctaagctggaaaaaaaatacacatacagaaaaattacttcacaagggtaaaccatagaccttctaaataaatagcatcaattacatagaaaagaaaggacagctaccccctctgtgaggctctacttgtgattttgttatattaaaatgattatccatcatttccttaaagggactctgttagtgtgtgttatttgtgcacgtgcacacacatgtttgtgt

SEQ ID NO: 56401 - DNA, 601 bp, Human
aagaaaggagatggggatatcattttgtattttaactcaatttgcaagtttagggtatatttaagtgagtctacaaagagtttggagcacttaataaagatgagaacttcaagatgtttccaacaatttatcctatggctcggcacttggagtgtccctacgtaagccatgagctgaggctggtctgcagaaccctccactggtctctttgagccccacttccttagagctcctttctcctctcccccagatactccttgctctgtgcagttattccagtactcctgggacctataactaycaaacagagcttccaatcagcattgtactaactagagttgccatgttgaattgacgccattctagcccaagcatctacttcagggagatttatgaacttggatgggaaatattttatatttacttttgctaatctctgagtgaaatttatcatttctttcaactaatatgaatgtaggcaaaaaaccacagcagtattagaggtgcctgtaactttatcaatgataaaaatcatggatatcacattatagttgttatagatacctcaaagtatatttatgctcataccagaattattaga

SEQ ID NO: 56402 - DNA, 601 bp, Human
gaccagttaatgcctctcaagtacactccactatgggcagccctctgcttatggatagggtcagcctaatctctctggaacagggcagaggactgtattcagatggactgtaattctctctgctgtgtgaccagatgatccatagtgcaagaaaccttaacacatgggtcttctcaaaatagccctcagccccaaacctgcagatggagagccaaaaggagagagctctgcgcctccagatatctacaattcacacaagaaaggagatggggatatcattttgtattttaactcaatttgyaagtttagggtatatttaagtgagtctacaaagagtttggagcacttaataaagatgagaacttcaagatgtttccaacaatttatcctatggctcggcacttggagtgtccctacgtaagccatgagctgaggctggtctgcagaaccctccactggtctctttgagccccacttccttagagctcctttctcctctcccccagatactccttgctctgtgcagttattccagtactcctgggacctataactaccaaacagagcttccaatcagcattgtactaactagagttgccat

SEQ ID NO: 56403 - DNA, 601 bp, Human
tccctcctaggaagctcttgtttaggttcctaattctagttcacaggtccattctaaaggatttctccattgtctttttcttctttttctttttttttttttttttttgagatggagtctcacacggttgtccgggctggagtgcaatggcatgatctcggttcactgcaacctccgcctcccgggttcaagcaattctcctttttcagcctcctgagtagctgggattacaggcgcccaccaccacgcccggctaattttttgtattttttagtagagatggggtttcactatgttggcyaggctggtctcgagctcctgacctcgtgatccgcccacctcggcctctcaaagtactgggattacaggcgtgatccactgtgcccggcctccgttgtctttttctaaagacaacaagaatgactcccttttgggtaccctgtttggtttccagtttggaggtgtattctaaatggtctactccattgttttttctccccaaatttagctcagttggcttgcctgcgcattcgtgtgactgtcatttttgtgcataaatgagagactgagctcctcagctctgaagagaaagggcattttg

SEQ ID NO: 56404 - DNA, 601 bp, Human
tttggcacctggacacattgggcctcagagaagactcagaaccctgaaggagttgcctgaactcagagctaaggtatcagcagggacctattgaaagtgccttcaactttgggcttctcctctgatggaactgttaagtcctcctgagccctgtttggttgacagttcttgatttttccctcctaggaagctcttgtttaggttcctaattctagttcacaggtccattctaaaggatttctccattgtctttttcttctttttctttttttttttttttttttgagatggagtctcacayggttgtccgggctggagtgcaatggcatgatctcggttcactgcaacctccgcctcccgggttcaagcaattctcctttttcagcctcctgagtagctgggattacaggcgcccaccaccacgcccggctaattttttgtattttttagtagagatggggtttcactatgttggccaggctggtctcgagctcctgacctcgtgatccgcccacctcggcctctcaaagtactgggattacaggcgtgatccactgtgcccggcctccgttgtctttttctaaagacaacaagaatgact

SEQ ID NO: 56405 - DNA, 601 bp, Human
gtgagggtttggagaaaggaaagaatgttccaggcagaaggaacagcaagtgcaagtgcttagaaggagggcacgcggcagcttgaaagaagtgaatgaaggccaatgcggctcaagtggagagaggggaggtggcctgatatgagatttgacccaaagagaggcctccagagccttgtcatagggctgtgatcttgtccctgattcatggctcacaaggtcgctcagccaggaaatgtagagttgggctttggacacaaatggtccagttccagaggtagtgtataataaggcaggaatkccatttgcatactttgttttgcaaagccagtatataagctcctctacttaagaattttaagcttacacagagctgttagctgaagccaaagtcgggtagcctgctactaatgggtggtcctaatggaaactcacacactgtgacctgggactcaagaacagccctggggaaccttagaaattaaggatattcaaaggcacatgttctcaggatctcctgagggctgggtcatgggtcactggtcactcatatttggctcagaatacatcaattcaaatattttacatattaatagtttga

SEQ ID NO: 56406 - DNA, 601 bp, Human
ttatctaggtgagggtttggagaaaggaaagaatgttccaggcagaaggaacagcaagtgcaagtgcttagaaggagggcacgcggcagcttgaaagaagtgaatgaaggccaatgcggctcaagtggagagaggggaggtggcctgatatgagatttgacccaaagagaggcctccagagccttgtcatagggctgtgatcttgtccctgattcatggctcacaaggtcgctcagccaggaaatgtagagttgggctttggacacaaatggtccagttccagaggtagtgtataataaggcaggaatgccatttgcatactttgttttgcaaagccagtatataagctcctctacttaagaattttaagcttacacagagctgttagctgaagccaaagtcgggtagcctgctactaatgggtggtcctaatggaaactcacacactgtgacctgggactcaagaacagccctggggaaccttagaaattaaggatattcaaaggcacatgttctcaggatctcctgagggctgggtcatgggtcactggtcactcatatttggctcagaatacatcaattcaaatattttacatattaa

SEQ ID NO: 56407 - DNA, 601 bp, Human
atagatattttccagagggtacatgttccacggaacctggaggctatgctgactatagagcagcaggaagccagagcagagtgggaagagtgggaggtgaacaggatgacagacggcccaccacggctccagctgcctcttgctgcctcccaccttcctctgcatatttggattcctcagaggagctgaccagaaggcacacactggcctgtccctgtttgctctaaaaagctgttgacaaggaagggaagaattgggagatgtgaccaaagagtaaaccaagggccaattttcccagccwtttctttcaatccaagagacagtttgagaacaacccctcctaacattttcacttcctccagcttgccagaagaatgggggctgtggagaccttggttcactttggaatgttttaatctgcctcctggggtgtggtttctagatctctcatagcactgagtgatgtgtttttttgactgctaagtgtgtggatttggtggggtgtacacagaggttcatagactatgtgtcacccagtccatccctcctttccataggaatacagcccagggcatttttatggccttcccattttatacaa

SEQ ID NO: 56408 - DNA, 601 bp, Human
acacctgggcaaatttaagtgcctttgcatctcaaaccacacatctacttacccattcattcatctgtctttttcccacttcacccatctgcccatccagttagccagcacatataattagatatgtgctggctaacatgagacagagatgaataagaaatagcttttaaagctacttaaaaaagaaataattaacaacaacaacaacaacatagcctttaaagctactcatagtctgtcctgtgagagtactgagagggcaaaccaaggacagaatagagagatgtggcagtggcaaccsttacaaaatcaaacactggacatgatacatgcctgcccttcttgcttacatgtgaagtataaccaagtgccaaatgcttttataattgactaagcagccacacccaccctgctcagaaacagaaagctactgcaggcccctacaaagtgagtgagagtgtgtgagctcctgctgaagaggtgagacccagatcatagttctacttgtttctctatgaagtggaaatacagaaaaagaagcaaatgtaagcataaattgtctatgttttaaaaacagttcagctcatgacttaaatttggt

SEQ ID NO: 56409 - DNA, 601 bp, Human
acagcatatttctaattcccaatctagaaggcttagattgagggtgtgtggttttgatggatgatagatgataatgtaatgaaaagaaccccagacttaaagtccattatcaaatgataatctgtgtgaaagaatcttggtatgtgtataaaacagaccataaatgctatttattataacaaatattatcttctatagatgaatctgttatcctcttgtttttctgttcttcagaatgtcttttggatttgtttttattttttctagttccattgataccctattcatagagtcctaaatsttgaaattggaaggtatccttacttctactcaatgtagaagaaatttctatatctttcctgactgattacctcccgggctctgcctggatgtgaatggaagctctccactctacaaagcatatcatattattgaagagctctgtgtgtaagaaagttcttatattaaatggaaatttgcttttatatgagttaaattcattggtcctagttgtgctttctagagtcacacaaaatttaacaaaaatcaccatgcttccactcttccaatcttatgcttctattgaaataaagctctttat

SEQ ID NO: 56410 - DNA, 601 bp, Human
cgagtcttgcctgcatgtggtcagtgccaccaagtccttcttctctccacattacagcccagctcggctgaagctatggccagaggcactgctttaaggccactccatatctaggacaggtcaacagacacctctgaggccactgagtcttgactcaatgaatcagctatagcaggcactattcctctcccacatggcctctaatgatatggccagagttgaaaggatgctaagggaggcctcagaggcttatttaatcagttggttaatgggaaaaagtattttgtggtacacaaatacrctttaaaaatattttagttatgtcataaaagtctaaacctggggttgacaaactatggctcacaggctaactctggcccaccagctgtttttataaatgaagctttattggaacacagccatgcccattcgttatgtattgtatatggctgtttttgccctacaacatcctttcaactctggccatatcattagaggccatgtgggagaggaatagtgcctgctatagctgattcattgagtcagcaaaattgaccaattgcgaaagagacagtatggcccacaaagcctaaaatattaa

SEQ ID NO: 56411 - DNA, 601 bp, Human
accaattgcgaaagagacagtatggcccacaaagcctaaaatattaactatctggcctttaacagaaaaagtttgccaactcctgatctaaaagctgtcaacttgttccaaaattattatggaataaacccaagacaaccacaaaactgactagactaggttttttaggtaataactttttaaattataaagtaatacatgatttcatgctccttgaaaatgagaaagcagtatagataaacctaaattcacctttggccattctgtcaatcctaatctccagtttccccaaaagtacttrgtgtgatatatttactgccagaccattgtgtctgtgtgtgtgttcatctatgcatagatggactattaaacctatctgttgccatgttgttctaattctgtttttccactcaatagcaagacttggagactttccatatctgtatagagctctacttcatttattttaactgctacgtcatatttcacagtgtacacttcttttatttagccgttttcttttcgatagatatttaagcttttccaatttttcagtcttaccaatgaacctcactgtgtttgtctgcttctagacatgtgc

SEQ ID NO: 56412 - DNA, 601 bp, Human
tcctgatttccatttttattttgtactatgaactcatttggaaacttctctttgggactcgttgagattgaaattgttttcctctagaggatttatttttgcttttgccaggaacctgaggacagaactaactgggaccaccataagcttggggtctactggccacacaaatagtgagaatcctgacccaaacttacttgattgcaggcctgttgttaagaatttcaaaggagacttttctttttgctctacccagagccaaggctgagaaggcctgggatagacctgtctccctccatgrtttctactgaggatgtcacccttaggggatcttgagtttatagtctatgatctggttaggctccaggctttgtctcctattctaccattaaaatccaggcctcaggcctacaggagtccagaaaactccaggatgatcatgacttccctttctcatgcctctggcttagcataatcttataaattttggcctcttgagacttcctttactttcctaccagctcaatcctgcatgaaaaatgacattcttaaaaatttagtatttctaggtgctgcataccaggaggattttctgtaacca

SEQ ID NO: 56413 - DNA, 601 bp, Human
acacacacataattaaatataatcctgctatctccaagagtttctatcccaaagattatggtttttgtttttttatccatttacccccttttacttagactctgttgcttcaaattcaagttgcccactcttctcttcccataatctcagtgacctggttccaaagcttgtgctttgactcatttgaagactaaatgtatctgtatgtcctccccacatccttttcctgggaaggaactatctcaccctcaaagtacattgactttttaaaaaattattattattattactttaagagacmgggtcttgctgtgtcacctaggctggagagcagtggtatgatcatggctcactgcagtctcgaactcctgggctcaagtgatcctcccgcctcagccccccagagagctgggactacaggtgtgtgccaccatgcccagacacttttaaaatttatttttggtagagacaaagtctcatgttgttgcccaggttcatctgaaattcctggcctcaagtgatcctcctgcctcagcccccctaagcattgggattacaggtgtgagccaccatccctggccatcattatacaaatttattt

SEQ ID NO: 56414 - DNA, 601 bp, Human
tgcttcaaattcaagttgcccactcttctcttcccataatctcagtgacctggttccaaagcttgtgctttgactcatttgaagactaaatgtatctgtatgtcctccccacatccttttcctgggaaggaactatctcaccctcaaagtacattgactttttaaaaaattattattattattactttaagagacagggtcttgctgtgtcacctaggctggagagcagtggtatgatcatggctcactgcagtctcgaactcctgggctcaagtgatcctcccgcctcagccccccagakagctgggactacaggtgtgtgccaccatgcccagacacttttaaaatttatttttggtagagacaaagtctcatgttgttgcccaggttcatctgaaattcctggcctcaagtgatcctcctgcctcagcccccctaagcattgggattacaggtgtgagccaccatccctggccatcattatacaaatttatttatttattttcatttgattgagacaaggtgtcattctcttgcccaggctgcagtgcagtgggacaatcatggctcactgtagccttgacctcctgggctcaagtgt

SEQ ID NO: 56415 - DNA, 601 bp, Human
ggggcacttctgaagcaggcatgggagagaaggaaggcaaaaatctcaattgccagggccctgacctcctagagattaaaatgtagttcagaactcaggttgggatcaaatgcagtttaattgacatggttatctttttcttcctgattgtagtgcttttaactactgtattagtccatgttcacattgctgataaagacatacctgagactgggtaaattacaaagaaaaaaggttcaatggactcacagttccatgtggctggggaggcctcacaaacatggtggaaggcaaacggcaygtcttacatggtggcaggcaagagagagaatgagaaccaagcgaaaggggtttccccttataaaaccatcagatctcatgagacttattcactgccatgagaacagtattgggggaaccgcccccatgattcaattaccttccaccaggtccctcccacatatgtagcattatgcaagctacaattccagatgagattttggtggggacacagccaaaccatatcaactattgatgttactttcctttgtttcctttctttctgctgcttctcctcctcacaacttctgtttcctcgggg

SEQ ID NO: 56416 - DNA, 601 bp, Human
tgtttaggaccacacagcactgctgggtgtctgcctttccttgtgactcttctctagcctctgcatggccagcagccctcttcttttctcctattctcttaagaaacatgcccatcacctgcagtttctctgggctccccgttaatctgccttcctcatctcctaatgctgcctcctccctcccattgccggtgcctggaaatagtcaaggctgggttctgttcttttgcttgaatttctttcacttggcttcttgactctttctaaactacaatccccccattctcactgccttagtttyccctctctctgtgtttctcaaactatatcccaccacgccctgacaagggcttctctcctgtagatcatcccttttctagtattttgctagaaatatatagtgggattttctcctttgccctacatcatcactaaacttcccaacctaataggcagtgtcttgcaccttctactgatcatttcattctttcttgcactaaagatgaccacttcccatgtctgtacccaattcctgtttggcccaaatgtatctgcagcactcacccgtgttctcacactgagtctctaaatatttgactcc

SEQ ID NO: 56417 - DNA, 601 bp, Human
aaagtcaaccattaatcttaattttatttctttgtggttaattttttttttctgggtatttgtaagattagttttcttgtcatcgattcccagcaattttacgatgtgtgggtaggtatgtgtgtttttaatcctttcattggtttcaaaaacttcttggcaagtgtgctttcccagattgcttctgtccgattcttgtgtccgtaacatatgttaggctatttcactgagtctcgtgtgtctcttacgccctgttcttttcttaatgctcttttttgtttgtttctgtgcttcggtttawatattttctgttgacctaattttgaactcactatcactgtctgttgctgattcaatctgttgttaaaacatccaatgagttgtcagtttcagatattgtactattaatttctggaatgtccagaaatgtccagttgattatttttaaaaatagcattattgagagataccttatgtatcataaagtctaatcatttaagtgaacaattgaataactgttagtatatttagagttgtgcagctatcatcaaaatctaattccaggacatttctatgctccaaaaagtactcgggaggctga

SEQ ID NO: 56418 - DNA, 601 bp, Human
aaaacaaacaaacacaaacaaaaaaaaacttttaaaagacaggaatagaataagtcttccgaatgtaatatgacaatctgtcttaccaaccaccagtaatatgctttataaggaaaactaggctgggtgtggtggttcatgcctctaattccagcattttgggaggctgaggggcatggatcacctaaggtcaggaatttgagaccagcctggccaacatggtgaaaccccgtctctactaaaaatacaaaaattagctgggcgtggtggcaggcacctgtaatcccagctactcaggagrctgaggcaggagaatcgcttgaacctgggaggcagaggttgtgcaccactgcactccagcctgcgtgatgagactttgtctcaaaaaacaaacaaacaaacaaacaaacacacacacacacacacacacacaaagacatataatacccgaagccttcacgcttttggtgtcatatctaagaaatctttccctaaccataagaacttattcctgttttcttctcagagttttatagttatagctcttacatttaggtctatgattttgtgatccattttgagtaaatttttgtgtatggca

SEQ ID NO: 56419 - DNA, 601 bp, Human
aaggaaaactaggctgggtgtggtggttcatgcctctaattccagcattttgggaggctgaggggcatggatcacctaaggtcaggaatttgagaccagcctggccaacatggtgaaaccccgtctctactaaaaatacaaaaattagctgggcgtggtggcaggcacctgtaatcccagctactcaggagactgaggcaggagaatcgcttgaacctgggaggcagaggttgtgcaccactgcactccagcctgcgtgatgagactttgtctcaaaaaacaaacaaacaaacaaacaaaaacacacacacacacacacacacaaagacatataatacccgaagccttcacgcttttggtgtcatatctaagaaatctttccctaaccataagaacttattcctgttttcttctcagagttttatagttatagctcttacatttaggtctatgattttgtgatccattttgagtaaatttttgtgtatggcacgagataagagctttaattcatcttgcatgtgaatatccaattttccaagcacctttttttagcaaagctggcctttcctccattgaattgccttgcatttttaccaga

SEQ ID NO: 56420 - DNA, 601 bp, Human
ttggagtcagactgacatgggttgagattctggctccacctcctcccagctaaataatgtcaatgaatcactcacctgaagaggagaggggctgtgtgtgctcagtgcagcctgacagtgccttcagcaaactgacaattttagtcacgtagaaagactaaattcattgatttattcactcatttattaaataaatgaattatattcttcctttctgagaacgtagtccttagctttaatacttaccctgcataccggattttacaattaattatctttgcaaagccctctctgaagaagygtttactttcactcagtacaggagatgatcctttcaaccctcttctgatgagatttcaccgattactaagcaccgtgagaagcaggtggagccctcagaagcaaacacagttgtattcagttaaaagtacacatctaattggtctccctaaatttgcatgaaagagagatgtagctggcacacctcagacacccagtcactgtcattttcctgcccagagggcaacattctgtaaaggaacagtgatggaagagtggcatgggagcaggactgcagctgctgggctggctcccccatcac

SEQ ID NO: 56421 - DNA, 601 bp, Human
tcctcccagctaaataatgtcaatgaatcactcacctgaagaggagaggggctgtgtgtgctcagtgcagcctgacagtgccttcagcaaactgacaattttagtcacgtagaaagactaaattcattgatttattcactcatttattaaataaatgaattatattcttcctttctgagaacgtagtccttagctttaatacttaccctgcataccggattttacaattaattatctttgcaaagccctctctgaagaagcgtttactttcactcagtacaggagatgatcctttcaaccytcttctgatgagatttcaccgattactaagcaccgtgagaagcaggtggagccctcagaagcaaacacagttgtattcagttaaaagtacacatctaattggtctccctaaatttgcatgaaagagagatgtagctggcacacctcagacacccagtcactgtcattttcctgcccagagggcaacattctgtaaaggaacagtgatggaagagtggcatgggagcaggactgcagctgctgggctggctcccccatcaccacagttcagatctatttctaacccaactccaggggttcc

SEQ ID NO: 56422 - DNA, 601 bp, Human
ttctagctcactgcagcctcaaaccctcaggctcaagagatcctccccgctcagcttcccaagtagctgggactataggctcacaccatcgatcttggctgtttttttttattttttgtaaagatgagatctcactttgttgcccaggctggtctcagattcctgggctcaagcgatcctcttgcctcagcctcccaaagccccgggattacaggcatcagccaccatgcttagctacagctctattaataggcacaagttcttcaatattcactgagaccccagctctgctgggaccacrggccatttttcttcccatgttgtgatcttgcccaccatgcctccactttttccccatctgcctggctacttagttgaaaactctttctgctcagcctttctagctccctgtgggagcttgggccacaccccacctgaaagactatcctccctcaatgtccccagtcccagaaatcatcttgaacaagtaatctgtccatgagctgctccccattcagacctctggccaggttgtggcctcctaacctcagtccactcagctgtggcctccatgatccgacccagacagcctgctctcttt

SEQ ID NO: 56423 - DNA, 601 bp, Human
cattctctgtggttttctcatttctagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggtagagttacccatcagccttcacccacgtgccaccactgacccactgggtaacrtctcagggcctcagcttgacctgtcccccaggttcagagtgtgggctggtggcccacccaaaggccttgtaattagtctcaagggagccatttatatcccagaggaatccttcatcttcagtcttcctgttctacccaggaaaggtctccttccattaagatatcccttggtttctccatgtgctcttgaataaaatggaaaatgactcagtgaaagataaggaatttgaaaatcccaaatccaagtgttcacatccgccttctggggtggttgttacataaagaatggcataaaataaa

SEQ ID NO: 56424 - DNA, 601 bp, Human
ctagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggtagagttacccatcagccttcacccacgtgccaccactgacccactgggtaacgtctcagggcctcagcttgacctrtcccccaggttcagagtgtgggctggtggcccacccaaaggccttgtaattagtctcaagggagccatttatatcccagaggaatccttcatcttcagtcttcctgttctacccaggaaaggtctccttccattaagatatcccttggtttctccatgtgctcttgaataaaatggaaaatgactcagtgaaagataaggaatttgaaaatcccaaatccaagtgttcacatccgccttctggggtggttgttacataaagaatggcataaaataaatgctcagaccatgggaagagaaa

SEQ ID NO: 56425 - DNA, 601 bp, Human
ggctggtggcccacccaaaggccttgtaattagtctcaagggagccatttatatcccagaggaatccttcatcttcagtcttcctgttctacccaggaaaggtctccttccattaagatatcccttggtttctccatgtgctcttgaataaaatggaaaatgactcagtgaaagataaggaatttgaaaatcccaaatccaagtgttcacatccgccttctggggtggttgttacataaagaatggcataaaataaatgctcagaccatgggaagagaaacagaccgaagggaggggaagrgtggggaggggagaaagccatgtgtgaggaagcactccaggtgcaccctccggagggcacagggtatgcaaggagcagctcccatctcgggagccacatgtgggaccctcatgcattcccaagacagccagcctgacagccctttgcagagttcttcgtggtggctgggcattcaaatggaaaagggcaggttccagggagaaatgaacattcgtgttgcatgagttataacaggggtgagacacatcagcagtgtcagactgggttcagctacaagtcacaggacacttgtcgccaatt

SEQ ID NO: 56426 - DNA, 601 bp, Human
aagtgcctggagagcggcatgaagaaggagagtgagcagtgggcgcgcgggcgggccggcgccggggtgcacggctctgagtaaggacgtgccgtgggtgtgtgcatgcttgtgtggagatgcgcgccgagtgtgcgcgtgaacacacgtgcacatgtgagctggtgtccgtgtgcaacaggcagccacctgggggagcgcttgcagtcggccctctgggagatggagggagtcggtaatctctgccctgggatgtgtgctgggcagccctggacagggcgtgccctctgtctcccctcasttgctcctgcatcattctttttgtccccttcataattgttgtaatggtttgaaaccacatttgcgggtaggagtgtgaatctgggggagggaagcaggagccacatgggtgataggacccggggccttctaggtgctagccccatcagctgccccagacctggatctttataggggaactgtttgcagacaggtgacatgaggtgttctcattctacctatttaactttgatatatttgtgctcctaggtcactatgagattaaggctcatgcggaaaaggctaggtgtttctggtgcat

SEQ ID NO: 56427 - DNA, 601 bp, Human
tttcaagaatttccgggtaggaggaactgcacagtgacccgaggtgtcactgccatcttcattctcacatagaaactgaggttccccaaggataagaaacttatacaaggtcacagctaatcagtggtggagggtagatttggagagctggtcctgcatctgtgctagctcctcaaagccttagtctcattcccaaaggttctgaaagtgtggtccctgggtcagcagcatcagcatgcagattttcaggtcacctcagatctcctgaatctgaagctccagggaggggcaggaccccccrgtgattctgttgcaggttcaggtttgaaaaatcactgctctctcctttaaggcaggtaggaactgggtctaagcaataagtggagggaaagctaggcagttccccagtgttgctggcattcggggctttatgaggacaggatcaggacctgttgggggtgtgacttttgtgaactggtgtttcttgatcccagcacattaactatgtctgtgctctaagtgccctccttcccctttgcactgatagatatctcaagtggcccttcacagcccaaataactggattagcccagtgacctca

SEQ ID NO: 56428 - DNA, 601 bp, Human
cagccccagaatatgtgtgcagtcgtaggattagggatggtgccaggtgtatctgtccttgggtaggccaccttgccttgccaagcctggtcaagtggggctgaaacacacctgccacaagctcctggtttcttcagcaggttgagggtaggttatactctaggagcccagaggttcttctctggccctgtaggagtcatgcgtgacttatttaatggggtgatgctgacagcaggtttggaatggggttcagatggtagcaaataagcttaaaggggcagggagagaagaatacttatamatgtggacattgggagatctttggtgaaatccagtgactgacaatttaacaccagggcttcccacttgctatttctcaaggccaccaatgtcgagcacagtgacctgaggtgtcactgccatcttcattctcagatagaaactgaagttccccaaggataagaaacttgtacaaggtcacagctaatcagtggtggaggctagatttggaagtaccaaagccagctcgatgccaggtcctaagctgggcaatggggaggcacagaagaataagatcaattacatggcatttgtagctcag

SEQ ID NO: 56429 - DNA, 601 bp, Human
agcctccctctcaggctgtgaagcttcctccttgtaaggaatgcctccttactggggaggtgggggcccctcccaggttgggagggagtgatccctgcaggaccggaagggtatccatgtaaccataatctcagaggcttgttaagccgcctccatggttaggcctgtgcttcagcgctaggagtggggcttcaggcatctgggctgcagggaaacagtagaaatacatgtgtgcacattaaacccaacaccgacagcaggaagcaaacatccccactactggaactcaggccaaaagggyggcactttcactctggaaaggggagactgcactctggaaagacttctgagaggggcaaagacatagcatggcctgaggggctagcaggatatactaaaggggaagtcattccaagggggaaactgaggcagaaaggaggaggccagggaccagaagccaaagcactagctgtaggtcaggatttgtataggagctgaaggagatggggccagcctgtaagggacctggatgccaagctcagtgggtggagttcccggaggttggaggggaggagaggatgctgcggggcagagctgtctg

SEQ ID NO: 56430 - DNA, 601 bp, Human
ccaactctagaaaaattttaaaaaattagccaggtatggtggcatgtgctctagtcctagctacccaggaggctgaggctggaggtctcttgagtccaggagtttgacactgcagtgagtccatgatcgtgccatcatgctctagcctgggtgacagaacgagatcctgtccctttaaagaaaaaaaaaaaaaaaagacacagctcccatgaatgggatgggagtggggagagtattgggcaggctgttctgcctttctcatctacagggtaaaagagaagcttacggaattcagccaagscttgtctcttggctgacctgaaatgtccagagattatgcttgtgcagcctcagagcagccctgaggcttgtgggtcagggcgggctgcacccacaatcttttctctggctggcatgcaggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagcc

SEQ ID NO: 56431 - DNA, 601 bp, Human; identical to SEQ ID NO: 56410

SEQ ID NO: 56432 - DNA, 601 bp, Human; identical to SEQ ID NO: 56411

SEQ ID NO: 56433 - DNA, 601 bp, Human; identical to SEQ ID NO: 56412

SEQ ID NO: 56434 - DNA, 601 bp, Human; identical to SEQ ID NO: 56413

SEQ ID NO: 56435 - DNA, 601 bp, Human; identical to SEQ ID NO: 56414

SEQ ID NO: 56436 - DNA, 601 bp, Human; identical to SEQ ID NO: 56415

SEQ ID NO: 56437 - DNA, 601 bp, Human; identical to SEQ ID NO: 56416

SEQ ID NO: 56438 - DNA, 601 bp, Human; identical to SEQ ID NO: 56417

SEQ ID NO: 56439 - DNA, 601 bp, Human; identical to SEQ ID NO: 56418

SEQ ID NO: 56440 - DNA, 601 bp, Human; identical to SEQ ID NO: 56419

SEQ ID NO: 56441 - DNA, 601 bp, Human; identical to SEQ ID NO: 56420

SEQ ID NO: 56442 - DNA, 601 bp, Human; identical to SEQ ID NO: 56421

SEQ ID NO: 56443 - DNA, 601 bp, Human; identical to SEQ ID NO: 56422

SEQ ID NO: 56444 - DNA, 601 bp, Human; identical to SEQ ID NO: 56423

SEQ ID NO: 56445 - DNA, 601 bp, Human; identical to SEQ ID NO: 56424

SEQ ID NO: 56446 - DNA, 601 bp, Human; identical to SEQ ID NO: 56425

SEQ ID NO: 56447 - DNA, 601 bp, Human; identical to SEQ ID NO: 56426

SEQ ID NO: 56448 - DNA, 601 bp, Human; identical to SEQ ID NO: 56427

SEQ ID NO: 56449 - DNA, 601 bp, Human; identical to SEQ ID NO: 56428

SEQ ID NO: 56450 - DNA, 601 bp, Human; identical to SEQ ID NO: 56429

SEQ ID NO: 56451 - DNA, 601 bp, Human; identical to SEQ ID NO: 56430

SEQ ID NO: 56452 - DNA, 601 bp, Human; identical to SEQ ID NO: 56410

SEQ ID NO: 56453 - DNA, 601 bp, Human; identical to SEQ ID NO: 56411

SEQ ID NO: 56454 - DNA, 601 bp, Human; identical to SEQ ID NO: 56412

SEQ ID NO: 56455 - DNA, 601 bp, Human; identical to SEQ ID NO: 56413

SEQ ID NO: 56456 - DNA, 601 bp, Human; identical to SEQ ID NO: 56414

SEQ ID NO: 56457 - DNA, 601 bp, Human; identical to SEQ ID NO: 56415

SEQ ID NO: 56458 - DNA, 601 bp, Human; identical to SEQ ID NO: 56416

SEQ ID NO: 56459 - DNA, 601 bp, Human; identical to SEQ ID NO: 56417

SEQ ID NO: 56460 - DNA, 601 bp, Human; identical to SEQ ID NO: 56418

SEQ ID NO: 56461 - DNA, 601 bp, Human; identical to SEQ ID NO: 56419

SEQ ID NO: 56462 - DNA, 601 bp, Human; identical to SEQ ID NO: 56420

SEQ ID NO: 56463 - DNA, 601 bp, Human; identical to SEQ ID NO: 56421

SEQ ID NO: 56464 - DNA, 601 bp, Human; identical to SEQ ID NO: 56422

SEQ ID NO: 56465 - DNA, 601 bp, Human; identical to SEQ ID NO: 56423

SEQ ID NO: 56466 - DNA, 601 bp, Human; identical to SEQ ID NO: 56424

SEQ ID NO: 56467 - DNA, 601 bp, Human; identical to SEQ ID NO: 56425

SEQ ID NO: 56468 - DNA, 601 bp, Human; identical to SEQ ID NO: 56426

SEQ ID NO: 56469 - DNA, 601 bp, Human; identical to SEQ ID NO: 56427

SEQ ID NO: 56470 - DNA, 601 bp, Human; identical to SEQ ID NO: 56428

SEQ ID NO: 56471 - DNA, 601 bp, Human; identical to SEQ ID NO: 56429

SEQ ID NO: 56472 - DNA, 601 bp, Human; identical to SEQ ID NO: 56430

SEQ ID NO: 56473 - DNA, 601 bp, Human
ctgctggagggacagacggggcgtgcggctgaccatcccgtgcccgcaggctgaggatgcagcgctggaaggcggcggccttggcctcagtgctctgcagctccgtgctgtccatctggatgtgtcgagagggcctgcttctcagccaccgcctcggacctgcgctggtccccctgcaccgcctgcctcgaaccctggacgcccggattgcccgcctggcccagtgtaagctcctcctctgtgtggggtcagatacccccaacgtaaggggtagaatttcaggcagtggagtgggaggtgtggggggtgtcataggttttttaaagatagggccagccagcccccttgcagggaggcagggacagacatcctaaaagattattcagggcaaggcatggtggcgcctgcctataatcccagcactttgggaggctgagacaggaggatctcttgagcccaggagttcatgaccagccagggcaatgtagcgagaccgccatctctacaaaaaacttcagaaattagccaggtgtagtggcgcacgcctgtagttccagctacttgggaggctgaggtgggaggatcacttgagcccaagagt

SEQ ID NO: 56474 - DNA, 601 bp, Human
aagcccggggcctcagagcagacgtcggggcctgaagagggggctctagagacctatgacaacctcactaaagagggatagggcatgggaagcagccccccagtgctgcccagagaggatgcaccagtgtcctggggcagcccagcataggggcggggtccagatagatttgcgatggaggacgaggagaatggagcagcaatggggtgagagaggggcccagaggaggtgagttagagaccccggtcagctcagctcaaggtgagacgggctggaaagcggcccagaaaggatggaccakgttctgggcagccaatataggctcagggttcagaaaggggttttggaccagcgtaggggtgtgagtgtgtacgtgccccccagtgccgcccagagagggtgcatgagcagctcagcaagagggtggggaaatttgggacctgggagtgagacgagaagccgtctaggcctggcgtcccagcaagggtcttcgtttgcaggggtacagagagggtagggggctccctcccaccccctgcacccactgaccccccctcctttctcttcctcccctcgcagaccgtgcactcctgcagggggc

SEQ ID NO: 56475 - DNA, 601 bp, Human
gcccagcataggggcggggtccagatagatttgcgatggaggacgaggagaatggagcagcaatggggtgagagaggggcccagaggaggtgagttagagaccccggtcagctcagctcaaggtgagacgggctggaaagcggcccagaaaggatggaccaggttctgggcagccaatataggctcagggttcagaaaggggttttggaccagcgtaggggtgtgagtgtgtacgtgccccccagtgccgcccagagagggtgcatgagcagctcagcaagagggtggggaaatttgggayctgggagtgagacgagaagccgtctaggcctggcgtcccagcaagggtcttcgtttgcaggggtacagagagggtagggggctccctcccaccccctgcacccactgaccccccctcctttctcttcctcccctcgcagaccgtgcactcctgcagggggccccggatgcgatggagctgcgcgagctgacgccctgggctgggcggcccccaggtccgcgccgtcgggcggggccccggcggcggcgcgcgcgtgcgcggttgggggcgcggccttgcgggctgcgcgagctggaggtg

SEQ ID NO: 56476 - DNA, 601 bp, Human
ggtcgcggccactacgatgccgggagccgccggggtcctcctccttctgctgctctccggaggcctcgggggcgtacaggcgcagcggccgcagcagcagcggcagtcacaggcacatcagcaaagaggtacagtcgaggcatgggcttgggttgcatcctttgccgggaccgagattcctcacttcttccactcttccgagagttgctgtctgtggactgccgtcttgcttcgccttcagagagtgcgctctggggcaagaggaacttgaagcaagttcaagttcaatgccatgagagcrtagtgtagggggaattacctaagtcctgcaaaaggaacggggagtgcttttcattgttctttagtttcgaagaggtcttgctatcacgatacatcccgtaaattgatttctgaaatctttccaagaggaaaactttttccaattggaaaaaaaagaatttcttcaaatcagagcccatcctgcagagaaaggcttcccaagctgtgtggttcatcctgggactttatggagggtagctgatgcatcaaaaaaaaattatatatatatatatacacacacacacacacacacacacacaca

SEQ ID NO: 56477 - DNA, 601 bp, Human
ctaagtcctgcaaaaggaacggggagtgcttttcattgttctttagtttcgaagaggtcttgctatcacgatacatcccgtaaattgatttctgaaatctttccaagaggaaaactttttccaattggaaaaaaaagaatttcttcaaatcagagcccatcctgcagagaaaggcttcccaagctgtgtggttcatcctgggactttatggagggtagctgatgcatcaaaaaaaaattatatatatatatatacacacacacacacacacacacacacacacacacatatatatatatataaagttttacagaactttgttttcaacttttaaaacaggatttctaaagaagttatgtggttttttttctttcatggcaatggcgcctccagcctcacctttttcaaacccacatcttatcttcatatcctattttattgtagtgaaatcgtgaaatttctccttttgcttaaatacagaggagacttctatgtcatgtgtactttaaggccacagtgactagatatacactttggaggactttggaagatggctgtatttaatgtaacttaaataacttattctcctcagagcctctta

SEQ ID NO: 56478 - DNA, 601 bp, Human
agtcctgcaaaaggaacggggagtgcttttcattgttctttagtttcgaagaggtcttgctatcacgatacatcccgtaaattgatttctgaaatctttccaagaggaaaactttttccaattggaaaaaaaagaatttcttcaaatcagagcccatcctgcagagaaaggcttcccaagctgtgtggttcatcctgggactttatggagggtagctgatgcatcaaaaaaaaattatatatatatatatacacacacacacacacacacacacacacacacacatatatatatatataaagttttacagaactttgttttcaacttttaaaacaggatttctaaagaagttatgtggttttttttctttcatggcaatggcgcctccagcctcacctttttcaaacccacatcttatcttcatatcctattttattgtagtgaaatcgtgaaatttctccttttgcttaaatacagaggagacttctatgtcatgtgtactttaaggccacagtgactagatatacactttggaggactttggaagatggctgtatttaatgtaacttaaataacttattctcctcagagcctcttagtg

SEQ ID NO: 56479 - DNA, 601 bp, Human
aagaggtcttgctatcacgatacatcccgtaaattgatttctgaaatctttccaagaggaaaactttttccaattggaaaaaaaagaatttcttcaaatcagagcccatcctgcagagaaaggcttcccaagctgtgtggttcatcctgggactttatggagggtagctgatgcatcaaaaaaaaattatatatatatatatacacacacacacacacacacacacacacacacacatatatatatatataaagttttacagaactttgttttcaacttttaaaacaggatttctaaagaagttatgtggttttttttctttcatggcaatggcgcctccagcctcacctttttcaaacccacatcttatcttcatatcctattttattgtagtgaaatcgtgaaatttctccttttgcttaaatacagaggagacttctatgtcatgtgtactttaaggccacagtgactagatatacactttggaggactttggaagatggctgtatttaatgtaacttaaataacttattctcctcagagcctcttagtgtttatgtatatatagctctcatttctgaaactttggggagtctttgaa

SEQ ID NO: 56480 - DNA, 601 bp, Human
attaagaatttttgacatgaatcaaccatttttagatgttgcagttgagttagaaacataaccagactttttgttttttactttttctttgaaatcttatgtggtttctatagcatactcgattgtagtatgaatagcattgattcagcaagaatgatattccaaggaaattctttagctatatttaaaattgacgaaatagaatgatgcaatcaaaatgattctgcatttcagcaaggcagtgtctaaaatgttttctgatattcttgtgaataatatgtggaaactgaagcataatggyaggtaaattgcaactgattgaaaaatagttcacaaagaatattgcatagtggattaaggtcaatccggaaagaagtctctagcagtgcaacagaggttttcttatactcaactatcttggtaatggcttgatggaaaatgtaaaatccaagcttatcagaactgcatgtggtccaaaattgatagaggtggctaagctggttactaacaagttcagaaattttaaaggtctctatagccttgaccatgaatggcacctacatgaagttgcttttattattcatatccacatgttaaaaaa

SEQ ID NO: 56481 - DNA, 601 bp, Human
atagtgtaatatggtgacaaaaaaggttggctcacttttacacaaaactcatagaagcacataggtctgttgcttaacacacatttgggtatttcattgacaaatgggtgtagatgcagagaagggagagcagaatggttaagagtctgagaagattttcagaagaggaatgtcccaagtaaaatctttccatctgaacaaggaaagatttagggaaggcaatcataaggactgtcctcaaattttcagaagagtcgttatgttaaagagggactattctaaaggctgaaggtggatccayagaagaacatgacaaacaaccaggtttgaattttataatatggagaaaatagctcctctcctcacttcctccccatgccattttgagttgttcagaaatagctgaattgtgtttgagcaacttgcttctggaaatgaccatgcagtgatcagatgtacagttagtgagggatgctttatgagggaatgcctctactgagaggaagttaagactcatcaactgtctagccatttgtcagttctaagattctaatattatagtctattgcttttagagtgcatacttgcatttaaatttctg

SEQ ID NO: 56482 - DNA, 601 bp, Human
tttcattgacaaatgggtgtagatgcagagaagggagagcagaatggttaagagtctgagaagattttcagaagaggaatgtcccaagtaaaatctttccatctgaacaaggaaagatttagggaaggcaatcataaggactgtcctcaaattttcagaagagtcgttatgttaaagagggactattctaaaggctgaaggtggatccatagaagaacatgacaaacaaccaggtttgaattttataatatggagaaaatagctcctctcctcacttcctccccatgccattttgagttgytcagaaatagctgaattgtgtttgagcaacttgcttctggaaatgaccatgcagtgatcagatgtacagttagtgagggatgctttatgagggaatgcctctactgagaggaagttaagactcatcaactgtctagccatttgtcagttctaagattctaatattatagtctattgcttttagagtgcatacttgcatttaaatttctgaattcttaaaatgtcaagaaaatgttaaatatataaaaatgtgtttttaaatcccttctgggatttaaaataaaaacatgtttgagacaat

SEQ ID NO: 56483 - DNA, 601 bp, Human
gaaggtggatccatagaagaacatgacaaacaaccaggtttgaattttataatatggagaaaatagctcctctcctcacttcctccccatgccattttgagttgttcagaaatagctgaattgtgtttgagcaacttgcttctggaaatgaccatgcagtgatcagatgtacagttagtgagggatgctttatgagggaatgcctctactgagaggaagttaagactcatcaactgtctagccatttgtcagttctaagattctaatattatagtctattgcttttagagtgcatacttgyatttaaatttctgaattcttaaaatgtcaagaaaatgttaaatatataaaaatgtgtttttaaatcccttctgggatttaaaataaaaacatgtttgagacaatcctcacacatttttggcaagaatacttagatatttagcatggattttccacatcatcgtcaattgcacagttctaaaacatcttgtgttataacacgcaagaatactttataaattacctgagaaattttcaggggattcatagtggccataaacctggaattaatttttttaaatatttttctttgctgcatatg

SEQ ID NO: 56484 - DNA, 601 bp, Human
agttagtagagtttgctgcatcaaatatattttttcaaatgcctacatattatagttgacacaatttcctggctttattgccttctgtgcaattttcaattattggatgaggctgaaagtttgaaagagaatatgaagcagtgcaattgtcatttcagtgagctacctcatctcattggtttgtcgtggtacatatgtaaaacactgaatataaaacatgaaacatctagtaaggcctcaataaatgttcattttcaaaatgcctcaaaaaatgaattaaacctaacaacctaacatgacwttctctggctgaaagaaacactcttctccaacatcatgtggtataccaaattcagttgagactgtttgtgaaggaaggaatttgcttatatacttaaacacacaagtatttgaattctaattagaatttgtgctgcagtatttctttattctcaactttatagcttagcctacaataaaaactcttatcaatacgtacctctttatacctttagtttccacatacagtactcttctttggaggtaactgaatcgtagaaaacgtatggacttaggagaaggctagactcggatccatagc

SEQ ID NO: 56485 - DNA, 601 bp, Human
agaatttgtgctgcagtatttctttattctcaactttatagcttagcctacaataaaaactcttatcaatacgtacctctttatacctttagtttccacatacagtactcttctttggaggtaactgaatcgtagaaaacgtatggacttaggagaaggctagactcggatccatagccaagtcaccactttactaagatcaaaagcctgagtcaacggagttaaattttctattcgtaagataggtttaggttagataataaatgtgaaaatacttgccagctaatcagtaaatactagytcttttcttctttattttatgagcataaaactaaaaaaaaagatttgctttgcatatagcatatcctttttgcttaagaacagcaaaatattctaaaaatttctttgaggagaccctaagagactatagatggcaaactatttatctcattgccaagagattgaataattctgtcgaggttacacagcaagtcagtaacagagataagaagaaacacaagttcctataattagctaacagttatgttagtagctctgtgtgagaagtgatttaaaacaggcaacatgatggaaatttttg

SEQ ID NO: 56486 - DNA, 601 bp, Human
ggcttaatagaagagaactggattctcatttctgcctctgcgttcaaattattacatgttattttagtttaaattattttggtttaagcatattaagaaatatataacaacaaacatagataagctattggaaaaaagaggagtctgtcagtgccttttaagatagctgtaaatattctttgattctataccaaaactcagtaagtggtagttttcaaaagattggctgcagtgtggtatctgaaactgcatcaacgatatttttgtacgcttttatattaaaatctacggatctatcttrcacctggaaagaattttacccatgtgtgatgttatagtatcattcatagatcatttggaagatactgatttactagttatgcagatcagccacaacttgacagattttcttataaaatattttaattacattttttatgactattgatctcaccagaaaagtccctaaatattagaagctgttaatctcacaatggtagagacaaatttttcagaatttttattttcatttgtaagtttctgtagttattgacaaattttgttatttttcttgaaatagttactttattcattcttaaga

SEQ ID NO: 56487 - DNA, 601 bp, Human
tctgaaactgcatcaacgatatttttgtacgcttttatattaaaatctacggatctatcttacacctggaaagaattttacccatgtgtgatgttatagtatcattcatagatcatttggaagatactgatttactagttatgcagatcagccacaacttgacagattttcttataaaatattttaattacattttttatgactattgatctcaccagaaaagtccctaaatattagaagctgttaatctcacaatggtagagacaaatttttcagaatttttattttcatttgtaagttyctgtagttattgacaaattttgttatttttcttgaaatagttactttattcattcttaagaaaatgtttatcaaacaaatgagtcttaaaaaccatagttagatcctttttgtagtacatagggtattccacgaaaaaagtggctagtttagcttgcagctgaaaacaactgtacaaatgcttttcctcaaatcaaccatcatgcttcagtatacagttgatgttaaaaagatgtacccaagatttaataaatttaatcattgttactacttcatcaagtacattcatctgtgaaactag

SEQ ID NO: 56488 - DNA, 601 bp, Human
actagttatgcagatcagccacaacttgacagattttcttataaaatattttaattacattttttatgactattgatctcaccagaaaagtccctaaatattagaagctgttaatctcacaatggtagagacaaatttttcagaatttttattttcatttgtaagtttctgtagttattgacaaattttgttatttttcttgaaatagttactttattcattcttaagaaaatgtttatcaaacaaatgagtcttaaaaaccatagttagatcctttttgtagtacatagggtattccacraaaaaagtggctagtttagcttgcagctgaaaacaactgtacaaatgcttttcctcaaatcaaccatcatgcttcagtatacagttgatgttaaaaagatgtacccaagatttaataaatttaatcattgttactacttcatcaagtacattcatctgtgaaactagttgtttttttcttctgggagtgtgtggtggtgaaaactaaactgaccactagcatggtttagtacccctgccttgatttgtgctaatgtaccatcagtgtttcccaccactattgcttttgcaccatcagtgc

SEQ ID NO: 56489 - DNA, 601 bp, Human
ccactagcatggtttagtacccctgccttgatttgtgctaatgtaccatcagtgtttcccaccactattgcttttgcaccatcagtgcacatgtcaacacaatgaaaaggcagataataattaaatcttgttactaaaaggatttttgaacttgtgtacctatggataatgtattgtggactcccagggattcacagatctttctttgagctctacagggttggactacagttaagttcctcactgcctgcctcttcaccaattctacaaaatctatagccatatgaaggtaaattttgcwatcagaaaaagccaaaaccacttcagtttttacctcaggtctagtctaggagagtgataccatttctttttaagggggaagaaatccagaaaagcttcttctgtggaaaaagcaggaagtgttaaaaccagccagacatacatatagaaatcaaaatctctgccatatcatctgcccttcttaatttcctttcacttgcccaaactatagtagagatagtgtacttacccacagttggacatatgatgttattcctaatagacttaaaaagtgaactcatggcggggcgcggtggctcac

SEQ ID NO: 56490 - DNA, 601 bp, Human
agatttttattccttgctgagctcctgaactcacatcaggaggggtcctttgttcttttcatagaaagaattcctgttggaagcactggatatcgtatttctcaaaatatggaatttccttcatttatttctagcctttgaagttttgtgatttctaaagcatttaaaaggttttgtaatgttgagaacctaaaacgtgattcttttctctgtgcccatctcataccattgtatgtgtgtcatatgatggatctggtttctttttcttatttgttgggagatgtccagagactcaaggatstatcctttgaccaaatttttcactcttcaagggcctcatactgctctgatttcagatgtatagatatattgcttatcaaacactgatgggtctgaacatgagtggtagtaagatatttccagattaagtagacaaattgtgcagaactttttagtatcactatttaaatgactaaatttttgaggtttatgtgtatccagcccaatatgtcctctccttatctagtataatttatctttaaaaattagactggcttggcatatgtcagattttgtatttaacagactttttatatatttc

SEQ ID NO: 56491 - DNA, 601 bp, Human
gtttgagtcctagattcacaccttgctggctgagtgctgttgcaatagtgctgttgagtgagttatttaacttctttaaacctgatcatcctcacctttaagagaatgaaaatagtagtgcctttttaaggattaaatggaattaagtatttaatttgtattcagaagaggatggaatcatcattcaaagactttacaatcagtggtgttttcagcatggacaactggagctttaacttaaaagatctagaaactgggcttgttggccacagttttagtgtgattagaggtggtcataggktagtcaaagttgccactatcctggttatggatggtaatagaactgcctatttatttgatgtcttcacttagttgtctcctaggtccttcacagcgaacatttgccaggattgaacataggtactctgcatttcctcaactcttttcccatcagcttttcccaactcagaaaatggtaccatcattcaccccttgaatcaaatttgacatctagaagttactattaacttctctctttccttcacctcccagattgaaataatcagcatgtctgtcatccacaccaccagagtttattcca

SEQ ID NO: 56492 - DNA, 601 bp, Human
cctagattcacaccttgctggctgagtgctgttgcaatagtgctgttgagtgagttatttaacttctttaaacctgatcatcctcacctttaagagaatgaaaatagtagtgcctttttaaggattaaatggaattaagtatttaatttgtattcagaagaggatggaatcatcattcaaagactttacaatcagtggtgttttcagcatggacaactggagctttaacttaaaagatctagaaactgggcttgttggccacagttttagtgtgattagaggtggtcatagggtagtcaargttgccactatcctggttatggatggtaatagaactgcctatttatttgatgtcttcacttagttgtctcctaggtccttcacagcgaacatttgccaggattgaacataggtactctgcatttcctcaactcttttcccatcagcttttcccaactcagaaaatggtaccatcattcaccccttgaatcaaatttgacatctagaagttactattaacttctctctttccttcacctcccagattgaaataatcagcatgtctgtcatccacaccaccagagtttattccataaatatc

SEQ ID NO: 56493 - DNA, 601 bp, Human
ataagattaaaatgcccatttaagatgtaaattatagggataaaatatagataactcacatggggtgatttgattggcatctgttttcatttttctttgtttctttttagataccaccaaagtccttcctatttcaggcaaaaagatatgttttaaaaaccactcacaaggcctctacaatatgtcagataatgcatgtgcgtgaatgtccttggatgtgtatggtctcttgcttgaagttatcagccagcaaaatggtgaaatacttagaattaatcaaacatctggaggtcaagaaacrcagtacctatattcttctccttactttaagaatgaaactaataaaaaataaggcggagctggcccttcagcaaaggagggatttttattatatgagtgaatttgagagaaagggggacaagaaaagacctttgagatcagggcccaggtctgttttgttactactgtatccttactgcatagcacagtgcctggcacctagcatggtcacagtaaagattgaatgatagaaaaatagaaaaggaagagctaacttttaggaaggaacacttacttcccacttacagttattgaaaaaact

SEQ ID NO: 56494 - DNA, 601 bp, Human
acttttaggaaggaacacttacttcccacttacagttattgaaaaaactatgaagatggttaacatcatgatactgtcggatgtaggcagttacaatttctactcaacgatagaaaaaagaactaaagagaatttaccaggacatgaaagaaaggtgtaagatcatggattcctgaaacaggatgttccaattaaatatttaaatttaagtgaggattgtaggagtttaacagctatttaaaatacgccctgctgctttccttcctaggttctccacaccttcaaagctcatcacttggayaagattgcctctttactttttccaaatcaatctggttcatccattttttgcaaaaatgaaaactcccctctttcactaaggtatttgagccatcaagaacaccctcctgtctaggcatggtggctcacagctataatcccagctctttggaaggccaaggcaggaggatggcttgaggccaggagttcaagaccagcttaggcaaaatagtgagatccctgcctctacaaaaataaaatgaaaaaattagctgcgtgtggtggcacatgccagtggtcccagctactcaggaggctgaga

SEQ ID NO: 56495 - DNA, 601 bp, Human
ttaacagctatttaaaatacgccctgctgctttccttcctaggttctccacaccttcaaagctcatcacttggataagattgcctctttactttttccaaatcaatctggttcatccattttttgcaaaaatgaaaactcccctctttcactaaggtatttgagccatcaagaacaccctcctgtctaggcatggtggctcacagctataatcccagctctttggaaggccaaggcaggaggatggcttgaggccaggagttcaagaccagcttaggcaaaatagtgagatccctgcctcyacaaaaataaaatgaaaaaattagctgcgtgtggtggcacatgccagtggtcccagctactcaggaggctgagatgggaagattacttgaacccgggaggtcgaggctgcagtgacccatgatcacaccactgcactttagcctgggcaacagagcaagaccttatctaggaacaataaaaaattcattattcattatttgatccaaaacaaaaacatgttatagactatctatagattcaattttcaaaaatcctatgcttctcatctctaaatattgttataatactgcaattttcaa

SEQ ID NO: 56496 - DNA, 601 bp, Human
gaaagcaaacacattcttcttcatgatgtcaggaaggagaagtgcagagcgaagtgggggaaaagccccttataaaaccatcagacctcatgagactactcactatcctgagaacagcatgggggaatcactctcatgatctaatcaccttccaggaggtccctcccccaacacatggggattacaatttggattacaattcaagatgagattttgtgaggacactgagccagaccatatcactaagagaataaaaatggacacagaatgccactttcctattccctttaaatatttccasttgaaagtatttccatgacctagtgagttcttagagaattcaatcactattgatgtcccaactggtataataaaagaagaaaacacataattttgagacaaattccacctttctcacactctcagcatataaacacataatcgaagcaagaaaaatgagaaaaaatcaaatatataatatgatgaagaattttacactattcattatgacatgtggggccaaagtgacaaaagtaattggacaaaggtagactcagcaatgaggacttggaagaaatgagctttcagtcccattttaaag

SEQ ID NO: 56497 - DNA, 601 bp, Human
gttactggaattgtgctttgtgcattacatttcattgacgtaattttaaacttccattctacttcactacaaatggaatttcattatatctgactccacaataagtgggttccagaatcgttgacatttagtagaattacagatcttagtgtctttgtacattctgtattaaaatgcattatgtgtgctttcaattctgttttaaagaaattgccattgatttacatggttgtatggaagagttttgtttaaatgccattgcctgatttcctggtggcttttattttccttctgaaatcayttacaaatatttcttagggtattggctactgttggtttgaaatgagatacaacttatggattataaatatgtttgtgcaaattttctctagcagtaattctaaaacctttgtggacattaagctgtaattgtagctttctcttgcaagcttctttatcctctgctttattattcccttgtaggaaattaagtattttatataataatgcttagaacatctttctcttttaaagagggaaattaagataaagagcttggcaaatataggatctttcctggattgtatgtttctgagatttg

SEQ ID NO: 56498 - DNA, 601 bp, Human
cttccattctacttcactacaaatggaatttcattatatctgactccacaataagtgggttccagaatcgttgacatttagtagaattacagatcttagtgtctttgtacattctgtattaaaatgcattatgtgtgctttcaattctgttttaaagaaattgccattgatttacatggttgtatggaagagttttgtttaaatgccattgcctgatttcctggtggcttttattttccttctgaaatcatttacaaatatttcttagggtattggctactgttggtttgaaatgagatamaacttatggattataaatatgtttgtgcaaattttctctagcagtaattctaaaacctttgtggacattaagctgtaattgtagctttctcttgcaagcttctttatcctctgctttattattcccttgtaggaaattaagtattttatataataatgcttagaacatctttctcttttaaagagggaaattaagataaagagcttggcaaatataggatctttcctggattgtatgtttctgagatttggtgacagagcgtctgctgtggaggatggggaaggacggatctgggctgaa

SEQ ID NO: 56499 - DNA, 601 bp, Human
ggagttagtaaccacctcaaaagacagctttctgactcgtcattataccacctacagtcttacttttagcttggtttgagggtgtcctgttcattacttacagaaacagatttggagtgtgaatgcccttaacaccagttttaataagcatttttaattctacaataatgtgattcagagaatttttttttcctttgtctctatctccctagatagaaatatgtggaggttggatttcctgctgagtttctttatttttttcctttcttttttttttttttttttttaagatggagtctcmccctgttgcccaggctggagtgcaatggcgtgatcttggctcactgcaacctccgcctcccgggttcaagtgattctcctgcctcagcctcctgagtagctgggattacaggcgagcgccaccatgcctggctaatttattcttgtatttttagtagagatggggtttcactatgttggccaggctggtctcgaactcatgaccttgtgatctgcctgccttggcctcccaaagttctgggattacaggtgtgaaccacagtgcccagccttcctgctgagtttcttagcattattgcca

SEQ ID NO: 56500 - DNA, 601 bp, Human
cttgtatttttagtagagatggggtttcactatgttggccaggctggtctcgaactcatgaccttgtgatctgcctgccttggcctcccaaagttctgggattacaggtgtgaaccacagtgcccagccttcctgctgagtttcttagcattattgccaggtcggaacttaggcatagtaacatgaaacatgttctgcatctgaaggccagaatataataagcattgttaatttagttaaaggaaaaggctgctgttgaaggttagacttcttgtgtatgtgtgggagataacagaataaygtctcttttccaagatgcatatggttttcttttgcttatgtgccaattttaatcaatggagaaattaatatgttaaatgaaataattaaccattttataattttagtcggatattggttgaccagtacttatatgatggtataaagttctagaaactggataactttaaaaatctttccatataatgcattatattctgggtcatagtttcctatattataactgctaaacaacataaaccaattttattttcaaaatcaatctttggggtaacttctacttagagccctgacctaataa

SEQ ID NO: 56501 - DNA, 601 bp, Human
tttaactatttttttctgttccattgcaggcatagtaccaattctgtgtcaggcattttattcactttgtttcaactgttcttgagatcccggaggattaggactattgcagttataagtctataactgaggaaaggaagcttatctggacaggaagatatttagagtatgatataaagacagtctctttttaaaaacagcattttaaaggtataatttcttttttgtttgtttttttcgtttttttattttttatttttatttttttcttttattattatactttaagttttagggtacrtgtgcacattgtgcaggttagttacatatgtatacatgtgccatgctggtgcgctgcacccactaactcgtcatctagcattaggtatatctcccaatgctatccctccccactccccccaccccacaacagtccccagagtgtgatgttccccttcctgtgtccatgtgatctcattgttcaattcccacctatgattgagaacatgcggtgtttggttttttattcttgtgatagtttgctgagaatgatgatttccaatttcatccatgtccctacaaaggacatgaactcatcatt

SEQ ID NO: 56502 - DNA, 601 bp, Human
caatggcagacgcccctcccccagcctcgctgccgccttgcagtttgatctcagactgctgtgctagcaatcagtgagactccgtgggcgtagtaccttcccagccaggtgcaggatataatctcgtggttcgccgttttttaagcccgtcggaaaggcgcagtattcgggtgggagtgaccagattttccaggtgccgcccatcacccctttctttgactaggaaagggaactcccctgaccccttgcgcttcccgagtgaggcaatgcctcaccctgcttcggctcacgcacggtgcgygcacccactgacctgcgcccactgtctggcattccttagtgagatgaacccggtacctcagatggaaaagcagaaatcacctgtcttctgcgtcgctcacgctgggagctgtagaccggagctgttcctattcggccatcttggctcctcccctaaaggtataatttctataaaataaagtttttttacacataagaaatgtatgtgacatttgacaaatatatatatacccatataaccgtcagcccaacaacaacaaaaaatagaacatttctcctttcccagaaggccctcactgtt

SEQ ID NO: 56503 - DNA, 601 bp, Human
ttctaaaataagatgtgtaatacagctaattagtcactattttaaaaggaatttaaatatagttttcattgaaattcaaatatttaattgcatgtgtacctaatgcctaattatttacatgttggctgatgttctctattatctaactgctgtgctgttcttaattgctgctagttcatctccgcccatctcccttggtgatgatagtcctgcatttcatggcaattttcaatagcagtttaatggtcttaagtgggtagcataatagccaggtgaacaacaaaaaaaacaaaaacaaaamcaaaaaaactatttggcaaattgggatatgagaattgaggccaaaacttttagtccttgccaattttttttaaaacttcaattatcttgattcatattcccatttgttgggttggtaggcactccaaaataaatataataatcagagagaacaccaactgtaggtactagttttagcaactgaaacaactggcgttaaaatcactgagcttctgttacatgaatacctgagtattatgtggctacttctgaaatggagtatgcagtgctcttataattgggcatttcagttgaacactgc

SEQ ID NO: 56504 - DNA, 601 bp, Human
tggataagttataaggcagatggtaagattggatctgatgggatggagtttggtgaagtggaaacttttaagcattaggtttgagatagctagggagtgttgacctctctttccccctgacattatcctcacatttgtttttattccaccatatctaccttgatccacctgattcttttcatttttttctttcattctctttgtgctggctttctttccttttttaaaatcccatggtatctcatcatctcttcttgtcctcccattctacaaatagaacatgaaattgaagccttttttwaaaaaaaaaaaactaattacagaattaatatatgtttactatgtacttactacaattagaaactatatataaacaaaaaagagagcttgcccatcaatccacatgcaaaattggttgagtaccttgaagatttgtaatagtatatagagaagaacattatttttcttaactatttaaaagtgtattctgcattctcaattaaaagtcattttatcttttactttttcttttattcctttttaagcaacaaatgaattaaatttcctttgttttatatatgacctattaacctcaatggag

SEQ ID NO: 56505 - DNA, 601 bp, Human
tgaaattgaagccttttttaaaaaaaaaaaaactaattacagaattaatatatgtttactatgtacttactacaattagaaactatatataaacaaaaaagagagcttgcccatcaatccacatgcaaaattggttgagtaccttgaagatttgtaatagtatatagagaagaacattatttttcttaactatttaaaagtgtattctgcattctcaattaaaagtcattttatcttttactttttcttttattcctttttaagcaacaaatgaattaaatttcctttgttttatatatgrcctattaacctcaatggagaaagaggctccctttgtttgcttcaggacttacatattgttacagttagtccttaggtaaatgaaatgagaagagcttcacatcagcactagttcttccccatggaattttagtttctccacaaccactttactgaatgtgtataattataagaattatttcattttcttacaactttttctctttattttatactctcaccctattatctgtcctttttcttttttttttctttctttctttctttctttctttctttcttttttttttttttttgagac

SEQ ID NO: 56506 - DNA, 601 bp, Human
tattcctttttaagcaacaaatgaattaaatttcctttgttttatatatgacctattaacctcaatggagaaagaggctccctttgtttgcttcaggacttacatattgttacagttagtccttaggtaaatgaaatgagaagagcttcacatcagcactagttcttccccatggaattttagtttctccacaaccactttactgaatgtgtataattataagaattatttcattttcttacaactttttctctttattttatactctcaccctattatctgtcctttttcttttttttttctttctttctttctttctttctttctttcttttttttttttttttgagacaggctcttactccgttgcccaggctgaagtgcagtggcaggatcatggcttattgtgcccttgacatctcagtttcaagtgatactcccacttcagcctcttcactagctgggactacaggctcttgccaccccacctggctaatttttctattttttttgtaaagatggtactttgccatgttgctcagactgaactcctgggctcaaacaatcctccccacctcggcctcccatagtgctaggattat

SEQ ID NO: 56507 - DNA, 601 bp, Human
atatgacctattaacctcaatggagaaagaggctccctttgtttgcttcaggacttacatattgttacagttagtccttaggtaaatgaaatgagaagagcttcacatcagcactagttcttccccatggaattttagtttctccacaaccactttactgaatgtgtataattataagaattatttcattttcttacaactttttctctttattttatactctcaccctattatctgtcctttttcttttttttttctttctttctttctttctttctttctttcttttttttttttttttgagacaggctcttactccgttgcccaggctgaagtgcagtggcaggatcatggcttattgtgcccttgacatctcagtttcaagtgatactcccacttcagcctcttcactagctgggactacaggctcttgccaccccacctggctaatttttctattttttttgtaaagatggtactttgccatgttgctcagactgaactcctgggctcaaacaatcctccccacctcggcctcccatagtgctaggattataggcatgagccactgcacctggcttttatattcttaatatttctt

SEQ ID NO: 56508 - DNA, 601 bp, Human
aatgagaagagcttcacatcagcactagttcttccccatggaattttagtttctccacaaccactttactgaatgtgtataattataagaattatttcattttcttacaactttttctctttattttatactctcaccctattatctgtcctttttcttttttttttctttctttctttctttctttctttctttcttttttttttttttttgagacaggctcttactccgttgcccaggctgaagtgcagtggcaggatcatggcttattgtgcccttgacatctcagtttcaagtgatmctcccacttcagcctcttcactagctgggactacaggctcttgccaccccacctggctaatttttctattttttttgtaaagatggtactttgccatgttgctcagactgaactcctgggctcaaacaatcctccccacctcggcctcccatagtgctaggattataggcatgagccactgcacctggcttttatattcttaatatttcttgtttcttctatttattttctttactttaaactcgttgttataaagtggtatgggttaatcaagagtgatggaaagattagctctgtttt

SEQ ID NO: 56509 - DNA, 601 bp, Human
aattatttcattttcttacaactttttctctttattttatactctcaccctattatctgtcctttttcttttttttttctttctttctttctttctttctttctttcttttttttttttttttgagacaggctcttactccgttgcccaggctgaagtgcagtggcaggatcatggcttattgtgcccttgacatctcagtttcaagtgatactcccacttcagcctcttcactagctgggactacaggctcttgccaccccacctggctaatttttctattttttttgtaaagatggtaytttgccatgttgctcagactgaactcctgggctcaaacaatcctccccacctcggcctcccatagtgctaggattataggcatgagccactgcacctggcttttatattcttaatatttcttgtttcttctatttattttctttactttaaactcgttgttataaagtggtatgggttaatcaagagtgatggaaagattagctctgtttttctgtgtgtgagtgaaagatttagaagtaagaaaatataattattcttcttcccaaagtaatgatgtttaccaaaacactggtaacatt

SEQ ID NO: 56510 - DNA, 601 bp, Human
ttctttcttttttttttttttttgagacaggctcttactccgttgcccaggctgaagtgcagtggcaggatcatggcttattgtgcccttgacatctcagtttcaagtgatactcccacttcagcctcttcactagctgggactacaggctcttgccaccccacctggctaatttttctattttttttgtaaagatggtactttgccatgttgctcagactgaactcctgggctcaaacaatcctccccacctcggcctcccatagtgctaggattataggcatgagccactgcacctggyttttatattcttaatatttcttgtttcttctatttattttctttactttaaactcgttgttataaagtggtatgggttaatcaagagtgatggaaagattagctctgtttttctgtgtgtgagtgaaagatttagaagtaagaaaatataattattcttcttcccaaagtaatgatgtttaccaaaacactggtaacattactttaaatttcctaaatttataattcaatttagtaaagtaggacttctgaaatggatttttagatatattggggaaaaacaattcaggatctaaggtaa

SEQ ID NO: 56511 - DNA, 601 bp, Human
ggtaaactttttaggatgtatatatatttgcatgccattcatggttgtgtttatctgaaaacctaatacatttttatcataaaaatctacataattctaaatcatctcaagtgaaattagaattaatataaagaaataaacaaatattggaagttaaaattttcagatttattaggtgttaaactgaatttttcgtcttctactcctatcctcccgtaaacactatctagaaaattgtcacccaacctattgtagaactaaaaacctagtggtcttcctcatcttcattgtcttcattatytccactacacgaaacattcccttgtaacaaatataatattcacagcattgtgcaaaaaatgtacattttaaatttctagtataaaatttgatttgtgactctgagcccccagtttccttagggcaaacaatatgggtgctttcagttaattttagtccaatccagtaatttttcagttacttttccatttaaaacaagtagttcgaggttcagccttctgatcattttcctgatatggaatctgggagcagcagggaacataagtaatgtcacggtgtcaggattgggaggtgtgcattt

SEQ ID NO: 56512 - DNA, 601 bp, Human
tatggaatctgggagcagcagggaacataagtaatgtcacggtgtcaggattgggaggtgtgcattttggatcctgattaaatgtatcaacgtaggtaatatattgtgattgtttcaaatagtggagatcaggaatccttcctggtacaaattcagttccccacagtaacctcaaaattgacttcaaacctactgacttcaaatctgactcatgatgtttctcctctcccatcacttttcactgtgttctgctgatctccatactgtttcctcaatgatgggcccaaaaaatgctggaagktttcttctatttctctctttgagaatcatgaggcactcattgggattgtggttcttggattgtttccctctttgtatgtatttatgtatgagccatatacaatcaactgttctctcaatatcaagaggtagcaattttaaatgttctgtgttttaaactttaatgtataacttacgtcagtcaatcctgataataccactattctcactagtcatcaacatcattatcatcattgtcatcatcatgtaacaattatataatggttaatattggccacaaatcaatcctagttccttaaaa

SEQ ID NO: 56513 - DNA, 601 bp, Human
gactcatgatgtttctcctctcccatcacttttcactgtgttctgctgatctccatactgtttcctcaatgatgggcccaaaaaatgctggaagttttcttctatttctctctttgagaatcatgaggcactcattgggattgtggttcttggattgtttccctctttgtatgtatttatgtatgagccatatacaatcaactgttctctcaatatcaagaggtagcaattttaaatgttctgtgttttaaactttaatgtataacttacgtcagtcaatcctgataataccactattctyactagtcatcaacatcattatcatcattgtcatcatcatgtaacaattatataatggttaatattggccacaaatcaatcctagttccttaaaatctattagttgagccttatgaaactgccctttttgtcggttcaaatggtgagtagaagcaatttcatatggttcaacttattattacttcaatttccttacaggcttacagccaacacagtgattcaggccaccatcatctcacaactagaaatcatcactgtggccttctaatggatattcttgcttgcaatttagccctccccc

SEQ ID NO: 56514 - DNA, 601 bp, Human
tatctctctgttaacctgactaatgcataccaattttcatgctcatttttcttttcttttttttttttttgacggagtcctgctctgtcacccaggctggagtgcagtgctgcgatctcagctcactgcaacctccacctcccgggttcaagcgattctccttcctcagcctctagagtagctgggactacaggcgtgtgccaccacgcccagctaatttttgtatttttagtagagacaggatttcaccatgttggccatgttggtctcgatctctcgacctcgcaattcgcccgcctcrggctcccaaagtgctgggattacaggcgtgagccaccgtgccggtccctcatgctccatttttatagtttctccaagaagcactttctgacctctagactagtttgaattttcctatttctgtacccatattggctctattcttcccctaatcaaacccttttcccaattaaccatgtttatatcctagtttatgtgcttccttttagcatgtaccattgtttctctagggccttataagtatttgttatacagacattacatatatatatatattatatatacatgtgtgtatatatat

SEQ ID NO: 56515 - DNA, 601 bp, Human
ggtttagggtggaccctgatccaatatgactggtatcatagaagaggggaggagatacagaaatacagggagaaagctgtgtaaagatggaggcagagatgggagtggtgcatccacaagccaagcaatgccaaggaaagaagcatggacattttttcttactgtgtctagaaggaaccaactaggctgacattttggtttcagagttacagcctcctgaactgtgaaatgaatgtctgttttttttttttttttattattattatactttaagttttagggtacatgtgcacaatgtgcmgattagttacatatgtatacatgtgtcatgcttgtgcgctgcacccactaactcgtcatctagcattaggtatatctcccaatgctatcccttccccctccccccaccccacaacagtccccagagtgtgatgttccccttcctgtgtccatgtgttctcattgttcaattcccacctatgagtgagaatatgcggtgtttggttttttgtccttgtgatagtttactgagaatgatgatttccaatttcatccatggccctacaaaggacatgaactcatcattttttatggctgcata

SEQ ID NO: 56516 - DNA, 601 bp, Human
tttagggtggaccctgatccaatatgactggtatcatagaagaggggaggagatacagaaatacagggagaaagctgtgtaaagatggaggcagagatgggagtggtgcatccacaagccaagcaatgccaaggaaagaagcatggacattttttcttactgtgtctagaaggaaccaactaggctgacattttggtttcagagttacagcctcctgaactgtgaaatgaatgtctgttttttttttttttttattattattatactttaagttttagggtacatgtgcacaatgtgccgrttagttacatatgtatacatgtgtcatgcttgtgcgctgcacccactaactcgtcatctagcattaggtatatctcccaatgctatcccttccccctccccccaccccacaacagtccccagagtgtgatgttccccttcctgtgtccatgtgttctcattgttcaattcccacctatgagtgagaatatgcggtgtttggttttttgtccttgtgatagtttactgagaatgatgatttccaatttcatccatggccctacaaaggacatgaactcatcattttttatggctgcatagt

SEQ ID NO: 56517 - DNA, 601 bp, Human
tgactggtatcatagaagaggggaggagatacagaaatacagggagaaagctgtgtaaagatggaggcagagatgggagtggtgcatccacaagccaagcaatgccaaggaaagaagcatggacattttttcttactgtgtctagaaggaaccaactaggctgacattttggtttcagagttacagcctcctgaactgtgaaatgaatgtctgttttttttttttttttattattattatactttaagttttagggtacatgtgcacaatgtgccgattagttacatatgtatacatgtgycatgcttgtgcgctgcacccactaactcgtcatctagcattaggtatatctcccaatgctatcccttccccctccccccaccccacaacagtccccagagtgtgatgttccccttcctgtgtccatgtgttctcattgttcaattcccacctatgagtgagaatatgcggtgtttggttttttgtccttgtgatagtttactgagaatgatgatttccaatttcatccatggccctacaaaggacatgaactcatcattttttatggctgcatagtattccatggtgtatatgtgccaca

SEQ ID NO: 56518 - DNA, 601 bp, Human
tatcatagaagaggggaggagatacagaaatacagggagaaagctgtgtaaagatggaggcagagatgggagtggtgcatccacaagccaagcaatgccaaggaaagaagcatggacattttttcttactgtgtctagaaggaaccaactaggctgacattttggtttcagagttacagcctcctgaactgtgaaatgaatgtctgttttttttttttttttattattattatactttaagttttagggtacatgtgcacaatgtgccgattagttacatatgtatacatgtgtcatgctkgtgcgctgcacccactaactcgtcatctagcattaggtatatctcccaatgctatcccttccccctccccccaccccacaacagtccccagagtgtgatgttccccttcctgtgtccatgtgttctcattgttcaattcccacctatgagtgagaatatgcggtgtttggttttttgtccttgtgatagtttactgagaatgatgatttccaatttcatccatggccctacaaaggacatgaactcatcattttttatggctgcatagtattccatggtgtatatgtgccacattttctt

SEQ ID NO: 56519 - DNA, 601 bp, Human
aaatacagggagaaagctgtgtaaagatggaggcagagatgggagtggtgcatccacaagccaagcaatgccaaggaaagaagcatggacattttttcttactgtgtctagaaggaaccaactaggctgacattttggtttcagagttacagcctcctgaactgtgaaatgaatgtctgttttttttttttttttattattattatactttaagttttagggtacatgtgcacaatgtgccgattagttacatatgtatacatgtgtcatgcttgtgcgctgcacccactaactcgtcatytagcattaggtatatctcccaatgctatcccttccccctccccccaccccacaacagtccccagagtgtgatgttccccttcctgtgtccatgtgttctcattgttcaattcccacctatgagtgagaatatgcggtgtttggttttttgtccttgtgatagtttactgagaatgatgatttccaatttcatccatggccctacaaaggacatgaactcatcattttttatggctgcatagtattccatggtgtatatgtgccacattttcttaatccagtctatcattgttggacattt

SEQ ID NO: 56520 - DNA, 601 bp, Human
tcttagcattatagaggtttatttctcaatgatgcaatgacaaatacaggtccatctggtgactcagggtcccagttgtcctccgcttatgatgtttccaactcaggaaatgccttttatggttgctatggcagaggaagagaggagtggggagctggcacctaggtcttcagtgcttcagctaggaagtcatagtcatgactctgctccacatttttacaatctaagaatagtcagatgcccctcttaactgcaaggggctgagaagtgtagggaacacaagaatattttttgagagctmctatctctgcttacatataatggcagaagaaatatcctcctaaatctattaaaatcatactatgctctcaaagattctagctgctcccttaatttgatattttatccctgctataatttttacaagcttcttttcatatatatatacacacacacacatatgtatttatgtgtgatgtatgtatacatagctattacccaagtctttccattaacatggtgttatatttgtccttaccagaactactgactgctaacaacataaaactcttttccatccaaaatcattcctatttaaaca

SEQ ID NO: 56521 - DNA, 601 bp, Human
tcatatcccaaatttataatccccagaggtaactcagatatgtataattctttaataacaatctgatttgttctcaatatttaaagtgaacccaagatgaagagttggaaaggaaatttttaaaactctaatgctttagtaggctctcaaactgctgacagctcaagtgttctgtctctttggcaacatataaaaatccagaataacagttaaatattccacagctaactattatttaatactaatattatgtcttggttaatggaagacaccatagaccacattttgaatatttgtgctyctttttaatattggtaatcctccttctgagataaattcaggaaatctgacctttctcctcagcccttttgaaataaagaccacttttccaattaggaatatctaatgtagtgttaaagctcagagttgaaaagatgttttagtattcatcagatataacgttgtagtattattggtaacattgtgaaacaaattccagtacacttcagctctgctaacaaagatgaaatagagaataaagtaggtgtatgctgaatcttattaaggttgacatccagtttgaatacattcatcctctaag

SEQ ID NO: 56522 - DNA, 601 bp, Human
ttctgagataaattcaggaaatctgacctttctcctcagcccttttgaaataaagaccacttttccaattaggaatatctaatgtagtgttaaagctcagagttgaaaagatgttttagtattcatcagatataacgttgtagtattattggtaacattgtgaaacaaattccagtacacttcagctctgctaacaaagatgaaatagagaataaagtaggtgtatgctgaatcttattaaggttgacatccagtttgaatacattcatcctctaaggtatagttttgggtataaaccatygagcaagcacaaaacagtgaagctgagagctgcagaacatagagatctggtggattctaaaggactgagaatgatcgatggctactgaaatgaagtgtgaaatggtatccatagctgatatttgtctttaactgataaaatggctaaagcatttcctggtcaacacaccactctccctcctctcttctcattcctctagaacagtggccttcaaactcttttcttgataacaaatgcacttaaattggagaatatctctctttctaacacacacataacaaaaatgtcatgagatgtctt

SEQ ID NO: 56523 - DNA, 601 bp, Human
aagttaaaaaacataaatatctgagaaatgaactgagaaaaggagaaatccttacaggacatgaatggtacaggagaatagtacatatcaaagggtgaactctgggtcacagcttgtgggatcaggcaagaacatgtctagtcatagtctttcaaataatcttattaaaaattattttttctaagatccacttttactcttttctctgactaattttatttagctttcaagcatttctttgtggcttcagttttgacttcagtttttaaacaatttaaacaaataaaaattacattacagrattgttacttttaaactcttactttccacggggactgttattgtaaaatctgttcttattcttttaatttaactccattattttgttttaaatgtaatgattgttcattatatttttctccaactgctttaaaagcaccaatccttctttgctgtatatgtatcaaagtccataaatattctttgacattatcctagccttgaataataaaaggaaaaaaacctctcacaactttttattctacaaaataatattaaaatatgcccctatttttactgtaaatgtaatcttcacagcaac

SEQ ID NO: 56524 - DNA, 601 bp, Human
ggatcaggcaagaacatgtctagtcatagtctttcaaataatcttattaaaaattattttttctaagatccacttttactcttttctctgactaattttatttagctttcaagcatttctttgtggcttcagttttgacttcagtttttaaacaatttaaacaaataaaaattacattacagaattgttacttttaaactcttactttccacggggactgttattgtaaaatctgttcttattcttttaatttaactccattattttgttttaaatgtaatgattgttcattatatttttytccaactgctttaaaagcaccaatccttctttgctgtatatgtatcaaagtccataaatattctttgacattatcctagccttgaataataaaaggaaaaaaacctctcacaactttttattctacaaaataatattaaaatatgcccctatttttactgtaaatgtaatcttcacagcaacagtcaagagaacaagactgagtcattcttcatcacacattgcaagggctatgtctcctctgttgtgaggagaatattgccctgcagcaatattctcacaagtggagctctgggtcatt

SEQ ID NO: 56525 - DNA, 601 bp, Human
tattctcacaagtggagctctgggtcattgactgcacttttgctaataagaaatcttcagtaggagtgactgggccttgtgcaaatctctccagtagtttcttccactagtgacgcattagagcctcagaatcaatcactcaacaagtgtttactgaaagcttactgatacccagaccttaaactgttaccaaacagaatgccagatatgggatataattccagcctgaagagtttatgctcaagacaagacttacatatattacagagaagcgtaacagagcaaatgattaagttctaartttcactgtacaccctaaaaaaaaggagaaattgatatggaacatgaatagtataggaaaatggtccttaggaaggccagacatgagagggtgagctctaggtgaccacctgtaggatcaggaaagaacatatctagtcctggagttaagatttctattttttctagatttatagaggtataattgacaattaaaaattgtgtatattctagatatgcatgacgatttaatatacatatacattgtgaaatgattaccacaaccaaattaattaatatgtgtatcacctcacatagttat

SEQ ID NO: 56526 - DNA, 601 bp, Human
agaaatcttcagtaggagtgactgggccttgtgcaaatctctccagtagtttcttccactagtgacgcattagagcctcagaatcaatcactcaacaagtgtttactgaaagcttactgatacccagaccttaaactgttaccaaacagaatgccagatatgggatataattccagcctgaagagtttatgctcaagacaagacttacatatattacagagaagcgtaacagagcaaatgattaagttctaagtttcactgtacaccctaaaaaaaaggagaaattgatatggaacatgartagtataggaaaatggtccttaggaaggccagacatgagagggtgagctctaggtgaccacctgtaggatcaggaaagaacatatctagtcctggagttaagatttctattttttctagatttatagaggtataattgacaattaaaaattgtgtatattctagatatgcatgacgatttaatatacatatacattgtgaaatgattaccacaaccaaattaattaatatgtgtatcacctcacatagttatcactttgtgtgtgcgtgtttgtttatgcatggaggacatttaagatct

SEQ ID NO: 56527 - DNA, 601 bp, Human
gcctgaagagtttatgctcaagacaagacttacatatattacagagaagcgtaacagagcaaatgattaagttctaagtttcactgtacaccctaaaaaaaaggagaaattgatatggaacatgaatagtataggaaaatggtccttaggaaggccagacatgagagggtgagctctaggtgaccacctgtaggatcaggaaagaacatatctagtcctggagttaagatttctattttttctagatttatagaggtataattgacaattaaaaattgtgtatattctagatatgcatgaygatttaatatacatatacattgtgaaatgattaccacaaccaaattaattaatatgtgtatcacctcacatagttatcactttgtgtgtgcgtgtttgtttatgcatggaggacatttaagatctgtgtttggaaaattccaaataaacagtacaatattattaactatagttactattctgtacattagatccctagaacttattcatcttataactgaaactgtgtaccctttgacccaaacctctcatttaccccaattcctggcaaccaccattcattccaccattctactctctg

SEQ ID NO: 56528 - DNA, 601 bp, Human
aacagagcaaatgattaagttctaagtttcactgtacaccctaaaaaaaaggagaaattgatatggaacatgaatagtataggaaaatggtccttaggaaggccagacatgagagggtgagctctaggtgaccacctgtaggatcaggaaagaacatatctagtcctggagttaagatttctattttttctagatttatagaggtataattgacaattaaaaattgtgtatattctagatatgcatgacgatttaatatacatatacattgtgaaatgattaccacaaccaaattaattartatgtgtatcacctcacatagttatcactttgtgtgtgcgtgtttgtttatgcatggaggacatttaagatctgtgtttggaaaattccaaataaacagtacaatattattaactatagttactattctgtacattagatccctagaacttattcatcttataactgaaactgtgtaccctttgacccaaacctctcatttaccccaattcctggcaaccaccattcattccaccattctactctctgcttctatgagttcaactttttagattccacatgtgagtgagatcatactgtg

SEQ ID NO: 56529 - DNA, 601 bp, Human
atatgtgtatcacctcacatagttatcactttgtgtgtgcgtgtttgtttatgcatggaggacatttaagatctgtgtttggaaaattccaaataaacagtacaatattattaactatagttactattctgtacattagatccctagaacttattcatcttataactgaaactgtgtaccctttgacccaaacctctcatttaccccaattcctggcaaccaccattcattccaccattctactctctgcttctatgagttcaactttttagattccacatgtgagtgagatcatactgtrtttgtttttctatgtgtggcttatctcacctagcacaatgcccttcaggcttatacatgtcattgcaaatagcaggatttccttctcttttatggctgaataatattcctctatctccctctctccctctctttctgtgtgtgtgtgtgtgtgtgtgtgtgtgtgtgtgtgtctgtgtgtctgtgtatgtgtgtatactatatttactttatccattcattcactgatggatacttaggccatttatttatcttgactgttgtgaatgatgctgctatgaacatgtggatgcagatatct

SEQ ID NO: 56530 - DNA, 601 bp, Human
tctcttttatggctgaataatattcctctatctccctctctccctctctttctgtgtgtgtgtgtgtgtgtgtgtgtgtgtgtgtgtgtctgtgtgtctgtgtatgtgtgtatactatatttactttatccattcattcactgatggatacttaggccatttatttatcttgactgttgtgaatgatgctgctatgaacatgtggatgcagatatctccttgagatactgatatcaccttttaaaatatatagctagaaatgggattgctgggtcatattgtagtactattttcatttttkgaagaatctctatgcttaatgctgttttccatagtggctatgcctatttacattcccaccaaaagtgtagaagggtttctttttctctgtttcctcaccaacatgtgttatcttttgtcttttatataatagccatgctaataggtatgaggtgatatctcactgtggttttgatttgtatttccctgatgattaatgatgttgaacactttttaatatacctgttggccatttgtatgtctctttttggaaacatgtctattttttagatatgtttaggtcctttgtccattttgaaat

SEQ ID NO: 56531 - DNA, 601 bp, Human
ctctctccctctctttctgtgtgtgtgtgtgtgtgtgtgtgtgtgtgtgtgtgtctgtgtgtctgtgtatgtgtgtatactatatttactttatccattcattcactgatggatacttaggccatttatttatcttgactgttgtgaatgatgctgctatgaacatgtggatgcagatatctccttgagatactgatatcaccttttaaaatatatagctagaaatgggattgctgggtcatattgtagtactattttcatttttggaagaatctctatgcttaatgctgttttccatagyggctatgcctatttacattcccaccaaaagtgtagaagggtttctttttctctgtttcctcaccaacatgtgttatcttttgtcttttatataatagccatgctaataggtatgaggtgatatctcactgtggttttgatttgtatttccctgatgattaatgatgttgaacactttttaatatacctgttggccatttgtatgtctctttttggaaacatgtctattttttagatatgtttaggtcctttgtccattttgaaattggcttattttgtgttttcttgctattgagttgta

SEQ ID NO: 56532 - DNA, 601 bp, Human
atatctagtttccccaatacagtttattgaaaagactatttgttccccattgtgtagttttaatggcctagtcaaagattagttggccatatatttgtgggtttatttctgggctattccgtttcattggtctatatgtctgtttttatagcactatcacactgttttgattaccatggctttgtatatagtttgaaatcaggacccatggtgcttctggctttgtccttctttcttaagattgctttggatattttgggtcatttgtgatttcatatgaattttaattattaaaattctyattcttttttttagaactgttttttctacattttctttctttttttctttcttttttttctgaggtggaatttccctcttttcgctcaaggtggagtgcaatggtgcaatctcagctcactgcaacctccgtctcctgggttcaagtgattctcctgcctcagcctcctgagtagctgagattacaggtgcacaccaccatgcccagccaattttattttttgtatttcttagtagagatggggttttgctatgttggacaggctggtctcaaactcctgacctcaggtaatctgcccac

SEQ ID NO: 56533 - DNA, 601 bp, Human
ttttcttgccgaattgctctgactaggactcatagtactatgttgattgggagtggtaagactgggcacctgataaggttaggctttatgtccccacccaaatctcatcttcagttgtaaccctcatcatccccataatccccaaatgtcaaaggaaaccagatgaaggtaattgaatcatggaggccagtttccccgatgcttttcttgtgatagtgagtgagttctcatgagctctgatagttttataaggggctcttcccccttcgcttggcacttcttcttcctgctgccttgtgargaaggtaccttgcttccccttggccttctgccacggttgtaagcttcctgaggtctccccagccgtgctgaactgtgattcaattaaaactttttcctttataaatcacccagtttcgggcagttctttatagccttgtgaaaacgactaatacagcacccttatcttattcctaatctcagaaaagctttcaacttttcactattcagtatgacatcagctgtagacttgtcatatatgtcctttattatgttcagatacatttttctatacctaatttgttgggagcttttatcatga

SEQ ID NO: 56534 - DNA, 601 bp, Human
gactgggcacctgataaggttaggctttatgtccccacccaaatctcatcttcagttgtaaccctcatcatccccataatccccaaatgtcaaaggaaaccagatgaaggtaattgaatcatggaggccagtttccccgatgcttttcttgtgatagtgagtgagttctcatgagctctgatagttttataaggggctcttcccccttcgcttggcacttcttcttcctgctgccttgtgaagaaggtaccttgcttccccttggccttctgccacggttgtaagcttcctgaggtctccscagccgtgctgaactgtgattcaattaaaactttttcctttataaatcacccagtttcgggcagttctttatagccttgtgaaaacgactaatacagcacccttatcttattcctaatctcagaaaagctttcaacttttcactattcagtatgacatcagctgtagacttgtcatatatgtcctttattatgttcagatacatttttctatacctaatttgttgggagcttttatcatgacaggatgttgaattttttcaaatgctttttctacatctgagatgataatatgattttta

SEQ ID NO: 56535 - DNA, 601 bp, Human
gacatcagctgtagacttgtcatatatgtcctttattatgttcagatacatttttctatacctaatttgttgggagcttttatcatgacaggatgttgaattttttcaaatgctttttctacatctgagatgataatatgatttttattctttattctgtgaaagtggtatacagtagtccccctttatgcatgggggatacattccaggacccccagagtatgtctgaaactgcagattgtactgacacctacatatagtatgctttttattctatgtatatacctatgaaaaagtttartttatgttaggcacagcaagagattaacaacaatagagcaattataacaatatactataataagagttatgtgaatgttgtctctctcactccccctcaaaatatcttattgtattatactcatctttctccttgtgatgatgtgagatgataaaaggccaccatgattagatgaaatatggtgaacgacataggcattgtaacataaagttaggttattattgattttctgatgatgcatcagaaggaagaccatctgctttgagcgacccttgattattgagctatgacaatgttgat

SEQ ID NO: 56536 - DNA, 601 bp, Human
atatgtcctttattatgttcagatacatttttctatacctaatttgttgggagcttttatcatgacaggatgttgaattttttcaaatgctttttctacatctgagatgataatatgatttttattctttattctgtgaaagtggtatacagtagtccccctttatgcatgggggatacattccaggacccccagagtatgtctgaaactgcagattgtactgacacctacatatagtatgctttttattctatgtatatacctatgaaaaagtttaatttatgttaggcacagcaagagwttaacaacaatagagcaattataacaatatactataataagagttatgtgaatgttgtctctctcactccccctcaaaatatcttattgtattatactcatctttctccttgtgatgatgtgagatgataaaaggccaccatgattagatgaaatatggtgaacgacataggcattgtaacataaagttaggttattattgattttctgatgatgcatcagaaggaagaccatctgctttgagcgacccttgattattgagctatgacaatgttgatggttggatgccaggtgcatatga

SEQ ID NO: 56537 - DNA, 601 bp, Human
tttctatacctaatttgttgggagcttttatcatgacaggatgttgaattttttcaaatgctttttctacatctgagatgataatatgatttttattctttattctgtgaaagtggtatacagtagtccccctttatgcatgggggatacattccaggacccccagagtatgtctgaaactgcagattgtactgacacctacatatagtatgctttttattctatgtatatacctatgaaaaagtttaatttatgttaggcacagcaagagattaacaacaatagagcaattataacaatwtactataataagagttatgtgaatgttgtctctctcactccccctcaaaatatcttattgtattatactcatctttctccttgtgatgatgtgagatgataaaaggccaccatgattagatgaaatatggtgaacgacataggcattgtaacataaagttaggttattattgattttctgatgatgcatcagaaggaagaccatctgctttgagcgacccttgattattgagctatgacaatgttgatggttggatgccaggtgcatatgatatcaatgtccaacaggtcggttgtgata

SEQ ID NO: 56538 - DNA, 601 bp, Human
gtgagaatactatatcacatttatcgactcatgtatgttgaattatccatttattccaaggataaatccctcttaatcatggtgaatgttccttttgatatgccgttgaatttgatttgctagtatttttttgaggatttttatatctgtgttcttcagagatattggcctgtaattttctttatttgtagtgtccttatctgggttagcattgtataatagttacctcatataatgagattggaagtgttccctccaagtgtctggtcttgaacttttctttattgggagatttttttttctgatttattctccttactcattatcaggtactcattacccaaatttgttcagattttctatttcttcatcattcagtcttggtcgattctatgtgtctagcctttatcaacttcttgtaggttattgtatttattggtgtataattgttcatagcagtgtctatgatccttttttatttctgttgcaatgtctcctctttaatttataattttatttagttgaatcctcattccttttttcttagtttggctgaaggtttgtcaattttgtttatctttaaaaaaacaattcttactta

SEQ ID NO: 56539 - DNA, 601 bp, Human
gatattggcctgtaattttctttatttgtagtgtccttatctgggttagcattgtataatagttacctcatataatgagattggaagtgttccctccaagtgtctggtcttgaacttttctttattgggagatttttttttctgatttattctccttactcattatcaggtactcattacccaaatttgttcagattttctatttcttcatcattcagtcttggtcgattctatgtgtctagcctttatcaacttcttgtaggttattgtatttattggtgtataattgttcatagcagtstctatgatccttttttatttctgttgcaatgtctcctctttaatttataattttatttagttgaatcctcattccttttttcttagtttggctgaaggtttgtcaattttgtttatctttaaaaaaacaattcttacttatattgatcttttctattctctttctagtcacaatttcatttatttatgctctaatatgtattattcccttcccttttctatctttgtcttagttttttttttcctatttccttgaggtataaagttaagttgttcattttagatctttttttttaatata

SEQ ID NO: 56540 - DNA, 601 bp, Human
ggttagcattgtataatagttacctcatataatgagattggaagtgttccctccaagtgtctggtcttgaacttttctttattgggagatttttttttctgatttattctccttactcattatcaggtactcattacccaaatttgttcagattttctatttcttcatcattcagtcttggtcgattctatgtgtctagcctttatcaacttcttgtaggttattgtatttattggtgtataattgttcatagcagtgtctatgatccttttttatttctgttgcaatgtctcctctttartttataattttatttagttgaatcctcattccttttttcttagtttggctgaaggtttgtcaattttgtttatctttaaaaaaacaattcttacttatattgatcttttctattctctttctagtcacaatttcatttatttatgctctaatatgtattattcccttcccttttctatctttgtcttagttttttttttcctatttccttgaggtataaagttaagttgttcattttagatctttttttttaatataggcatttatcaatgtaaacttctctcttagaacgtcttttgct

SEQ ID NO: 56541 - DNA, 601 bp, Human
tcattttggagtgtgttgcttactttccatatatctgtgctgggattaatatttctgactttttagccaggctgcctgtattctaattacaacttcaccacttacaaggtatttagctttaggtaagccatttaaactctcagtgcctcagtccccttatctgtaaaaatgagtaatacagtgatattaataataataatgagagtatctacctccctgactgattgtgaagatgaaatgaaatagtcagtagaaagtagttagaatagttcacagcatacagtatttattatttttatgtataactaatgttttatgaggtccttagagtgctagacactgtttgcatgaattattttatatgatctcaccacaaccttataaaaaagtttttattgtccgatgttttagacggcgtagttataggagttagtttcagccaccagttgtatatagagaagctgctaggcaaacataagatttttttaaatctagcacaaggacctgaactttaccacatctgtctcccctgttgactatcaattcaatgcctaggtcccatgagggaagggtcaaagcatttgatgttaaaatgtacttc

SEQ ID NO: 56542 - DNA, 601 bp, Human
attttggagtgtgttgcttactttccatatatctgtgctgggattaatatttctgactttttagccaggctgcctgtattctaattacaacttcaccacttacaaggtatttagctttaggtaagccatttaaactctcagtgcctcagtccccttatctgtaaaaatgagtaatacagtgatattaataataataatgagagtatctacctccctgactgattgtgaagatgaaatgaaatagtcagtagaaagtagttagaatagttcacagcatacagtatttattatttttatgtataactaatgttttatgaggtccttagagtgctagacactgtttgcatgaattattttatatgatctcaccacaaccttataaaaaagtttttattgtccgatgttttagacggcgtagttataggagttagtttcagccaccagttgtatatagagaagctgctaggcaaacataagatttttttaaatctagcacaaggacctgaactttaccacatctgtctcccctgttgactatcaattcaatgcctaggtcccatgagggaagggtcaaagcatttgatgttaaaatgtacttctc

SEQ ID NO: 56543 - DNA, 601 bp, Human
tagctttaggtaagccatttaaactctcagtgcctcagtccccttatctgtaaaaatgagtaatacagtgatattaataataataatgagagtatctacctccctgactgattgtgaagatgaaatgaaatagtcagtagaaagtagttagaatagttcacagcatacagtatttattatttttatgtataactaatgttttatgaggtccttagagtgctagacactgtttgcatgaattattttatatgatctcaccacaaccttataaaaaagtttttattgtccgatgttttagacrgcgtagttataggagttagtttcagccaccagttgtatatagagaagctgctaggcaaacataagatttttttaaatctagcacaaggacctgaactttaccacatctgtctcccctgttgactatcaattcaatgcctaggtcccatgagggaagggtcaaagcatttgatgttaaaatgtacttctcagaggatgtccttcggagaagtattctttctcttacttatgttttgttaatttttgcttggttttgattgtagacatcagtttgtaatcagaaatgaagggaaggtcctgg

SEQ ID NO: 56544 - DNA, 601 bp, Human
caaaagaatggaagccagcaaaagggatagaattctatcatcttgactcccaaacctactccatgttgatagtcttaatcttagttaatgatccctgctgcttgatccaaaaacctaacaatgacttcactcatttccctccttctgcactgttgttacctcttcagggacaaaatttcaatactttccacttagactttcactactgacttctaactcatctttttgctttctcttatttggaacagttattcagcttaccctaagtccagagtgaatttccaaaaaatcaaaggttctscaacttttcatttctcttcaattccaactcagtttcacacgtttatcacctagtgtagaagggctttcctccacagttttgcttggcaaactccttttcatccttcaagactcaacaaaattgttgccttttcatgaaaaaggatactcttccatccttctgatattaataattttttgttcttgtgtccatgatagactttgtcataatgtattacagtttatcctggaggaaagcaccacaagaccaagagtttcctttttttttttcatcccaatgcttgatacatagtagccattt

SEQ ID NO: 56545 - DNA, 601 bp, Human
tctatcatcttgactcccaaacctactccatgttgatagtcttaatcttagttaatgatccctgctgcttgatccaaaaacctaacaatgacttcactcatttccctccttctgcactgttgttacctcttcagggacaaaatttcaatactttccacttagactttcactactgacttctaactcatctttttgctttctcttatttggaacagttattcagcttaccctaagtccagagtgaatttccaaaaaatcaaaggttctccaacttttcatttctcttcaattccaactcagkttcacacgtttatcacctagtgtagaagggctttcctccacagttttgcttggcaaactccttttcatccttcaagactcaacaaaattgttgccttttcatgaaaaaggatactcttccatccttctgatattaataattttttgttcttgtgtccatgatagactttgtcataatgtattacagtttatcctggaggaaagcaccacaagaccaagagtttcctttttttttttcatcccaatgcttgatacatagtagccatttgataagtacatgttgaatgaaagcatgaattta

SEQ ID NO: 56546 - DNA, 601 bp, Human
agtgtagaagggctttcctccacagttttgcttggcaaactccttttcatccttcaagactcaacaaaattgttgccttttcatgaaaaaggatactcttccatccttctgatattaataattttttgttcttgtgtccatgatagactttgtcataatgtattacagtttatcctggaggaaagcaccacaagaccaagagtttcctttttttttttcatcccaatgcttgatacatagtagccatttgataagtacatgttgaatgaaagcatgaatttataacatatataccttcacytgacttggagtttcataaggaatgcaacagcttccaattcatttactttctttttgcttaacaaagtatctgacacgtagtacaaaagttaaatattataaataaaagattaattgcacagatatttttaaaggagacagaaaagatttgaatatccaggaattccacccaacgatgaaagacctataggcggttacaagtaggtaagcagagtccaaaatgtagggtcattttcaatggcagagaggaataggagagtcaataagaagcaaatgctcaaggagcttgagtagagactgg

SEQ ID NO: 56547 - DNA, 601 bp, Human
acaagaatctctcctaggcagattcagttgcctttcctggttctccctgagtgctctgagtaagccccaccattgccttctagaaaaactttctttcttctttcttgcccactcccatctgatcccttcacggcatccagaatgatgatccaaaagtttgggtccaaatgtgatgcaaaagtttacagtggtctaccatggttcctttacaaaaaaagaccaaaaatgttctgccattcttgctcatcatgattttgcctcagtttttcaagttatgttttgttcataatggattttttttgtttgttttctgaatgtgttctgttccttctactgccttaaaaagccctcatcactgagtcttcctactacttccctcacctccacttaccctactgaattttcaaactgcaagtcaaatattacttccttaggggaatctcatcagactgtctccctagaccaccacaccccacccaacaactagatcacatccctttattaggggtactatgttttcagtataattgcaattataattattgacccattgaatgagttgattcatgtcccttccttctttattataagctttaagagg

SEQ ID NO: 56548 - DNA, 601 bp, Human
aggccagcctgggtagcacaataccttgtctctacaaaaaaagaaacaaaattagttgagcatggtagtacacacctgtagtcccacctactccaaaggctgaagtgggaggattgcatgagcccaggagttccaggctgcagcgtgctgagatcatgccactgtgctccaggctgggtgacagagcaagagcctgtcccccccaaaatttttttaaataagaaagttttaataagcagaatattagtttaattatgaatgagaagagatgtatagcatttgtaggggtacagaaccatgyattccataaaggaagaagttaagagcaatgatgtggaataagcatggggcttttaagaacttgtctgaaaagaggatattctttggtcaatagttgaaaaaataaaataaggcttgctggagtggagcaagtcaatggaaagccttcacagttaggtggagcatttacactaaatgactttatttcgaacattcaacaaacactgactgattgtctattggttacccgccatataatgttaggtgctggggaaatagaagtaagtagaatgaggtgggggaggttcactgtggctcttgg

SEQ ID NO: 56549 - DNA, 601 bp, Human
ttctagttgatgcttctgtagaataaaaaaaaaagtttagctgagaaaggtaggtcttaatggaattgttaatatgtagtcttattttggatgacattttaaaatcacttacgtatttaatctgtggattgtagagcatgctgggaagttatcaattccattggtacctgcctcagttgcagttcagccttaagtacttaccaaagggagctcatttggggtggcaggggtaaccgaaaagtgtgggagctgaggtattgtttgagagcctgtgggcagtgtgactgctccaatcgtagtytcagtgaggaagagcaccatctgtgcaagattttctcagatgtcctctataagactttcattgtcatcagttctatgtgctctcaaatcattgctttttcttctttattttgcacataagctataagctattttttaagacatataggttttatttctgtgtgatcaaaaactatgtctcgggcaacttctactttttggaattaacaattattttctttgtggtcttgtgtgtgtgtgtatatatataaacacatacgcacaagaagactgtctctctgtttgtatatatacatacacg

SEQ ID NO: 56550 - DNA, 601 bp, Human
cctctataagactttcattgtcatcagttctatgtgctctcaaatcattgctttttcttctttattttgcacataagctataagctattttttaagacatataggttttatttctgtgtgatcaaaaactatgtctcgggcaacttctactttttggaattaacaattattttctttgtggtcttgtgtgtgtgtgtatatatataaacacatacgcacaagaagactgtctctctgtttgtatatatacatacacgcacatataaatacacagagagagtgtgtgtgtatatatacacasagagagagagagagagagagagagagagagagagagagtcagtcttgctctgttaaccagctggggtgctgtggtgcaattatggctcactggagcctccacctcccagactcaagcaattctcatgcctcagccttctgagtggctgggactcccagcattcaccaccacacccagttagttattgtactttttttttttttgaagagacagggttttgctgtgttgcccaagctgatcttgaactcctggacctccagcaattctcctggcttggcttctcaatatgctgaaattata

SEQ ID NO: 56551 - DNA, 601 bp, Human
ctctataagactttcattgtcatcagttctatgtgctctcaaatcattgctttttcttctttattttgcacataagctataagctattttttaagacatataggttttatttctgtgtgatcaaaaactatgtctcgggcaacttctactttttggaattaacaattattttctttgtggtcttgtgtgtgtgtgtatatatataaacacatacgcacaagaagactgtctctctgtttgtatatatacatacacgcacatataaatacacagagagagtgtgtgtgtatatatacacacagagagagagagagagagagagagagagagagagagagtcagtcttgctctgttaaccagctggggtgctgtggtgcaattatggctcactggagcctccacctcccagactcaagcaattctcatgcctcagccttctgagtggctgggactcccagcattcaccaccacacccagttagttattgtactttttttttttttgaagagacagggttttgctgtgttgcccaagctgatcttgaactcctggacctccagcaattctcctggcttggcttctcaatatgctgaaattatag

SEQ ID NO: 56552 - DNA, 601 bp, Human
ataaacacatacgcacaagaagactgtctctctgtttgtatatatacatacacgcacatataaatacacagagagagtgtgtgtgtatatatacacacagagagagagagagagagagagagagagagagagagagtcagtcttgctctgttaaccagctggggtgctgtggtgcaattatggctcactggagcctccacctcccagactcaagcaattctcatgcctcagccttctgagtggctgggactcccagcattcaccaccacacccagttagttattgtactttttttttttttgaagagacagggttttgctgtgttgcccaagctgatcttgaactcctggacctccagcaattctcctggcttggcttctcaatatgctgaaattataggcgtaagccaccttgcctgaccatcgtccatatatttttgaaaatgacctaggaacaatgagactttttgaagttttttccgtttgctaacttatcagagaaaactagtggaaataatatcaaaaagaaatcatcaaatgctacccatggataatgtacaagaaaactcagcaaaattatttggcacagatgaagaagacaa

SEQ ID NO: 56553 - DNA, 601 bp, Human
ggaaataatatcaaaaagaaatcatcaaatgctacccatggataatgtacaagaaaactcagcaaaattatttggcacagatgaagaagacaagaaaaatgtctgctttgtgagaataccatagtaggtccttcagacaggaggtactttattaagaaggagcaattctcattaataaagatttagagagatcacttataagatgtatttatggcagcaagctcatttggtacatgtatgtatgagggaatcaagatctgaaaagattttcatcggttagagtgatacgtctgttatgatrcaattaattgtgatatactgtctactggagatttgttctccaaaacctgacaatctaatactttgtaggaactaatgtgtataatcttagggggcttagtggacagaaagttcattagccgttggtactgtgataggggaaaaagcaaatgggaccttaaacaatatgaatagacatggtttctcaaagaatagtctatggttcacctgagcacacatcacaaaggatgctgacaatgcacagttaaggtaccccacctagattaaatgaattaattttggacttgggtttagatattta

SEQ ID NO: 56554 - DNA, 601 bp, Human
tcagcaaaattatttggcacagatgaagaagacaagaaaaatgtctgctttgtgagaataccatagtaggtccttcagacaggaggtactttattaagaaggagcaattctcattaataaagatttagagagatcacttataagatgtatttatggcagcaagctcatttggtacatgtatgtatgagggaatcaagatctgaaaagattttcatcggttagagtgatacgtctgttatgatacaattaattgtgatatactgtctactggagatttgttctccaaaacctgacaatctartactttgtaggaactaatgtgtataatcttagggggcttagtggacagaaagttcattagccgttggtactgtgataggggaaaaagcaaatgggaccttaaacaatatgaatagacatggtttctcaaagaatagtctatggttcacctgagcacacatcacaaaggatgctgacaatgcacagttaaggtaccccacctagattaaatgaattaattttggacttgggtttagatatttacatttttatcaggacttcttatgttcaccccaaagtttgcaaaatgctcatctaaaat

SEQ ID NO: 56555 - DNA, 601 bp, Human
tagtaggtccttcagacaggaggtactttattaagaaggagcaattctcattaataaagatttagagagatcacttataagatgtatttatggcagcaagctcatttggtacatgtatgtatgagggaatcaagatctgaaaagattttcatcggttagagtgatacgtctgttatgatacaattaattgtgatatactgtctactggagatttgttctccaaaacctgacaatctaatactttgtaggaactaatgtgtataatcttagggggcttagtggacagaaagttcattagccrttggtactgtgataggggaaaaagcaaatgggaccttaaacaatatgaatagacatggtttctcaaagaatagtctatggttcacctgagcacacatcacaaaggatgctgacaatgcacagttaaggtaccccacctagattaaatgaattaattttggacttgggtttagatatttacatttttatcaggacttcttatgttcaccccaaagtttgcaaaatgctcatctaaaataagaaagatgataggcctgatccatcttctgtttactaggttaaatctggaaaatataaacct

SEQ ID NO: 56556 - DNA, 601 bp, Human
aaagcaaatgggaccttaaacaatatgaatagacatggtttctcaaagaatagtctatggttcacctgagcacacatcacaaaggatgctgacaatgcacagttaaggtaccccacctagattaaatgaattaattttggacttgggtttagatatttacatttttatcaggacttcttatgttcaccccaaagtttgcaaaatgctcatctaaaataagaaagatgataggcctgatccatcttctgtttactaggttaaatctggaaaatataaacctcaggtgccagacttcagaggsatatagaaaaacaattactttttgcattagtccattcttgcattgctaaaatcctaaagactggataatttctaaagaaaagatgattaaggcgggatgcagtggctcacgcctgtaatcccaggattttgggaggccgaggtgagcagaccacgatgtcaggagttcaagaccagcctggccaacatggtgaaacctcgtctctgctaaaagtagaaaaaaaaaaaaaagaagaaagaaagaaaagacgattaagtggttctagattctacaggctgtacaggaagcacaacagcatct

SEQ ID NO: 56557 - DNA, 601 bp, Human
aaaaaaaagaagaaagaaagaaaagacgattaagtggttctagattctacaggctgtacaggaagcacaacagcatctgcctctggggaggcctcaggaagcttccaatcatggcagaaggttaaggaggagcaggcatgccacactgcataaacaggagcaagagagagtgggaaggtgctacatactttaaaatgacctcatgagaactcactgtcatgaggacagttccaagggggatggtgctaaaccacttatgagaaatcagcccctattctccaatcatctcccaccaggcccytcccctaacattggagattacatttcaatacgagatttgggtaggatcacacatcctatatcacttttggagaaagaatggaggtagctctgaaggtttgttacatcacagcatttgaggaatggctggggtgatggcaaatatcatacagaagagcaggcgtagacaagatataccagttgttttcaaatatctgagaaaatatcagtaagaagaagtatagtcatgagtgtgcctcacttgcctaaacattttgattaaaaatgcattttagtagatttaattatgcctttttcctct

SEQ ID NO: 56558 - DNA, 601 bp, Human
caacaaagtagaagatataattcggatataactcaggtggctaaattagttttcttcaagctactcaaaaggaagattattctgagggcacccaacttaatcaagtgaactcctaaaagagtgtctagttctcagagagcttttcctgctcttgaagaagcaaataatcatgtgagaaggccacacagcaagaggcttaggaggcctctagaagctgagagcagcactggattgataatcagcaagaaagcacagctgagctaacatggagactgcagcctctctaggtcgacaggaactgattatcaatgaatgttgttttaagtcactacgtttgtgataatttattatacagtaataaaaaccaaatacaaaagattaaaaagaaatctaagttgaagatatcttaaaccgaattgcatttaatacacctaacctactgaacatcatagtttagcctagcctacctttaacatactcagaacactcacattagcccacagttggacaaaattacctggcaacacagtacactgtggaatattgttggttcaccctcatgaacatgtggtggactgggatcctcagcttgctgcccctg

SEQ ID NO: 56559 - DNA, 601 bp, Human
tactgaacatcatagtttagcctagcctacctttaacatactcagaacactcacattagcccacagttggacaaaattacctggcaacacagtacactgtggaatattgttggttcaccctcatgaacatgtggtggactgggatcctcagcttgctgcccctgcccagcatcacagagagaaatgtgcttcatatcactagcctggaaaaatatcaaaattcaaaatttgaagtatgatttatattgactatgtattgctttggcactatcacaaaatcgaaaaataccaagttcaaccrtcataaattgatgactatctgtaccaccaaatagcccattactcaaatcctcaactttttctcttcaatgtatgtgacctctatttatatagtcaatacttcttgatttgaaaaaggattggatgataatagaagtgaaaagtttgaatgattatactcatttttctttttctttatctataaaccagcgcccagttggaacatttccatattttagttctaaggttgtaaattgctgaaagtttaggttttcttattgatgattctctgctaacatttgataagtaggtcccattgaat

SEQ ID NO: 56560 - DNA, 601 bp, Human
gaaaatggtaaatgaaattacaatttatatttttcccctaattcatgggcattgaatattaacttagtggtctgcacttgtagcttgttaattgtttgacatctagctgaaaagtaaagtgttatatcacagatagcttttctaattgcaaacacatcaccctgtttattcattggttcactaagccttaattaggtatctatcctgtaccaaatggtatgccaggggtgaggatacaaagatagaatagaactttttagtacaatgtgaagaaagaaacataaagaaataagactgctgragtattttaactaccaggtttgcacgttgacttctttatgcttcatttggattttctgaggctttaacgttttccgtttttaagactaagctcaagggtcaactctttcatgaaaattaattgctatttatgtttccatctataagaagagtgaaataaacaatgaaatctaatgacactgaaaagtgctttcaatgtactgttgagtgggaaaagccacatttttaacttgtatattcagtgtgatcccaattttataattttactctcaatccatatatgtgaatataatacatagga

SEQ ID NO: 56561 - DNA, 601 bp, Human
gaaaagtaaagtgttatatcacagatagcttttctaattgcaaacacatcaccctgtttattcattggttcactaagccttaattaggtatctatcctgtaccaaatggtatgccaggggtgaggatacaaagatagaatagaactttttagtacaatgtgaagaaagaaacataaagaaataagactgctgaagtattttaactaccaggtttgcacgttgacttctttatgcttcatttggattttctgaggctttaacgttttccgtttttaagactaagctcaagggtcaactcttycatgaaaattaattgctatttatgtttccatctataagaagagtgaaataaacaatgaaatctaatgacactgaaaagtgctttcaatgtactgttgagtgggaaaagccacatttttaacttgtatattcagtgtgatcccaattttataattttactctcaatccatatatgtgaatataatacataggaaagaggttggaagtaattcaatcatgaggttaacaagttttatctcagatgagattgtgtgtgatttttaaaaattatatttattctacctaataagcatttattact

SEQ ID NO: 56562 - DNA, 601 bp, Human
aagagtgaaataaacaatgaaatctaatgacactgaaaagtgctttcaatgtactgttgagtgggaaaagccacatttttaacttgtatattcagtgtgatcccaattttataattttactctcaatccatatatgtgaatataatacataggaaagaggttggaagtaattcaatcatgaggttaacaagttttatctcagatgagattgtgtgtgatttttaaaaattatatttattctacctaataagcatttattacttttataacctgagagataaacattattgaaaaagaagakcatggatttaaagcgaggatgtgagactgtggctgttacatatttttttggtttggaccttggttaagaaggcaaagagggatagagattgtgggacatagagggagacgcaggcctgaggacagttacagtgttataaagggagaggcttaagtatcattataatatgagcagaaattgcaaagagtgagaagctaaaatggaagggagacgataaatagctcagcaaggtttttagggaagcagaaatgactcagatttgaaatataggtgacagaattagccctaaggaggagaaag

SEQ ID NO: 56563 - DNA, 601 bp, Human
attgaaaaagaagatcatggatttaaagcgaggatgtgagactgtggctgttacatatttttttggtttggaccttggttaagaaggcaaagagggatagagattgtgggacatagagggagacgcaggcctgaggacagttacagtgttataaagggagaggcttaagtatcattataatatgagcagaaattgcaaagagtgagaagctaaaatggaagggagacgataaatagctcagcaaggtttttagggaagcagaaatgactcagatttgaaatataggtgacagaattagccytaaggaggagaaagaaaagatcttttgagactataagaaaggaggtgagagttgatgtagccataaaaaatacagagatgaaagggtggggagttaaaagagcctgtgtatgtagcctaaattcttgctatgaactagaaagccaggtcattagccgaaattgacaatgggataggggtggtcttggggaggttaaggctagaaaaatccaagcaaagcaggtaacaagaggacttgattccagactgtgaacagatttgaggcagggtcagaaagccaccctgaaatttcagtgctata

SEQ ID NO: 56564 - DNA, 601 bp, Human
aggaggagaaagaaaagatcttttgagactataagaaaggaggtgagagttgatgtagccataaaaaatacagagatgaaagggtggggagttaaaagagcctgtgtatgtagcctaaattcttgctatgaactagaaagccaggtcattagccgaaattgacaatgggataggggtggtcttggggaggttaaggctagaaaaatccaagcaaagcaggtaacaagaggacttgattccagactgtgaacagatttgaggcagggtcagaaagccaccctgaaatttcagtgctataaamctgtagtgggaactctataggaatactaatttctcccttcatcaacaaagatattatactggtcctgtgaagaggcttagtcacttcccagtttatgtatttcaagattatattcctaaaacacagaagtttttcagtttgttccctaacctgaccccagtctacctgtttccatccaagactatcactaccacttctaaaccacctccagccacacaaaaaacacacactatgcttgagtcattccaaattacacaccttcctctaaacattagtgtgaaattaggacatttgggaaat

SEQ ID NO: 56565 - DNA, 601 bp, Human
aaagccaccctgaaatttcagtgctataaacctgtagtgggaactctataggaatactaatttctcccttcatcaacaaagatattatactggtcctgtgaagaggcttagtcacttcccagtttatgtatttcaagattatattcctaaaacacagaagtttttcagtttgttccctaacctgaccccagtctacctgtttccatccaagactatcactaccacttctaaaccacctccagccacacaaaaaacacacactatgcttgagtcattccaaattacacaccttcctctaaayattagtgtgaaattaggacatttgggaaatgtgattgatatgatttgcatgtttgcccccttcaaatcgcatgttgaaatggtattcccagtattggacgtggggactggtgggaggtgattggatcatggggacagatccctcatgaatggtgtagcaccattcccttggtgataagtgagttctcccttagttcccatgagatctggttgtttaaaagaaattgggatctccccctgctctctcttgctcccactccctccatgtgacatgtgtgctccagctttatcttctgccatg

SEQ ID NO: 56566 - DNA, 601 bp, Human
tcagtttgttccctaacctgaccccagtctacctgtttccatccaagactatcactaccacttctaaaccacctccagccacacaaaaaacacacactatgcttgagtcattccaaattacacaccttcctctaaacattagtgtgaaattaggacatttgggaaatgtgattgatatgatttgcatgtttgcccccttcaaatcgcatgttgaaatggtattcccagtattggacgtggggactggtgggaggtgattggatcatggggacagatccctcatgaatggtgtagcaccatycccttggtgataagtgagttctcccttagttcccatgagatctggttgtttaaaagaaattgggatctccccctgctctctcttgctcccactccctccatgtgacatgtgtgctccagctttatcttctgccatgactggaagcttcctgaggccctcaccagaatcagatgtctgcaccatggttcctgtacagcctgcagaacagagaaccaattaaatatcttttctttataaattacccagcctcagatgtttcttaaaaacagtgcaaaaaatggcttaacactgtgatatttg

SEQ ID NO: 56567 - DNA, 601 bp, Human
ggggacagatccctcatgaatggtgtagcaccattcccttggtgataagtgagttctcccttagttcccatgagatctggttgtttaaaagaaattgggatctccccctgctctctcttgctcccactccctccatgtgacatgtgtgctccagctttatcttctgccatgactggaagcttcctgaggccctcaccagaatcagatgtctgcaccatggttcctgtacagcctgcagaacagagaaccaattaaatatcttttctttataaattacccagcctcagatgtttcttaaaarcagtgcaaaaaatggcttaacactgtgatatttggtattttctagtccattagtgcacatccccccgatgtaggataaatatggtatgaatatttgaatatttttatgagtaataattaagcttattgaattatcacaactccagtgagataagtctaattttaatatcattagaaaggtgaagaagacaagaccagcgagggctactaatttctcaaggacacgctcatcctcatgtgagagctggaactcaaaaccagaccttgactttgtcaaaatgcacttttggttcccaatctg

SEQ ID NO: 56568 - DNA, 601 bp, Human
aatatcaaaatgtggaaatgtttgaaaaagaaagacaagaaggataggggaaaatagagaagaatagagagagaaaggaagaaagaaaggaggagagaagggaaggaaggagaatgtttgatgagcttatgaaggatgtctctttgcaactgagtgtgaatttagatgggattacataacatgaaacaaaatgaaaagaagaaaaaacagatacattcagtgatttaaaaatggggtaattctttctgtttttatttcacaagtcttttgtaacttattttagagttttaaaactttgtakacatatttaaaatgttcaattttcactaaaacaatcacatttttaaacataagggcatatatttggtgtgacaacctaacatttgccaccaagtgttaaagatgaaccagttttaattttaactagacgatttgaaacttttttgatatacttgagaatttgggactaccaaaaaacccctaaatatgatcctttatattttttattacttctaaaatattttgattctaaacaaatatatgtaaatactatgtggagaatttagatactaaaaatttaagtcaaatattgtttaagtac

SEQ ID NO: 56569 - DNA, 601 bp, Human
tagagtatattacattttaacagctcttgaaaattcagttaagtggtctagtgcttgtggtaatctggatgttagctaacaagaataaaaattaattccatacgttatcaacagcaaagaattttggagcagctaccataaataagaaactgctttagatgctggagatctaaatttggtaagatataatttcagccctcaaggatctagtttgttaagaaacataggcatcataacaaataaatgttcttgaattcaaaaaaaattaaagcttgattgttcagaaagcaatttcatctayatttaggagatgtttacaggtgttatattttataatgcagatctgagttcactttttgtacaagtagaagagtcacacttttatattaatagtgataatattattaacactgttggatttcttccatgtactgtcctagatattttacttattcctagaattttatagaataggtcattttgcttatgttagccttcagttgcaggtgatagaaatccaaattgagcatctattgacacctctattgatctgtccagggaagtacagaggagacctgccttagccatctgttgaccagag

SEQ ID NO: 56570 - DNA, 601 bp, Human
tgtgtgtgtgtgtgtgaatgtatgtctatatatatatgtatggtgtttgtgtgagaggcaaagagaagagaaaaaagaatgacgttagcttatcaatatattataataaaattgtgttgactagtttctttatcgttctcttccaaactgataaaaggacaatttttggtgtgcggtttaaaagaaatgaacttttccccctatactgagggcaattttaaaagaaggtagtttctcaggtgtttctagtcaaaatgacaaacctacaaagtacatttgcattattttatgtatactttaytgatagagtcctttaaatgttgagttcaagctaatttttcttaatcttcaaaaagtttagggatcaaattgtatcctgcagatttttgttatgctaaatttcatttcatctcttcttctttagttctacagagaagttaggtcaagattgtttgaaagtagacttgagtccagaaacttgtctcttcgaccagtggattatctaccaatttgaaaaaatatagcatgcatgtggaagaaaatgttacttttgcatgtcagcatgttgtcattattattagaagaacacatctttcaaaga

SEQ ID NO: 56571 - DNA, 601 bp, Human
gtgtgtgtgaatgtatgtctatatatatatgtatggtgtttgtgtgagaggcaaagagaagagaaaaaagaatgacgttagcttatcaatatattataataaaattgtgttgactagtttctttatcgttctcttccaaactgataaaaggacaatttttggtgtgcggtttaaaagaaatgaacttttccccctatactgagggcaattttaaaagaaggtagtttctcaggtgtttctagtcaaaatgacaaacctacaaagtacatttgcattattttatgtatactttactgatagwgtcctttaaatgttgagttcaagctaatttttcttaatcttcaaaaagtttagggatcaaattgtatcctgcagatttttgttatgctaaatttcatttcatctcttcttctttagttctacagagaagttaggtcaagattgtttgaaagtagacttgagtccagaaacttgtctcttcgaccagtggattatctaccaatttgaaaaaatatagcatgcatgtggaagaaaatgttacttttgcatgtcagcatgttgtcattattattagaagaacacatctttcaaagaaaggaaa

SEQ ID NO: 56572 - DNA, 601 bp, Human
ataacaattattattgagatgtttcatgcattttttttatccatagtagtaagtactactatctctataaagaggaaaaattcaatccaacagtcattaaagttgttctattaaatgtagtgataaatcttcagtttgtatttttaatataagatctgagggataatcaaagcaaaggcttatgtggatagggcatttattacataccaggaaatgtcctgaactctttacacatgattcattaattttctgaattacacttgtagataggaactattgttatcctcattttatagacaaagacacagagatagaggttaagtatctttactggggccacacagctaggaattggcagaaccaggatttaggcactaaaatctgtttatttaaccactagcctacatggccattggaaatgaattatacagagatgaaaagttttcgttatagattccctcgttgaaactcaaaaacagaaggcaaaatatgtaaaagaactcaaaactgagaatatttttaaaaatagaataaaatgtcatagaaaaaaatcacatttaagagtttctttcttctattacttttaccattgcagttatgg

SEQ ID NO: 56573 - DNA, 601 bp, Human
ttcttgaagtcgtgcttattacagatatgtgaggagtgctttttttagggggggaaggggagaaacagatgtagaataatccttttttgttgttgtttttaacacccttttctatgatggccagtgtttcactgatcttgttggctgtctccgtggctggatgagttgtctcgaagagcagtttacactcagtagtgaccaggtccttgagagctcttagctcatcatcctttaagtatagtttggagtattcttcccaggctgtactacttcatgcatttttttttttttttttttttttgcctattgtatttagagtttttcctgaaatgaatttctcactatgtatttgactatcaagaagagttgtatcatctgcaagtttgaggtttcacttgaaaatcctattagcccatacagggaataattcattccagtaggttcttaatagcccttccctgttccctgtttctaatccatttattgctctttaaagattaccatgtactcctttttcttattataaaatattgcatattcatattaaaatctggaaaattcatagaagcagcaataagtaatctaatgaatcaaaaacaat

SEQ ID NO: 56574 - DNA, 601 bp, Human
tcatgcatttttttttttttttttttttttgcctattgtatttagagtttttcctgaaatgaatttctcactatgtatttgactatcaagaagagttgtatcatctgcaagtttgaggtttcacttgaaaatcctattagcccatacagggaataattcattccagtaggttcttaatagcccttccctgttccctgtttctaatccatttattgctctttaaagattaccatgtactcctttttcttattataaaatattgcatattcatattaaaatctggaaaattcatagaagcagmaataagtaatctaatgaatcaaaaacaatgtcaagtagtgtttcttaatcattacaattatttatgaattttggttttaatttttcaacatttggtctacttgatgtgtggcacacattgttctatgaaatccaaacagtgttattgtaaagtctctgggcttcttagagcaaaagttttaaaaccatcatttatatgtttaatatatttttatctatttctagatttattttaaaggcagtaaaataatctaacaggctcctgggtacccatggtgtttattatattatgaagaaataa

SEQ ID NO: 56575 - DNA, 601 bp, Human
ccatgtactcctttttcttattataaaatattgcatattcatattaaaatctggaaaattcatagaagcagcaataagtaatctaatgaatcaaaaacaatgtcaagtagtgtttcttaatcattacaattatttatgaattttggttttaatttttcaacatttggtctacttgatgtgtggcacacattgttctatgaaatccaaacagtgttattgtaaagtctctgggcttcttagagcaaaagttttaaaaccatcatttatatgtttaatatatttttatctatttctagatttrttttaaaggcagtaaaataatctaacaggctcctgggtacccatggtgtttattatattatgaagaaataaaatattactcatacagtcgaaaccctacaattaaattcctttccctcccttcagagggaacctattataatgtgtgatttgtgatcatgaatgatttcaactagtttttctgatatttatatttattctgcaccttcaccctcatcatcatccttacaataggctttatcttttggaaatacatataatattgatgtgctctggttttaatcatcacctgcctcttgcc

SEQ ID NO: 56576 - DNA, 601 bp, Human
ataaaatattgcatattcatattaaaatctggaaaattcatagaagcagcaataagtaatctaatgaatcaaaaacaatgtcaagtagtgtttcttaatcattacaattatttatgaattttggttttaatttttcaacatttggtctacttgatgtgtggcacacattgttctatgaaatccaaacagtgttattgtaaagtctctgggcttcttagagcaaaagttttaaaaccatcatttatatgtttaatatatttttatctatttctagatttattttaaaggcagtaaaataatmtaacaggctcctgggtacccatggtgtttattatattatgaagaaataaaatattactcatacagtcgaaaccctacaattaaattcctttccctcccttcagagggaacctattataatgtgtgatttgtgatcatgaatgatttcaactagtttttctgatatttatatttattctgcaccttcaccctcatcatcatccttacaataggctttatcttttggaaatacatataatattgatgtgctctggttttaatcatcacctgcctcttgcctcagcaagctctaggttatatt

SEQ ID NO: 56577 - DNA, 601 bp, Human
aaccctacaattaaattcctttccctcccttcagagggaacctattataatgtgtgatttgtgatcatgaatgatttcaactagtttttctgatatttatatttattctgcaccttcaccctcatcatcatccttacaataggctttatcttttggaaatacatataatattgatgtgctctggttttaatcatcacctgcctcttgcctcagcaagctctaggttatattttaaaggagattaaatatattttcactgaatttaattgtatctaagtaatacctttcgaagagtcaaatratacagaaaagctcataacaaaaagttgcaattcttccatccctccttcactctcagagacatgactgatctatctcagctgtttcttctagcatttacccccggatttaaaaataatatatttaaacaactataacttaatttaaacattttagacattatctcttcctttcctagtatggaagacaaagattgagcactctcatctgaccctcacacatttctgcctacatcctgcaacatatacttaaaataaatatttaatgctaacattgttaaaaccatataaatattactcac

SEQ ID NO: 56578 - DNA, 554 bp, Human
tacacatatttatgacttaactcttattttagaagatttgtaggttataatagcatttaagtgtgtgtgttcatggtcaggtttaaccaaagtcctaggcctgagtatttcaatgtgaagaacaaacagaatatgatattactttcatacctctatttttgatagtctgtgattctgagccctatctatgctttcagtcaaattaccaatggtatgaaactctttaattttgtgtgtctcacgtttagagggtrgcttaagaggttctttaactgcatgactattgtgaggaggatacttatgagttgttcttcatttccatggggacaaggacaatgaaaatacagtataatacattcagagtgttattagaagttaggtagtaccttttaattgttaaacaataaagtaataacattgctcattaggcatgtgcttatgaagacaaaaaggcctgatttactgatttagtgatttagtccaaggctttgacatccatatgatgtggacctctgggtactaaagaagtctataaatcccaatcacaactgtga

SEQ ID NO: 56579 - DNA, 601 bp, Human
aaatcaaaatgttacatcaaaggaagagttgcatcaaaagaacctcagcaaaacctcaaaacaaccaaacactccacttgtctgtttaaattattagcaaaagcagctctgttatcccagcttctaagctaaccagactcatcattttggcctttcatgtatgcttttcctatggccaaaacgtccacaaattactaataaatgctgacaaggagagaggttaaaaccaggaagccatgccttttagctgacaaaacattcattgaaatgctatctgggtgaagcactgagaaattaatcrtctgaatagtctaaattatagtacatgaagaatgcaacttgctagggagacataccttcagcattattcgaggttaatttaaaccaacatgtaaatgtttgtatgcttcatgtgtggtatcccaaaaggttgtgttttctcttttgatctttgaatatgctgatcgcctttcatgaacagtggcattcaatgcactttgaaaaaaacacagtctttttctttgaaggtaagttgtaagaaagagaaatcattaaagcctggagtgcagaattgttgtcgactgaaatggtatcaagtgag

SEQ ID NO: 56580 - DNA, 601 bp, Human
ttgaactggctgtattttccgactgacttgtttttcttatgaaggcagcattttagtaaaattgtgtttgtctttctttctgataggctctaattgaagtttgaaggttcattacacaatgcctgggaatatgttgtcaaatacaattcacctctcccacagtgaatattggcatgattttataggacagggtactctagagctcagctgtcataatatttggctccaatttcattcataatggacagaatatctacaatgttttgaatccctactttcaaatgtcagcacactggaacawatattaaagaatgggtttgaatctaagtagatgagtatttccttgaagcaacatgttatagcctaaatgttgtttccttcaattatgtttaaacaatgtaaccttaaatgtttcacagatgtatcacttgaaatccaaaacacatactactcatcaaagtcatctttatttaagcttaggaagaaaaatagaaatctgaaatgtttgctcttagtccacacacacttctcatctggcaggacatttctgaatttatttgggaaattgaatatatgtcaggtaggtttgggttgctgggta

SEQ ID NO: 56581 - DNA, 601 bp, Human
ccagcagcagatttttagtgtaagcaatttattgaaaaagtcctctcagaagatatctatgagatggtaagaaaagctgaaaaaggtaggggagaaagtggacaaagatgtgatctctaaagttgagcctcagactgatacatggcatggtctggagggaaaattgcaccacagaaagaggtaccccttaaggaacaggatgccaggattttacccctcatatctgtcagttatcggctacaagtccaaggggcagggggaagtgcaagtgatgtatcttgctggaagtctcagggtcagraggctctcattcaaagaggcaggtctctggaatgatgcagctgcaagccattagcagccaacccttgcctcagctgagagatgggtaccaggatgaaaggcctggtaaagggttatggctgtgccaccagtggaatttcctacactgggaatatacatgctaggtgcatagaatgttaggtgtgagaggggagaccagcctgttggaaagtattcattaatgcatatttgtcaagaattctagctggtaacactttattaaacattagatattgctattttatgtgctttgaagcaatta

SEQ ID NO: 56582 - DNA, 601 bp, Human
ctcagctgagagatgggtaccaggatgaaaggcctggtaaagggttatggctgtgccaccagtggaatttcctacactgggaatatacatgctaggtgcatagaatgttaggtgtgagaggggagaccagcctgttggaaagtattcattaatgcatatttgtcaagaattctagctggtaacactttattaaacattagatattgctattttatgtgctttgaagcaattacactgtttgaaaaaccttattttgtaaaaaaaaatctgttctattcactgtctcacagatttaggacartttattaattaagaacactagatttcaagttaaacagacctgaccttaaaccttgaccttgttctttgctgtataaatggttttgtatgagttacttaaccacactgagcctcaaattcccatcagttatatgtggattataatgtctgcctcatgcttgttgtgaacattcaatgtaatcattcatatgaagaagcaatgaacacagggtctggtgcacataaatgttcaacaaatgatagacattacttccttctggatgagcaaaaccttgatgctttcagtagaaggtatttggaa

SEQ ID NO: 56583 - DNA, 601 bp, Human
gcctggtaaagggttatggctgtgccaccagtggaatttcctacactgggaatatacatgctaggtgcatagaatgttaggtgtgagaggggagaccagcctgttggaaagtattcattaatgcatatttgtcaagaattctagctggtaacactttattaaacattagatattgctattttatgtgctttgaagcaattacactgtttgaaaaaccttattttgtaaaaaaaaatctgttctattcactgtctcacagatttaggacagtttattaattaagaacactagatttcaagtyaaacagacctgaccttaaaccttgaccttgttctttgctgtataaatggttttgtatgagttacttaaccacactgagcctcaaattcccatcagttatatgtggattataatgtctgcctcatgcttgttgtgaacattcaatgtaatcattcatatgaagaagcaatgaacacagggtctggtgcacataaatgttcaacaaatgatagacattacttccttctggatgagcaaaaccttgatgctttcagtagaaggtatttggaactatggttgaatcttttctgggggtattgat

SEQ ID NO: 56584 - DNA, 601 bp, Human
tgtcaagaattctagctggtaacactttattaaacattagatattgctattttatgtgctttgaagcaattacactgtttgaaaaaccttattttgtaaaaaaaaatctgttctattcactgtctcacagatttaggacagtttattaattaagaacactagatttcaagttaaacagacctgaccttaaaccttgaccttgttctttgctgtataaatggttttgtatgagttacttaaccacactgagcctcaaattcccatcagttatatgtggattataatgtctgcctcatgcttrttgtgaacattcaatgtaatcattcatatgaagaagcaatgaacacagggtctggtgcacataaatgttcaacaaatgatagacattacttccttctggatgagcaaaaccttgatgctttcagtagaaggtatttggaactatggttgaatcttttctgggggtattgatgggactagagtcaggatgaggtggatgaaatgccaggtactttcatctgtatgacttgagagtgtatgcatcaaattttgcaccctcgagcacctctctcacctccacattgaaaaaaatacatgccag

SEQ ID NO: 56585 - DNA, 601 bp, Human
taaacagacctgaccttaaaccttgaccttgttctttgctgtataaatggttttgtatgagttacttaaccacactgagcctcaaattcccatcagttatatgtggattataatgtctgcctcatgcttgttgtgaacattcaatgtaatcattcatatgaagaagcaatgaacacagggtctggtgcacataaatgttcaacaaatgatagacattacttccttctggatgagcaaaaccttgatgctttcagtagaaggtatttggaactatggttgaatcttttctgggggtattgaygggactagagtcaggatgaggtggatgaaatgccaggtactttcatctgtatgacttgagagtgtatgcatcaaattttgcaccctcgagcacctctctcacctccacattgaaaaaaatacatgccagattaaaaaaaatgaaattggaaaggatggtttgtagaactgttagagcatccataaaactcattacaaagtaaaatatattagtaataaaatgattttagtaatacctcgggaaccactctaattccaaatcatctctctgtctcttgtaatggctttccaatattctttg

SEQ ID NO: 56586 - DNA, 601 bp, Human
aatgtactgaaggcatttcagattaccagaagaatcacagagacaagggaccatttagccatagggttaaacctgtcactttacctaccccacaaataagtaactatggcaactcactgaaagtgcttagctaccatgggagtggatggagttcgtgctttgtggggacaatgctgtgggacctctatgcccccatccataagggaccctgggaattgccttctagcagagaggccaactcacatttcaaataagtatttttccctcctcaactgcttttctaagctttgcacattaacaytgacctagtgcaccatttaaaagtcctaaatatatcacacagtcgccagcccaatcaaggtgagtggtcagacaccagcatgctgtgcacagtatgctagttggccttagagtaatacagggtacaccatttatgtccagttaaccaggtgaccctctagttgctttattaagcacaggcttgactgtcaaacaggtcacaaggaggacaaaaagtgtccttgcatcgtatgaaaagagttgcttgaaatcacagaataccctctattaattgctaaaatccaatttccacctgaagaca

SEQ ID NO: 56587 - DNA, 601 bp, Human
cacatgcagttttcagatgtgtcccccaaagttaatatatttcctgggtactcattcacactcttctgccaatagtattaatgctttgggaaatgtttgagaagtgttgttccagtggaaatgagcctgtgggttcactgattcatttatccattcattcatttattccttcatacagtatatagctttcaagccacttttatggactattttattaactttgaatatcaaaaccaataaaatagactttgtgtctgctttgtgacacaatttaatgagtaacaattttttttttttttttgagaaggagtctcactctgttgcccaggctggagtgcagtggcacgatcttggttcactgcaagctccgcctcacgggttcacgccattctcctgcctcggcctccggagtagctgggactacaggcgcccaccaccatgcccagctaatttttttgtatttttagtagagacgaggtttcactgtgttagccaggatggtcttgatctcctgacctcgtgatccgcctgcctctgcctcccaaagtgctgggattacaggcctgagccatcgcgcctggccatgagtaacaatttttaa

SEQ ID NO: 56588 - DNA, 601 bp, Human
aagataagtacggagttgtaaacctgcaatagaataataccctggatatccaccttcactgatgagtttaactgactcattcttacctgttaaccaaatgcttttgagagtcaaaggcagggtctgagaggaattatcaatgaatatttgtaatgaatcattgaggtcgcttgtgaatagttgaaacttccaatattaaggctgtgtaggccaagaatctagttatcctttcagaaatttttttttctgaccacctactctgtgccttaagcaaaagtacctgcccttctttctttctttyttttttttttttttgagagcatggtgtggtctcggctcactgcaacattcgcctcccgggttcaagcgattcacttgcctcagcctcctgagtagctgggattacaggcgcctgccaccaagctgggctaatttttgtatttttagtagagacaaggtttcaccatgttggccagactggtcttgaactcttgacctcatgatctgcatgcctgagcctcccaaagtgctgggattacaagcgtgagccaccatgcccggtcagtacctgcccttctctaaaggcacttgcttgcagtct

SEQ ID NO: 56589 - DNA, 601 bp, Human
tgagaggaattatcaatgaatatttgtaatgaatcattgaggtcgcttgtgaatagttgaaacttccaatattaaggctgtgtaggccaagaatctagttatcctttcagaaatttttttttctgaccacctactctgtgccttaagcaaaagtacctgcccttctttctttctttcttttttttttttttgagagcatggtgtggtctcggctcactgcaacattcgcctcccgggttcaagcgattcacttgcctcagcctcctgagtagctgggattacaggcgcctgccaccaagcygggctaatttttgtatttttagtagagacaaggtttcaccatgttggccagactggtcttgaactcttgacctcatgatctgcatgcctgagcctcccaaagtgctgggattacaagcgtgagccaccatgcccggtcagtacctgcccttctctaaaggcacttgcttgcagtctttggaggagataagctttgatcaactcatcaacctaatggcaagtatcatttgacttgagaaaagataagaaacagggttctcaatagtgtgatctacaagatagacagcagtcagtagacgct

SEQ ID NO: 56590 - DNA, 601 bp, Human
tgaaagaagatatttatactaggcagatgggctaggttatgctgcaataatgaacaaccccaaaatcttagtggttgcaaacaacaaacttttttctcccactcacaatacaggttcatcatagtcagcagggggctccaggaatcataattgctgatatagccacctgacagatcagtaacctcagtgtagctggtggccatgagaaaaggcgataatcatctttcatatcaaatattagaacaatgcaagagaaatatggtgattttactctctatatcaatatcacacacactaacayttggtgtgcattttagaatatcttgctggttcccagtaaatatgtcaactttttgcactatatgccgcttgaaatgtcaatactgcacaaatacgcgtagtctgctgacagtaacctgccaggttctagacttccatattgattactgttagcaaaatgtgtaggtgaaatttttgtagggtacgcacgtgaccattcacagaaggcaagaggttctctttggaatttaattttctgtgtgaaaaataaatcacttttttgtgtgtgtggaacatttctcatggaataatgggtcatatt

SEQ ID NO: 56591 - DNA, 601 bp, Human
atcttagtggttgcaaacaacaaacttttttctcccactcacaatacaggttcatcatagtcagcagggggctccaggaatcataattgctgatatagccacctgacagatcagtaacctcagtgtagctggtggccatgagaaaaggcgataatcatctttcatatcaaatattagaacaatgcaagagaaatatggtgattttactctctatatcaatatcacacacactaacacttggtgtgcattttagaatatcttgctggttcccagtaaatatgtcaactttttgcactatatrccgcttgaaatgtcaatactgcacaaatacgcgtagtctgctgacagtaacctgccaggttctagacttccatattgattactgttagcaaaatgtgtaggtgaaatttttgtagggtacgcacgtgaccattcacagaaggcaagaggttctctttggaatttaattttctgtgtgaaaaataaatcacttttttgtgtgtgtggaacatttctcatggaataatgggtcatattaggttaagtttaggaaactgatgtttattgagctgtgcacatatctgctaaaggaatttcacat

SEQ ID NO: 56592 - DNA, 601 bp, Human
cagtgtagctggtggccatgagaaaaggcgataatcatctttcatatcaaatattagaacaatgcaagagaaatatggtgattttactctctatatcaatatcacacacactaacacttggtgtgcattttagaatatcttgctggttcccagtaaatatgtcaactttttgcactatatgccgcttgaaatgtcaatactgcacaaatacgcgtagtctgctgacagtaacctgccaggttctagacttccatattgattactgttagcaaaatgtgtaggtgaaatttttgtagggtaygcacgtgaccattcacagaaggcaagaggttctctttggaatttaattttctgtgtgaaaaataaatcacttttttgtgtgtgtggaacatttctcatggaataatgggtcatattaggttaagtttaggaaactgatgtttattgagctgtgcacatatctgctaaaggaatttcacatctataaataaataagcttatttttccatggtgtcagagagataatgagactttcatataaaactatttttgccagctgaaatatcatgattgttattctaatatttcctccacaaagact

SEQ ID NO: 56593 - DNA, 601 bp, Human
acatatctgctaaaggaatttcacatctataaataaataagcttatttttccatggtgtcagagagataatgagactttcatataaaactatttttgccagctgaaatatcatgattgttattctaatatttcctccacaaagacttagtgaactgcatgtccattttagaaagttggagtagatattttaattttttcttgcttcttgagaactactatcaacaataaaaaaagctttgattttaacgtgtatatcttaagatttcttttgatcaatactaatgaaaataaacctgaaamgcgaatcattggacaaatgtgagatttttcctttaatttatacattaattgatgtaagatagtatttagaaagtttcaatcctttccagttacaattgtaattgtcacttacctcaaactaaacaaacggactctttcccatatttttctacttggtgaaggacattctaatcatctagatgcctaagtcagaaacctaggcatcatcccttcattctttctgttcctcacagtcacacttaattaattgaacgattttcggtccctacatacttcctgatttcctcccctgtgccctac

SEQ ID NO: 56594 - DNA, 601 bp, Human
cataaactttacaatatatgcttgtgtgtgtcagtcagagggggaggtggagagaggcagtgtttctgaaacaagagatctatgaaagaagggaacagtctgttagttccacctggttcttctcatttaattactataattaatatatgcagaagaaaaattaatagggttcttaaatccagggagatattaaatgtcaaaaatgtggatatttgaattaaagactaatcaacttgaacaatacattataatgttaaagaactggtagcatattaatttcaagtgagagttttaaacttgctaactgcagtggttttgtgaatccaattttaagagttaaatgttgtgtcaatgccatgaatcagagaatagatatttataacaaaagatctgtatgaaatgatgcataatagatggtgatggctgaagctgctgaaaattgatggtctaaatcaaaaggatggattaggaatctttgcggaattattacagacctgtagttttgtgagaaaagcagagaatgtcaaggtcttttacttcaaggaggatttgaagtatttgggggtatacattattgcattagcttagtcagtttacagct

SEQ ID NO: 56595 - DNA, 601 bp, Human
aggcatcacactacctgacttcaaactatactacaaggctacagtaaccaaaacagcatggtactggtacaaaaacagagatatagatcaatggaacagaacagagccctcagaaataatgccgcatatctacaactatctgatctttgacaaacctgagaaaaacaagcaatggggaaaggattccctatttaataaatggtgctggggaaactggctagccatatgtagaaagctgaaactggatcccttccttacaccttatacaaaaatcaattcaagatggattaaagatttaaaygttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaacccc

SEQ ID NO: 56596 - DNA, 601 bp, Human
agacattcattctggaaagaaaaaacatgctggaaagaaaaattttacttactctaatgtgttttattttaaataaaaagtcctataggttatgattttactgtcctctttttttttctgaaaaacattaaggtttctttcccaaagcttattagttaattgtcagtttttatgtaagcccatgaggttagacctatataaggcagtaatttttaattctccctctcttcccacccttccttttcttccctatctcctttattttcttccttcttctttattagtttttaaatatgcatatctctttttataggagaaaggatggataatgattgcagcattctctgaccactctaatatctcaccctagaaattttaataaatgatttactaacattctcatcagggtttttattataaaataatatcaaagaaaacctgctttttaaaaaaatatcttgatacttgtattttaccaaattcatgggtatagataactttttgatttctcattactttcaagtatcttcttcatgtaaaattttaatcaaatttcagatcccatgcttaacacataaaaattaataaattgatgttgagg

SEQ ID NO: 56597 - DNA, 601 bp, Human
acccacatgctattatacaagagaaagtagtcctatgactgctggataatttacatacattatctaatttatcataaccctgggagagtggaaatattgctattcttattttactagtgagagactaagtgatttgctggtttttgatcccgggtctacatgaatacaaagctacatctttaattagttctctatagggtctcaaagcagtcattttactaaatttttgatctttattaaacatagatgcaaaagtaataataatatttccacaaataaagggatgttaaccaaaattaaygttcaagaatcctttcagtgtttctctacctctttaaatattccagaaatggtgatacagtcaggagcaatatattgccaggaactttggcaggacgagagattactttttggatagaatcagttgcaggaattttccaaacgattcacacagcatcaacttaatcttctggaaaacattttagggaccacaaatacatattgtacccaggatgtagtgtacttactgcagtgtggtctatgatttttcttggcatgcataattcaaagacccagatagaaatgactgattttagcactt

SEQ ID NO: 56598 - DNA, 601 bp, Human
tttattaaacatagatgcaaaagtaataataatatttccacaaataaagggatgttaaccaaaattaacgttcaagaatcctttcagtgtttctctacctctttaaatattccagaaatggtgatacagtcaggagcaatatattgccaggaactttggcaggacgagagattactttttggatagaatcagttgcaggaattttccaaacgattcacacagcatcaacttaatcttctggaaaacattttagggaccacaaatacatattgtacccaggatgtagtgtacttactgcagygtggtctatgatttttcttggcatgcataattcaaagacccagatagaaatgactgattttagcacttctaacaataaaacaaaagctcttctacaagagaatatcttcattcatgttaaacatatcaatatctcaagtaagtatgatgaattttgagatagggatcatgccattggggtctcatctggtggtcatggggaaatggtcctctttcttggatatctttggagagtatactatttgactctttagtcaaactgaggatcagtattttaaaagtctataaaatacttaagcca

SEQ ID NO: 56599 - DNA, 601 bp, Human
aaagcagatttattcttttttttctttgagatggagtctcgctctgtcaccccctggctggagtgcagtggcttgatcttggctcactgcaacctcagcctcccaggttcaagtaattctcctgcctcagcctcccgagtagctgggactagatttattcttaatcccatttatccatgtggagaatatgtcaccctgctcatttcactttgcaaaccgacttactattctttgtacctctctccttctctttttgctctgtcactaatagagctttcagctactaagacacacaggagtsctttctagagagtaactgaaattaaccacatacatcattttggtggcaaacctcacagccaccagtcatttatagtaccaagtccctgctctttgggtaacagtggataagaaatgctacacaagctccttatgtggagaaaagactgttctcctatttggaagccttgtgcccatatccatgccctttgcacatttatcaaataaccgtgacttgtcctttatgttttttcaagcatttgtatcattaggcaaggctctgcctaatggaagagatttactcttactctgtgcccaggtg

SEQ ID NO: 56600 - DNA, 601 bp, Human
atatcgggtgcaagatctaaaataggaagacaggttatgaggctgttggatccccattataatggcagcttggatgagataggtttcatgaaaatgggaaaaagcagacatgtgtgggatgttttaggcagctggaatcaatagtacttattaatggcccagaggtctgggtagtaaaggaaagaggagaaactttagataaggcagttagagaaggaaaatcaaggatagattctagatttttgtcttgagcaactgcatggatggtgatgtcattgaatgtgatggaatagatcgggargggtgcaagatttttcatggagggaaggccagagaagaaacagttctgctatagccatactgaattttaggcaccttttagacatctaaatagaactattgatttaatatttggatatgtaagtctcatctgtatgccatctgttctggctatcttacattcggatcctgtgtattttttacactggcctggaaaagctggcaaaacctagaactgcatttgtcccctctgcgtttataccatttcagttgacaggtctaattttaagttccaccttttcataattgattattcatttgt

SEQ ID NO: 56601 - DNA, 513 bp, Human
aacagttctgctatagccatactgaattttaggcaccttttagacatctaaatagaactattgatttaatatttggatatgtaagtctcatctgtatgccatctgttctggctatcttacattcggatcctgtgtattttttacactggcctggaaaagctggcaaaacctagaactgcatttgtcccctctgcgtttataccatttcagttgacaggtctaattttaagttccaccttttcataattgattattcatttgtacacaagtatttgttgagtaccagaaatagcatttagtyatttcaagctttagtttttcatcatcctattctccagatttcagcagcatcagaagccatataaacactgccttcggatggcccttagatggccaccaagatcccctagttacattttctgtgtacaaagcagaagaaagatgtccttcattctgtacacagtgtgctacactgtggtttagtttattataaagagcataataaaagaaaaa

SEQ ID NO: 56602 - DNA, 601 bp, Human
cctagcaaagttttattgatcttacatatatatatatataaaatggtttttcataatttcatgggatgcatcatccaagagaatgatcacagtgatactaattactgccattgactagccacctgccacatgccagacacatggtgacatggctgatgataacatgtgataggtgtttcccaagagagtccctttaaacaaggtttttttcctgtcttcatattgatgaagtgttttttctaaagccattatttcatttattctatgaaagacaaaattggcattttaaaagtagaacacrgtcttttgatacctgtcatctgagatacctaaaggattttttttttaagttagcatcaagggtaaataataacaaatgaagttattttatgttagatcttgtaggtctaaatatatgcacagcaatatttaacatcctgaaatcagaaattttgtttctgatggcatctctttccattatgtgatttgaaacattttagggatattttcctgtctactttgcatggaaaaaactacagactttgtcaaatctagttgccttggaagaagaatgaataagaggagatgtgttaaacaatac

SEQ ID NO: 56603 - DNA, 601 bp, Human
ggcagaggggcgagagatgggagtggaaggcaagtcagagagaacttggttctaaggcggcttctttagtccaaagtgctcagctcctcaaagcgccatactttggagtactattttctgagccctaacagccacaaatggaagaagtattcccctgtacagaaaagtttgcattacttttgtcagattatgtctcttaatataatcacattttatgaataagttttatttcacttaacagatttatttattttttaaaaccacaactttaattcccaagtaactcttagaagtttctccyttttggattttcattttgatgtttagtaggcttaaattccagtgtttaacacaacccccagcttttgagtcacagtttatttcattatagtagacccctgattgccaaattacaatatcttatgaaccgggcaaaatgttgacttatttaggacattatgttacctatttattccaaaatatttcatttgaaaatcagctacattcccatgtagacttttctttatacaaaaattaaaataattacagaaaggtaaattattctgatgctaaaattagcctttcattgatttcaagtaga

SEQ ID NO: 56604 - DNA, 601 bp, Human
tttgaaagcagtttttagaaatttctaattttgaaaatcttaaattgatttttaggaattctggggctacttttttctcagacctctagggcaaccaattgtagagacttcccccttctgttaattgactcagatctgcttacatattaaaggccacctctggttctcagctggaaaaaagagttcctcccttttgaaacagttgactcagaatcagttccttcctttcagatccttatctttaattactttgtcttctaacctggggtcctaatctttgcctaggaatttaaagtaaagrttggccgaatcttatttctcttgacttgtatctacctttactttagctcaccctctgggcgtggcctctagccagtctcactttgagtatctttgaaactctctccttattgtcaaccccttactttgattattttttttaatttaatgtttccaatgtagaaatacatctcaaaaattatgcagaagttctatcatataatgttcttgcatgggtctgaagctctttgaaggcaagggtccttgactgtgttgttcattgttgtgtaattactgcctagatgagtacttggaaaggtgg

SEQ ID NO: 56605 - DNA, 601 bp, Human
ttcaaattcctaggccaaagtcacatgtacatgccctaactgctatagggtagggagaagaaaggtctcctctatttacatttccttggcaggaggtaggacactgcataccctcaatagtagacacaatgccaattactcaagaaaagaaatggaggatgaatgttggacagccaagaaatgatgaaggtctgccacatttttcatataggttggctttttctttgaatgttttcacttagctagtgtaccaaaacagttctacatttccaccaaattaaaggtctgattagtttaatgyccttcatttgccatatttttctcaagaaagattatacagtgcatgaactcattcttattcagtaaatttaaatttgagtggcattatattccaactagtgctatccatgccctcagtaattttatagacttgagagccaccgtaaaaaatactaaagttacagtatgatgagggttctactaaatatcaactaagtaatatacggacaccaagaaagaaacagaaaattctgtgtggcaaagtcagaaaacactttcacagagcagggaatatttgagctatgaaagatgaacatgcaac

SEQ ID NO: 56606 - DNA, 601 bp, Human
caccgtaaaaaatactaaagttacagtatgatgagggttctactaaatatcaactaagtaatatacggacaccaagaaagaaacagaaaattctgtgtggcaaagtcagaaaacactttcacagagcagggaatatttgagctatgaaagatgaacatgcaacaaaaagggagaacattctttgttgaagggacaagataatgtcatcacaaagcattttcaaaatgcctgctatatttgtaaataggaagagatcagttcactagatgtataagaaggcatgaaggaggatagcaacagwtgagttcagacaggtagaaagcaggcctgattataaatgtttagatcaccaaggagtttgtctacgacactacaggtgacaggcaactcacaaaagtctttaaaaaagaaagtgagttttagggaagataatttcaacaacaatggggaagattaatgggagtagagtcacgcaggaagactaggaagggcagtggtgctcaacctgtttggcaccagggaccagttttgtggaagacaatttttccattgacagggataggggtggatggtttcaggatgaaactgttccacctcagat

SEQ ID NO: 56607 - DNA, 601 bp, Human
tatcttttaacattttctggtttctgtggagtcacattttattaatgctggttgacatttatctacctagaaaaaaatgacagaaatttcaggaacaaaggtgactatgaattaggtaccaatatttttgtggatgatcttcatgaagtcagccaataatggagatgagtatgtggaaaggatggattatttggactttttgaaaagaagttattgggtgaacatgatggctcatgcctgtaatctcaacagtttgggaggttgaggtgggaggatcacttgaggccaggagtttgagatmaacttgggcaacagagcaagatccatctttacaataattaaaaaaaaaatagaaattagctgtatgtgatggcttgcacctgtagttctagctactcaggatgctcaggcaagaggatcacttgagcctaggaggcagaggcttcagtgtgccatgatcatgccactgcactccagcctgggcaacaagagtgagaccctgtcttaaaaaaattaaacaaattaaaaagaaatgaagttattgagtgacagttaaagaaactgatttgcaagtggccttcaggaggcagaagaaggctac

SEQ ID NO: 56608 - DNA, 601 bp, Human
ttataattgcaatttttactgtactattatctttttttaacagaaaagaaaacttaatagtcaatacatactctaataatcaaatattataaaaatcttcctaatttactttcttttttaattttttgtttctttcaatgcaattctaaggccaaccaggtccgcaaggtagcactagatctatgctggtttcataaaacattgtagatgccattcagtagagtgattaagaggatagactctggagccagattgctttggttcaaatcatagctctgctacttgctagctgtaatcaggrgcgagttacttaacacctctctgccttcttaataaaatagagataatagtggtatgaagctcatgtggatgttttgtgtagcaaatcattgtaggaacagtgtctgacaatagtgcttggcacattgcaaacattcaacgatgctggctattatgattataattattattattatatgcagatgatacagacaaacatttatgagtccaatatttataatctaattattcgtttattttacaaatacattgagtgcctactctgtccctactatgtgccaagctttgaggataaggcaga

SEQ ID NO: 56609 - DNA, 601 bp, Human; identical to SEQ ID NO: 18818

SEQ ID NO: 56610 - DNA, 601 bp, Human; identical to SEQ ID NO: 18819

SEQ ID NO: 56611 - DNA, 601 bp, Human; identical to SEQ ID NO: 18820

SEQ ID NO: 56612 - DNA, 601 bp, Human; identical to SEQ ID NO: 18821

SEQ ID NO: 56613 - DNA, 601 bp, Human; identical to SEQ ID NO: 18822

SEQ ID NO: 56614 - DNA, 601 bp, Human; identical to SEQ ID NO: 18823

SEQ ID NO: 56615 - DNA, 601 bp, Human; identical to SEQ ID NO: 18824

SEQ ID NO: 56616 - DNA, 601 bp, Human; identical to SEQ ID NO: 18825

SEQ ID NO: 56617 - DNA, 601 bp, Human; identical to SEQ ID NO: 18826

SEQ ID NO: 56618 - DNA, 601 bp, Human; identical to SEQ ID NO: 18827

SEQ ID NO: 56619 - DNA, 601 bp, Human; identical to SEQ ID NO: 18828

SEQ ID NO: 56620 - DNA, 601 bp, Human; identical to SEQ ID NO: 18829

SEQ ID NO: 56621 - DNA, 601 bp, Human; identical to SEQ ID NO: 18830

SEQ ID NO: 56622 - DNA, 601 bp, Human; identical to SEQ ID NO: 18831

SEQ ID NO: 56623 - DNA, 601 bp, Human; identical to SEQ ID NO: 18832

SEQ ID NO: 56624 - DNA, 601 bp, Human; identical to SEQ ID NO: 18833

SEQ ID NO: 56625 - DNA, 601 bp, Human; identical to SEQ ID NO: 18834

SEQ ID NO: 56626 - DNA, 601 bp, Human; identical to SEQ ID NO: 18835

SEQ ID NO: 56627 - DNA, 601 bp, Human; identical to SEQ ID NO: 18836

SEQ ID NO: 56628 - DNA, 601 bp, Human; identical to SEQ ID NO: 18837

SEQ ID NO: 56629 - DNA, 601 bp, Human; identical to SEQ ID NO: 18838

SEQ ID NO: 56630 - DNA, 601 bp, Human
gctttcaagttaaacttgggtgactaaatgaagtaacaagctttgtagttatacaaaattgatgccggaagttgttcaagtttgtcttgcataggcctgggtgccttctatgcttaatctctttcttccttctcttcacaatattcaggtcaggctgaagttattaatcaggaatcgccagcacctcaaattatttaggcttgcaattaggatggaaagtggacaaatgccacattccatcctatttgtatgcctaaataatgtgcaggggtgatggtcaggatagttaatgacagacacyatacactgtaaaggtcatggtttttataagttatcactgtgtggggaagcccccagccagtgggccagatcagcacaagacattttcctaatggatgccatttgccaccagcatgagtacaatctccctcctccagtgtctaggttcattttggtgagggctgcatatattcaagagccacagaaagctggctggagcaaacaagctggtggattgcacggtagacctgccttccacccatatgggcctcctcgggatatgaggaactggtggcggcaggggctcagtgctgcagcttat

SEQ ID NO: 56631 - DNA, 601 bp, Human
gatggaaagtggacaaatgccacattccatcctatttgtatgcctaaataatgtgcaggggtgatggtcaggatagttaatgacagacaccatacactgtaaaggtcatggtttttataagttatcactgtgtggggaagcccccagccagtgggccagatcagcacaagacattttcctaatggatgccatttgccaccagcatgagtacaatctccctcctccagtgtctaggttcattttggtgagggctgcatatattcaagagccacagaaagctggctggagcaaacaagctggyggattgcacggtagacctgccttccacccatatgggcctcctcgggatatgaggaactggtggcggcaggggctcagtgctgcagcttatatcaccaaatggcatggacttatttctaccctcactaatatacagcagctgaatgtcagtcctgagttaataatatttctcaggaagtctcagagcactatcagagaatggcagggcaagctaccacactgatcaatcatgctttaggaaaattaatcctgtgcatgaatcccctggggatcttagcctcaaaatggactgcataccact

SEQ ID NO: 56632 - DNA, 601 bp, Human
ggtgggagatggttgaatcatgggagtgttttcccccatgctgttgtcgtggtagtgaaaagtctcatgagatctggtagttttatcaggggtttccgcttttgcattttcctcattctctccttgcctgctgccatccatgtaagacaggactcctccttaccttccaccatgattgtgaggcttccccagccacatggaactataagtccaattaaacctctttcttttgtaaattgcccagtctcaggtatgtctttttttttttttttttttttctttttttttttttttgagacgsagtctcgctctgtcgcccaggctggagtgcagtggcgggatctcggctcactgcaagctccgcctcccaggttcatgccattctcctgcctcagcctcccaagtagctgggactacaggcgcccgccactacgcccggctaattttttgtatttttagtagagacggggtttcaccgttttagccgggatggtactcgatctcctgacctcgtgatccgcccgcctcggcctcccaaagtgctgggattacaggcgtgagccaccgcacccggcctcaggtatgtctttatcagcagtgt

SEQ ID NO: 56633 - DNA, 601 bp, Human
agatctggtagttttatcaggggtttccgcttttgcattttcctcattctctccttgcctgctgccatccatgtaagacaggactcctccttaccttccaccatgattgtgaggcttccccagccacatggaactataagtccaattaaacctctttcttttgtaaattgcccagtctcaggtatgtctttttttttttttttttttttctttttttttttttttgagacgcagtctcgctctgtcgcccaggctggagtgcagtggcgggatctcggctcactgcaagctccgcctcccrggttcatgccattctcctgcctcagcctcccaagtagctgggactacaggcgcccgccactacgcccggctaattttttgtatttttagtagagacggggtttcaccgttttagccgggatggtactcgatctcctgacctcgtgatccgcccgcctcggcctcccaaagtgctgggattacaggcgtgagccaccgcacccggcctcaggtatgtctttatcagcagtgtaaaaacagactaatacagagatgaaagactggtacactgaaaactgtaaaacagtgatgaaataaattg

SEQ ID NO: 56634 - DNA, 601 bp, Human
gtgctgaatagctaaagcaatcttgagcaaaaagaacaaagctggaagcatcacactatctgactttaaaatatactacaaagctgtagtaatcaaaacagtatgctgctaacttaaaaacagatacgtagaccaacagaatagaataggagcccagaaataaatctaagcatttatggtcaattgatttttgacaaagatgccaagaacacacaatgggattgaactgtctgtccagtgaagggtgtttggagcagtagatgtccacatgcagaagaatgagtatagacccttatctcaygccatataaaaaatccattcaaattctaaatgaattaaagactgaaactgtaaaactactgaaagaaaacacaggggaaaagttccatgacattggtctgggcaatgattttttaaagatataaaccccaaagcacaggaaacacaataaaacatagacaaatgagattacattaaactgaaacacatctggataaccagggaaacaatcaacatggctgctcttcaaatcactgaatttattttgttggtactatttgggtcactgctaaattggtgaataccaaactaacacagaaga

SEQ ID NO: 56635 - DNA, 601 bp, Human
taaagatataaaccccaaagcacaggaaacacaataaaacatagacaaatgagattacattaaactgaaacacatctggataaccagggaaacaatcaacatggctgctcttcaaatcactgaatttattttgttggtactatttgggtcactgctaaattggtgaataccaaactaacacagaagagattataatatacatgttccaaatgtagattataccttacctgagtataccttgtttaagtacaacagaatatagttaaaatcacagttctttacctgctttagttgtatataratttttaagatcatttgttcagtatcacaagtagaatctgtggttaattagaaaatatattttccctttaaaagaatttgtgctgacttttaaaattattaataaaggtgacagctagctttggtgtctatattgaagaaaatgttcatcctaattggtttccgtttgtctaccctttggtctgctttcaacacagcagtcacagcaatctcattagtacagatcacataacactttccactaaaagtggaaatcttattagtacagatcacacaacactttccactaaaagtctctact

SEQ ID NO: 56636 - DNA, 601 bp, Human
attttaactcttcttttgtaacagagaagtctgggactgtcattttttgttttttgcttgacattgtattttttcctcatagaacaaaagttagtataaaagaaagggaaaaaaggccatacaatgatgctgtttaaacaagagtgtaaatgtaggatatgtattttgatctaaaatgttgataaaccaaattctagcaatatcatgaaaatgtaaacattttggagacccagatcctatttcaaatagagtcaagatgactgccctagaaaatgcttcttgaagtcatggaataaattakatgattgtttatttaaaaaaaaagaacaataatacataggagatctgttaaaaaatctgtgaggaaagagctgttaaaatgttgaaaccacatgaattctgttatggaaagtctgaacaagactttctaaaatagattgaatgtgggcagttttcacagctgcctgatgacttccacacacaaaacatccacatttcatccttttggtgaatactgtgtattttccaattttattcttagagtttaattttttacttacatattatgcttatgtatatcatatttgttatatatattata

SEQ ID NO: 56637 - DNA, 601 bp, Human
aatgtaaacattttggagacccagatcctatttcaaatagagtcaagatgactgccctagaaaatgcttcttgaagtcatggaataaattagatgattgtttatttaaaaaaaaagaacaataatacataggagatctgttaaaaaatctgtgaggaaagagctgttaaaatgttgaaaccacatgaattctgttatggaaagtctgaacaagactttctaaaatagattgaatgtgggcagttttcacagctgcctgatgacttccacacacaaaacatccacatttcatccttttggtgaatactgtgtattttccaattttattcttagagtttaattttttacttacatattatgcttatgtatatcatatttgttatatatattatatataactaatatacaattatattatttatttaaaaataaggaattaaaaacaattatattatttgtttttaaataaggaattacaaaataatgaagagaccgtatttattatagatcttgaaactgtgactaaaaaccccatgcacagagaaaattcttgagtcaaatggcttcattgatgaatagaagttagaatactggttattgtt

SEQ ID NO: 56638 - DNA, 601 bp, Human
atcgtgaaattgttatattgtattgaatcctgctcttatatgtcttgttttttacttctcgttattttttattttagtttactacattttcttagcttcttgaaatcgatacctatgttattaatatttcagttcttttttcctaatatatttattaacgcctacaatttgcctctacatagggctttagttgcctcctacaagtttgatatattgtatttttcattatcatttattttaaaatatattctaattttcatagtaaatttttctgtggcctctgagttatatagaagtgaartgcttaatttctgaacaattgagtatttttctaatcgttttgtttttgttgttattcctttcctcactaattccactatggtcagtgtattttcaattctttgagactaaactttttgagacttgtttttatccaacatatggcagtgacttgaaaacaatgtggaccagttgccctggctcactcctgtaatcccagcactttgggaggccaaggcaggcggatggcttgagcccagaagttcaagaccagtgtgggcaacgtggtgaaacctcatctctaccaaacaaaacaaaacaa

SEQ ID NO: 56639 - DNA, 601 bp, Human
cttctgtgaagtcttttattactcatactaattaccataaatatggtaacttgcgtccttcatttatcagaactttgtaatattttacctcagtcccacctccccatcagatttaattctatagttctcatatgtttaattctatgtatatattaaactccataggaagtaattgttaccatcataaacatgcagttttcatctaattttaaacacctttaacttttttgtttattttttgttagtatactttgtttatttatttatttctgttagtaaacttccatcaagaaagtatccyatttcttttctgccttttttaaatgaaagcctgctagtgataaatctctcatcttttgtttgttttttcacttttctttacttttgagacttattttccaccaagtataaagtagaatttcttgcctggttggaattttgttttgttttgtttttttccagcactctaaatatatcctatcattattacttgtttttcattatttctatcatgaagtaagcggaaagtcttattgttggttcttggaaacaagatcatttttcctttcactccattgaaggctattttttttaattttgc

SEQ ID NO: 56640 - DNA, 601 bp, Human
catcccattactgggtgtatacccaaaggattataaatcatgctgctataaagacacatgcacacatatgtttattgtggcactattcacaatagcaaagacttggaaccaacccaaatgtccatcaatgatagactggtttaagaaaatgtggcacatatataccatggaatactatgtagccataaaaaatgaagagttcatgtcctttgtagggatatggatgaagctggaaaccatcattctcagcaaactatagcaaggacaggaaaccaaacaccgcatgttctcactcataggwgggaaacgaacaatgagaacacttggacacagggtgggtaacatcacacaccggggcctgttgtggggtggggtgagggggggagggatagcattaggagatacacctaatgtaaatgacgagttaatggatgcagcacaccaacatggcacatgtatacatatgtaacaaacctgcacattgtgcacatgtatcctataacttaaagcataacaataaaaaaagaaacttaaaaaaaatgaaatgtccgtatattttcttgattttttccaaatgttttgaagaaagtttttgtattat

SEQ ID NO: 56641 - DNA, 601 bp, Human
agggatatggatgaagctggaaaccatcattctcagcaaactatagcaaggacaggaaaccaaacaccgcatgttctcactcataggagggaaacgaacaatgagaacacttggacacagggtgggtaacatcacacaccggggcctgttgtggggtggggtgagggggggagggatagcattaggagatacacctaatgtaaatgacgagttaatggatgcagcacaccaacatggcacatgtatacatatgtaacaaacctgcacattgtgcacatgtatcctataacttaaagcatamcaataaaaaaagaaacttaaaaaaaatgaaatgtccgtatattttcttgattttttccaaatgttttgaagaaagtttttgtattattaaatgctattcattggtcaatttaagtaatcttcttttaagaaatcattcagaaattgtaggtccttgatcgtaattctttttgggtaatttcaatttcaataggttaaacactgtgctggaagatttgagaaagattatcattggtccattttgtcaaaatcatttccagaagtttaagtccttttttcttcatttttagtgtgattcatt

SEQ ID NO: 56642 - DNA, 601 bp, Human
ggcctgttgtggggtggggtgagggggggagggatagcattaggagatacacctaatgtaaatgacgagttaatggatgcagcacaccaacatggcacatgtatacatatgtaacaaacctgcacattgtgcacatgtatcctataacttaaagcataacaataaaaaaagaaacttaaaaaaaatgaaatgtccgtatattttcttgattttttccaaatgttttgaagaaagtttttgtattattaaatgctattcattggtcaatttaagtaatcttcttttaagaaatcattcagarattgtaggtccttgatcgtaattctttttgggtaatttcaatttcaataggttaaacactgtgctggaagatttgagaaagattatcattggtccattttgtcaaaatcatttccagaagtttaagtccttttttcttcatttttagtgtgattcattgattttcctaaggaagaacatttaacttctctcagtattcacaaggaatacctgcttgaatgtttaagtaccaacagaggatttaaagttcttattacttatgagcattaaatgaattcaatactccaaattttatagaaga

SEQ ID NO: 56643 - DNA, 601 bp, Human
gtttcaaagtagatgtaggttctcttgccaagttgatactcgtgttctttccttttcaagattacataaaaagtatagcttagatccaacgtatcaacctggaataggtgaaaatatcactattgattataactagtatttaacgaggcttaatatggaccaaacactgatctaggtatttcacatgtattatgttttgtaatcctcacaactttatgaaggaagtatatgtgtgagaaaagatacacacgattagattttgagagccagtgcaaactgcaccgcaggtgtattgcctgtkcaaatttttctttaccactctatattaacacctaagttaaaggccggcacaataaacaatgtgttgcttgataatatttgtaaaacaaatggattagtgaacaagttaatatgtcactctgtggtctttaaaatatatatggaaatgcagaatattaaaatctgcaatacatattttgaaaaacaaaggtgagagtaatgctagccaaagcaggtttgactgcaggcacaactgtccttcccactcttcttaattgaagagtcacctcaatccccatttgaatgttctcttttcaacctc

SEQ ID NO: 56644 - DNA, 601 bp, Human
caagattacataaaaagtatagcttagatccaacgtatcaacctggaataggtgaaaatatcactattgattataactagtatttaacgaggcttaatatggaccaaacactgatctaggtatttcacatgtattatgttttgtaatcctcacaactttatgaaggaagtatatgtgtgagaaaagatacacacgattagattttgagagccagtgcaaactgcaccgcaggtgtattgcctgttcaaatttttctttaccactctatattaacacctaagttaaaggccggcacaataarcaatgtgttgcttgataatatttgtaaaacaaatggattagtgaacaagttaatatgtcactctgtggtctttaaaatatatatggaaatgcagaatattaaaatctgcaatacatattttgaaaaacaaaggtgagagtaatgctagccaaagcaggtttgactgcaggcacaactgtccttcccactcttcttaattgaagagtcacctcaatccccatttgaatgttctcttttcaacctcctaaaaagattactgagaatgtagatatttaaatgtattctgttcatctttaaata

SEQ ID NO: 56645 - DNA, 601 bp, Human
ttcctaaagatatgttgttttctaagatttgcttctagattttgtgattaaatgttttattggacagggatttaagaatcagaatttcatgacattttgtcctactttaaatggaaatgtctatagacttttctagtgaaggcttttacaaatgttaagggatgattgaatgctcacagcaggacacatggcattacagaaagtctccaaaattattcatccttttggggacaactataaccatgattttttgtgacactcataacctgttgaattggaaaaatattaatgttagaaatcygttctcatgtcacttttaaaattcttctccttttttgcctcctgtagcatgagtcctagtttgattaaactagacacttgattttctccaatggtaacatgtttttaaaaaaggacttttactctgttggaaccaattaggccaatgtgaggaactttggaaggaccatgagcagccaaacttgctaacagcaaaacatatttttctgaaggcagcatgaaaaggacggaggagttctctaaggactgtgagttccacgggtccttttgagcttcagaaatccagctctcagcacttcat

SEQ ID NO: 56646 - DNA, 601 bp, Human
ttagggacattgaaaataagtcttgctatttttcagagctagactttgagatttgcttttttgcagagtgagatagagaagtccttcaaatactgtcccttgaagagttaggcattgatttaaacccttttgaaaaacaatttcaacaaataattgaaaatgttctcttcaaagtattatcattagtcatccagttagattattattattaggaattctgaggtggtggaataattcattttccaatgtgttaacttctcatgagtttaatgtgagtataaaaagtctgttttaactgagrgcagagtattcctttttctcttataatacaggagccagttacaacacaggaggtgaaatggcctgtttgcttacctgcaacttcaggaatttcatgcttagcaattaattgcagtacacacttgtgggggtaggggtaggaggttggataagtgggttgcacttaataattcagtgacaattacaaatcgtttcactatatgtgaaagtatttgaagtaaatttacctgaagatagaaaatatgggtgggcaagctcctcctgaactccccaccacattattctaggtttattgaagtaa

SEQ ID NO: 56647 - DNA, 601 bp, Human
ctgtataagtatctcttcagggaatttttaagatgagagtgaacaattttctgagattgcctacacatttttgttacacagtaagagccaggttctatgtggcttaggtggggatggggctttgagtgaatcctctgttgtacacagacttaatacattctccatttcagcccacttttcacctctgttttcatcagacctacctcggtgaggttctagacttctgccctgctgcagctactcagtactttaggccatgacctccgctctccttcctcagcaactcaccacagaccttccrgaaaaatgttaaacccttctcatccttttcttgttattggtttctattttctttctttcttttttctttagcgtcacaggggaagagctgataattgtattggctatatgtatcaactcaaacagagagacattacctgcagttctataaagattcccagattattccaatgggtattaagcttgaaaacatgatgtctatgatcctttctggttctgatattgtataactctcatcacttaatgaaagccaccgttcctatttggataaataagagaattgaaaaacgcactattagaa

SEQ ID NO: 56648 - DNA, 601 bp, Human
ttttctcagctcacagagacctaataggacaaatactccaggaacgtatgccttagttcctgcagatgacaatatatgctaactgggattcaagctctaacaaacaggcaagaccaatgtcaaactaataaccataacgtggaagcacattacagtgattttggctatccaactaaatgtaataaatatcaaatgcccaccatttcagaagaattataataaggaatatagcatctttaacccatttctcatttgcctgaagaatacttgcagacagcatttgtggcttaatgtttacccygagataacttgtggcttactgtcctaaccttatccccaaagtttgccatgaaatatctcacttttattattatttttgcataggtctagcatattgactttggaaacaaaagacatcattctatttgtagcattctgtgtttgatagtagtatttccatatacaaaatatagtaattattgattgctgaaatcaaatcctagaaaatacagcattcctatataaaaaattattaaattctgatcatcatatacatttctgttacattaggattagagataagttttatttagaaataact

SEQ ID NO: 56649 - DNA, 601 bp, Human
ctgctcagtctctcagccatgtgtctggacaggaaaatgctcacaggacaaaagctgtcacaacgtaccaatcacctgtctagacatctcttttgtccttgatgttgagaaggttatcttcactctcttgatagctctcacatggctttaaacatatgtttttgtatatttatccagtttgtctagttgttgtcattgagagtgttgactcttactgtataatctaccataaatagaagcgaagttgcacatgcatttaattttttttattttggaattatgttaagtttacacacatgtrtgaagattatagagaatcctcacattccctcatccagctatccctaggaataatatcttaaataatgacaatgcacatgttaaaactaagaagttagcattgatacattattgttatctaaaccacagaccttattcaggtttcattcattttaccaatttcattttttctcttctgggatccaattcaggtactattttgcatttagtcactgatctgtgacagttttaagagatattttaagaaatattttaagagatatttagagatattttatagactattattcagtttgggttt

SEQ ID NO: 56650 - DNA, 601 bp, Human
cacagctagtaatttttggagctgtgatttgaattcagtgtattctcagagcaccagaaaggtacaaagctaaaagtttccttctgtgtctggggtttcctggaaaatctgctctgccctataagctcaggagtcccccctcctagcagttcctgctgaagctctatgtgagattgcacagacctgagtttgagctgctgcttattttttattttggggttttagtattttcatgttttaggttaaaaaaattctttaccttttagctttgatgaattacttcatttttatatctaataggtttttttaaccttcactttaattgatttcttaacctctttatcttgctcattttttaatctttttaatgattttaaaatgctgattttaataattttatcttggcatatttatatttatcagtttttctgcttcaagctttattctggcaaatgatgtatatttatatttcttttgtgttgttttttaaatattttttatttttgtttctggaatttaatgtatgtcagttgtgcaatagacttgttagaattttgtttgctttaataatttttaaagtgactttttgcattacttttga

SEQ ID NO: 56651 - DNA, 601 bp, Human
tcagtgtattctcagagcaccagaaaggtacaaagctaaaagtttccttctgtgtctggggtttcctggaaaatctgctctgccctataagctcaggagtcccccctcctagcagttcctgctgaagctctatgtgagattgcacagacctgagtttgagctgctgcttattttttattttggggttttagtattttcatgttttaggttaaaaaaattctttaccttttagctttgatgaattacttcatttttatatctaataggtttttttaaccttcactttaattgatttcttaamctctttatcttgctcattttttaatctttttaatgattttaaaatgctgattttaataattttatcttggcatatttatatttatcagtttttctgcttcaagctttattctggcaaatgatgtatatttatatttcttttgtgttgttttttaaatattttttatttttgtttctggaatttaatgtatgtcagttgtgcaatagacttgttagaattttgtttgctttaataatttttaaagtgactttttgcattacttttgatcattttactcttagcttattttgagcttttgat

SEQ ID NO: 56652 - DNA, 601 bp, Human
tcccattgatacgattataactcacacaattccctaaaggaaaactacaaaaaggatgtttcttgagataggaatacaaataaacttttgcttgtttgtttgttttgttttaaatccagtgataagaatgaatgttttctgtatttgctttttttaaaaaaactctatattttatgtgcagacatttaacataaaatcttttcccaatgtctttcttagatgattaggtagttgaaagacgctactgtttacgaggcattgctaaaagcttttgggttccatgagggagagggccatgacmtactcctttgtacatttccccactcctccgtttacatcacataaacatatatgtatggtcttccatgcagtcagccaaatcagacaaatcatgcctaggagttgaaagtgggaactgatttgtctagtttgaatattctgattagtgaactagctagcttagaattttgtggtatttgcatatgtcattcatttatgtactacagctacacctaaatcccagaaaaatcggtaacaaaataacctattattctagatttaaattttaaaatccacataagaatattaataacacaaatta

SEQ ID NO: 56653 - DNA, 601 bp, Human
cctaaattccttaggaaacacaaaccatgtttaatctgaagtcctgccagtctgttttctctcctaccagcttttcccatggcagaaatggttgagatctgtacagaaggaggactttagtctggtaacaggtggtgttgctgagtgcaagggcctttgaaatcaggcctggtttggaatcttggtccagcaatcaatagctgtgtaatcttaggtaactctttgaagtttagtttccgcatctaagaatgaggaagtataaatacatatctgcccacgttggttgtattaaatgagatamtttacataacacatccgactaaggtgcagatgtaataaatgacagctgttattatcatttatttcagcacgttgcagaaagcaacttacaatttcttcttttcctgacctcctagggcttttatgcatgcaattagcaatttgggatttgcacaaggtttttccagagtacaagatttttgagagctgtgactgaatcttattctttagaaacttgctctttgagtggaggaaaaggaagaaactaagttgactaatgacattataaaagcaggtagagaatcatttctttctgagcttc

SEQ ID NO: 56654 - DNA, 601 bp, Human
ttctaaatatttttgggatatgtatagaaccaagatgatttgtgtgaagggtttttccattcacttagttgtattatattttaatataattgtttaaaaaagattcatgttatagtcacagattaaaaggcagtttttaaaggagatgaattaacagtttcagagaaacaattttaataacatgcattttatacatttatttattctgaaaacagtaattttcaatatactattttcttataaccactttaaagaaattaaggacttgcaggttgtctggttttttactatttttcttatscatagcaaggttggtgctcaataatactagatgagcaactgaatgaagagatgacaaaaataaatgaatttattaccactgcatgttaaagaagtgtacttttttatgcttgtctttgagaaaagtgtcaaggtggcatacatgacaaaacacaactttaaaatgacaacaaaaaattaaaatttcactgaacaaaataaaataaaagaaaaatgcatactagctgctcatctgggatgagttagttattgcaattcaacttgtaatttaatgcagaattttcagacaattagggccaaa

SEQ ID NO: 56655 - DNA, 601 bp, Human
tccattcacttagttgtattatattttaatataattgtttaaaaaagattcatgttatagtcacagattaaaaggcagtttttaaaggagatgaattaacagtttcagagaaacaattttaataacatgcattttatacatttatttattctgaaaacagtaattttcaatatactattttcttataaccactttaaagaaattaaggacttgcaggttgtctggttttttactatttttcttatccatagcaaggttggtgctcaataatactagatgagcaactgaatgaagagatgayaaaaataaatgaatttattaccactgcatgttaaagaagtgtacttttttatgcttgtctttgagaaaagtgtcaaggtggcatacatgacaaaacacaactttaaaatgacaacaaaaaattaaaatttcactgaacaaaataaaataaaagaaaaatgcatactagctgctcatctgggatgagttagttattgcaattcaacttgtaatttaatgcagaattttcagacaattagggccaaaaaagaaaatgttaaattagctagtgtctgacaaagaagaaagctttcaaactttc

SEQ ID NO: 56656 - DNA, 601 bp, Human
ccttctagcctttatttaaaaaatagcttctgaattgcaaggatatttttaagccacatgaatcagtatgccccttcagctggacttttcaaggagcctgtgaatgctgaaatgattaacattatgtgaagctaaattgcactgaaccgtggaaccatgtggtgtggcaatagtgggtggggagacatattagtctagaggtccctgctgagcaaaagacaaagacctccttctccattgtcccgcactgatggtgggcttgggatgtattttcagaaataattatttgcagggaacttayaaaaacaaatgaatcaccctcatcactgtgcttgttccgttttgggatgtttgtctactagactttctaaattgggagatttagaaattcagtaagaaagatatttaaaaaaattttttgaggtcctcagtgtcttctgcaagtacactttcaatttttattacagacagactctcttgatgctgttgtttaccattgcatttttatttaacttgaatattttaatttagcatgagtcattcccatggattagcaactttgtatgctagcatatctagttgtatcttctgtgtgttttca

SEQ ID NO: 56657 - DNA, 601 bp, Human
agcaggaagttctggaagatgatgctaacaaatacctcaaatctggaaattgtaggctttagaaaaataaagtcatcttgttagtgaatctctatattagactttctaataccttataaacaggttttcagaaattaattatatttatagcctcgagaaactagggaaaaagctggatctcaaagacattattacaaagcagtagtaaattataaacaatatattttgaattcataattaaaattaacgagtcaattttctgaggcattgacctattaaagatttatgagttacctaaaaycccaaatcttccctgaggtaatagcttcagttgagataaagggaaggtatcttatttgtcgcttcactgcaggaaaaaataaaatttgtgattatgactcattatcatgatgcctattgcaaaattacagctcactcttaaaattatgtgaaaaaagatcattaaatgttttagacatttcttaaaacttataagcaaaactttcaagttttttaaactgatttactggttgtatatgtagctaattgactatgaaaacttgaagcttaactctttgtagaccttccatcataccattgc

SEQ ID NO: 56658 - DNA, 601 bp, Human
aaaattacagctcactcttaaaattatgtgaaaaaagatcattaaatgttttagacatttcttaaaacttataagcaaaactttcaagttttttaaactgatttactggttgtatatgtagctaattgactatgaaaacttgaagcttaactctttgtagaccttccatcataccattgctttataaattattaccagaatattgaaggaaataaacttttttctaaccatatttatgcaatcaatatttattaggtagtttttgagaaaatcttatatgagaacttattccttgtatacmaaatgtttcatggaacaccaccagcatagacatttttgtttactctgtgcaactggatttcgttctggggagcttcaatttgtacatgagctcattttcacaaaccatcttaccgatacttagagtccaaagtgaaattcaggaactatggcccagcaagctttcatgtgctattctttgcttcatgactttggaaatctatgggagaccctgtatcactagacagaatactgaaaagcaggattacatatgaagtttaccatctgatttttttcctaagggtttttacatgaacgttta

SEQ ID NO: 56659 - DNA, 601 bp, Human
gttgttcacaactgagctcattcccactgtgttgatatactccggttcccccacatagctccaccccgctaactcccaacctcatgcatagctccaccacactattgggcttgaatctaggctctgccactttctagctggttcctgagcaagttctttaacctctctgagcctgtttcctcatccacaaaaaggatgaagaacaaaaaggacgaggcaataccttcttaacactgataattaaataagataagcttaaattataaaatcagcacagagggaatgtaaattggttcaaccrttatggaaggaaaaaagtaggaaggttcctcaaaaaattcaaaatgggactgcgaggccgggtgtggtggctcaagcctgtaatctcagcactttgggaggctgaggcaggcagagcattttgaggtcaggagttcgagagcagcctggccaacatggtgaaaccctgtctctactaaaaaacatccaaaaattagccaggcatagtggtgcacgtctgtaatcccagctacttgggaggctgaggcagaagaattgtgtgaaccgggcaggcagaggttgcagtgaactgagatggtgc

SEQ ID NO: 56660 - DNA, 601 bp, Human
taccccataaatttacataattagaaattgtcaatttacaataaaaaataaaaagccatcaaaaaacgccaggcaaaaatatgtgatatacttatacccatatttaaacctacaccataaattatatttaaatttataattctgcctgctgctgttttcagtaattaatatcattaagaaagcacaggttaaatcaaatttcaacacagtatcatttcagtataaaatctcatattttgaataaaacaaacatatctttacacattattaaatgaactacgctgacaaattttgtttcttyttttgagaaccagaaaaacaattatacttagatgggccatctaaaatgtccttccagcttgtggagtaggttgtgtttgtttttcaatgaacatctgtttgacaaattgaaatgctaattatgatttatcatttccatgacatcaaatatccagatagtaataaacgttgatgactaactatatttttcagtttcagccagatgtttggcatcacgtaagataccaccttagttttacataaaaataaaatgtttcttgagtctggcttatcataatggggaggaaactaatatgaatga

SEQ ID NO: 56661 - DNA, 601 bp, Human
aaattatatttaaatttataattctgcctgctgctgttttcagtaattaatatcattaagaaagcacaggttaaatcaaatttcaacacagtatcatttcagtataaaatctcatattttgaataaaacaaacatatctttacacattattaaatgaactacgctgacaaattttgtttctttttttgagaaccagaaaaacaattatacttagatgggccatctaaaatgtccttccagcttgtggagtaggttgtgtttgtttttcaatgaacatctgtttgacaaattgaaatgctarttatgatttatcatttccatgacatcaaatatccagatagtaataaacgttgatgactaactatatttttcagtttcagccagatgtttggcatcacgtaagataccaccttagttttacataaaaataaaatgtttcttgagtctggcttatcataatggggaggaaactaatatgaatgaagcagaatggttcattttttttctcaatgtgtacaattctactggtaagacttttacaatatcataaataaaattgtactttaaaataagtgtctttcaaacttttacaaatacaaag

SEQ ID NO: 56662 - DNA, 601 bp, Human
atttcaacacagtatcatttcagtataaaatctcatattttgaataaaacaaacatatctttacacattattaaatgaactacgctgacaaattttgtttctttttttgagaaccagaaaaacaattatacttagatgggccatctaaaatgtccttccagcttgtggagtaggttgtgtttgtttttcaatgaacatctgtttgacaaattgaaatgctaattatgatttatcatttccatgacatcaaatatccagatagtaataaacgttgatgactaactatatttttcagtttcasccagatgtttggcatcacgtaagataccaccttagttttacataaaaataaaatgtttcttgagtctggcttatcataatggggaggaaactaatatgaatgaagcagaatggttcattttttttctcaatgtgtacaattctactggtaagacttttacaatatcataaataaaattgtactttaaaataagtgtctttcaaacttttacaaatacaaagaaagccagaatcaaaacccaattttgaatatcaagtgttaaatatgaatatcagaaactgaatatatcatcaatacaaa

SEQ ID NO: 56663 - DNA, 601 bp, Human
attagaaaagcatatacatacaaacatccttacagttgtacacatagactcaggtttataaacccactgaagtgaagactcatcatttatgaaaatatacaattttgttctgcaaaataatttaattttttaaaattccttgtgcaatgagaaaagatcagagaggcctacagtttccttttacagagctaggccaggggctgtatttagagtaattgaacacatgattttacttgaatgcggagaaacttgaccaactgtgaatatgcaatttcactctacagatgaaataaaattaaayggggcaaaagtaaagaagaatggagactaggtaaagtgatggaaagagacaccaaaaaattagtcatgtgaaagcaaaactaagaggagagggaaaggtggcaaaagaagggaacattcagagaatgttgatatattgagaggtgagaatagggagttggtaggcaagtgtcagagtgtgggaggatggtgacagtcactaggaactccagtttgcatacacacaatgttaagaacattagaaattagctagccaatggaatgctcagtcttgaagagcttgtgtctctgcttaaactcc

SEQ ID NO: 56664 - DNA, 601 bp, Human
gaatacatgactaatgattttatcctcttatgatatctctggttggggcacacccaaaacaaaatttggagcaatgcaaatgttcgaggagagtgagagaacttccttctggtgtttttctctaatgacttgctctgaagctactcctcttagattctttcctagctgtgtattcctatatagtcttagcttaacagcacaaagatttaacagtggtgtctgcatttgataaaatgtaaatgagaagctcccaaaagagattgagaagctctattttgacaactcttcttttatctgtgtwattattatatactttaactgaagaaagaaaaacacaaagataaatacaatatttcaacttcgagtactttttaaaaattatttgaaagcatttaaaaatagatgtaaaatgaactcctgtatgtcaaattcctttcagagaaaaaaaaaagtgagagggaagggggaaatttgcatttagtaattttttttgtttttttgaaaatttcaggcacttagtaatcactgttccttttgtacgtcatgcccaatgggaacgataccaggatctttcactcaattctgtggattacaggtcacc

SEQ ID NO: 56665 - DNA, 601 bp, Human
aattgacagaatacttcaaaaactgtgcctgatataattggaaataatgcctggaaacagattgagtccataatcctgtatgtgttcattaaggccaggaagattcttggtaaggaaatgtctagtctgaaaggtctaaagattttattaatctgtataataaattatatcttatgaaactcttgtcatttatccagtatatttgaattacccgtgcattactgtttcatatattcatggtactttcatattttataacatttaaaaatatttcaatattccattgatttgaataagattytttaaattacagtgaaagctttctgataaggtatggtaagattatttttcagtaattatgctgatacatataataaagctactgacaattcataaagatgataatacacttagtacaaactgagcttcaatgggattactaaatgagtatgtgaggacagagcagaggaaaaggccaagggttgagcactgtggtgctctattatgagaaagttaggaaggattaaagttggcactgaaggggattgagaaggagtagctgaagcggtagaaggaaaacaagaacagtgtgtcctggaag

SEQ ID NO: 56666 - DNA, 601 bp, Human
ttttattaatctgtataataaattatatcttatgaaactcttgtcatttatccagtatatttgaattacccgtgcattactgtttcatatattcatggtactttcatattttataacatttaaaaatatttcaatattccattgatttgaataagattctttaaattacagtgaaagctttctgataaggtatggtaagattatttttcagtaattatgctgatacatataataaagctactgacaattcataaagatgataatacacttagtacaaactgagcttcaatgggattactaratgagtatgtgaggacagagcagaggaaaaggccaagggttgagcactgtggtgctctattatgagaaagttaggaaggattaaagttggcactgaaggggattgagaaggagtagctgaagcggtagaaggaaaacaagaacagtgtgtcctggaagtcagtggagtaatcacttgtctcaaatgctgctaataggtcaaatatggtgagaactgagaactggacatttcatttagtaatgtgaaggacgttggtgactttcccaagagcagtttcagtggaatggaggaagaccaatg

SEQ ID NO: 56667 - DNA, 601 bp, Human
tccagtgggtgaccttgagtcacagctcctcagtgcacacactgtcctgtacccaagcatctcccagatagcacagaactcccacttcctgcatccctgtacctttagcactgtgtgcatgtttgtgtgtgtatgtgtgtgtgagtgtgagtgtgtatgtgtattttcagttcaaaatctaccactcaatttcactttctttaacaattttggtttggttcaatttgttgcataggtaataataatccatttacagaatacaaaaatagtgtaagtatgtgcttcttcctatctgtatgtygagagattcctcattcttttttatggttgcagataattcattatgcagatatacaatttatttaaccagtcccatattgatggatattaggttatttccagtcctttgatgtgaccaaaaaagattataataaaaaatgctgaaagaataatattgtctttgtcagtttgggcggccataagaaagttccatagactaggtgggttgtaaacaagagaaatttatttccccacagtactggaggctgaaaatctgagatcagggtgtccgcatggttatgctttggtgaggactgtttcg

SEQ ID NO: 56668 - DNA, 601 bp, Human
tacccaagcatctcccagatagcacagaactcccacttcctgcatccctgtacctttagcactgtgtgcatgtttgtgtgtgtatgtgtgtgtgagtgtgagtgtgtatgtgtattttcagttcaaaatctaccactcaatttcactttctttaacaattttggtttggttcaatttgttgcataggtaataataatccatttacagaatacaaaaatagtgtaagtatgtgcttcttcctatctgtatgttgagagattcctcattcttttttatggttgcagataattcattatgcagwtatacaatttatttaaccagtcccatattgatggatattaggttatttccagtcctttgatgtgaccaaaaaagattataataaaaaatgctgaaagaataatattgtctttgtcagtttgggcggccataagaaagttccatagactaggtgggttgtaaacaagagaaatttatttccccacagtactggaggctgaaaatctgagatcagggtgtccgcatggttatgctttggtgaggactgtttcggggcttgcagactgctgacttcttgtagcctcacatggttgaaagagag

SEQ ID NO: 56669 - DNA, 601 bp, Human; identical to SEQ ID NO: 18839

SEQ ID NO: 56670 - DNA, 601 bp, Human
atttttttatcctaaaaaccaaaattttaacttatagagctattacccatatcaagtaaatgtttgtgtgtggtgtgaataagtaaccagatttatatggttaacctgaagttctagcaccatttgttgaaaaatcaattgatcatattacatggatcaatttctagaacctcagttatctatttttcctagcatctatttttccctctgcgtgctaataccatactatcttcattgctttagtaagtctagaatttaggtaatataatgtaccaactttattttttattttcaagattgtctatagtaggggcttttttgtgtgtgtttctatacaattttagaatcaacttgtcaattacagaaaatattaggattattgcttagactctatatacaaatatggaaaatggagcttgaggagatgttggtcaaagaatataaaatttcagttagatagtaggaatacattgaagatatttattgtacagcatggtgactgtagttaataacaatgtatttactcttaaaaaatgctgagagtagattttaagtgttctcaccaaaaaaattgataattatgttaggtaatatgttaatt

SEQ ID NO: 56671 - DNA, 601 bp, Human
tagcaccatttgttgaaaaatcaattgatcatattacatggatcaatttctagaacctcagttatctatttttcctagcatctatttttccctctgcgtgctaataccatactatcttcattgctttagtaagtctagaatttaggtaatataatgtaccaactttattttttattttcaagattgtctatagtaggggcttttttgtgtgtgtttctatacaattttagaatcaacttgtcaattacagaaaatattaggattattgcttagactctatatacaaatatggaaaatggakcttgaggagatgttggtcaaagaatataaaatttcagttagatagtaggaatacattgaagatatttattgtacagcatggtgactgtagttaataacaatgtatttactcttaaaaaatgctgagagtagattttaagtgttctcaccaaaaaaattgataattatgttaggtaatatgttaattagcttgatataaccatttcacaatttgtatatatataatatatatatacaatgatattcaaaatatcatgtcacacatgataaatatatacaattttgtcaaaaaggaaattaa

SEQ ID NO: 56672 - DNA, 601 bp, Human
gaaggaaaaaaatttacattaaccatacctttcccattttccatactctgtggttctagcttatatatattgccctcctgcttgaaaaatttcctttaacattttttttttggtagtgcagagctgctggtgacaaattttctcaacttccctttatctgaaaatgtctttaatctactttcattattgaaggatattttccacatagttacagaggtgtgtgttttcttctttgtttagcactttaaagatgtggcaccattattttctggatttcattcatccttatgacaacatagccattatttgtttctttgttctatatatatatatctttaattcactagatgatttcaaaaatttttttatatctgccttttgacacttataccatgtatgataaaactttggcccgtagaccaaatctgactcatggcctatatttgtatgatctgtaagcaaaggatgtttttacatttgtaaaggtttgttaaaaggagaagtagaagaaggggagaatgaagagaactaggaggggggggaagaagaggaggaagaatgaagagagtctttatatggcttattttactatctggccctt

SEQ ID NO: 56673 - DNA, 601 bp, Human
gatctgtaagcaaaggatgtttttacatttgtaaaggtttgttaaaaggagaagtagaagaaggggagaatgaagagaactaggaggggggggaagaagaggaggaagaatgaagagagtctttatatggcttattttactatctggccctttacagaaaagttttccaacctcagagttaaataaactatgatgtgtctatgtttggctttcaagcttaccttgcttgattcacaaagcttctaggaactataaattgagattttattccacatttaggaaattttaggctattttttttatttttacttattttttttaggcttttgtttaaaacctgttttttgaccagtgtttttccttctctttctaggactccagctgcatgtgtgctagggcgttcattgtatctgaggcagtgctaagtaattttttttctttctccgttctttagattggatcatttccattcatctgtcattatactttggtctacatataatgtatctttaatttactagctgattttaaaatattctcattaggccgggcacagtggttcaccccaggaatcccagtactttggaaggccgaagcaggc

SEQ ID NO: 56674 - DNA, 601 bp, Human
aacccctgtgttttgtgtaatgctaagtataatgactaccataagataagtgctatttgagtcttagaagttttgtttatttggggttatcatttgcatttgggtatcaagttagaatttgcttcataaattgaattacatagctctccatttttatatgaccataagagtttcaagttttgaaaacagtctgtaaaaattaactagcattacagaaaaccaaacaccgcatgttcttactcgtaagtgggagttgaacaatgagaacacatgaacacagacaggggaacatcacatgccrgggcctgtcagtgggtgggggtctaggggaggaacagcattaggagaaatacctaatgtagatgacaggtcgatggctgcagcaaaccaccatggcacgtgcatacctatgtgacaaacctggatgttctgcacatgtattccagaacttaaagtataataataaaaaaaattaactatcattaaaacatgtttgtggtagttctttgataatttgtcctcttttgatacccttgattagctttgtttaccgtttccttttgcttgcttttctttttttcaaatctctttacttccctgt

SEQ ID NO: 56675 - DNA, 601 bp, Human
gctactttgcacctgtaatagtctggtggagcaggcttgttccgtgagccactagttttgcatttgttactgcttattcttctcaatgtagcatcatcagcattagcgtttgtggaaatttctccttggtcattgttttctatagccatagtttggtagatgctttgagatttcatctttcttgtttacatttttaatatttctattgacacttagaagatgctatgttcacgtaatcatagaaagcttttaattaaaccctctactctttggttttaacttttctttattgatatatatmaaaaatctatttttgtgtcaaaatagcattttaaaggttactgtcattaaaactttaacaactaaattatgtacttgttttagaaatgttgatatgtggctcatctttctttaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggtacattgtttattccagtaatgtc

SEQ ID NO: 56676 - DNA, 601 bp, Human
aaaatctgtgaaatttgaaatgtttaccatttctattaatagagttaattagtaccacaatttaggagggcaatatggtattatctagtatctttgaaggtgataaaaccctgtcaaccagcaattccacatccaaacatttaccccaaaaaactcttacaatgtatagagaaaaaccatctaaaatgtgctcaacgtaaatgtacttactatgatgaaaatgagaaaaataaatagcaaaaataaattgtagtgtttcctttaatctgataaaagaaacagttaaagtggttgaaatagwtcttcatgtataaaccatgataaatttcagaaacttcaggtggaaaaaacaatgtcattatggtattatttatatcaagttgtaaaacataaaacaatgctacattgtttgtgaatacatatattataattaaaaaatttaaatacacttgtagggtaagtactaatttcagaatagtagttacctctagagaaacaggaaagggaataaaacagaagtgaaatgagattcatttgtatctaagtatcattgctttaaaaatatatctgaggcaaatataaaatataaatattttgttac

SEQ ID NO: 56677 - DNA, 601 bp, Human
agttaaagtggttgaaatagatcttcatgtataaaccatgataaatttcagaaacttcaggtggaaaaaacaatgtcattatggtattatttatatcaagttgtaaaacataaaacaatgctacattgtttgtgaatacatatattataattaaaaaatttaaatacacttgtagggtaagtactaatttcagaatagtagttacctctagagaaacaggaaagggaataaaacagaagtgaaatgagattcatttgtatctaagtatcattgctttaaaaatatatctgaggcaaatatraaatataaatattttgttacctctaggttgcatgggtaatgcatgttatatgtgctttttgaatgtcttaatataatttctaatttaaaatttctttaattgaatgtaaaaaagaattccagatttaaaaagaggagaatgaaatttttaatacaatgtcaactacattattacattttacacataagattttctcttcaacaatgatgttaatgaatattatcatcattatatttcaaaatgtgaaagcagtgctagctcaagacactcaaatgtttataatatttttgcattgttaaa

SEQ ID NO: 56678 - DNA, 601 bp, Human
tctccaagtagaaactgtgctaagggaactaaagcaaaaaagaaaattcctacttcctttgctataatcctcttgagggcatttttatattccctgtgatatctcatatgtcttgtatatagtagttcagctatgagttgatgaacgaataatataaagaataaagcaacgataagaaataatgagcagagcatttattaataatttgatattgataacagaggaagttaaattattcaaagagctcaaccataaagcagatggcttcactttcaagctgggaatcaaaaaactttaagtsctagaatattcatgtcaagaggatcttccaagaataagccaggaatgcaattaggggctgactcatggatgacaatggtcgatgagtcacaaagaaattttgaaaaaacaatgatgtccctggggacacatagaaagaattggaactagactgtcaagatcatatatattaacaagctaatagaaggcgggaaattttggtctctatgaaaatgtgcacaaaagtcccagaacactatacttctgtgtttgaactgtgctactctaaattatataaaatatactctataatgtagtaaag

SEQ ID NO: 56679 - DNA, 601 bp, Human
aaatctgaaatgctctagtgaacattccatttgagcatcatataggtgcccccaaagtttcaaattttgaaacatttaagattttggattttctgattagggatgctcaacctgcacatttgtcttgaaaaataaataatgaataaacctccaacttttaaaatgaattcttgttcccaatgtctttgctaacatcggtctctcattctatctatgtccacaagttgaatttttaaaccatgcttcaaggatcaggtcaaactccactcctgtcataaagcttccttaagccttatagcaraaattagtgcttcctctatgttcccgtaattatttatttctcagatgcacttaccatattccaccttgcattatagttgattgtgagtatatctttttacccaactagatattggcctttaaagacagacttatttaaagacagaccttgacttatttatcttcatagtgcctagaattcctaccctaatgtgttgcttcaggttattaaataaaattgaatgtgaaattatttaatcatattttttcaaggtcattttactaggctaaaatggagctaaggaaaatgtagctaatgtct

SEQ ID NO: 56680 - DNA, 601 bp, Human; identical to SEQ ID NO: 18840

SEQ ID NO: 56681 - DNA, 601 bp, Human
gaaaatcccttcctaaattaatgttgtttaagcctagtttacacctaacaaaatatagcattatttatgaagaaatcataattgattaagcaaataaaagtatgtttatagtcagtggttttcttgcatgacatgtgagtattgaaatagaaaaacttagtatctcatatgctactcagtgaatgggaactggtggtgttggctggttgaaacacttttaacttatggccagtttcttatatttaacagaactctgaatgctattacaaaaaatgtgtaaatgtctaaaagacattttcartgaacatgtattttaagagacagagtatgttgcataaaattcaatagctgtaaaataaaaatcgaattaaacttttatttgcaaggccctttacagcaagaagtcattttatcctattctatttaggaaactctggtattcccaaaagaacaaaacagcacataagacttgaatttctactgcttaaaattgccaaaaaaatataaaaatatactgtcaatttaaaaaaaaaacaactgagagctccaagaagagccttaggtcaaaattggatgaatttcagaggccttatttcttata

SEQ ID NO: 56682 - DNA, 601 bp, Human
ttgtttaagcaactaggcagcagtggaaagagctagaggacaaagaatcctgctggtttgctgcaggctacagctattcagaaacagtttgggaatttcagagttgggataatttactgccctagtaaactaagtgctactggaacattgcaacagtcatttgcttaaggttgccctagtggtctgaaatagttgaggcagcttccaaaagcaattctctttgcatctgtaaagttctgggagaagctagcttggcttgtctgctgttcctgcattaccattaaggtttgaaattctctcyctgaatattattaaattaatcttatgtgatttgttctttaccaaaacctgcttattttctacagcattatgctatctttctgtttctagcttagagaagcctttaaatttgttcatatagttgccaagaatacctatagtctagtttaagatgcacattaggagagtctgctgacataatagcatctggcttctaaaagtaatctctggtaaactcttttgttttgttgttcttgcttgactttccattctacttcacggatctcaaattaaagctatagatttgaagaaggaaactgat

SEQ ID NO: 56683 - DNA, 601 bp, Human
tctctctgaatattattaaattaatcttatgtgatttgttctttaccaaaacctgcttattttctacagcattatgctatctttctgtttctagcttagagaagcctttaaatttgttcatatagttgccaagaatacctatagtctagtttaagatgcacattaggagagtctgctgacataatagcatctggcttctaaaagtaatctctggtaaactcttttgttttgttgttcttgcttgactttccattctacttcacggatctcaaattaaagctatagatttgaagaaggaaaytgatatttgagatttgtaggacagggtagatctcatcatataaaagaagctcaacaaataccttgtaattgatgctacatgcttaacacaaacaaacaaaactctaagaaattgttttttttaggttgctcagaaatgcccattgagttggatttgtgggagttgaaagatgaattctgtcttgctttacaaaataattaaaaactcgctaacaaatatgttccactctcctttgagcagcatattttgtgacttctttgctccatagtcctcaaaattattcagaagtggagttcaaac

SEQ ID NO: 56684 - DNA, 601 bp, Human
tttctgatactttttggtttacaaattgttaaggataaatgagaaaataagtattaaaaaacaaaaaaaatcaaggactcatttatttcccatagctatgatagaatctgctgtgtaaaagtaacacaaatgcaggagctcaaggtcaaacatagaaacctctgtcttacatatccgtcataacattctcttgacgtttttcctaattaaatttataaagcattagttctaatgttaaaaattgttatataaaaagcattttaatattcacatgcatctgtctacagtgttttacattttrtttataattcgtcaactgaatgaatactagataggagaatgttccatttaataaaaactcttgagaaaaataaaatagcttacttaacagtaatttcaatgtgagttggtttgtgatgtggttggcaacaaaacttacgtaatctagggctacattggcaggaatttactggtcaggacaaaggaggtagtgtttatacagattctgcacaaaacgcatgtcacctaatattattattaaatattattaaatattattaatatttagcttacttgtgaatttctctttttatctttgtta

SEQ ID NO: 56685 - DNA, 601 bp, Human
aaataaacaaataaggaagtatcagaaaataaacaaattaagagtattatgaaaatttacacacaataagaatacaatttagaaaaaggaatatccttctaggaaaatgcaacttaaaaaaactgactcaaagaaaaaaaatctataatgtcagataaacattaaagtaattgaatcagcagtcaaataaaccttccaatgaagttaactccaagcctattgatttgcaagtaatatcaatcaaaattcaaaaatttttaaaaatgcaaaattatacaaactttccagagaatagaacaaytgggacgtactcctcacataattttatgtggcttgatataaaatcttgacaagaggactatgaagaagaaaacccctacccaaagtcactcatgaacgtagatgaaaatatcctaaataaaatattaacaacccaaatccatcagtttataaaaatagtcaggctaaattggccaagtggattttatcatccgtgtttgaggttactttaaaattagaaaaccagtttaagtaattgaccatattgactgattaaaagagaaaaaaatcaattatctcaatagacacagaaaaagaaatg

SEQ ID NO: 56686 - DNA, 601 bp, Human
attgaagatagcttcagattctagaagagtttctagctctttctgaatatgtgttaacagtttcgctgtttgagctctgctacccactagccagttataaacacaggtaagacccttaacttcacagggcctgttgggaagaggttataattttttagcaacagaacctgtttttcaaacaaaatcctaattagaacacccaaaaacaaacaaaataaaggattcaaatgggtgacatggccagtcctggttacagtatgagacagatgccggttacggtgggcaacagaacagatgctggctacagtggtcgacagagttcattttagttcaagcagaaggtagggctggtgcttgttacagtggccagtaggcctggtttctggttatagcacatggcagagttaggagctctacctacattatgtccccacggcctcatctgtggtttccccataagaaaactaccttttgggaaaacatgatacaaacagatcaggtgaattagaaggtctcctgcagatttaaaattttatgaatataatgccaaatataatcttacactcagttgactactaataataaataaccctacaaaata

SEQ ID NO: 56687 - DNA, 601 bp, Human
ttcttagaatacagggttgggcgtgggggctcatgcctgtaatcccagcattttgggaggctgaggcgggtggatcacgaggtcaggagatcaagaccatcctggccaacatgacgaaaccctgtctgtactaaaaatacaaaaattacctgggtatggtggcgtgtgcctgtaatcccagctacttgggaggctgaggcaggagaatcgcttgaacccaggaggcggaggttgcagtgagctgagatcgtgcctctgcactccagcctggtgacagagcgagactccatctcaaaaaaawaaaaaataataataataagggtaaatacaaggagtgtgttttgaatacaaaatatctatttttagaatctcaaacccatgagttactttcttccatatataagtcccaacatgttttctataatcagtctatgtctattagatgtgtaattatattaattatgtaaatgcacatgaataccaaattatttggttaatcttcgaatttcttttagcaattatatactctcctccaggttagattgagctttcccttcaactcagagaaatcagtgtcaacaggctaccttctgtaagacta

SEQ ID NO: 56688 - DNA, 601 bp, Human
ttagaatacagggttgggcgtgggggctcatgcctgtaatcccagcattttgggaggctgaggcgggtggatcacgaggtcaggagatcaagaccatcctggccaacatgacgaaaccctgtctgtactaaaaatacaaaaattacctgggtatggtggcgtgtgcctgtaatcccagctacttgggaggctgaggcaggagaatcgcttgaacccaggaggcggaggttgcagtgagctgagatcgtgcctctgcactccagcctggtgacagagcgagactccatctcaaaaaaaaaawaaataataataataagggtaaatacaaggagtgtgttttgaatacaaaatatctatttttagaatctcaaacccatgagttactttcttccatatataagtcccaacatgttttctataatcagtctatgtctattagatgtgtaattatattaattatgtaaatgcacatgaataccaaattatttggttaatcttcgaatttcttttagcaattatatactctcctccaggttagattgagctttcccttcaactcagagaaatcagtgtcaacaggctaccttctgtaagactacca

SEQ ID NO: 56689 - DNA, 601 bp, Human
gaatacagggttgggcgtgggggctcatgcctgtaatcccagcattttgggaggctgaggcgggtggatcacgaggtcaggagatcaagaccatcctggccaacatgacgaaaccctgtctgtactaaaaatacaaaaattacctgggtatggtggcgtgtgcctgtaatcccagctacttgggaggctgaggcaggagaatcgcttgaacccaggaggcggaggttgcagtgagctgagatcgtgcctctgcactccagcctggtgacagagcgagactccatctcaaaaaaaaaaaaaataataataataagggtaaatacaaggagtgtgttttgaatacaaaatatctatttttagaatctcaaacccatgagttactttcttccatatataagtcccaacatgttttctataatcagtctatgtctattagatgtgtaattatattaattatgtaaatgcacatgaataccaaattatttggttaatcttcgaatttcttttagcaattatatactctcctccaggttagattgagctttcccttcaactcagagaaatcagtgtcaacaggctaccttctgtaagactaccagag

SEQ ID NO: 56690 - DNA, 601 bp, Human
tttagttgttaaaattctgaggggaaaatgtaaattagatgtgaactacctctacaatataagatagcagtaggctgtaagttaaaataatcatttttctcatttttcagtaacattcattaaatgcctgatacaattctgtactttctgaaaattgactataataaagaaatcctggccattataaaattgtcatccactcataggtagaataaatgagagaattatggtgatctaaatatagaaagcatttaaattagagaacagctgaaattgtgcttctaaaacatttcagtgttgytcattttctatatgttacattgaaaaaagtaatatggaaatgtaatgttttcatttgcagatgcttaaatttagatacatgtttaatactgtaatcattttgatcaaacagcagctatcatttattattcaatatttatatgtaaaacctgaaactttcatctaccttaatgatggtattgtgataaaagtacccatgtatcaccaagctttgccaattctttttattccttaaagaatatccgacaatttgctggtttgtataagtttgagttaagacaccgtaataatgtcctgcagt

SEQ ID NO: 56691 - DNA, 601 bp, Human
gaggggaaaatgtaaattagatgtgaactacctctacaatataagatagcagtaggctgtaagttaaaataatcatttttctcatttttcagtaacattcattaaatgcctgatacaattctgtactttctgaaaattgactataataaagaaatcctggccattataaaattgtcatccactcataggtagaataaatgagagaattatggtgatctaaatatagaaagcatttaaattagagaacagctgaaattgtgcttctaaaacatttcagtgttgctcattttctatatgttayattgaaaaaagtaatatggaaatgtaatgttttcatttgcagatgcttaaatttagatacatgtttaatactgtaatcattttgatcaaacagcagctatcatttattattcaatatttatatgtaaaacctgaaactttcatctaccttaatgatggtattgtgataaaagtacccatgtatcaccaagctttgccaattctttttattccttaaagaatatccgacaatttgctggtttgtataagtttgagttaagacaccgtaataatgtcctgcagtatatatgtcaaaatacat

SEQ ID NO: 56692 - DNA, 601 bp, Human
ttaaatgcctgatacaattctgtactttctgaaaattgactataataaagaaatcctggccattataaaattgtcatccactcataggtagaataaatgagagaattatggtgatctaaatatagaaagcatttaaattagagaacagctgaaattgtgcttctaaaacatttcagtgttgctcattttctatatgttacattgaaaaaagtaatatggaaatgtaatgttttcatttgcagatgcttaaatttagatacatgtttaatactgtaatcattttgatcaaacagcagctatyatttattattcaatatttatatgtaaaacctgaaactttcatctaccttaatgatggtattgtgataaaagtacccatgtatcaccaagctttgccaattctttttattccttaaagaatatccgacaatttgctggtttgtataagtttgagttaagacaccgtaataatgtcctgcagtatatatgtcaaaatacatgggtcaaaaagacactctaaaatagcagtctccaagaacccaggaagtatgtgatccataggagtgtacatattttattttctttaaaaaataagacagac

SEQ ID NO: 56693 - DNA, 601 bp, Human
tctcagactgctgggctagcaatgaacaaggctccgtaggcatgggaccctccgagccaggtgtgggatataatctcctggtgtgccgtttgctaagaccattggaaaagcgtggtattagggtgggagtgacccgattttccaggtgccgtctgtcacagcttcccttggctaggaaagggaatttcctgaccccttgtgcttcccgggtgaggtgatgcctcgccctgctttggctgacacttgatgggctgcaaccactgtcctgcacccactgtcagacaagccccagtgaggtgamcctggtacctcaattggaaatgtggaaatcacccatattctgtgtcgctcatgctgggagctgtagactggagctgttcctattcgaattatactggtttctaaaaaagattgtaatatattgttgagagtgaagggagttttatatcaataattaaattattttaaaatattgtttatttcatttctcatacttcaaattacttatttacattttaataatatattagtatcataacacatgtgtataatacagctagaaagagagagcatatataccctgaaggcatttttaattata

SEQ ID NO: 56694 - DNA, 601 bp, Human
cgtttgctaagaccattggaaaagcgtggtattagggtgggagtgacccgattttccaggtgccgtctgtcacagcttcccttggctaggaaagggaatttcctgaccccttgtgcttcccgggtgaggtgatgcctcgccctgctttggctgacacttgatgggctgcaaccactgtcctgcacccactgtcagacaagccccagtgaggtgaccctggtacctcaattggaaatgtggaaatcacccatattctgtgtcgctcatgctgggagctgtagactggagctgttcctattcsaattatactggtttctaaaaaagattgtaatatattgttgagagtgaagggagttttatatcaataattaaattattttaaaatattgtttatttcatttctcatacttcaaattacttatttacattttaataatatattagtatcataacacatgtgtataatacagctagaaagagagagcatatataccctgaaggcatttttaattataatattgtaaaaccaaactctaaagactcctgttctaggtaattgattagtccagtaaatgtaggcataagaaaaatgtatgaaata

SEQ ID NO: 56695 - DNA, 601 bp, Human
gtgtataatacagctagaaagagagagcatatataccctgaaggcatttttaattataatattgtaaaaccaaactctaaagactcctgttctaggtaattgattagtccagtaaatgtaggcataagaaaaatgtatgaaatagatgacgttaatctttcatgcacaataacacctttctccagctgtggctctaactgtcctgatggattctttactgctctcagctaatccattatatggttttagacatccaggatagacactgaaaggaataactattacaaaagtaattttaagrggagcatttgattgactgatgctcctcttatgtattcattgtgtgtatgtattgaatttgtgtattcattgtatgtattcaatattcaatgtatgtattcattgatcctgcatatacttgatgatttgattggtggtttgattccagttatattaacttgccagaaactttctagtttccaaacagtgaatacaacttagacctcatgaagcttacattctagttagaagagagaatattaattagataagcacataaaatatacatgtgttagatagtgataaatgacaagaaaaaaag

SEQ ID NO: 56696 - DNA, 601 bp, Human
attcattgatcctgcatatacttgatgatttgattggtggtttgattccagttatattaacttgccagaaactttctagtttccaaacagtgaatacaacttagacctcatgaagcttacattctagttagaagagagaatattaattagataagcacataaaatatacatgtgttagatagtgataaatgacaagaaaaaaagtagagcatggagggcctaggaaggatgatagtggttgaatagactttaattttatatagaatattaggtcagagatctgaaggtgactaggaaaaarttatgtgggtatctggagcaagagcatcttaggacaaagagaaagtaagtgaaaaggccctaagatatgaatgtggctggcatgttcaaagaccctcaaggatggggtaagagtggggaagagttgaaggatatggggaaggggaaaatatcgtaggcctttggcacactgtagttaatgtcttcacatttttcttgcaatgcaatgagaaacacagacatgtaatgatctgagttatgttttaatagggttagtatgattgttactttgagagttggttgaatgaggacaaacagatag

SEQ ID NO: 56697 - DNA, 601 bp, Human
aagtgaaaaggccctaagatatgaatgtggctggcatgttcaaagaccctcaaggatggggtaagagtggggaagagttgaaggatatggggaaggggaaaatatcgtaggcctttggcacactgtagttaatgtcttcacatttttcttgcaatgcaatgagaaacacagacatgtaatgatctgagttatgttttaatagggttagtatgattgttactttgagagttggttgaatgaggacaaacagatagaccagttaagagacttggcattcatccagtcattagctgtgaagtctggaccacagtgataatggtgaaaatgatcaagtgtggtttgattccagatacattttgaaggtaatgctgaaaagatatgctaatagtttggctgtggaacatgaaagaaagaggagttgaggattatttcccaactatggacctgagcaactaaaagacttgtcattgatttagatggggaagactgtggtaaaaacaaattttttacaggagatcatgaactcagcttagctaattatataaagttagagatgcctattatatatcgaggtgtaaatgttaaagtgatagctagtata

SEQ ID NO: 56698 - DNA, 601 bp, Human
tgattgttactttgagagttggttgaatgaggacaaacagatagaccagttaagagacttggcattcatccagtcattagctgtgaagtctggaccacagtgataatggtgaaaatgatcaagtgtggtttgattccagatacattttgaaggtaatgctgaaaagatatgctaatagtttggctgtggaacatgaaagaaagaggagttgaggattatttcccaactatggacctgagcaactaaaagacttgtcattgatttagatggggaagactgtggtaaaaacaaattttttacrggagatcatgaactcagcttagctaattatataaagttagagatgcctattatatatcgaggtgtaaatgttaaagtgatagctagtatacaagtctgaagttcattgggtcaggaacatctgaactgaagatgtaaaatgtttgaatcatcaatccatatgtcatttaaaccagaagactagatgtgataaccaagaaaatgaataacgagacaaagtatgagatctaaggattgggccctatagcaccccaacatttagaggttaggaaactgaggacgaactagaaaggagactaag

SEQ ID NO: 56699 - DNA, 601 bp, Human
gtgaaaatgatcaagtgtggtttgattccagatacattttgaaggtaatgctgaaaagatatgctaatagtttggctgtggaacatgaaagaaagaggagttgaggattatttcccaactatggacctgagcaactaaaagacttgtcattgatttagatggggaagactgtggtaaaaacaaattttttacaggagatcatgaactcagcttagctaattatataaagttagagatgcctattatatatcgaggtgtaaatgttaaagtgatagctagtatacaagtctgaagttcattkggtcaggaacatctgaactgaagatgtaaaatgtttgaatcatcaatccatatgtcatttaaaccagaagactagatgtgataaccaagaaaatgaataacgagacaaagtatgagatctaaggattgggccctatagcaccccaacatttagaggttaggaaactgaggacgaactagaaaggagactaagaatcagtgaccaaaaaagtagaaggaaaaccacagaagtcatgtattgaaagtcatttgaatgaatcaagtgatcaactttgtcagatactgttgatgggccaaataa

SEQ ID NO: 56700 - DNA, 601 bp, Human
tttcccaactatggacctgagcaactaaaagacttgtcattgatttagatggggaagactgtggtaaaaacaaattttttacaggagatcatgaactcagcttagctaattatataaagttagagatgcctattatatatcgaggtgtaaatgttaaagtgatagctagtatacaagtctgaagttcattgggtcaggaacatctgaactgaagatgtaaaatgtttgaatcatcaatccatatgtcatttaaaccagaagactagatgtgataaccaagaaaatgaataacgagacaaartatgagatctaaggattgggccctatagcaccccaacatttagaggttaggaaactgaggacgaactagaaaggagactaagaatcagtgaccaaaaaagtagaaggaaaaccacagaagtcatgtattgaaagtcatttgaatgaatcaagtgatcaactttgtcagatactgttgatgggccaaataaggtaagaaatgagaattgaccattggatatagcaatgcattcgaccaatgaccttgagaagagtatttcagtggaatgaagggcaacatggaaactagagtggatttaag

SEQ ID NO: 56701 - DNA, 601 bp, Human
agaaatggataccctacaaagcagcacattccattttcaacagctctagatattattttatttatttattttagatgaagttctgctgtgttgtccaagctggtctcaaacccctgggctcaagcaatcctcctgcctcagcctcccaagtagctggaattatagttgtgtgccactgcatctagctccagattttagaagttaattcttacacagggttttctggagggacagaactaataggattgatgtatatatgaaggggagtttgttaggagaattggctcacatgatcacaagrtgaagtcccacaataggccatctgcaagctgagtagcaagaaagccagttcgattcccagaacctcaaaattagggaagccagcggtgcagccttcagtctgtggccgaaggcccgagagcccgtggcaaattactggtgtaagtgcaagggtccaaaagctgaaaaacttggaatctgatgttcaagggcaggaagcatccggcataggagaaagatgaagactagaagactgcgcaattctagaccttccacgttctcctgcctgctttatcctagccacgctggcagctgattaaat

SEQ ID NO: 56702 - DNA, 601 bp, Human
tctgtggccgaaggcccgagagcccgtggcaaattactggtgtaagtgcaagggtccaaaagctgaaaaacttggaatctgatgttcaagggcaggaagcatccggcataggagaaagatgaagactagaagactgcgcaattctagaccttccacgttctcctgcctgctttatcctagccacgctggcagctgattaaatggtgcctacccagaatgagggtggttctgtctttcccagccctctgactcaaatgttaatctcctttggcaacaccctcacagacacactcaggtacartactttgcatacttcaatcaagtagacagtcaatattaatcaccacattctccaacgctttctcatacaggttctatttctccactatgaacagtgagattttttttctggtatacttgataggccttcaaatgttccaagaaaacaatcatgcttttcctaagtcttctctttttaaatactcccattacctttccaaaccttttgttcagctgttgggaccatcaacatcctggtcacacctctatggatgaagtctaatttgtcaactactctcttaaatggtggtgtcatgaattg

SEQ ID NO: 56703 - DNA, 601 bp, Human
gagagcccgtggcaaattactggtgtaagtgcaagggtccaaaagctgaaaaacttggaatctgatgttcaagggcaggaagcatccggcataggagaaagatgaagactagaagactgcgcaattctagaccttccacgttctcctgcctgctttatcctagccacgctggcagctgattaaatggtgcctacccagaatgagggtggttctgtctttcccagccctctgactcaaatgttaatctcctttggcaacaccctcacagacacactcaggtacagtactttgcatacttcartcaagtagacagtcaatattaatcaccacattctccaacgctttctcatacaggttctatttctccactatgaacagtgagattttttttctggtatacttgataggccttcaaatgttccaagaaaacaatcatgcttttcctaagtcttctctttttaaatactcccattacctttccaaaccttttgttcagctgttgggaccatcaacatcctggtcacacctctatggatgaagtctaatttgtcaactactctcttaaatggtggtgtcatgaattgatcacagtgctctggat

SEQ ID NO: 56704 - DNA, 601 bp, Human
gagaaaatgtgtagctgatctgaagaagcatgctgtgtgaaattttgaatgtttatcttaatagaacctaaaatcttccacataggttcacccctcattactcacaataatgccaagtgctgtagtccaggcagatatttattattttatatgtgaaaagacattcgaataaggccatttctcagtggattaggggaatcagagttttctgaatttaagttccttatagagccccatgtaatgagctcttagaagacattgcagagctgcaatttaaaatcctgtttaatcagccgtagcragctatgtgccattctctgtggaacactaagaggaatcagggttcttcctcctccatccagtacattcccaaccaggaattgctgtctggtcagggttggacgtgaaaggccatagagagccaaccctgcgaagccaagtctctgcatgtcagcacagagcaagcagcagaatacagatcatcagctttgttttatgaatatctctatttacagtgctggagtggaattttaaaaaaaggattgcagcatttgcattgaatctgtcactcacagcttcaattttgattcctgtcctataa

SEQ ID NO: 56705 - DNA, 601 bp, Human
tttgcattgaatctgtcactcacagcttcaattttgattcctgtcctataaatgatcttgctttcctatttttttctgaatttctacaaggtgactgtcaatgtcagaaaatgtaaacctcaagtgtacattgcatggggcttggcatgtatattagaaagaaagaagtttgcttaatgaaaagaggataatatttattcaaactaagcctatttaattgcacagaggaaagtataccttctttgcctgttttgtttgaattttaatataaaataaaatttgctgctaaccttttgttttwctttgaccaataacatttctcagcttagtgtatgggctatgtaaagtgcctgtcaaatggagggatgtctttgttgaaagaatccagactcacagaaagtgagtgactttctggtcagatggttagaactctcccaattttgacaaagatcgttctctgtttgggatttgtaaagctcaaactgtagactaagatgatgacaggaggatctgctgtttggcttcatggaacttaacctatttcagcaagcctgcaatactggggaaaataatacatatatttatgtttatgtcaggcttg

SEQ ID NO: 56706 - DNA, 601 bp, Human; identical to SEQ ID NO: 18841

SEQ ID NO: 56707 - DNA, 601 bp, Human; identical to SEQ ID NO: 18842

SEQ ID NO: 56708 - DNA, 601 bp, Human; identical to SEQ ID NO: 18843

SEQ ID NO: 56709 - DNA, 601 bp, Human; identical to SEQ ID NO: 18844

SEQ ID NO: 56710 - DNA, 601 bp, Human; identical to SEQ ID NO: 18845

SEQ ID NO: 56711 - DNA, 601 bp, Human; identical to SEQ ID NO: 18846

SEQ ID NO: 56712 - DNA, 601 bp, Human; identical to SEQ ID NO: 18847

SEQ ID NO: 56713 - DNA, 601 bp, Human; identical to SEQ ID NO: 18848

SEQ ID NO: 56714 - DNA, 601 bp, Human; identical to SEQ ID NO: 18849

SEQ ID NO: 56715 - DNA, 601 bp, Human; identical to SEQ ID NO: 18850

SEQ ID NO: 56716 - DNA, 601 bp, Human; identical to SEQ ID NO: 18851

SEQ ID NO: 56717 - DNA, 601 bp, Human; identical to SEQ ID NO: 18852

SEQ ID NO: 56718 - DNA, 601 bp, Human; identical to SEQ ID NO: 18853

SEQ ID NO: 56719 - DNA, 601 bp, Human; identical to SEQ ID NO: 18854

SEQ ID NO: 56720 - DNA, 601 bp, Human; identical to SEQ ID NO: 18855

SEQ ID NO: 56721 - DNA, 601 bp, Human; identical to SEQ ID NO: 18856

SEQ ID NO: 56722 - DNA, 601 bp, Human; identical to SEQ ID NO: 18857

SEQ ID NO: 56723 - DNA, 601 bp, Human; identical to SEQ ID NO: 18858

SEQ ID NO: 56724 - DNA, 601 bp, Human; identical to SEQ ID NO: 18859

SEQ ID NO: 56725 - DNA, 601 bp, Human; identical to SEQ ID NO: 18860

SEQ ID NO: 56726 - DNA, 601 bp, Human; identical to SEQ ID NO: 18861

SEQ ID NO: 56727 - DNA, 601 bp, Human
aggatgactcctaggttttgctttgcaatggagtagatgataataagtaccatgtgcagctataggaattataggaggaggagcaagttcaggaaggaaagataatcactttgcatttttatcagctttttgtgaggtattaataaaataaaattcacccatttatagtaatgaattttaaccaatgattacagtggtgtaatcatcccttgtgccccattgcagtgaagtccccatcaccccccatgtgcctactgttttgccttctagcattataattttccaatttctacaacttctkaaaaatagaatcgtagtctgtttttttgagggggggtttgtttgtttctttgtttggcttccttcacttggtgttacgtttttgtaattcatccatattgttgcatgtatcagcagtttgttctaaaaattgcttaataatattccatttgtgtaatgtacagtgacttgcttacctgtttaccatttaatgggtgtttgggtcatttctagtttggggttacaattttgctgtgaacattagcatacaagtcaaaagcatatttatggacaaatgttttctcttttttttcttaagaac

SEQ ID NO: 56728 - DNA, 601 bp, Human
aaagcatatttatggacaaatgttttctcttttttttcttaagaacactccacatctttgccaactcttggacttttaacccttttttaattttaagaattctgatgcatgtgtatttctcttgtttgcatttatttaatgcccagtaatgttgggaatcctttcatttatttatttgtcatttatacatcttttttgaagtgtttacaaagcttatgcccatttctattttgagttgtttgtttccttagtaatgcattgcaaggattatttatatattctggatacatgttctttaacrtatgttaaagcttgcttttcatatagattgctttttacctagtttcatcatctaatttttataaacactagcttattatctttttcttctatagtccatactttttatgttctacccaagaaagacaaggtccaaagatttctctcccatgttttcttcaagaagttttagagttttagctcttaaatgtaggtttggattccattttgaatattaatttttctatatatcaggtaatggtcagagctcactttttatggatacccaatttttcaaacattatttgttgaaaagactatc

SEQ ID NO: 56729 - DNA, 601 bp, Human
ttgccaactcttggacttttaacccttttttaattttaagaattctgatgcatgtgtatttctcttgtttgcatttatttaatgcccagtaatgttgggaatcctttcatttatttatttgtcatttatacatcttttttgaagtgtttacaaagcttatgcccatttctattttgagttgtttgtttccttagtaatgcattgcaaggattatttatatattctggatacatgttctttaacatatgttaaagcttgcttttcatatagattgctttttacctagtttcatcatctaatytttataaacactagcttattatctttttcttctatagtccatactttttatgttctacccaagaaagacaaggtccaaagatttctctcccatgttttcttcaagaagttttagagttttagctcttaaatgtaggtttggattccattttgaatattaatttttctatatatcaggtaatggtcagagctcactttttatggatacccaatttttcaaacattatttgttgaaaagactatcctttttcccattgaattactttgactcctttgtcaaaatctatcaactatatatatg

SEQ ID NO: 56730 - DNA, 601 bp, Human
tgcatgcacctatcagcattcagtcaatgactcaagagaacgcttctgcacatctctggaattacctttctatctaacttctttctttttgaacacgtattctatttgccatcataagtttcagcagcctcggcttcctcaaactccactctttgtctctcaactcagctataatgcgggctttgggtttaccctctctgtgttgcagcctagaaattgcctctgtacactgcttcatgtttttttccttctctcagaaatcacagtcctgtgcttcctataattcaatatctaaaaacarttgtttcttggtttgtatttttattttagttggttgtgtactttaacagcttaacaaagaagaataaatactgtaaaaactaagaagaggctgttcaaaagaagaatattcttcagtgcctaatgcaacacaaaggtcaagtaggattagtgctgaagttgttcattaaattgaagagcaataataagggcatttttttatgttagtgggagtcgttccaattgattccactgggttgtgaaatattggaacgtgatgaccaagtgtggtcctgtttgaccctatagcagtaccctatag

SEQ ID NO: 56731 - DNA, 601 bp, Human
caggagaaaagcagggatgccatgcatttaaacaaccagatcttgccggtaggaactcatggtcacaaggacagcaccaagccctgagggatcagcccccatgatccaaacacctcccaccaggctccacctccaacactggggattatattttaacacgagaattagtggggacatatccaactgtatcagagacctctcaagtaatttatttatgagcatgtgttttactgtttttaaaactgggatgactttaatttaaatgaacagtgatttgagatttatagcttccctttctttrtgtcatggataatttctctgtgctaaggtgtgagcatacacatcatttgggctgttactgaagtagaatacgaagcctgccttctttcactagcaggggaatagtgagtaaattctctattgctaaacaaatattacctctatttatgatttaaatttgatgatggccatagtgctatctaaacacatggttaatggtctggtttattctccactataacttcctgaataaacttcctgatttggaaaggtcccaatgtctatttgtactgtcaacaattttgtaaaaattcatgctttg

SEQ ID NO: 56732 - DNA, 601 bp, Human
atggtcacaaggacagcaccaagccctgagggatcagcccccatgatccaaacacctcccaccaggctccacctccaacactggggattatattttaacacgagaattagtggggacatatccaactgtatcagagacctctcaagtaatttatttatgagcatgtgttttactgtttttaaaactgggatgactttaatttaaatgaacagtgatttgagatttatagcttccctttctttgtgtcatggataatttctctgtgctaaggtgtgagcatacacatcatttgggctgttaytgaagtagaatacgaagcctgccttctttcactagcaggggaatagtgagtaaattctctattgctaaacaaatattacctctatttatgatttaaatttgatgatggccatagtgctatctaaacacatggttaatggtctggtttattctccactataacttcctgaataaacttcctgatttggaaaggtcccaatgtctatttgtactgtcaacaattttgtaaaaattcatgctttggttttatacaattatttggataacttcatattttagttaaagataaagatgcctcaca

SEQ ID NO: 56733 - DNA, 601 bp, Human
aaacacgtcggagtttgtaggcaaatgcatgtctgtagaagctgcccaccgttcttggaggataggagcacgctgggctactgagaagccgacttcaaggtcagagcgtgtgtgcagaccaaagcaagtcagaagggtgcctatggagagacaatgtgccctcccaactaaaggcacacctgggattctttctgggccactgggctcccgtgctaaataatacaaaaataatgatgaagattctttttttttttttagacagagccttgctctgtcgcctaggctggagtgcagtggcgcratctcggctcactgcaagctgcacctcctgggttcacgccattctcctgcctcagcctcaggagtagctgggactacaggcgtccgccaccacgcccggctaattttttgtgtttttaatagagacagggtttcaccatgttagccaggacggtctcaatctcctgaccttgtgatccgccctcctcggcctcccaaagtgctgggattacaggcatgagccaccgcgcccggcctaatgaagaaccagaactcagcttggaagtgtggtgggccgccattatggacttattgggtcctt

SEQ ID NO: 56734 - DNA, 601 bp, Human; identical to SEQ ID NO: 18862

SEQ ID NO: 56735 - DNA, 601 bp, Human; identical to SEQ ID NO: 18863

SEQ ID NO: 56736 - DNA, 601 bp, Human; identical to SEQ ID NO: 18864

SEQ ID NO: 56737 - DNA, 601 bp, Human; identical to SEQ ID NO: 18865

SEQ ID NO: 56738 - DNA, 601 bp, Human; identical to SEQ ID NO: 18866

SEQ ID NO: 56739 - DNA, 601 bp, Human; identical to SEQ ID NO: 18867

SEQ ID NO: 56740 - DNA, 601 bp, Human; identical to SEQ ID NO: 18868

SEQ ID NO: 56741 - DNA, 601 bp, Human; identical to SEQ ID NO: 18869

SEQ ID NO: 56742 - DNA, 601 bp, Human; identical to SEQ ID NO: 18870

SEQ ID NO: 56743 - DNA, 601 bp, Human; identical to SEQ ID NO: 18871

SEQ ID NO: 56744 - DNA, 601 bp, Human
tattcacagattctgcattttaaaaagtaaggaaaaaataactgggagaaccactgagcatgtcaagaaatagaattttagcagcatcttagaagagcaccagaagacatacctatttaaaaattatgtgtgcctttttttctgattattttcttataaataaactttctataaaatttggaaattacagaaaagaattaagaagaaaaaattcacccaaaatgcaacataacattttaatgttttaagtatttcccaccaatttttacatgtgtttatgaataagatttatataacaccatggatgcagttttatgtcttgtcctttacatttttacctatcatgaggttgtattatgttgttagatattatttaaaatctttacgatctttgtttggatgtcccataatttacccatttcccttagaattgaggtagctcttatttttttatgtttctgctggcaccctgcactctctaccaccatctgcattagaacaatcagaacaatcatgtgttccaccctttttatcgtagtcactgtaagaaattcaggttgcccctgtcaccacttgtccctcaagctgtaatctgcccaca

SEQ ID NO: 56745 - DNA, 601 bp, Human
gcagaatcctcctcttccctcagtgttctcttcatcatgctctgactgaaacccaactctcactttgcatgctgctaccccggcagccctcttaaggagtagccatcacctttttgttttttttttcccctgagatgctgactcactctgtcgtgcaggctggagggcagtggcgatcctggctcactgcaacctccgactcccgggttcaagtgattctcatgcctcagcctcctgagtagctgggactacaggctcacgccaccacacctggatattttttttatttttagtagagacrgggtttcaccatgttgtctaggctggtctcgaactcctaacctcaggtaatccacccaccttggcctcccaaagtgctgggattacaggcatgagccaccatgcccagctgcagtcgccatcactttctttcactcccttcattcccctgagtctgaaggtgggggcaggttttcctgctcctcgctgccagtttcatattatccatcctcctctacatcagggtccacaacccctgggccacaggaggatattggtccgtggccttttagaaaccagaccacacagcaggaggcaagca

SEQ ID NO: 56746 - DNA, 601 bp, Human
gagacggggtttcaccatgttgtctaggctggtctcgaactcctaacctcaggtaatccacccaccttggcctcccaaagtgctgggattacaggcatgagccaccatgcccagctgcagtcgccatcactttctttcactcccttcattcccctgagtctgaaggtgggggcaggttttcctgctcctcgctgccagtttcatattatccatcctcctctacatcagggtccacaacccctgggccacaggaggatattggtccgtggccttttagaaaccagaccacacagcaggaggsaagcagcaggcaaaggagcaagcgcagcttcattagcatttacagctgctcctcattcctggtattactgtactgcctgagctccacctcctgtcagatcagagacagcattagattctcataggagcacaaaccctattgtgaactgcacatgtgagggatctaggttgtgcgctcctgagaatctaatgcctgatgatcaatgatctgtcactgtctcccatcaccccaagatgggactatctagttgcaggaaaacaagcttagggcttccactgattctatgttatggtgagttgt

SEQ ID NO: 56747 - DNA, 601 bp, Human
aaaccagtccctggtgccaaaaacattggagacgctgctctacagcacccagctttgactctcatgcttccctctatgtgccccctctccatctgcttgtcgaagtcacctactaacctttaaataccccacatcattccttgctgattttccctgtctaattgtcattttccctagcactactcctgtcatcattcttagtgattttaatgtccatgaacttaactcttccatactcttcactttcagtttcttgtgcctctctggtctccatttgaagcgtttttttgttgttgtttgktttttgtttgtttttttttttttttcccactgtgtcgtttctctctagttcacttcttctaaatacttccacttcaatgtgtgtaatctcacaattgatgcacacacttttttcttgttccttatctcatgctttcactgtagtaaccagcttaatagtcatgatctttcattggtattactgctttgcaacgctcatttccctggctactcctttacttattttttactcaagtgaactccaacactgtgagaatcctaccatctcctccatacctgcaccttctttttttttttgaga

SEQ ID NO: 56748 - DNA, 601 bp, Human
gtccctggtgccaaaaacattggagacgctgctctacagcacccagctttgactctcatgcttccctctatgtgccccctctccatctgcttgtcgaagtcacctactaacctttaaataccccacatcattccttgctgattttccctgtctaattgtcattttccctagcactactcctgtcatcattcttagtgattttaatgtccatgaacttaactcttccatactcttcactttcagtttcttgtgcctctctggtctccatttgaagcgtttttttgttgttgtttggtttttktttgtttttttttttttttcccactgtgtcgtttctctctagttcacttcttctaaatacttccacttcaatgtgtgtaatctcacaattgatgcacacacttttttcttgttccttatctcatgctttcactgtagtaaccagcttaatagtcatgatctttcattggtattactgctttgcaacgctcatttccctggctactcctttacttattttttactcaagtgaactccaacactgtgagaatcctaccatctcctccatacctgcaccttctttttttttttgagacggagt

SEQ ID NO: 56749 - DNA, 601 bp, Human
ctggtgccaaaaacattggagacgctgctctacagcacccagctttgactctcatgcttccctctatgtgccccctctccatctgcttgtcgaagtcacctactaacctttaaataccccacatcattccttgctgattttccctgtctaattgtcattttccctagcactactcctgtcatcattcttagtgattttaatgtccatgaacttaactcttccatactcttcactttcagtttcttgtgcctctctggtctccatttgaagcgtttttttgttgttgtttggtttttgtttktttttttttttttttcccactgtgtcgtttctctctagttcacttcttctaaatacttccacttcaatgtgtgtaatctcacaattgatgcacacacttttttcttgttccttatctcatgctttcactgtagtaaccagcttaatagtcatgatctttcattggtattactgctttgcaacgctcatttccctggctactcctttacttattttttactcaagtgaactccaacactgtgagaatcctaccatctcctccatacctgcaccttctttttttttttgagacggagtcttg

SEQ ID NO: 56750 - DNA, 601 bp, Human
tgagatactataatattaatgttatagtcatttgattttgtagaaggaatatataccaacagttttccagtgtgcaaaaaaaaacttaacaaatctaatatattctgatgtattattgaagagatactagcacataccactcttgagaatataattaaacttctcattaggcatccaaaatataggaatttcccctaatggctaatttttatataagaaaaaatactatgtacactatttcaaagcagacagaaaagtcatatgaaaagggtatgtcaaaaaagtttcaaaaagaggctcytgatttatgtgttgtgtgtttgtggacctaaccaggacatttgattcaattaaccaagtttagtatgtcagcaaccctctgaaagattgagaagattgactgtccagagaatattacaatatttgctttctctgttgaagaaattatgtagacttacaggtataagagaaacaaaatcatatttttgaatctcttatttttagtaatgattattggctttaaggattttaattcagttactaatgttatatttaggttacataaaataattcattatgcaattattttactgcaaaagca

SEQ ID NO: 56751 - DNA, 601 bp, Human
ggtttagcaagagatgaacttcattgttgtcatttcaaatttaagacgcttctgtgttatacaatatttattcaagaagcaattagaagcagaagtctggaacccattagagatatccaggctgaatacataaaatacagagttttgggcacaccattaactgaagtcatagtaatggatgaaatcaccaaggtaaatgtggaggagaaaaaagagatgaggaccaaagttagaattaagggcgtcaattatattgaacagaaagggaaggaagagtcgataaaggagaattcgagtagcygcagaagtaggagaaacatcaactggcttactcttaaagaagccatgggggctgggcacggcagctcccgcctgtaatcccaacactttgggaggccagggcaggcagatcacggggtcaagagatggagacgatcctggccagcatggtgaaaccccgtctttactgaaaatacaaaaattaactgggcatggttacgcatgcctgtaatctcagctactcaggaggctgaggcaggagaatcgcttgaacctgggaggcagaggttgcagtgagctgagatggtgccactgcactcca

SEQ ID NO: 56752 - DNA, 601 bp, Human
acctgggaggcagaggttgcagtgagctgagatggtgccactgcactccagcctgactacagagcgagactgtctcaaaaaaaaaaaaaagaaagaaagaaaaagaaagaaagaaaccatgggaagagagtatccagaaatatctatcaatggctacagaaaacctacatatgaggcctgatgattgtaagttttgctttagcaacaaagatcttatgggtcatcctggtattatgtttaatggtgaaaccagaagcctgtttaaagggagaatgggagatgaagaagtagagaccaggartgtaaacaatgtctttttaaaagcttatcgaaaataggatagaaattgtcaagcaatttgagacctcacagattttttttttaagacaggaaaggcttgaccaatttcaaatattaatgagaatgagcctgcaaaggagggaataaagatggtggagaaaatggggaggcaggaggaaaggaaaccaatttaggagtggagtagcttcagacaaaggacggaaacaaatgtcaaagggatggaaaataatgtggcaatatactgaattgtttgccaggaaaccaagggagcatccaaatt

SEQ ID NO: 56753 - DNA, 601 bp, Human
ctcaaatgcaaggatcgcattcccacaagataacattcaatgttgcattcttgctgccatgtttattttttgtcaggtggtttttttaaattattattttcccaaagtctaagtaaatttctagaaggtaggatgttctttcattgcctgtttcagtgcattccatgtagctcttcctaactccttattgcataattgattattgtgttaaatataattctgcttcatgaaaattttaatttgaagctatttgcacactattctgaagctattctcatttctttgtggaaaggtgttaaarggtatcaccccaatgtctcttattatgcaagcataagaaagaagatatcgatctgagattgctagttttagattgactcctctgtatttatgaagaaccacctacatctatgctttccaccttgaggtggtttcagaaagcccactagtgggcatgtgccaaggccacagtatttgtagcacctttttctaacatctcatagagctaaaacctgggatatgaagaaacataaatgcctagaagaaataataaattttagagactcgaagtctattccccaatttagagtaggagaaaaat

SEQ ID NO: 56754 - DNA, 601 bp, Human
ctagttttagattgactcctctgtatttatgaagaaccacctacatctatgctttccaccttgaggtggtttcagaaagcccactagtgggcatgtgccaaggccacagtatttgtagcacctttttctaacatctcatagagctaaaacctgggatatgaagaaacataaatgcctagaagaaataataaattttagagactcgaagtctattccccaatttagagtaggagaaaaatttacatagagattgattcagggaaaagagaatagcaactcttattgtcagtgtagctacgayagcacagtattagtttctcaaatcaaagagttcctttaaaaatatttatatcaaagactgagttctctgtcagtgataaagtgtgtgtgtgagtgtgtgtgtgtaagaaagtatatgtgttcatagacacacattcatagctagggactgtatgataaattacattctaactatcactaaattaaaaacaaacttcttctcccttttcctttacagaattgtcaacatcacactgctggtgacttctgtgaacgatgtgctcttggatactatggaattgtcaagggattgccaaatgac

SEQ ID NO: 56755 - DNA, 601 bp, Human; identical to SEQ ID NO: 18872

SEQ ID NO: 56756 - DNA, 601 bp, Human; identical to SEQ ID NO: 18873

SEQ ID NO: 56757 - DNA, 601 bp, Human; identical to SEQ ID NO: 18874

SEQ ID NO: 56758 - DNA, 601 bp, Human; identical to SEQ ID NO: 18875

SEQ ID NO: 56759 - DNA, 601 bp, Human; identical to SEQ ID NO: 18876

SEQ ID NO: 56760 - DNA, 601 bp, Human
cattaaaatctggggtagataatataatgggattatttggggaacatttcttttaaagagaattggcattctgcccatcaacaacaatggctttttcatttattgttgatgatcaatacttttttaacattttgaatacatttatcattagaaatcgtaattcatcttttccctatcacatatgtgggtttctaatctccacttgtcccatgtgatattaagaaaagggccaatcctccagttacaaagctacaccagttttataattcttatttgctttattcttgccccacaaggaaaygtatttacaggggttatacatggtatttagttcagttgctggactggaagtgtttatattctttttaaaagaatagcagtttttattccagaaaaaaatattaaattataggattgtttttgatatctagactcttttgctaaagcacagttaattatcttataattatgctgtatagattttccatatactgctcttaagcattagtgatttccacttacttctaggaatgttttctcttcacctttcactaaactaactctaagaattgttacacagagtatctttagacttttcatc

SEQ ID NO: 56761 - DNA, 601 bp, Human
atttatcattagaaatcgtaattcatcttttccctatcacatatgtgggtttctaatctccacttgtcccatgtgatattaagaaaagggccaatcctccagttacaaagctacaccagttttataattcttatttgctttattcttgccccacaaggaaatgtatttacaggggttatacatggtatttagttcagttgctggactggaagtgtttatattctttttaaaagaatagcagtttttattccagaaaaaaatattaaattataggattgtttttgatatctagactcttttkctaaagcacagttaattatcttataattatgctgtatagattttccatatactgctcttaagcattagtgatttccacttacttctaggaatgttttctcttcacctttcactaaactaactctaagaattgttacacagagtatctttagacttttcatcttttctcttcttctaaaatttctcccgttatggaaaaatatgccatgattctatgatcttggcctttcccaggattcggtttctacttctactcctagttttgaaatcagataaaataagacacaagtgaggatgtaat

SEQ ID NO: 56762 - DNA, 601 bp, Human
tcacctgcaagaagctgcaggtgtcacctgcaagaagctgatttattaaaagccctgccagggcagtttaatccctgtgaagtgatattgtaactcacctctagctgctgtcctatcaaaaaatcactctccgtcctccttctctttgtttacaagcaccagttaatggttttctctccattaagcagctcaggggactgctgtttagagacctaattgaattcttgccaagtttgggcatgatccagagctgctccaattctcggtattttccatgctatgtattttcccctattctaasatgtatatagcattgatacctctatctgcagaatgtaagaaattgtaactgtatacatgagagtatattataaatgcagtagttcctgctccttggcgtgcagatacacctcattactctgcaatgcaaaactaaaaatatacatgttttttaaatctgctaaaagattcaatatatgttaattttggaaattatacgactatttatgagatctattccataatgaagagtcaacaatccatttgtctctctaccaattctaccacctatcctggcccctaccaccaaatttgaatagca

SEQ ID NO: 56763 - DNA, 601 bp, Human
cctctttgatggccaaaaatattatggtgagtgtattagtccattttcgtattgctataaagaaatgcctgaagctcggcaatttgtaaagaaaagaggtataattggctcatggttccatcaggctgtacaggaagcatggctggggtggcctcagggaactttcactcatggcagaaggcaaagctggagcaggcatcttcacacaggcagagcaggaggaagtgggggctggaggtggcacacacttttaaataaccaggtcttatgagaactctgtcatgagaacatcactagggcrgtggtgctaagccattaaaaccactccagtgattcaatacctcccacgaggccccatatccagtattggggatgacatttcaatatgagatttggatggggacacagatccaaaccatatctggtagaatattagcattcttggctacttaaagaatatagtttttctagcctttagcaattatttatctataagactgaaagaggttaatcatcaaagtagggatttgtgagactgcatctaatcatgggtggtaatagactgaagggataaagaggaacagttggcaaataaataagt

SEQ ID NO: 56764 - DNA, 601 bp, Human
tgaactcctgacctcaggtgatccacccacctcggcctctcaaagtgttgggattacaggcatgagccaccacacccggccttctttagacttttttttttttttaattattctactcaatagataccaagctaaaaatttatatactttttgaatgtgtaatacataaagcatgtggaggtcaaattactatgactttctccagtgcaatctaatggagcaccacacatttagactctggagcatgttttattccctgtggacaggttcctttcgattgctcatgtagggatttaggggrtacttttaatgttatattctatgccttaaaggaaatcttcaatacttgtgcaatacactttttctccccaaatctatttgctcctcctctttggtccctcagtttatattatcgcctctatttcaggttctgggcgacatgcatatctgttcttttgttgttgttcttatctttcctcaaccatcatccatttgatagcattaatattctgagatgagtagtttcatcttccatggaattattcttggaccataaaatatttcatagctgaattctttgaacatctgcctgggatgttta

SEQ ID NO: 56765 - DNA, 601 bp, Human; identical to SEQ ID NO: 18877

SEQ ID NO: 56766 - DNA, 601 bp, Human; identical to SEQ ID NO: 18878

SEQ ID NO: 56767 - DNA, 601 bp, Human; identical to SEQ ID NO: 18879

SEQ ID NO: 56768 - DNA, 601 bp, Human
cacaagaagtatttcattaagagtgtcagatctttattatgtctcaacctatactctttaccctttccagcagattgtctcatgctatgttttttaaacagactttattttttagaacagcttaaagttcaaagaaaaattgagtgtaaagttcagagtgttctcatatctactccctgcccccacaaccttccccaccagaatggtacatttattatagtcgataaacctaagttgacacctcctcatcacccaaagtccatagtttacattagggttccctcttggtattgtacattcyatgggtttggaaaaatgcattatgacatgtgtccaccgttgttgtaaaatatagaaaagttttactgcccgaaaactcctctatgcttcacctattcatacctccctcttccttgacccctggcaaccactcatatttttactacatccatagttttgccttttttggaatatatagctggaatcatacagtgtggtactttttcatattagcttctttcccttggtaatatacacttaaggtttctccatattttttcatgactttatagctcatttctttgtagtgttgaataatatt

SEQ ID NO: 56769 - DNA, 601 bp, Human
ttttagaacagcttaaagttcaaagaaaaattgagtgtaaagttcagagtgttctcatatctactccctgcccccacaaccttccccaccagaatggtacatttattatagtcgataaacctaagttgacacctcctcatcacccaaagtccatagtttacattagggttccctcttggtattgtacattctatgggtttggaaaaatgcattatgacatgtgtccaccgttgttgtaaaatatagaaaagttttactgcccgaaaactcctctatgcttcacctattcatacctccctcytccttgacccctggcaaccactcatatttttactacatccatagttttgccttttttggaatatatagctggaatcatacagtgtggtactttttcatattagcttctttcccttggtaatatacacttaaggtttctccatattttttcatgactttatagctcatttctttgtagtgttgaataatatttcattgtttagacatatcactgtttacttattcattcccctactgaaggacatcttggttgcttccaaattttggcagcatgaatcaagttgctgtaaacatctttgtg

SEQ ID NO: 56770 - DNA, 601 bp, Human
acttttgtgtggacttaagttttcaacctatttgggtgaatataaaggagcatgattgctggatggtatggtaagagtatatttagttttgaaagaaattaccaaaatgtattccaaatggtcttttctattttgcattcccaccggcaataaatgagagtttctgttgctccacatcctcaatagcatttggtgtttttagtgtttggattttgtcattctaataagtgtgtatggtatctcattcttgttttagtttgcaattccttaatgacatatgatgtcgagcatcttttcataygcttatttgccatctgtatatcttctttggtaaggtgtctatttaggtctttttccattttttcattgggttgttttcttgtcgaattcagagttttttgtatattttgggtaatagtcctttatcagatatgtcttttgccattatttgcttcccctctgtggcttgtcttgttctcttgagaagtgtctttcacagagcagaagtttttaattgtaacgaagcccagcttatcaattaggtttctccttgttgagcctttggtgttgtatctaaagactcattgccatatccacggtc

SEQ ID NO: 56771 - DNA, 601 bp, Human
atttcaaaaaacttgcaaagagagtaccaagagccttcacatactccattcccagtctccccattgttaacatcttacattagcatggtacatgtgtcatatacatgttatatacatgtgtcatatacatattagctcatatacatgagctaataatattgaaatattaccattaacccaagactgtattcatattttttcagtgtttactgaatgtttttttactgtttcaggatcccatgcaggatactacattacatttagccattgtgtcttcttagggttcctctagactgtgacracactgtcaaaaatactgtaacagtgtttctgatgactttgagagtttggacaggttcgtgtgtttggtaagctgtccctcaattggggtttgcctcatatctttctcatgattagaatggaattatgagtttttgtgggaaaaacttcagaggtaaagtaccatgttcatcacatcaagaacccatgtgaccaatatgacttattactgtggatattgaccctgatcacctgactaacatagtgtttgccagatttttccactgtaaagttactcttttatgcccttttcatactctaa

SEQ ID NO: 56772 - DNA, 601 bp, Human
ttaccattaacccaagactgtattcatattttttcagtgtttactgaatgtttttttactgtttcaggatcccatgcaggatactacattacatttagccattgtgtcttcttagggttcctctagactgtgacgacactgtcaaaaatactgtaacagtgtttctgatgactttgagagtttggacaggttcgtgtgtttggtaagctgtccctcaattggggtttgcctcatatctttctcatgattagaatggaattatgagtttttgtgggaaaaacttcagaggtaaagtaccatkttcatcacatcaagaacccatgtgaccaatatgacttattactgtggatattgaccctgatcacctgactaacatagtgtttgccagatttttccactgtaaagttactcttttatgcccttttcatactctaatactatttttatctgcccattcttcagattcagtaacataaaaggcgcagaaataggactactgaaagcaaagatcactttgatgggttgagaagggggaggaaatgtaaatactcattaattacttttttcctaccatatttataattacaaatatatcttccat

SEQ ID NO: 56773 - DNA, 601 bp, Human
actgtaacagtgtttctgatgactttgagagtttggacaggttcgtgtgtttggtaagctgtccctcaattggggtttgcctcatatctttctcatgattagaatggaattatgagtttttgtgggaaaaacttcagaggtaaagtaccatgttcatcacatcaagaacccatgtgaccaatatgacttattactgtggatattgaccctgatcacctgactaacatagtgtttgccagatttttccactgtaaagttactcttttatgcccttttcatactctaatactatttttatctrcccattcttcagattcagtaacataaaaggcgcagaaataggactactgaaagcaaagatcactttgatgggttgagaagggggaggaaatgtaaatactcattaattacttttttcctaccatatttataattacaaatatatcttccatgcagaccataaatactcaagtcaacatgaccaattctctctttccctgtggtcaagctgcatgacaatcaaaaggtgaattaatacagatggaattataattagagagttagatggtttcattatccaaaatcaggctaagcacgctaa

SEQ ID NO: 56774 - DNA, 601 bp, Human
ttctgatgactttgagagtttggacaggttcgtgtgtttggtaagctgtccctcaattggggtttgcctcatatctttctcatgattagaatggaattatgagtttttgtgggaaaaacttcagaggtaaagtaccatgttcatcacatcaagaacccatgtgaccaatatgacttattactgtggatattgaccctgatcacctgactaacatagtgtttgccagatttttccactgtaaagttactcttttatgcccttttcatactctaatactatttttatctgcccattcttcagrttcagtaacataaaaggcgcagaaataggactactgaaagcaaagatcactttgatgggttgagaagggggaggaaatgtaaatactcattaattacttttttcctaccatatttataattacaaatatatcttccatgcagaccataaatactcaagtcaacatgaccaattctctctttccctgtggtcaagctgcatgacaatcaaaaggtgaattaatacagatggaattataattagagagttagatggtttcattatccaaaatcaggctaagcacgctaatgcctctatctca

SEQ ID NO: 56775 - DNA, 601 bp, Human
gaggtaaagtaccatgttcatcacatcaagaacccatgtgaccaatatgacttattactgtggatattgaccctgatcacctgactaacatagtgtttgccagatttttccactgtaaagttactcttttatgcccttttcatactctaatactatttttatctgcccattcttcagattcagtaacataaaaggcgcagaaataggactactgaaagcaaagatcactttgatgggttgagaagggggaggaaatgtaaatactcattaattacttttttcctaccatatttataattasaaatatatcttccatgcagaccataaatactcaagtcaacatgaccaattctctctttccctgtggtcaagctgcatgacaatcaaaaggtgaattaatacagatggaattataattagagagttagatggtttcattatccaaaatcaggctaagcacgctaatgcctctatctcagagtcatgaatgatcctgcagttgtgaccagggtatgagaaatgcagtggccacaacttccaattacccatgactacattagaggagacagtgctctagactaggactgcacattggaattac

SEQ ID NO: 56776 - DNA, 601 bp, Human
aattaatacagatggaattataattagagagttagatggtttcattatccaaaatcaggctaagcacgctaatgcctctatctcagagtcatgaatgatcctgcagttgtgaccagggtatgagaaatgcagtggccacaacttccaattacccatgactacattagaggagacagtgctctagactaggactgcacattggaattaccaggagccctatctcacacccataggttgtgatgcagttggtctggggtagagtcagaccactgggatattcaagaactccccagattatacwgataaagaattactgtgatcctgtagttacctaatagctaagactctcttccctctggaaaatgccttaattggtactgccaatcttttttttttttttttaaacagagtttcacccttgttgtccaggctggagtacaatggtgtgaactcagctcactgcaacctccacctcctaggttcaagcaattctcctgcttcagcctcccaagtagctgggattgcaggcacctgctaccatgcccagctaattttttttttttttttttttaagtagagacagggtttcatcatgttggcc

SEQ ID NO: 56777 - DNA, 601 bp, Human
atgcagtggccacaacttccaattacccatgactacattagaggagacagtgctctagactaggactgcacattggaattaccaggagccctatctcacacccataggttgtgatgcagttggtctggggtagagtcagaccactgggatattcaagaactccccagattatactgataaagaattactgtgatcctgtagttacctaatagctaagactctcttccctctggaaaatgccttaattggtactgccaatcttttttttttttttttaaacagagtttcacccttgttgtcsaggctggagtacaatggtgtgaactcagctcactgcaacctccacctcctaggttcaagcaattctcctgcttcagcctcccaagtagctgggattgcaggcacctgctaccatgcccagctaattttttttttttttttttttaagtagagacagggtttcatcatgttggccaggctggtctcgaacccctgacctcgggtgatccacccgcctcagcctcccaaagtgctgggattacaggcgtgagccaccatgcccagcactactgccaatctttgttatgctcctttttctctg

SEQ ID NO: 56778 - DNA, 601 bp, Human
aatctcatattgtgtagtttgggattaccacatttgttttttagctggtctctctgcttttactcttgttctcctccaaatctgttctccgtaacgtagccagaatgaatgtttgctattccaaatgtgaatacgtcatcgcagtgcttacaaactcttcccctgacttcccttaggctcgtaggataaagaccaaaattctccccttggccacatctcccatcacttgtgcccctggccatctgcactccagccatactgtcccccagccactttgtcccaccacaaagcattgccacayatttctttattttgccttaaaggtaatctacctctccctacattttgttaatttctgttaactccaatttacctttcaaatctcagctcgtgaaagccctctgtgccatcgcaggggttccaagattcctcctgtgcttatcttataccactatttttcctctagtttgtagttataaatttatctacatgatcatttgacaaataactatatagtccaccagactatagactccaaatgggcaagaaacctttttgtttcttaccacagtatcaccaatattatacacataataggtgt

SEQ ID NO: 56779 - DNA, 601 bp, Human
actgtgtaactcatcctttagcatgctaacccgcattaagttgatgcttttggtgccgggaacctcacgtctcctcctcttctggaatagcctagagaggaagctcttcttctgtgtttagagggaaggtatctccttcagtaagcactgtgctggccctgaagagtcttcctaccctcttcctgccccctactgccactcccaccccaccagcgtggaacttcgtgtgtattcaaaggtccagtttgaattactgtgaggccagtggctagaaagcagtgtagttgggactggagattcwcatgcctggctcttctcccaagcttcaactgtagctcttgagcagcagcttcctctgagcttctaaaaaatgcccagaaaattgcccagccaaccacatttcctggcaagcatagcaccaggcatatggtcagtttgagtgctattagataggctttagaacttccaagggatcattggtttgattgtcattgtatccaccaatcacccaacatctttgacccacgacaatttgccagacactatgcttggcactctgaggaataaaaagagtaagacagatccctagccttttctaatc

SEQ ID NO: 56780 - DNA, 601 bp, Human
cctttagcatgctaacccgcattaagttgatgcttttggtgccgggaacctcacgtctcctcctcttctggaatagcctagagaggaagctcttcttctgtgtttagagggaaggtatctccttcagtaagcactgtgctggccctgaagagtcttcctaccctcttcctgccccctactgccactcccaccccaccagcgtggaacttcgtgtgtattcaaaggtccagtttgaattactgtgaggccagtggctagaaagcagtgtagttgggactggagattctcatgcctggctctyctcccaagcttcaactgtagctcttgagcagcagcttcctctgagcttctaaaaaatgcccagaaaattgcccagccaaccacatttcctggcaagcatagcaccaggcatatggtcagtttgagtgctattagataggctttagaacttccaagggatcattggtttgattgtcattgtatccaccaatcacccaacatctttgacccacgacaatttgccagacactatgcttggcactctgaggaataaaaagagtaagacagatccctagccttttctaatctatctatctaatgg

SEQ ID NO: 56781 - DNA, 601 bp, Human
tggaatagcctagagaggaagctcttcttctgtgtttagagggaaggtatctccttcagtaagcactgtgctggccctgaagagtcttcctaccctcttcctgccccctactgccactcccaccccaccagcgtggaacttcgtgtgtattcaaaggtccagtttgaattactgtgaggccagtggctagaaagcagtgtagttgggactggagattctcatgcctggctcttctcccaagcttcaactgtagctcttgagcagcagcttcctctgagcttctaaaaaatgcccagaaaaytgcccagccaaccacatttcctggcaagcatagcaccaggcatatggtcagtttgagtgctattagataggctttagaacttccaagggatcattggtttgattgtcattgtatccaccaatcacccaacatctttgacccacgacaatttgccagacactatgcttggcactctgaggaataaaaagagtaagacagatccctagccttttctaatctatctatctaatggagatatggcaaagcacctaacaaagtcactacccattagagttgtgaatagtggtaataataattatt

SEQ ID NO: 56782 - DNA, 601 bp, Human
ctggatttgttttggataagtagagaagagttaagaagcaaaagtatgaacaaaatctttttttgagaatgttccaaaaggaagtaggcaagaagaatggtaataaggttggcaagattggttaggaaaattgttttttagtcctgtatataacaactttagagaatatttactataagttaggcatcatactaggagctggatatatgataaacaaaacagaccaagttctcacccccttagagcttaccttacagttggagaggttgtcaataaataggtgagccaattactaagtaaktctcaaatccatggtgctatgaaggaaacgtcctgctgcaggaagtgtggaaacctaggtagcaccctgggaatggccacgctaaggagaagcacttaaactgaaagctgatgggtaacaaggacccagtctttacaggtgttgaggagaagctcattctaggtaaagacaatgggatacaagaaggtgctaagaagggatgagttttgcatatttaatatactaaaactatgccagggaggttgattgcatagggtcttagtgctaattgttttaacttctttcttatcatggagtttg

SEQ ID NO: 56783 - DNA, 601 bp, Human
tataaataagaattggtccacttggtgtgaaattatgatcttttggtaatacagaaaatatattgatgaagaaaaagaatatattttaagtttaaattataatgtacattttctgtaccataagagacactagtggtattgatacattaatccgtaaggtaagatattggaagatgaccaaaatatagatcaagttccttattatggtgttcagtaatatgtgaaagtaagagtggtaccataaagttcagtcaagtctagactagaaaaatatccaaagcagtttagactacgaacatcttttttttttcttttcttttctttttttttgagacagaggctcgctctgtcgccaggctggagtgcagtggcgtgatctcggctcactgccaagctgttgaccttagttagtgattcagaagtaacatttaaataattgggtatgagtatgtgtgtgtgtatgtgaatgtgtttatgtatatgtgtctgtgtgtaaaaagttatttgacccatcagacctttgagtgcaaacacgtgcaggaagccaagtttaaggaaattaatggaacataattacaacactcaccagaaaagcaaggat

SEQ ID NO: 56784 - DNA, 601 bp, Human
caccttaatgattgcttcttgtttacaaatggttttaatttaaagaaattatgtatgccatccaaaagatacagccatatttgccttttccctttctctatctgttgtcattctttttccaccagattcttctctgcagaagtttagctttgagaccagagcacaagagaaatagtgagactctgtctctcatttttcccttcctctatactgcctaggcccagaatctaaattagatcaaatttcaaaagatatttcttatgaaagctgatttatacacgcacacacacacacgcgcgcrcacacacatattcatttaacaaagaaaaaacatacagctttagcaggttgggaagtggcatttattaatatcatcttcattttaaaaagtgagtacaaattatatcagtagttacttacatgctacaattggttaaagtcagctatacagatagcatgcactcagactaaaggatgagatagtaccataggtagagccaaatctgctactgctttcttgaaatctaagaagcagaaagcttcttacatttaatcattggtactctggaaggcttcccacctagtttgctggaccagggag

SEQ ID NO: 56785 - DNA, 601 bp, Human; identical to SEQ ID NO: 18880

SEQ ID NO: 56786 - DNA, 601 bp, Human; identical to SEQ ID NO: 18881

SEQ ID NO: 56787 - DNA, 601 bp, Human; identical to SEQ ID NO: 18882

SEQ ID NO: 56788 - DNA, 601 bp, Human; identical to SEQ ID NO: 18883

SEQ ID NO: 56789 - DNA, 601 bp, Human; identical to SEQ ID NO: 18884

SEQ ID NO: 56790 - DNA, 601 bp, Human; identical to SEQ ID NO: 18885

SEQ ID NO: 56791 - DNA, 601 bp, Human; identical to SEQ ID NO: 18886

SEQ ID NO: 56792 - DNA, 601 bp, Human; identical to SEQ ID NO: 18887

SEQ ID NO: 56793 - DNA, 601 bp, Human; identical to SEQ ID NO: 18888

SEQ ID NO: 56794 - DNA, 601 bp, Human; identical to SEQ ID NO: 18889

SEQ ID NO: 56795 - DNA, 601 bp, Human; identical to SEQ ID NO: 18890

SEQ ID NO: 56796 - DNA, 601 bp, Human; identical to SEQ ID NO: 18891

SEQ ID NO: 56797 - DNA, 601 bp, Human; identical to SEQ ID NO: 18892

SEQ ID NO: 56798 - DNA, 601 bp, Human; identical to SEQ ID NO: 18893

SEQ ID NO: 56799 - DNA, 601 bp, Human; identical to SEQ ID NO: 18894

SEQ ID NO: 56800 - DNA, 601 bp, Human; identical to SEQ ID NO: 18895

SEQ ID NO: 56801 - DNA, 601 bp, Human
aaagcttacagcaatattaaggactatattgatgaagctgagaaagttgccaaagaagccaaagatcttgcacatgaagctacaaaactggtaagaaacaaatggcacatgtgctgggaatggaagtcaacctttttgaatttttcaaatgtaagtcagtctggaaaatcccagtaaattggtatatttgttttgggttatttttgaagacctcttttaaaatttgcctaaaataaattctcggtatgctataattatagcagaactcttttctcagtcacccactaccactgttagggtsttaaaattatctcagaaaccaagcaagtttgtgctaccaactcacaaaataaaacaggcaaagacaacactctggatagggaattttatcaccattatctcaaatggcattagtaaaaaagaaaaaaaagtaaccattgtatataatcacacacaaattggttacatatgaagtttggctataaaattcactttttaataaaaacatactggatcatatgcttctaaacaatttataccatgtttatgaattaatgaatttttatgaatttttgaattaaaaagctcttaacctttggct

SEQ ID NO: 56802 - DNA, 601 bp, Human
tggaagtcaacctttttgaatttttcaaatgtaagtcagtctggaaaatcccagtaaattggtatatttgttttgggttatttttgaagacctcttttaaaatttgcctaaaataaattctcggtatgctataattatagcagaactcttttctcagtcacccactaccactgttagggtcttaaaattatctcagaaaccaagcaagtttgtgctaccaactcacaaaataaaacaggcaaagacaacactctggatagggaattttatcaccattatctcaaatggcattagtaaaaamgaaaaaaaagtaaccattgtatataatcacacacaaattggttacatatgaagtttggctataaaattcactttttaataaaaacatactggatcatatgcttctaaacaatttataccatgtttatgaattaatgaatttttatgaatttttgaattaaaaagctcttaacctttggctacaatcattgttcgtaatacatttggaacaagtattttagagtttgggcattccaagttctatcacattatttgaatgccttcaatggtgacaaatctttatgctttagatgtaaagcaa

SEQ ID NO: 56803 - DNA, 601 bp, Human
gaagtcaacctttttgaatttttcaaatgtaagtcagtctggaaaatcccagtaaattggtatatttgttttgggttatttttgaagacctcttttaaaatttgcctaaaataaattctcggtatgctataattatagcagaactcttttctcagtcacccactaccactgttagggtcttaaaattatctcagaaaccaagcaagtttgtgctaccaactcacaaaataaaacaggcaaagacaacactctggatagggaattttatcaccattatctcaaatggcattagtaaaaaagaaaaaaaagtaaccattgtatataatcacacacaaattggttacatatgaagtttggctataaaattcactttttaataaaaacatactggatcatatgcttctaaacaatttataccatgtttatgaattaatgaatttttatgaatttttgaattaaaaagctcttaacctttggctacaatcattgttcgtaatacatttggaacaagtattttagagtttgggcattccaagttctatcacattatttgaatgccttcaatggtgacaaatctttatgctttagatgtaaagcaaca

SEQ ID NO: 56804 - DNA, 601 bp, Human
tttttcaaatgtaagtcagtctggaaaatcccagtaaattggtatatttgttttgggttatttttgaagacctcttttaaaatttgcctaaaataaattctcggtatgctataattatagcagaactcttttctcagtcacccactaccactgttagggtcttaaaattatctcagaaaccaagcaagtttgtgctaccaactcacaaaataaaacaggcaaagacaacactctggatagggaattttatcaccattatctcaaatggcattagtaaaaaagaaaaaaaagtaaccattgyatataatcacacacaaattggttacatatgaagtttggctataaaattcactttttaataaaaacatactggatcatatgcttctaaacaatttataccatgtttatgaattaatgaatttttatgaatttttgaattaaaaagctcttaacctttggctacaatcattgttcgtaatacatttggaacaagtattttagagtttgggcattccaagttctatcacattatttgaatgccttcaatggtgacaaatctttatgctttagatgtaaagcaacattttgtacatgagttgtg

SEQ ID NO: 56805 - DNA, 601 bp, Human
agtctggaaaatcccagtaaattggtatatttgttttgggttatttttgaagacctcttttaaaatttgcctaaaataaattctcggtatgctataattatagcagaactcttttctcagtcacccactaccactgttagggtcttaaaattatctcagaaaccaagcaagtttgtgctaccaactcacaaaataaaacaggcaaagacaacactctggatagggaattttatcaccattatctcaaatggcattagtaaaaaagaaaaaaaagtaaccattgtatataatcacacacaarttggttacatatgaagtttggctataaaattcactttttaataaaaacatactggatcatatgcttctaaacaatttataccatgtttatgaattaatgaatttttatgaatttttgaattaaaaagctcttaacctttggctacaatcattgttcgtaatacatttggaacaagtattttagagtttgggcattccaagttctatcacattatttgaatgccttcaatggtgacaaatctttatgctttagatgtaaagcaacattttgtacatgagttgtgtgatagtaagttggtag

SEQ ID NO: 56806 - DNA, 601 bp, Human
tgttttgggttatttttgaagacctcttttaaaatttgcctaaaataaattctcggtatgctataattatagcagaactcttttctcagtcacccactaccactgttagggtcttaaaattatctcagaaaccaagcaagtttgtgctaccaactcacaaaataaaacaggcaaagacaacactctggatagggaattttatcaccattatctcaaatggcattagtaaaaaagaaaaaaaagtaaccattgtatataatcacacacaaattggttacatatgaagtttggctataaaatkcactttttaataaaaacatactggatcatatgcttctaaacaatttataccatgtttatgaattaatgaatttttatgaatttttgaattaaaaagctcttaacctttggctacaatcattgttcgtaatacatttggaacaagtattttagagtttgggcattccaagttctatcacattatttgaatgccttcaatggtgacaaatctttatgctttagatgtaaagcaacattttgtacatgagttgtgtgatagtaagttggtagtactatttcaggttaaaaaaatctcatagga

SEQ ID NO: 56807 - DNA, 601 bp, Human
ttttgaattaaaaagctcttaacctttggctacaatcattgttcgtaatacatttggaacaagtattttagagtttgggcattccaagttctatcacattatttgaatgccttcaatggtgacaaatctttatgctttagatgtaaagcaacattttgtacatgagttgtgtgatagtaagttggtagtactatttcaggttaaaaaaatctcataggaatcatcctgaataaaatgttcagaaccatcatttatttattttgtttcacatagaacctaccaaacacatgagaattttttkggggagaaatctgattggacatttgactgtgagtgaaatacacataagcagtggtgttaaagaaactgatcaatattttctttgcttcagtgttgggcaaaaatactttctaggatttaggggatattagagatatcccctaaatgaaccagtcttagcaggttcattttgtgatcataatgaaacatcatattctatgagcaatttgtactgtttttggtttctcttgagtgagccctactaatgccatatgttctgttgacttcttattcaaaatagtggcatgatcattgcagaagc

SEQ ID NO: 56808 - DNA, 601 bp, Human
catcctgaataaaatgttcagaaccatcatttatttattttgtttcacatagaacctaccaaacacatgagaattttttgggggagaaatctgattggacatttgactgtgagtgaaatacacataagcagtggtgttaaagaaactgatcaatattttctttgcttcagtgttgggcaaaaatactttctaggatttaggggatattagagatatcccctaaatgaaccagtcttagcaggttcattttgtgatcataatgaaacatcatattctatgagcaatttgtactgtttttggyttctcttgagtgagccctactaatgccatatgttctgttgacttcttattcaaaatagtggcatgatcattgcagaagcatttctatgttcagttatcctttcagaatgaatctacttttcaaatctaaactaaattttaatccatcttctgttagataattttctattttaaagaccctaatttcaagttcaccattttcatttcacctgttttattgtatgattattttcagcacctaaaatggtgcctggcaaatagtaggcacttataaatgaatgagtgtattttttcattataa

SEQ ID NO: 56809 - DNA, 601 bp, Human
atttatttattttgtttcacatagaacctaccaaacacatgagaattttttgggggagaaatctgattggacatttgactgtgagtgaaatacacataagcagtggtgttaaagaaactgatcaatattttctttgcttcagtgttgggcaaaaatactttctaggatttaggggatattagagatatcccctaaatgaaccagtcttagcaggttcattttgtgatcataatgaaacatcatattctatgagcaatttgtactgtttttggtttctcttgagtgagccctactaatgccrtatgttctgttgacttcttattcaaaatagtggcatgatcattgcagaagcatttctatgttcagttatcctttcagaatgaatctacttttcaaatctaaactaaattttaatccatcttctgttagataattttctattttaaagaccctaatttcaagttcaccattttcatttcacctgttttattgtatgattattttcagcacctaaaatggtgcctggcaaatagtaggcacttataaatgaatgagtgtattttttcattataattgacaccttttatgcctgttcataatc

SEQ ID NO: 56810 - DNA, 601 bp, Human
ttgtttcacatagaacctaccaaacacatgagaattttttgggggagaaatctgattggacatttgactgtgagtgaaatacacataagcagtggtgttaaagaaactgatcaatattttctttgcttcagtgttgggcaaaaatactttctaggatttaggggatattagagatatcccctaaatgaaccagtcttagcaggttcattttgtgatcataatgaaacatcatattctatgagcaatttgtactgtttttggtttctcttgagtgagccctactaatgccatatgttctgtygacttcttattcaaaatagtggcatgatcattgcagaagcatttctatgttcagttatcctttcagaatgaatctacttttcaaatctaaactaaattttaatccatcttctgttagataattttctattttaaagaccctaatttcaagttcaccattttcatttcacctgttttattgtatgattattttcagcacctaaaatggtgcctggcaaatagtaggcacttataaatgaatgagtgtattttttcattataattgacaccttttatgcctgttcataatcttttataccaa

SEQ ID NO: 56811 - DNA, 601 bp, Human
ttatgcctgttcataatcttttataccaataaaaatttgctgtagtaattgcttcatccttataaatttcttgtaacattttatgataaggaggtgtttaattttaccctaatttaatacctttaggaaaaatcattttttgccaacatgaagtgtgcacttacttcttaccacccatgcttatacatggtaggctaaccaacctcaaacagagagtgatggtgagttgtaatgcattacaccatgtctgctgttatcattattccttctctctttccacaatcatttaaaaataattaartgtctgaaaaattacaaaataagtgctatagagaatcagtgatttattaaatgactattggataagaaaaagaagacaatctgtcccagaaattttgttggaatgtttttcatgaacagaatgaataaaattttagtttaatagatcagtataatatagttctactttgctggaaaagaaatatatttgaaaagcattacgttgagtaattatctagataggactaacatcccataaatataagatctgatataaaagctatagctcaacagagaagaatgagattaaatgtattattaa

SEQ ID NO: 56812 - DNA, 601 bp, Human
ttataaatttcttgtaacattttatgataaggaggtgtttaattttaccctaatttaatacctttaggaaaaatcattttttgccaacatgaagtgtgcacttacttcttaccacccatgcttatacatggtaggctaaccaacctcaaacagagagtgatggtgagttgtaatgcattacaccatgtctgctgttatcattattccttctctctttccacaatcatttaaaaataattaaatgtctgaaaaattacaaaataagtgctatagagaatcagtgatttattaaatgactatyggataagaaaaagaagacaatctgtcccagaaattttgttggaatgtttttcatgaacagaatgaataaaattttagtttaatagatcagtataatatagttctactttgctggaaaagaaatatatttgaaaagcattacgttgagtaattatctagataggactaacatcccataaatataagatctgatataaaagctatagctcaacagagaagaatgagattaaatgtattattaagtatagaagagttcaaagcttaacaatacagaagagtcctctactcctttgagtctagc

SEQ ID NO: 56813 - DNA, 601 bp, Human
gcacttacttcttaccacccatgcttatacatggtaggctaaccaacctcaaacagagagtgatggtgagttgtaatgcattacaccatgtctgctgttatcattattccttctctctttccacaatcatttaaaaataattaaatgtctgaaaaattacaaaataagtgctatagagaatcagtgatttattaaatgactattggataagaaaaagaagacaatctgtcccagaaattttgttggaatgtttttcatgaacagaatgaataaaattttagtttaatagatcagtataatrtagttctactttgctggaaaagaaatatatttgaaaagcattacgttgagtaattatctagataggactaacatcccataaatataagatctgatataaaagctatagctcaacagagaagaatgagattaaatgtattattaagtatagaagagttcaaagcttaacaatacagaagagtcctctactcctttgagtctagccctataaagaaggaagaatgttttcaataacttaaaaggaaaaacaaagaaacaatttatacatttgcaggagaaaaggaaaaggtcaagtagtaga

SEQ ID NO: 56814 - DNA, 601 bp, Human
ttagtttaatagatcagtataatatagttctactttgctggaaaagaaatatatttgaaaagcattacgttgagtaattatctagataggactaacatcccataaatataagatctgatataaaagctatagctcaacagagaagaatgagattaaatgtattattaagtatagaagagttcaaagcttaacaatacagaagagtcctctactcctttgagtctagccctataaagaaggaagaatgttttcaataacttaaaaggaaaaacaaagaaacaatttatacatttgcaggagraaaggaaaaggtcaagtagtagagcaaccaacgaccactatgaagaaagtggaggtcagacaatttgagaagaaaaaaagcattgaaaataccataagaaaagaaacaaagaaatgatagaaataacctccaagcataattaagacaatgtttaaaatcaactttgattttttaaaaatttacttgtcttcctatatataaacacacatagacaatcaagaatcacactgaaaggaaaatatgagtgagaaggaagtggatcctttataagcaggagaaagctaatacgatttgtttgta

SEQ ID NO: 56815 - DNA, 601 bp, Human
tatagttctactttgctggaaaagaaatatatttgaaaagcattacgttgagtaattatctagataggactaacatcccataaatataagatctgatataaaagctatagctcaacagagaagaatgagattaaatgtattattaagtatagaagagttcaaagcttaacaatacagaagagtcctctactcctttgagtctagccctataaagaaggaagaatgttttcaataacttaaaaggaaaaacaaagaaacaatttatacatttgcaggagaaaaggaaaaggtcaagtagtasagcaaccaacgaccactatgaagaaagtggaggtcagacaatttgagaagaaaaaaagcattgaaaataccataagaaaagaaacaaagaaatgatagaaataacctccaagcataattaagacaatgtttaaaatcaactttgattttttaaaaatttacttgtcttcctatatataaacacacatagacaatcaagaatcacactgaaaggaaaatatgagtgagaaggaagtggatcctttataagcaggagaaagctaatacgatttgtttgtactgcagtattattttgtaaaga

SEQ ID NO: 56816 - DNA, 601 bp, Human
tacatttgcaggagaaaaggaaaaggtcaagtagtagagcaaccaacgaccactatgaagaaagtggaggtcagacaatttgagaagaaaaaaagcattgaaaataccataagaaaagaaacaaagaaatgatagaaataacctccaagcataattaagacaatgtttaaaatcaactttgattttttaaaaatttacttgtcttcctatatataaacacacatagacaatcaagaatcacactgaaaggaaaatatgagtgagaaggaagtggatcctttataagcaggagaaagctaayacgatttgtttgtactgcagtattattttgtaaagagtaatagctacttgtcttgcataactaatttctttaaatatcagaatgaaatgttattttaagaatttagacatcatgaaataacaaatgctatttttctattggtgtcgggtgaggaaagtactataaagcatttgttttcctacatataatcaccaagaaaatatctcatttagtacttctctagagggtgcaaggaaaacagaaaggagatatgtcactcataaaatggaataaaaatggaatatggacatcagtaatttt

SEQ ID NO: 56817 - DNA, 601 bp, Human
atttgcaggagaaaaggaaaaggtcaagtagtagagcaaccaacgaccactatgaagaaagtggaggtcagacaatttgagaagaaaaaaagcattgaaaataccataagaaaagaaacaaagaaatgatagaaataacctccaagcataattaagacaatgtttaaaatcaactttgattttttaaaaatttacttgtcttcctatatataaacacacatagacaatcaagaatcacactgaaaggaaaatatgagtgagaaggaagtggatcctttataagcaggagaaagctaatacsatttgtttgtactgcagtattattttgtaaagagtaatagctacttgtcttgcataactaatttctttaaatatcagaatgaaatgttattttaagaatttagacatcatgaaataacaaatgctatttttctattggtgtcgggtgaggaaagtactataaagcatttgttttcctacatataatcaccaagaaaatatctcatttagtacttctctagagggtgcaaggaaaacagaaaggagatatgtcactcataaaatggaataaaaatggaatatggacatcagtaattttttc

SEQ ID NO: 56818 - DNA, 601 bp, Human
gatcagatttttaaaattgatgaatgtattaatgttctctagaaggacagaactaataggatagatgtatacaagaaggggggtttactaaggaatattgacccacgccatcacaagatgaagtcccacaataggccatctgcaagctgaggagcagggaagccagcccgagtcccaaaacctcaaaagtagggaagctgacagtgcagccttcagtctgtggttaaaggcctgacagcccctggcaaacccctggtgtaagtccaggaatccaaaagctgaagaacttggagtgtgatgktcaagggcaggaagtatccagcatgggtgaaagatgaaggctggaagagtcagaagatctgctctttccactttcttctgcctgcttttattctagccacactggcagcttattagatggtgcccacccacattgagggtgggtctgcctcttccagtccagtgactcaaattttaatctcctttggcaacaccctcacagagacacccaggaacaatactttgcatcgttcaatccaatcaagctgatactcaatattagtcatcacaagtccaccccttgtcaacttgaacccataca

SEQ ID NO: 56819 - DNA, 601 bp, Human
gcctgacagcccctggcaaacccctggtgtaagtccaggaatccaaaagctgaagaacttggagtgtgatggtcaagggcaggaagtatccagcatgggtgaaagatgaaggctggaagagtcagaagatctgctctttccactttcttctgcctgcttttattctagccacactggcagcttattagatggtgcccacccacattgagggtgggtctgcctcttccagtccagtgactcaaattttaatctcctttggcaacaccctcacagagacacccaggaacaatactttgcatcsttcaatccaatcaagctgatactcaatattagtcatcacaagtccaccccttgtcaacttgaacccatacacatctcctgaaatcatacataatctccaaataaagacaataataacatcataattatacctaacataatacagctatcccttgtacaatcagaagcacactaatccttaacctaaatgctattacataaagttaacaacacttaaatgctgatatgaagtcaataaattttatgtcacatgataaaggaaaaagaaagcaaatgaagatattttcctagtacaagtgta

SEQ ID NO: 56820 - DNA, 601 bp, Human
agctgaagaacttggagtgtgatggtcaagggcaggaagtatccagcatgggtgaaagatgaaggctggaagagtcagaagatctgctctttccactttcttctgcctgcttttattctagccacactggcagcttattagatggtgcccacccacattgagggtgggtctgcctcttccagtccagtgactcaaattttaatctcctttggcaacaccctcacagagacacccaggaacaatactttgcatcgttcaatccaatcaagctgatactcaatattagtcatcacaagtccamcccttgtcaacttgaacccatacacatctcctgaaatcatacataatctccaaataaagacaataataacatcataattatacctaacataatacagctatcccttgtacaatcagaagcacactaatccttaacctaaatgctattacataaagttaacaacacttaaatgctgatatgaagtcaataaattttatgtcacatgataaaggaaaaagaaagcaaatgaagatattttcctagtacaagtgtatacatgcacaaacatattcttaacagaataaggaggaaatatatgac

SEQ ID NO: 56821 - DNA, 601 bp, Human
actcaaattttaatctcctttggcaacaccctcacagagacacccaggaacaatactttgcatcgttcaatccaatcaagctgatactcaatattagtcatcacaagtccaccccttgtcaacttgaacccatacacatctcctgaaatcatacataatctccaaataaagacaataataacatcataattatacctaacataatacagctatcccttgtacaatcagaagcacactaatccttaacctaaatgctattacataaagttaacaacacttaaatgctgatatgaagtcaatraattttatgtcacatgataaaggaaaaagaaagcaaatgaagatattttcctagtacaagtgtatacatgcacaaacatattcttaacagaataaggaggaaatatatgacaattacagtcttcatttctgcaactggccacgtggttgtagctggtattgatgactaccttcttctactaaccattatgtattccctttgccttctgcaagcacctcagcgggtcatggctttttacctggtggggtgacccaaacctttattctggaaggacctgtgccatttgtagtcctgtctgga

SEQ ID NO: 56822 - DNA, 601 bp, Human
ctactaaccattatgtattccctttgccttctgcaagcacctcagcgggtcatggctttttacctggtggggtgacccaaacctttattctggaaggacctgtgccatttgtagtcctgtctggattgggttggattgggttgttgtagtttcccattgaccttaaacacagaggatggtaatattaagagatgccctatgggatctcctgtattccatgcatgctcttccttgccttcattgtggaatagtagactgatttcaccttgatattctgggtcaattacccagccaacactgmaacccccttcttagcctgttgacttggaggtaggagggccccaattggccaggtggtaatcttaacttccagtttaatggaatcattgttgtatcccttggtgacagcattcttccctctgggaactaagatgtctaggccagcagaacataatgttgtgggaacaggaagcaaaattttgctagtgggtcactagtggtgatggtgagtggtgccacttccgcttccaccccttgattctgggacccgtgaacactggctatgggagaaacagtaccatattttggacactgattcaag

SEQ ID NO: 56823 - DNA, 601 bp, Human
ctctgggaactaagatgtctaggccagcagaacataatgttgtgggaacaggaagcaaaattttgctagtgggtcactagtggtgatggtgagtggtgccacttccgcttccaccccttgattctgggacccgtgaacactggctatgggagaaacagtaccatattttggacactgattcaaggcatacacagccttctggagaactttgccccagtccggcaaagtattgtcacctagttggcattgtaattatgacttcaaaagggcattccacaattctatcaatccacctgcttcrggatgatgggaaacatgataagaccagtgaattccatgagcatgagcccagtgctgcacttctttagctgtaaagtgagtgccttgttcagaggcaatgctgtgtggaataccatgacagcgaataaggcattctgggagttcacggatggtactcttggcagaaacattgggcgtaggatgggcaaatccatatccagaataagtgcctattccattgaggacaaacctctgcctttgcatgatggaagaggtctgatataatcaacctgccaccaagaagctggctgatcaccctgag

SEQ ID NO: 56824 - DNA, 601 bp, Human
agacggagggctcagtgttggtttctgctgctggcaaattgggcactcagcggtggctatagtcaggtcagtccatgttgctgagcctatgcataacctccattcctgccaccatggccactttgttcatgagcccattgagcgatgacagggtggctggggaaagaggctgagtggtgtacacagaatgagtcatcctatccacttgattattaaaatcctcctcagctgaggtcacccgttggtgagcactcacataggatacaaatatcttcacagtttttgaccactcagagaggtycatccacatacctcttccccagattactttgccaccaattttttaatcatgcttcttccaagtccctgaccatccagccaaaccattggctacagcacattaattagtatataattacacatctggccatttcttcttccaagcaagtgcacaaccaggtgccctgctcaaaattctgccccctgggaagacttccctttgctactgtccttcagggatgtcctagaaaggggctgtagtgctgcagctgtccacttttgggtgctacctgcatatcttgcagaatcatctgtgaaccag

SEQ ID NO: 56825 - DNA, 601 bp, Human
gaaagaggctgagtggtgtacacagaatgagtcatcctatccacttgattattaaaatcctcctcagctgaggtcacccgttggtgagcactcacataggatacaaatatcttcacagtttttgaccactcagagaggtccatccacatacctcttccccagattactttgccaccaattttttaatcatgcttcttccaagtccctgaccatccagccaaaccattggctacagcacattaattagtatataattacacatctggccatttcttcttccaagcaagtgcacaaccaggtrccctgctcaaaattctgccccctgggaagacttccctttgctactgtccttcagggatgtcctagaaaggggctgtagtgctgcagctgtccacttttgggtgctacctgcatatcttgcagaatcatctgtgaaccaggccctagtcttctctgcctctgtcaactgatcatggggaactccctgtgaggccatcagtgcaggcttggggagagaaggcagggtggcaggagtggaggccatgggcgtttgagccacttcctcatgcaactgacttgtgcctttaggactggctcgagc

SEQ ID NO: 56826 - DNA, 601 bp, Human
tccccagattactttgccaccaattttttaatcatgcttcttccaagtccctgaccatccagccaaaccattggctacagcacattaattagtatataattacacatctggccatttcttcttccaagcaagtgcacaaccaggtgccctgctcaaaattctgccccctgggaagacttccctttgctactgtccttcagggatgtcctagaaaggggctgtagtgctgcagctgtccacttttgggtgctacctgcatatcttgcagaatcatctgtgaaccaggccctagtcttctctkcctctgtcaactgatcatggggaactccctgtgaggccatcagtgcaggcttggggagagaaggcagggtggcaggagtggaggccatgggcgtttgagccacttcctcatgcaactgacttgtgcctttaggactggctcgagcctgatcatgtatataccacttacagttgatgatggaaggctgctgtgtatgcccaactttatggctagatgggtcagaaagcatccagttcatgaaaggcagtttaggttgcatggtgacttgatgacctacagtcaaacattcagtttctacca

SEQ ID NO: 56827 - DNA, 601 bp, Human
ctttctcaatttgtttagttagatcttcactagaaataagtattagaaattgggaaaagtttatactggttgtattagggttctccaaataaacagaactattaggagatggatagatagatagatacattgattgatagatgacagatagatgaatggatggataggtggataataggctggtagatgatagatggatgatagacagattagatagatagatagatagataatagattagatgatagacagaaagaataagagatttattatgaagaattggcttacgtgattatggagsctgcaaagtcccagtatctgtgagctgcagatccatgatatagttcactttgagtccaaaggccagagaatcacgggagctgatggtacaaaccacagttcaagaactagagagaaaatgagatgagatgtcccagctcaatctgtaaggcagaaaagaagggaaggaattcctcctttctttgctttttgttctattcagccctcaagagattgggtgatgcacagcaatattgaggagggcaatctcttttactgtcatccagaaacaccctcacagacacacccggaaataatgttt

SEQ ID NO: 56828 - DNA, 601 bp, Human
gacagatagatgaatggatggataggtggataataggctggtagatgatagatggatgatagacagattagatagatagatagatagataatagattagatgatagacagaaagaataagagatttattatgaagaattggcttacgtgattatggagcctgcaaagtcccagtatctgtgagctgcagatccatgatatagttcactttgagtccaaaggccagagaatcacgggagctgatggtacaaaccacagttcaagaactagagagaaaatgagatgagatgtcccagctcaayctgtaaggcagaaaagaagggaaggaattcctcctttctttgctttttgttctattcagccctcaagagattgggtgatgcacagcaatattgaggagggcaatctcttttactgtcatccagaaacaccctcacagacacacccggaaataatgtttaatttaggtgcccatggccagtcaagttgacacatacaatttacaatgacactggccttcaactccagtgcacaatgtggtcttcctctttattctccaaattcaagttctcttacttgctacagttgtccatatttcttgg

SEQ ID NO: 56829 - DNA, 601 bp, Human
ctttgagtccaaaggccagagaatcacgggagctgatggtacaaaccacagttcaagaactagagagaaaatgagatgagatgtcccagctcaatctgtaaggcagaaaagaagggaaggaattcctcctttctttgctttttgttctattcagccctcaagagattgggtgatgcacagcaatattgaggagggcaatctcttttactgtcatccagaaacaccctcacagacacacccggaaataatgtttaatttaggtgcccatggccagtcaagttgacacatacaatttacaatsacactggccttcaactccagtgcacaatgtggtcttcctctttattctccaaattcaagttctcttacttgctacagttgtccatatttcttgggaaccatcattctaaaaaatgttgaccaggcctttcttaggcatttctaggaaaaataatataaaatacagaataaagtgaggggagttcagatataatgcatttctcatagaaaaaatgttagtgggatggttagtaaagaactgtgctgtgtaagcaagatgtaagctttaaacaaagtgaagaaaaggggagaagcctagaaa

SEQ ID NO: 56830 - DNA, 601 bp, Human
agagaaaatgagatgagatgtcccagctcaatctgtaaggcagaaaagaagggaaggaattcctcctttctttgctttttgttctattcagccctcaagagattgggtgatgcacagcaatattgaggagggcaatctcttttactgtcatccagaaacaccctcacagacacacccggaaataatgtttaatttaggtgcccatggccagtcaagttgacacatacaatttacaatgacactggccttcaactccagtgcacaatgtggtcttcctctttattctccaaattcaagttctcttacttgctacagttgtccatatttcttgggaaccatcattctaaaaaatgttgaccaggcctttcttaggcatttctaggaaaaataatataaaatacagaataaagtgaggggagttcagatataatgcatttctcatagaaaaaatgttagtgggatggttagtaaagaactgtgctgtgtaagcaagatgtaagctttaaacaaagtgaagaaaaggggagaagcctagaaaaaataacattatacagaaagagaatattcttaaatatgtcaacttctcttatagcaaatttcc

SEQ ID NO: 56831 - DNA, 601 bp, Human
aaggaattcctcctttctttgctttttgttctattcagccctcaagagattgggtgatgcacagcaatattgaggagggcaatctcttttactgtcatccagaaacaccctcacagacacacccggaaataatgtttaatttaggtgcccatggccagtcaagttgacacatacaatttacaatgacactggccttcaactccagtgcacaatgtggtcttcctctttattctccaaattcaagttctcttacttgctacagttgtccatatttcttgggaaccatcattctaaaaaatgytgaccaggcctttcttaggcatttctaggaaaaataatataaaatacagaataaagtgaggggagttcagatataatgcatttctcatagaaaaaatgttagtgggatggttagtaaagaactgtgctgtgtaagcaagatgtaagctttaaacaaagtgaagaaaaggggagaagcctagaaaaaataacattatacagaaagagaatattcttaaatatgtcaacttctcttatagcaaatttcccagtgttcattcctaatacaaggagagtaaaaactccatagaaacctcaaaaa

SEQ ID NO: 56832 - DNA, 601 bp, Human
cagaaacaccctcacagacacacccggaaataatgtttaatttaggtgcccatggccagtcaagttgacacatacaatttacaatgacactggccttcaactccagtgcacaatgtggtcttcctctttattctccaaattcaagttctcttacttgctacagttgtccatatttcttgggaaccatcattctaaaaaatgttgaccaggcctttcttaggcatttctaggaaaaataatataaaatacagaataaagtgaggggagttcagatataatgcatttctcatagaaaaaatgwtagtgggatggttagtaaagaactgtgctgtgtaagcaagatgtaagctttaaacaaagtgaagaaaaggggagaagcctagaaaaaataacattatacagaaagagaatattcttaaatatgtcaacttctcttatagcaaatttcccagtgttcattcctaatacaaggagagtaaaaactccatagaaacctcaaaaagagctttttcttgcaatggggttaggtgtctaaggaataaacaggacttttgaaactttactcttatgtgacagatcagtgaggaggaaacacgctgat

SEQ ID NO: 56833 - DNA, 601 bp, Human
caagttctcttacttgctacagttgtccatatttcttgggaaccatcattctaaaaaatgttgaccaggcctttcttaggcatttctaggaaaaataatataaaatacagaataaagtgaggggagttcagatataatgcatttctcatagaaaaaatgttagtgggatggttagtaaagaactgtgctgtgtaagcaagatgtaagctttaaacaaagtgaagaaaaggggagaagcctagaaaaaataacattatacagaaagagaatattcttaaatatgtcaacttctcttatagcraatttcccagtgttcattcctaatacaaggagagtaaaaactccatagaaacctcaaaaagagctttttcttgcaatggggttaggtgtctaaggaataaacaggacttttgaaactttactcttatgtgacagatcagtgaggaggaaacacgctgataagaagcactgaactactacaaatacgcttcatttgctataaatacacttcattcactgaactataataaaattcacttcaaaaggaatgtgaacaaaatgaaagaacttggatataaaggggcaaaagtgaacaaaaaga

SEQ ID NO: 56834 - DNA, 601 bp, Human
ttcccagtgttcattcctaatacaaggagagtaaaaactccatagaaacctcaaaaagagctttttcttgcaatggggttaggtgtctaaggaataaacaggacttttgaaactttactcttatgtgacagatcagtgaggaggaaacacgctgataagaagcactgaactactacaaatacgcttcatttgctataaatacacttcattcactgaactataataaaattcacttcaaaaggaatgtgaacaaaatgaaagaacttggatataaaggggcaaaagtgaacaaaaagatagraaatgtgtacaaatctaagtaagcattatggaaagcataatgataataattattaaatatgtggaattaaaaacaaagtggaactaaaacacaagagactaataaaatggaaaatggggcaggtagtcagttatttaataaaagtttttaatattcttgaattctggggaggaaagcaaaaagctaattaactttagttttcactaagaatatgtattaaacattgaaaaaaaatctggaaaaataaaattgacaatattcgagttctccagagaaacagaacaaattggaagtgtatat

SEQ ID NO: 56835 - DNA, 601 bp, Human
ttgaaactttactcttatgtgacagatcagtgaggaggaaacacgctgataagaagcactgaactactacaaatacgcttcatttgctataaatacacttcattcactgaactataataaaattcacttcaaaaggaatgtgaacaaaatgaaagaacttggatataaaggggcaaaagtgaacaaaaagatagaaaatgtgtacaaatctaagtaagcattatggaaagcataatgataataattattaaatatgtggaattaaaaacaaagtggaactaaaacacaagagactaataamatggaaaatggggcaggtagtcagttatttaataaaagtttttaatattcttgaattctggggaggaaagcaaaaagctaattaactttagttttcactaagaatatgtattaaacattgaaaaaaaatctggaaaaataaaattgacaatattcgagttctccagagaaacagaacaaattggaagtgtatatatacacagatatattatatattttaaagaattgactcatgagattgtggggtctggctgcagggaataggtgaatattgccgtcttgaatccaaaggcagtttgga

SEQ ID NO: 56836 - DNA, 601 bp, Human
aacttggatataaaggggcaaaagtgaacaaaaagatagaaaatgtgtacaaatctaagtaagcattatggaaagcataatgataataattattaaatatgtggaattaaaaacaaagtggaactaaaacacaagagactaataaaatggaaaatggggcaggtagtcagttatttaataaaagtttttaatattcttgaattctggggaggaaagcaaaaagctaattaactttagttttcactaagaatatgtattaaacattgaaaaaaaatctggaaaaataaaattgacaatattygagttctccagagaaacagaacaaattggaagtgtatatatacacagatatattatatattttaaagaattgactcatgagattgtggggtctggctgcagggaataggtgaatattgccgtcttgaatccaaaggcagtttggaggcagaatttcttcttcttcaggggacctcagtaattcttcttaaggcctctgactgttggatgaggttccccaacatcatggagggtgacctgctttactcaaagtctactgactgaaacgttaatcacatctaaaaaatacattcacagcaac

SEQ ID NO: 56837 - DNA, 601 bp, Human
tcacaaacagctaaacattccaaacaagcagacagagagagaaaaaaataaagaaatgtgaaggggaggagaattttcaatcaattctggaaaagacaaaaaaagagaaaaagagaaacaaatcataaatataaaatataatggaattaaatccatatacaacaatcagggtaattatcaccagctgcctcaagaaataacccctgaaatctcacatgatggacataattcaagtttatgtctcacatcacaacacaatgtgagttataccaccttttgcatcttgtagtgacaccatacrgtgtagcctccaaggcagggaagagaaaaaatgaagagacatgtaggcccctaccatactggctcatgaagcctggaccacgtctggtctgagtcattgaccagaagtagccgtgtgccccaagctaactgtaagggaggtctggaaaagtaggaggcacataggatatttgatgagcactaactatctctgcttcaggttgtcttcataataaatgcaaacattaaaattgacaggttactatgattttcatattggattaaaatgtctaaaacaaagggattcgtctatgtatgactt

SEQ ID NO: 56838 - DNA, 601 bp, Human
tgtgaaggggaggagaattttcaatcaattctggaaaagacaaaaaaagagaaaaagagaaacaaatcataaatataaaatataatggaattaaatccatatacaacaatcagggtaattatcaccagctgcctcaagaaataacccctgaaatctcacatgatggacataattcaagtttatgtctcacatcacaacacaatgtgagttataccaccttttgcatcttgtagtgacaccatacagtgtagcctccaaggcagggaagagaaaaaatgaagagacatgtaggcccctaccrtactggctcatgaagcctggaccacgtctggtctgagtcattgaccagaagtagccgtgtgccccaagctaactgtaagggaggtctggaaaagtaggaggcacataggatatttgatgagcactaactatctctgcttcaggttgtcttcataataaatgcaaacattaaaattgacaggttactatgattttcatattggattaaaatgtctaaaacaaagggattcgtctatgtatgacttacacaaatactgcaaatcttaggggaacagaaagactgaaaatgagagataagata

SEQ ID NO: 56839 - DNA, 601 bp, Human
acaccatacagtgtagcctccaaggcagggaagagaaaaaatgaagagacatgtaggcccctaccatactggctcatgaagcctggaccacgtctggtctgagtcattgaccagaagtagccgtgtgccccaagctaactgtaagggaggtctggaaaagtaggaggcacataggatatttgatgagcactaactatctctgcttcaggttgtcttcataataaatgcaaacattaaaattgacaggttactatgattttcatattggattaaaatgtctaaaacaaagggattcgtctakgtatgacttacacaaatactgcaaatcttaggggaacagaaagactgaaaatgagagataagatacactatgcaaactctaaccagaagaaagctggtatgctaccattaatagcaatcaaaaagactttaatttttttaaaagaattattaaggacaaagaaagtgatcatgatagaataaaaggaacaaggaaaactaaaaaattatgagcctgcaaggtcataataacaaagcctatggataaataaagataaatatatcagaatgagaacattttcatatatataatagggaatga

SEQ ID NO: 56840 - DNA, 601 bp, Human
ctgctcaagatgtttaaaaaagtacacagaaagaaataaaaataaaagcagaaattaatgacctaaggaaaggcattagacagggttgacaaaacagcaagttgattcttagaataaactagcaaataaacagaagacaagaacaattaagcaaagagagacaacacaaatgaataggatcaagaatgaaaaggggatcataactgtagatacattatagattgaaaaataaaaatggatatattggaggatatgcgcaattttattcaaacacatttgaatacttaggtgaagtaaacartaagtttagagcaaaatttactcaaaaagaaatagtacacctgagaactataaccgttaaataaattgcatcagtagttaatacaacaaaataacaatatgtacaaaaatgtaaaggacccattatgcaatttgttcccaagaatggaaaaagaagaaaaatttcctcagcttattttatgaggctgatacaatcttgatggcaagccctacagaggacagtactacaaagaaaaactataggccagttatttaaatagagaagctacaaatgaaatattataaaacccagttcaaatgt

SEQ ID NO: 56841 - DNA, 601 bp, Human
gttgacaaaacagcaagttgattcttagaataaactagcaaataaacagaagacaagaacaattaagcaaagagagacaacacaaatgaataggatcaagaatgaaaaggggatcataactgtagatacattatagattgaaaaataaaaatggatatattggaggatatgcgcaattttattcaaacacatttgaatacttaggtgaagtaaacagtaagtttagagcaaaatttactcaaaaagaaatagtacacctgagaactataaccgttaaataaattgcatcagtagttaatasaacaaaataacaatatgtacaaaaatgtaaaggacccattatgcaatttgttcccaagaatggaaaaagaagaaaaatttcctcagcttattttatgaggctgatacaatcttgatggcaagccctacagaggacagtactacaaagaaaaactataggccagttatttaaatagagaagctacaaatgaaatattataaaacccagttcaaatgtacatattttaaagatctgtaaatatacagtaaaacattaacatttgccagatacagatgatgggaatagaggtgtctgtattaa

SEQ ID NO: 56842 - DNA, 601 bp, Human
ccgttaaataaattgcatcagtagttaatacaacaaaataacaatatgtacaaaaatgtaaaggacccattatgcaatttgttcccaagaatggaaaaagaagaaaaatttcctcagcttattttatgaggctgatacaatcttgatggcaagccctacagaggacagtactacaaagaaaaactataggccagttatttaaatagagaagctacaaatgaaatattataaaacccagttcaaatgtacatattttaaagatctgtaaatatacagtaaaacattaacatttgccagatayagatgatgggaatagaggtgtctgtattaatttctaatcgtatctatcttatttcctacttaaatagtttaattaaaatgaacctcagaggagatagaaaatctgtcctgcaataaaatctgttctaaaataataaagaaaataggtctaaaatgggtctggaaatgaaacaacaaccctcatcctttacaccagcaagaagttctaaatttctttctttttctaaattcatgatgcatacatgttttaatttcttttaaatgatcagaggctgataattgcaagcaacaatcccctaac

SEQ ID NO: 56843 - DNA, 601 bp, Human
cgttaaataaattgcatcagtagttaatacaacaaaataacaatatgtacaaaaatgtaaaggacccattatgcaatttgttcccaagaatggaaaaagaagaaaaatttcctcagcttattttatgaggctgatacaatcttgatggcaagccctacagaggacagtactacaaagaaaaactataggccagttatttaaatagagaagctacaaatgaaatattataaaacccagttcaaatgtacatattttaaagatctgtaaatatacagtaaaacattaacatttgccagatacrgatgatgggaatagaggtgtctgtattaatttctaatcgtatctatcttatttcctacttaaatagtttaattaaaatgaacctcagaggagatagaaaatctgtcctgcaataaaatctgttctaaaataataaagaaaataggtctaaaatgggtctggaaatgaaacaacaaccctcatcctttacaccagcaagaagttctaaatttctttctttttctaaattcatgatgcatacatgttttaatttcttttaaatgatcagaggctgataattgcaagcaacaatcccctaacc

SEQ ID NO: 56844 - DNA, 598 bp, Human
ctacagaggacagtactacaaagaaaaactataggccagttatttaaatagagaagctacaaatgaaatattataaaacccagttcaaatgtacatattttaaagatctgtaaatatacagtaaaacattaacatttgccagatacagatgatgggaatagaggtgtctgtattaatttctaatcgtatctatcttatttcctacttaaatagtttaattaaaatgaacctcagaggagatagaaaatctgtcctgcaataaaatctgttctaaaataataaagaaaataggtctaaaatrggtctggaaatgaaacaacaaccctcatcctttacaccagcaagaagttctaaatttctttctttttctaaattcatgatgcatacatgttttaatttcttttaaatgatcagaggctgataattgcaagcaacaatcccctaacctaacttttctctcaactaagctcacagctccaggatcaacaattccaaatctttcaaatattcttcttttactacatctcttagtaatattattgtgccatcacgtatttcattaagtggggcattatctatttaattactgctatgatga

SEQ ID NO: 56845 - DNA, 601 bp, Human
gtgtttcaaccctgtttgtgttgtagctctctcatttccaccatttgcgggggggtcccaagttcttgtcccacatcctggaagaatgaggtttgcagacaactggagggttagcaaggtgaagaggtgctttattgagtgacagtgcaactctcaggaggcctgaaatgggtagctccgttccacaggcaggtaattccagcatctgtgcagcaccctcaacagaggtgagacacacagtgggtagctcctatccacaggtagatcatcctgttgtctgcccacgtctggctgagtccgrggttttttatgggcctcagaggggaggaagtgtatgctgattggtccatgggtggccatgagctggcccaaaaaaagcaccataagttctcactccagtttgtggaaccgacagtccagcccccttccttcaggcagtccctggcttgaaggtggagcttcactgagggcccacccctttccacccaggaacctgtatgcctcctgccaccaccaacctgccatccacggcgcccactggcacccaggctgttcatgcctagggtcaccttcaggcccatgcagagccaccctcaactcc

SEQ ID NO: 56846 - DNA, 601 bp, Human
ttgtgttgtagctctctcatttccaccatttgcgggggggtcccaagttcttgtcccacatcctggaagaatgaggtttgcagacaactggagggttagcaaggtgaagaggtgctttattgagtgacagtgcaactctcaggaggcctgaaatgggtagctccgttccacaggcaggtaattccagcatctgtgcagcaccctcaacagaggtgagacacacagtgggtagctcctatccacaggtagatcatcctgttgtctgcccacgtctggctgagtccggggttttttatgggcytcagaggggaggaagtgtatgctgattggtccatgggtggccatgagctggcccaaaaaaagcaccataagttctcactccagtttgtggaaccgacagtccagcccccttccttcaggcagtccctggcttgaaggtggagcttcactgagggcccacccctttccacccaggaacctgtatgcctcctgccaccaccaacctgccatccacggcgcccactggcacccaggctgttcatgcctagggtcaccttcaggcccatgcagagccaccctcaactcccccttggcctcccta

SEQ ID NO: 56847 - DNA, 601 bp, Human
agaatgaggtttgcagacaactggagggttagcaaggtgaagaggtgctttattgagtgacagtgcaactctcaggaggcctgaaatgggtagctccgttccacaggcaggtaattccagcatctgtgcagcaccctcaacagaggtgagacacacagtgggtagctcctatccacaggtagatcatcctgttgtctgcccacgtctggctgagtccggggttttttatgggcctcagaggggaggaagtgtatgctgattggtccatgggtggccatgagctggcccaaaaaaagcaccrtaagttctcactccagtttgtggaaccgacagtccagcccccttccttcaggcagtccctggcttgaaggtggagcttcactgagggcccacccctttccacccaggaacctgtatgcctcctgccaccaccaacctgccatccacggcgcccactggcacccaggctgttcatgcctagggtcaccttcaggcccatgcagagccaccctcaactcccccttggcctccctaatgtgctccttggcacccaaaatccagaaggggccaagatagtagggggctagagtgtcagtgctgc

SEQ ID NO: 56848 - DNA, 601 bp, Human
tgggtagctcctatccacaggtagatcatcctgttgtctgcccacgtctggctgagtccggggttttttatgggcctcagaggggaggaagtgtatgctgattggtccatgggtggccatgagctggcccaaaaaaagcaccataagttctcactccagtttgtggaaccgacagtccagcccccttccttcaggcagtccctggcttgaaggtggagcttcactgagggcccacccctttccacccaggaacctgtatgcctcctgccaccaccaacctgccatccacggcgcccactgrcacccaggctgttcatgcctagggtcaccttcaggcccatgcagagccaccctcaactcccccttggcctccctaatgtgctccttggcacccaaaatccagaaggggccaagatagtagggggctagagtgtcagtgctgccccgagcatatgcacacctggctgggttgcaacagcctcagctttgctctgaaatcagcctgggtgccgggaacagtgagagaccaggaagaaggagcgggcacttctgagcctgtaggggaagagaggtggctgagggcacagggatgcctgggtcc

SEQ ID NO: 56849 - DNA, 601 bp, Human
ctccagtttgtggaaccgacagtccagcccccttccttcaggcagtccctggcttgaaggtggagcttcactgagggcccacccctttccacccaggaacctgtatgcctcctgccaccaccaacctgccatccacggcgcccactggcacccaggctgttcatgcctagggtcaccttcaggcccatgcagagccaccctcaactcccccttggcctccctaatgtgctccttggcacccaaaatccagaaggggccaagatagtagggggctagagtgtcagtgctgccccgagcatakgcacacctggctgggttgcaacagcctcagctttgctctgaaatcagcctgggtgccgggaacagtgagagaccaggaagaaggagcgggcacttctgagcctgtaggggaagagaggtggctgagggcacagggatgcctgggtccacagctggctgggtggctgcagctgcacccagtagggcagggttcccccaccttcaactcggaaggggacatggctcccacttgttcctggctcccaccagctctgtggagcacaaagccagacaggctgacactgccattactgagaccctc

SEQ ID NO: 56850 - DNA, 601 bp, Human
gtccagattttcagaattgataagatatttatattaccctaagagatacggaagttgaacagaataaaaaaattcaaaataaaagtaaataaaattactttctttccctgtttagtttgagatcatgtgtaaatatcagtgaacgtgatgtcatataggatttttttttattgatcagaattaggttcaagttgtgttctggaaacttctaattaaattgagggaagatgctagcaggccagaatttgggaattagatgatctggctccaaattcaatacatattgtctatgtaattagckgtgtcacctaatgtaccaataatgccttttcaagaaacactgtgcagtctgttctgattcctccattggcttaattcctataataaatatagtttccaaagtttataacttaattttcagaatttatttattttaattgacagataaaagtggtatatatttatcatgtacaacatgatgctttgaaataagtatacattgtggaatggctaaatcgaggtatttaaaaatatgcactacctcacatactggtcatttttctgtgttgagaacacttaaaatctactctcttagcaaagc

SEQ ID NO: 56851 - DNA, 601 bp, Human
ttaaaagtctattggaagcagagaaataaattttttgacccagccttagatgtatttaaaagttcagggcataaaatgatagatgtctcagggtttgtgtcatcagtcggaaacacagaactcttttgaacaatgccacaatgcaatctaagtttgatctaattttcttcaagacaataatgctcttggtgccatcctacctgctctttatgatttctacccgtaggtagaataatcaagaggtgagattgatgttgtttttgattctggacattaactagagggaaaattcgaagccctstaagaatggtatctaacttaatagacacctctccattacctttactcaaaactaagactctttgtggtatgggcccaccccacctctagtagccagctgctagtccagtgtctgtctcactgaagcagtctagtggtacacataggtactgagcaattatgtctgtcatgctgtaattgaggaaaaccatccttacttcattttatatttttgaatgctcccttgattgtccttcttggtgttcccataaagctaaaaattcacactcacgaattttaaattatcatgagcaatttgggg

SEQ ID NO: 56852 - DNA, 601 bp, Human
tttaataacctatagtacttaaaaatgtacagtactatataaagcaccttaaaaattgatgcatggtgattttcttattttaaaattgtgtatgattttttaaattattataaaagcagcttatgtctattatagaaaataggaaatacagaaaagcaagaagaagaaaatataaaatgtgcatacgagtaattacttttgtaatatcattgtatatctactcatatcttttcctatgcaaatagtttttctacaaatgggtgatatttatataactgtttcataacttactatgggaatkaacatcacatacgtattttaaaaaatattctcaaaaatatatttttaaaatgtatattgaactagattctgagaatttacatcattattatagtaagaacattatccttgattttgattcatagtctaacataccaaactctaaatttcttctgttactcactttacataaacacattgcagccagtcaccaacccttacatatatccctgcacagtttgagcagttttctttattgaaaatatttttaatttaaaatcatttaagttttatattatcttggcacattaacccctgtgga

SEQ ID NO: 56853 - DNA, 601 bp, Human
aaatatttttaatttaaaatcatttaagttttatattatcttggcacattaacccctgtggaaatgtgtaagacttctcttctaaaataaattatttcataaagagagagagtaatagaataagtcataaaccatgctgatgaatttttagttactactgtctttaaaaagtaaacaaaaaaacagaaaataaatattttacatcttttacagccaactctttcaatgagttcaaaaatttcatctctaataaaaaagtaatttggggaacatttaggaaaaaagcaaaatatataaagcaatgtaaacaataacttttaaacttgcttgtttagaaaatcactggggtacaggttagtcagcctgataaactctaacttgccttcacacctccctcctccagcagagcctcctctgacagccaaacatctaggcatttctgtgttccattatggtaatgattgtctttttttataagtgactatatttgtttgtctttcctcttccctccactccagttccattagggaaggcatagtctttccattttgaatatttggtgcttgagataaataaaaagttttgttgggtaaataaatca

SEQ ID NO: 56854 - DNA, 601 bp, Human
ttaatctgagtctaaacaaatatatctttgcttggagataattgtggctcagagattgtcatttagaagattgtgttttgccataccgctttaagatgcattttttaaaagaagcagtgttctttctcatttcagcacttgggagatacaggaaatgctcccctctcagtccacaactagagtgaaatttgcttaaggataaagtcaggggatgtgtttagttcttaatttgcttgacttctgtagcacgtcataatgctgctcagttatgtccttacaacaccgccagttatcatgcatygagtcacttctgcatctcttaatttccatagtgttatgctctcctaatttctccttttcctctgtggaatgccagtcaccttgccagctccactttctctgcctactccctaaacattgaagttcctaagaactctgttctagatcttcttctcataccgtaataaacagtctcctaactttaactaccgaatatgtgctaataatttacaattctatatctgcagcccagagctctttcctaaaggcaaactctgtgtaccaactgccttctggatccctccactccattattctatgg

SEQ ID NO: 56855 - DNA, 601 bp, Human
aactgtgtatttctagtatgcataatagtgactagctcaaatgaggaaatacttattttttacaataaatggtgttggcttatcttacttatcttagaaagagaagaggttttaaaatcatttatatttggcatgttttggtctcagtagaagctgatatgaaattacaagttctatctcgattataagtaaaattttaatagtacaattcttcaggctgtgtattacaggtgaaataaaactccctacacacataattctgctcagcaggtacctcttattacaatctgaagaatgactrtaagaagccaaaacctgtgttcctattggacaaatggactcaatcccgtgactttgcggtcactccttcctatctcatacccttgcccagggctgggaatagggaggaagggagcgaggtgattcatgcaagtgcaagaaccaatcctgtctttaagattttaataataccagggccgtgccctcgcctctatttccccacaaacactggtattataaaaatgaagaaagaattttattttcagccattttttttccaagagaaaaagaaatctaaagacaagcattgtaggaagggtta

SEQ ID NO: 56856 - DNA, 601 bp, Human
ctacacacataattctgctcagcaggtacctcttattacaatctgaagaatgactgtaagaagccaaaacctgtgttcctattggacaaatggactcaatcccgtgactttgcggtcactccttcctatctcatacccttgcccagggctgggaatagggaggaagggagcgaggtgattcatgcaagtgcaagaaccaatcctgtctttaagattttaataataccagggccgtgccctcgcctctatttccccacaaacactggtattataaaaatgaagaaagaattttattttcagscattttttttccaagagaaaaagaaatctaaagacaagcattgtaggaagggttaggagacagaaatgttcattagtttaaatttattttttttgtagttcaggtagtacattatttaaagtaatgaaaacccacaaactactcaagtaataattcctctagaaaaccaagccaaggctatgacggagatgggaatgttttcttgctacattatgacatttctctgatttgtggccaattacggaggttataaaatggctgttaatcagggaaatgccatatattactaccaggaactgc

SEQ ID NO: 56857 - DNA, 601 bp, Human
gtgttcctattggacaaatggactcaatcccgtgactttgcggtcactccttcctatctcatacccttgcccagggctgggaatagggaggaagggagcgaggtgattcatgcaagtgcaagaaccaatcctgtctttaagattttaataataccagggccgtgccctcgcctctatttccccacaaacactggtattataaaaatgaagaaagaattttattttcagccattttttttccaagagaaaaagaaatctaaagacaagcattgtaggaagggttaggagacagaaatgttcrttagtttaaatttattttttttgtagttcaggtagtacattatttaaagtaatgaaaacccacaaactactcaagtaataattcctctagaaaaccaagccaaggctatgacggagatgggaatgttttcttgctacattatgacatttctctgatttgtggccaattacggaggttataaaatggctgttaatcagggaaatgccatatattactaccaggaactgctgaaataggccctacagagcaaaactcttgacagcagctattaaaatagagatttagtcatttctctctcta

SEQ ID NO: 56858 - DNA, 601 bp, Human
caaatggactcaatcccgtgactttgcggtcactccttcctatctcatacccttgcccagggctgggaatagggaggaagggagcgaggtgattcatgcaagtgcaagaaccaatcctgtctttaagattttaataataccagggccgtgccctcgcctctatttccccacaaacactggtattataaaaatgaagaaagaattttattttcagccattttttttccaagagaaaaagaaatctaaagacaagcattgtaggaagggttaggagacagaaatgttcattagtttaaatttmttttttttgtagttcaggtagtacattatttaaagtaatgaaaacccacaaactactcaagtaataattcctctagaaaaccaagccaaggctatgacggagatgggaatgttttcttgctacattatgacatttctctgatttgtggccaattacggaggttataaaatggctgttaatcagggaaatgccatatattactaccaggaactgctgaaataggccctacagagcaaaactcttgacagcagctattaaaatagagatttagtcatttctctctctatggtgcctggagtt

SEQ ID NO: 56859 - DNA, 601 bp, Human
cttgcccagggctgggaatagggaggaagggagcgaggtgattcatgcaagtgcaagaaccaatcctgtctttaagattttaataataccagggccgtgccctcgcctctatttccccacaaacactggtattataaaaatgaagaaagaattttattttcagccattttttttccaagagaaaaagaaatctaaagacaagcattgtaggaagggttaggagacagaaatgttcattagtttaaatttattttttttgtagttcaggtagtacattatttaaagtaatgaaaacccacaractactcaagtaataattcctctagaaaaccaagccaaggctatgacggagatgggaatgttttcttgctacattatgacatttctctgatttgtggccaattacggaggttataaaatggctgttaatcagggaaatgccatatattactaccaggaactgctgaaataggccctacagagcaaaactcttgacagcagctattaaaatagagatttagtcatttctctctctatggtgcctggagttagaaggaataaaaatggtgaggccagtataccctccatatttctaatttgt

SEQ ID NO: 56860 - DNA, 601 bp, Human
gggctgggaatagggaggaagggagcgaggtgattcatgcaagtgcaagaaccaatcctgtctttaagattttaataataccagggccgtgccctcgcctctatttccccacaaacactggtattataaaaatgaagaaagaattttattttcagccattttttttccaagagaaaaagaaatctaaagacaagcattgtaggaagggttaggagacagaaatgttcattagtttaaatttattttttttgtagttcaggtagtacattatttaaagtaatgaaaacccacaaactactcragtaataattcctctagaaaaccaagccaaggctatgacggagatgggaatgttttcttgctacattatgacatttctctgatttgtggccaattacggaggttataaaatggctgttaatcagggaaatgccatatattactaccaggaactgctgaaataggccctacagagcaaaactcttgacagcagctattaaaatagagatttagtcatttctctctctatggtgcctggagttagaaggaataaaaatggtgaggccagtataccctccatatttctaatttgttgcttggt

SEQ ID NO: 56861 - DNA, 601 bp, Human
aaaagtttgagaatattaagattttaaaattatacatcttaccttatattgactaacttttcagttttatttccttcttaatttatccccaatttttgtctttgcccaagataaatgaaattatttaattacttagaaaaataataggtaacatgttggccaggtgcggtggctcgcacctgtaatcctaacacttcgggagaccgaggtgggcagatcacctgaggtaaggagtttgagaccagcatggccagcgtggtgaaaccctgtctctactaaaaacgcaaaaattagctgggcwtggtggtgggtgcctgtaatcccagctactcaggaggctgaggtaggagaattgctggaacccaggatacggaggttacagtgagctgagattgcgccactgcacttcagcctgggcaacagagtgagactctatctaaaaaaaaaaaaaaaaaactaggtaacatacctataaaatagataacacaggaaataaaaagacctattccctggagatctatgacagctcattttaaaggaggcggtttgtctcatagcactgtagcctgtggtatataattacagttaacccttgaccaat

SEQ ID NO: 56862 - DNA, 601 bp, Human
tacatcttaccttatattgactaacttttcagttttatttccttcttaatttatccccaatttttgtctttgcccaagataaatgaaattatttaattacttagaaaaataataggtaacatgttggccaggtgcggtggctcgcacctgtaatcctaacacttcgggagaccgaggtgggcagatcacctgaggtaaggagtttgagaccagcatggccagcgtggtgaaaccctgtctctactaaaaacgcaaaaattagctgggcatggtggtgggtgcctgtaatcccagctactcrggaggctgaggtaggagaattgctggaacccaggatacggaggttacagtgagctgagattgcgccactgcacttcagcctgggcaacagagtgagactctatctaaaaaaaaaaaaaaaaaactaggtaacatacctataaaatagataacacaggaaataaaaagacctattccctggagatctatgacagctcattttaaaggaggcggtttgtctcatagcactgtagcctgtggtatataattacagttaacccttgaccaatgcaggggttggagagcatggacccctgcacag

SEQ ID NO: 56863 - DNA, 601 bp, Human
caggaaatgataccgttccgaatcattgtcaccaaattcaatgattgcctgcataatgcagaaaattggagggatttttctaagaagtacaaagattgggtgtagcaaccttatcaaatcaatttgctggagacctaggagagaaatacagttgtagatttcaacttctattcttcctcactcgggtgctcttctttcctacccaggtctcaagatcctgcactgggtatttaggttgacttaggggacagggtctttagaaatctcaagaagccaaaatctgaacacagtcacttatgcytgtaatcccaggtcctttcaaaagtaatcacatttccatgaatttcacccttgtgaatggggcattctttcagggcatttatttgtgccctattcatattaataaaaaataaaaattccatttgagaaactcaactggatggaatttgaatagtcaaattaaacatttccattaaaatttataaaaatcatcccgatatttagttgaaaagtgaggaatatatacataggtatacatatgtttaggaaatataaaaacgaaataaacttaggttctggaccaagtaatttaaataaaaaa

SEQ ID NO: 56864 - DNA, 601 bp, Human
cttctttcctacccaggtctcaagatcctgcactgggtatttaggttgacttaggggacagggtctttagaaatctcaagaagccaaaatctgaacacagtcacttatgcttgtaatcccaggtcctttcaaaagtaatcacatttccatgaatttcacccttgtgaatggggcattctttcagggcatttatttgtgccctattcatattaataaaaaataaaaattccatttgagaaactcaactggatggaatttgaatagtcaaattaaacatttccattaaaatttataaaaatcrtcccgatatttagttgaaaagtgaggaatatatacataggtatacatatgtttaggaaatataaaaacgaaataaacttaggttctggaccaagtaatttaaataaaaaaggaataaagtcataaatagcattattataataaaaactggtaaaacacaccaggacaattttcaaaccaatgtcagtgtgttaccttttacttactgcctatggtaaatccagcactttctcatacatctcccagtttatttctcatatcagtcacatgaaggaagatgttttctttatttgccatatgt

SEQ ID NO: 56865 - DNA, 601 bp, Human
agaaatctcaagaagccaaaatctgaacacagtcacttatgcttgtaatcccaggtcctttcaaaagtaatcacatttccatgaatttcacccttgtgaatggggcattctttcagggcatttatttgtgccctattcatattaataaaaaataaaaattccatttgagaaactcaactggatggaatttgaatagtcaaattaaacatttccattaaaatttataaaaatcatcccgatatttagttgaaaagtgaggaatatatacataggtatacatatgtttaggaaatataaaaasgaaataaacttaggttctggaccaagtaatttaaataaaaaaggaataaagtcataaatagcattattataataaaaactggtaaaacacaccaggacaattttcaaaccaatgtcagtgtgttaccttttacttactgcctatggtaaatccagcactttctcatacatctcccagtttatttctcatatcagtcacatgaaggaagatgttttctttatttgccatatgtaaaaagggacagaaatgacatttgaacccacatcttccaactctgtgtcctatagtgatttcattgta

SEQ ID NO: 56866 - DNA, 601 bp, Human
tgtaatcccaggtcctttcaaaagtaatcacatttccatgaatttcacccttgtgaatggggcattctttcagggcatttatttgtgccctattcatattaataaaaaataaaaattccatttgagaaactcaactggatggaatttgaatagtcaaattaaacatttccattaaaatttataaaaatcatcccgatatttagttgaaaagtgaggaatatatacataggtatacatatgtttaggaaatataaaaacgaaataaacttaggttctggaccaagtaatttaaataaaaaakgaataaagtcataaatagcattattataataaaaactggtaaaacacaccaggacaattttcaaaccaatgtcagtgtgttaccttttacttactgcctatggtaaatccagcactttctcatacatctcccagtttatttctcatatcagtcacatgaaggaagatgttttctttatttgccatatgtaaaaagggacagaaatgacatttgaacccacatcttccaactctgtgtcctatagtgatttcattgtaccagactagatttcagagaaatactgtgtagcagttttatttt

SEQ ID NO: 56867 - DNA, 601 bp, Human
aattccatttgagaaactcaactggatggaatttgaatagtcaaattaaacatttccattaaaatttataaaaatcatcccgatatttagttgaaaagtgaggaatatatacataggtatacatatgtttaggaaatataaaaacgaaataaacttaggttctggaccaagtaatttaaataaaaaaggaataaagtcataaatagcattattataataaaaactggtaaaacacaccaggacaattttcaaaccaatgtcagtgtgttaccttttacttactgcctatggtaaatccagsactttctcatacatctcccagtttatttctcatatcagtcacatgaaggaagatgttttctttatttgccatatgtaaaaagggacagaaatgacatttgaacccacatcttccaactctgtgtcctatagtgatttcattgtaccagactagatttcagagaaatactgtgtagcagttttattttgagatcgtacatagttagttctaatataactaagccctaatttatatttagcatcatgtcagaaacatgataaacaagagtaactgctcattattaatgcaagtgacttgcaa

SEQ ID NO: 56868 - DNA, 601 bp, Human
tcctatagtgatttcattgtaccagactagatttcagagaaatactgtgtagcagttttattttgagatcgtacatagttagttctaatataactaagccctaatttatatttagcatcatgtcagaaacatgataaacaagagtaactgctcattattaatgcaagtgacttgcaactctgccctgcgatttttattctggatatatctatcttgtgccatttcaatgggcatgtgacaaaggaaaattacactgtcattgtgttcccagtcgacccttgctactctgctgcttccattmcctcattgtgagtcctgcttttgccaaactaattctagcacatttttcttctactctatgaggaggagatgagaaagggagagccagacttaaagacgtatgtgtgtgtagcctttgagttttggtggatgtgatctttagagagaaagtagaatgactaggcttctgttattgggtttgagagctgaaggaataaggagagggaatctagaaaataaaactatggattataaattaaatcttcttcttattctccagaaatcacaagtaaaaaaattcagttggattttcttttaacta

SEQ ID NO: 56869 - DNA, 601 bp, Human
gtgattgacagaggagaaaatccaattacttggaaagtatattttgtgggcttagaattgaaaataataatatattagtgactgaactagacatattgatgttttagagccgtgctttgctggaatattttatgctttgtttttcagtgatgtcaggtctttggcttggaatttaacaacagacactttaaacaatgttatgtgcttatattagtataatctgtagtataacagaagtttaaggtgtctgcctataaaaccctttatatgaagtggagtgaatcattaattaatatgtccmgtactcttcttcacatccagacaccgatagttcagaatcctccatctatccacctttccctttgctattcttcacagatgcaggccaacaaagatgaggatagttctccagctgcccatggcctgcacagttcctctaatgagccacatgcacaacctctgagaggggtgtgcacacagtcaaatcaagactgctgtagctctattctttggggcgtattctctcccacctgccttctctgggtaccaggaaagtgatgaaaatcagtcttggtgttgacaaataacatgaagatagcaa

SEQ ID NO: 56870 - DNA, 601 bp, Human
gattgcacctgtaccattgtatgaacatgctgtgtggatataaacagcactttaatcttattagggtatttttattcccccctccttttttttattacaaatgaagagctaatgagtatccccaaagataaatcttttacaggtatattgaagggtaaatttctatcagtagaattgccaaaccaaatacatgtctatttaaaattctaataaacttattaacttgctcttcaaacaatggaatcaatctgcacgtccactagcactcttgtgaacacttggcattatcatacatttaatwttccccaatctcaaaaataagaaatgacatcttactgttgcttagttttacagttctttatgataatcttgagtgctttttacgaatttcataaatgattatgtatgtttattttattgtgaactacgtattcttatattttcctcattatccttaaaaatatggaacactttgcatatttgcctgccagttttgcacatagacaatgctattccactctgaataattacaacttggttatatatgttgcttaggtgaggcttctctgatttctgtaactgtgaccaatttctttaagac

SEQ ID NO: 56871 - DNA, 601 bp, Human
tgaatgacactttgggaaagttatcagctattccaaatggtaagcattcaggacactaccaactgtgtcagttgacctgaagttttgaagactgttgttaacttttaccatttttttctaagattattctggtactattatctggaaattagatactgtttttcttactcatgaattcttctttgtgagaatgagaaactaaaccatactttgcattatggtattttttatcttttattgcctttagccagtatccttaggaatgtgttacagaaaggaagatatagacatcttattattrtaaaactcatccttcagtattggcaggggattggttccaggacccccccccacagatatcaaaattcttgaatactcaagtcccttttataaaatggcatagtatttgcatataacctatgcatagcctcccatatactttaatccctagatcatttataatacctaatataatgtaaatgctatgtaaattcttacagtgtattgtttatgaaataatgacaagaaaaaagtttgtccatgttcagtacagacacaaccattttttcccctaaatatccaaatatccaactctccaagg

SEQ ID NO: 56872 - DNA, 601 bp, Human; identical to SEQ ID NO: 18896

SEQ ID NO: 56873 - DNA, 601 bp, Human; identical to SEQ ID NO: 18897

SEQ ID NO: 56874 - DNA, 601 bp, Human; identical to SEQ ID NO: 18898

SEQ ID NO: 56875 - DNA, 601 bp, Human; identical to SEQ ID NO: 18899

SEQ ID NO: 56876 - DNA, 601 bp, Human; identical to SEQ ID NO: 18900

SEQ ID NO: 56877 - DNA, 601 bp, Human; identical to SEQ ID NO: 18901

SEQ ID NO: 56878 - DNA, 601 bp, Human; identical to SEQ ID NO: 18902

SEQ ID NO: 56879 - DNA, 601 bp, Human; identical to SEQ ID NO: 18903

SEQ ID NO: 56880 - DNA, 601 bp, Human; identical to SEQ ID NO: 18904

SEQ ID NO: 56881 - DNA, 601 bp, Human; identical to SEQ ID NO: 18905

SEQ ID NO: 56882 - DNA, 601 bp, Human; identical to SEQ ID NO: 18906

SEQ ID NO: 56883 - DNA, 601 bp, Human; identical to SEQ ID NO: 18907

SEQ ID NO: 56884 - DNA, 601 bp, Human; identical to SEQ ID NO: 18908

SEQ ID NO: 56885 - DNA, 601 bp, Human; identical to SEQ ID NO: 18909

SEQ ID NO: 56886 - DNA, 601 bp, Human; identical to SEQ ID NO: 18910

SEQ ID NO: 56887 - DNA, 601 bp, Human; identical to SEQ ID NO: 18911

SEQ ID NO: 56888 - DNA, 601 bp, Human; identical to SEQ ID NO: 18912

SEQ ID NO: 56889 - DNA, 601 bp, Human; identical to SEQ ID NO: 18913

SEQ ID NO: 56890 - DNA, 601 bp, Human; identical to SEQ ID NO: 18914

SEQ ID NO: 56891 - DNA, 601 bp, Human; identical to SEQ ID NO: 18915

SEQ ID NO: 56892 - DNA, 601 bp, Human; identical to SEQ ID NO: 18916

SEQ ID NO: 56893 - DNA, 601 bp, Human; identical to SEQ ID NO: 18917

SEQ ID NO: 56894 - DNA, 601 bp, Human; identical to SEQ ID NO: 18918

SEQ ID NO: 56895 - DNA, 601 bp, Human; identical to SEQ ID NO: 18919

SEQ ID NO: 56896 - DNA, 601 bp, Human; identical to SEQ ID NO: 18920

SEQ ID NO: 56897 - DNA, 601 bp, Human; identical to SEQ ID NO: 18921

SEQ ID NO: 56898 - DNA, 601 bp, Human; identical to SEQ ID NO: 18922

SEQ ID NO: 56899 - DNA, 601 bp, Human; identical to SEQ ID NO: 18923

SEQ ID NO: 56900 - DNA, 601 bp, Human; identical to SEQ ID NO: 18924

SEQ ID NO: 56901 - DNA, 601 bp, Human; identical to SEQ ID NO: 18925

SEQ ID NO: 56902 - DNA, 601 bp, Human; identical to SEQ ID NO: 18926

SEQ ID NO: 56903 - DNA, 601 bp, Human; identical to SEQ ID NO: 18927

SEQ ID NO: 56904 - DNA, 601 bp, Human; identical to SEQ ID NO: 18928

SEQ ID NO: 56905 - DNA, 601 bp, Human; identical to SEQ ID NO: 18929

SEQ ID NO: 56906 - DNA, 601 bp, Human; identical to SEQ ID NO: 18930

SEQ ID NO: 56907 - DNA, 601 bp, Human; identical to SEQ ID NO: 18931

SEQ ID NO: 56908 - DNA, 601 bp, Human; identical to SEQ ID NO: 18932

SEQ ID NO: 56909 - DNA, 601 bp, Human; identical to SEQ ID NO: 18933

SEQ ID NO: 56910 - DNA, 601 bp, Human; identical to SEQ ID NO: 18934

SEQ ID NO: 56911 - DNA, 601 bp, Human; identical to SEQ ID NO: 18935

SEQ ID NO: 56912 - DNA, 601 bp, Human; identical to SEQ ID NO: 18936

SEQ ID NO: 56913 - DNA, 601 bp, Human; identical to SEQ ID NO: 18937

SEQ ID NO: 56914 - DNA, 601 bp, Human; identical to SEQ ID NO: 18938

SEQ ID NO: 56915 - DNA, 601 bp, Human; identical to SEQ ID NO: 18939

SEQ ID NO: 56916 - DNA, 601 bp, Human; identical to SEQ ID NO: 18940

SEQ ID NO: 56917 - DNA, 601 bp, Human; identical to SEQ ID NO: 18941

SEQ ID NO: 56918 - DNA, 601 bp, Human; identical to SEQ ID NO: 18942

SEQ ID NO: 56919 - DNA, 601 bp, Human; identical to SEQ ID NO: 18943

SEQ ID NO: 56920 - DNA, 601 bp, Human; identical to SEQ ID NO: 18944

SEQ ID NO: 56921 - DNA, 601 bp, Human; identical to SEQ ID NO: 18945

SEQ ID NO: 56922 - DNA, 601 bp, Human; identical to SEQ ID NO: 18946

SEQ ID NO: 56923 - DNA, 601 bp, Human; identical to SEQ ID NO: 18947

SEQ ID NO: 56924 - DNA, 601 bp, Human; identical to SEQ ID NO: 18948

SEQ ID NO: 56925 - DNA, 601 bp, Human; identical to SEQ ID NO: 18949

SEQ ID NO: 56926 - DNA, 601 bp, Human; identical to SEQ ID NO: 18950

SEQ ID NO: 56927 - DNA, 601 bp, Human; identical to SEQ ID NO: 18951

SEQ ID NO: 56928 - DNA, 601 bp, Human; identical to SEQ ID NO: 18952

SEQ ID NO: 56929 - DNA, 601 bp, Human; identical to SEQ ID NO: 18953

SEQ ID NO: 56930 - DNA, 601 bp, Human; identical to SEQ ID NO: 18954

SEQ ID NO: 56931 - DNA, 601 bp, Human; identical to SEQ ID NO: 18955

SEQ ID NO: 56932 - DNA, 601 bp, Human; identical to SEQ ID NO: 18956

SEQ ID NO: 56933 - DNA, 601 bp, Human; identical to SEQ ID NO: 18957

SEQ ID NO: 56934 - DNA, 601 bp, Human; identical to SEQ ID NO: 18958

SEQ ID NO: 56935 - DNA, 601 bp, Human; identical to SEQ ID NO: 18959

SEQ ID NO: 56936 - DNA, 601 bp, Human; identical to SEQ ID NO: 18960

SEQ ID NO: 56937 - DNA, 601 bp, Human; identical to SEQ ID NO: 18961

SEQ ID NO: 56938 - DNA, 601 bp, Human; identical to SEQ ID NO: 18962

SEQ ID NO: 56939 - DNA, 601 bp, Human; identical to SEQ ID NO: 18963

SEQ ID NO: 56940 - DNA, 601 bp, Human; identical to SEQ ID NO: 18964

SEQ ID NO: 56941 - DNA, 601 bp, Human; identical to SEQ ID NO: 18965

SEQ ID NO: 56942 - DNA, 601 bp, Human
cagagttttaaaagataatgtttgttcaatgactcacatatactgaacgtttaataaatggcataagtactatgtagtaatgataataatgagtactttcaccagcccagggctaaacaattttcattcaatattatatgtaattctcataacggctctgtaaaatatagtctttctacttttagtcgagttaataagaattagctatcttaagcaaccaacccactcacaccactagtaaaaggcagagtaagaattttattctagcgagtcagactccaaagtctgactccttatctcyggaacactctgcctttccaatttattctacttttaatagaccatggtaggctattgagagtgtttccagtttttcactattagaaactatactctgatgagctcctctatgcatcaagctttttcattatttccagttattcttaaaatagataagtagttaggaaattataaggccaaaagatgaatatgtctaaggttttcaatacacatacctgaattgtttcttccacaggctatgccaatttacattcttatcaccaatacaacaaagatggtcacagtcactacactctttaca

SEQ ID NO: 56943 - DNA, 601 bp, Human
tccgaaaacagagcattccacttagtagatgagacagaagcaaaaagttgagtagcatgccaaattggttggtttagaaagaatcacagaacattagagctagaagacaccctaaagattccaactcttaacttgcacatgaggaaagaaagccctcaaacttacagcatggcccagggggttacacacatgagcgatagttggcactaaaacccagatatctaaattccaactgctatttcaccttctttttgtttgtttgtttgtttgtctgttttttgagatggagtttcactcttgytacccaggctggagtgtaatgtcacaatctcgtctcactgcaacctccacctcctgggttcaagcaattctcctgcttcagcctcccgagtagctgggattacgggcatgcaccaccactcttggctaattttgtatttttagtagagacgggatttctccatgttggtcaggctggtctcgaactgccaacttcaggtggtctgcccacctcagcctcccaaagtgctgggattacaggcatgagacactgcgcccggcctatttccccttcttttgcacattataattagttatgact

SEQ ID NO: 56944 - DNA, 601 bp, Human
agtctacattcatggaaaccttctagtggactgataattttcaagaaaaagtaatatagtgggagatggaaatggggagggcaagaaaaaacacattttgctactcttataacccaagtggctagcttgtcattttccctgttcgatcttctaagaatagagctcttcatatgtgaaggaaaaatgaaagggaaattccagttttctcagaaatatacataaatttttagaggataatgaaactatgagttaatcaataaatatgtctgagcacattcctttagccattccagggtgtgayatgagaaaactgattcacacgcactgagcactcaataataagtacttactatgcagtagactacagagatgaataatgtagtttttattcttaaagaattacgctaatatgtaagaaacaattagacagcatcattacctttttaaagaacagtccataatctcctgtttttctctcctgggtattttacagggtccttgtgctgcagaatcagaaccagctcttttgatagggagcaagcagttcgggctttcaagaaacagtcacattgcaattgcatttgatgacaccaaagttaaa

SEQ ID NO: 56945 - DNA, 601 bp, Human
taattttcaagaaaaagtaatatagtgggagatggaaatggggagggcaagaaaaaacacattttgctactcttataacccaagtggctagcttgtcattttccctgttcgatcttctaagaatagagctcttcatatgtgaaggaaaaatgaaagggaaattccagttttctcagaaatatacataaatttttagaggataatgaaactatgagttaatcaataaatatgtctgagcacattcctttagccattccagggtgtgatatgagaaaactgattcacacgcactgagcactcrataataagtacttactatgcagtagactacagagatgaataatgtagtttttattcttaaagaattacgctaatatgtaagaaacaattagacagcatcattacctttttaaagaacagtccataatctcctgtttttctctcctgggtattttacagggtccttgtgctgcagaatcagaaccagctcttttgatagggagcaagcagttcgggctttcaagaaacagtcacattgcaattgcatttgatgacaccaaagttaaaaaccggtatgtatcatcctgagacactgggaaag

SEQ ID NO: 56946 - DNA, 601 bp, Human; identical to SEQ ID NO: 18966

SEQ ID NO: 56947 - DNA, 601 bp, Human; identical to SEQ ID NO: 18967

SEQ ID NO: 56948 - DNA, 601 bp, Human; identical to SEQ ID NO: 18968

SEQ ID NO: 56949 - DNA, 601 bp, Human; identical to SEQ ID NO: 18969

SEQ ID NO: 56950 - DNA, 601 bp, Human; identical to SEQ ID NO: 18970

SEQ ID NO: 56951 - DNA, 601 bp, Human; identical to SEQ ID NO: 18971

SEQ ID NO: 56952 - DNA, 601 bp, Human; identical to SEQ ID NO: 18972

SEQ ID NO: 56953 - DNA, 601 bp, Human; identical to SEQ ID NO: 18973

SEQ ID NO: 56954 - DNA, 601 bp, Human; identical to SEQ ID NO: 18974

SEQ ID NO: 56955 - DNA, 601 bp, Human
acaggggccgctcccgacaaccccaccagccgtgctgtgcctgaaggtcaagtttctctgcacctcgccagtcccctcgccagtcccccttccgtccccgtccccacaagccagcgtgctggtcatcagggcaattccctcagctccctgggccccagggaccagctggcctctgcgagggtcccacagccccggagtccaggtagggcgaggtgtctgtggggatggaggtcctcccttaccttcggttttgaggcgctctgcctctgctgagtcctcctcggaaggcggggttcgcgckgggctcctcaggtcctgcggcatctcctggacccggaggcaaaggcggcccgctgtcctctcctcccaacctggcaccctccggccttagcttccctcgggacgccagagagggccaccaagttccgaaggacccgggggctctgcaggggactcctggccccccatcatgtggccctgggcgagtgaccacagcgctatgtgtctcaggacccgccgatagggggaggagggccaagtgctcctgcagccacgtccccagcccaggagaggatgcaggcagagtgctgggggacgatga

SEQ ID NO: 56956 - DNA, 601 bp, Human
tggtcacctgatgctcgctcctggtctgagaccaccggtgaatggatccctcatctacagcgcagaggcctctcccatctcaggtccctgctaagcatcccggaggacgcccccgcacccggccgcccctgccctgggcaggccctgagctggtacctgttgcagaaatagacggcgttggctgggttgagctcgatggcttttccgtagaaatgcacggcagcttcaaagttttccactttcatctgctcgtttcctacagggagagaggaaaacaccggcccggtgtccacacagaccsgagggggtgtcagggagagaggaaaacaccggcctggtgtccacacagacccgagggggcgtcacacttggctcttctgggcagccaggactcaacacagatgccggctcaggaggcatctgcatctatagggggttcgctagtcgcaaacaatcatatctacatccactaagggggatggaggtgggggcggcagggcctggcctggcctgtgcctggcgacggtggctgtcactgcctggatggcgaccccgggagcagaacagttaatacagctcaccggcccggggacggaaactg

SEQ ID NO: 56957 - DNA, 601 bp, Human
ccccatctgtaaaatggggctgatggggaaagctgagaggtgtggccactgagatgctcttagacaaatgtgggctcaaagcaccagcagccactcaggactgcgactctgaattttatttgcaaaaaatgttccgatccatggctgtacaagagcaatgagggtagggaacttatacccaagtttcattcacaaattatttacatatcagtaaaaaaagaactcagaccaatgtcaaagctcaaagctcttggcttacagcgtctgaatcgtcttcaccattttcgtgtttagtgtttcyctttacaattttttcaaagtacagagaagagtgagtggagactaaactaccccatgacaggcggccaggaaccctgcactgcctctgcaactgtcctgtaagcctgaagcagatccaagaccacacattcaaaaaacacaaccctccacatactggattattttcttggcttgacatccacgtggaatgccatgatacctgattttctatgtatgtatttatgtatttattatttttgaaacagggttttgctctgctgcccaggctggagtgcagtgacacgatctcagctcactgcaa

SEQ ID NO: 56958 - DNA, 601 bp, Human
tcgttgtcggggtccagctccagagccttcttgtagtaagccacggcctccacgtgcttgttgaggctggagagcgccaggctggaggagagcaccggggatggactgttcccatctgcccagctccaggaggccccgccaaagccctcgtccccggcggtcctggcaacccccaaaccacctcggatggtgccaccccctgcccgctgtcagctcagtggagacaaacctggctttcgaggggcccaggggcaggactgagggagacagacatgagaacacccctgccacacaagaactrgagtccccatggggccacacacagggcctcaaagcccagagcgggctgagaggagggagcgggccagctcagggtcacaggaaatgcgtggatgttgtcttggccccgcttcccggcacagggcaccaaggaccctcggaacctctgagcgacagacatgtctcccgtcatccacaagcagcccctgacccccacctgagtgagtcttcactcgtgaggtgactcagggcccctacagagcccaggaggaggcgggtcctggggagactgggcagttgaacagggcccctccccagcctc

SEQ ID NO: 56959 - DNA, 601 bp, Human
cctgcggccagagggtgctttgaggcaggcagcacgaagcacatcgcaaccgcccggggacggcacagtctgtcatcccgtgtttattccccgcacagcgcgaccgcccggggacggcacagtctatcatcccgtgtttattccccgcacagcgcgaccgcccggggacggcacagtctatcatcccgtgtttattccccgcacagcgcgaccgcccggggacggcacagtctatcatcccgtgtttattccccgtacagcgcgaccgcccggggacggcacagtctatcatcccgtgttkatttcctgtattctgccgctttgacaccttggggccttgctggcctggcagagccgccccctcctggagtagccaattcccagagaaagcaaatgactcacccagaaacgcacctttgaaatacaaacaaactaacccagaacccacaccctcagcacctcccccatcaccccagggccacagtccacctgccccactcacccccaggccagggaccaggcaaccaggggcagcccccaggcctgggtctaatgaaatggctccaaccagccaacccgaagcctcctcacccggcctcgc

SEQ ID NO: 56960 - DNA, 601 bp, Human
tgcggtgcccaggacgaccccacagacaagacccatctggttccagaagccagcagtgccaaggcaaggaagccctggccagtagcggacacagcagatgcgggcctggggggtggcgcagacaccatggacagggaggaggggcgggccgttaccatgctcatgaagccagggttgttcagcaggccggcgatgtcgaagctgcccacgcctcccgtctgaggatgagaacagccctggttagtggggcctggaccagaggccacggtgaataaccccctggaactcagaaacaacggcyccccacggggctcagacattctatcaaccctgcggccagagggtgctttgaggcaggcagcacgaagcacatcgcaaccgcccggggacggcacagtctgtcatcccgtgtttattccccgcacagcgcgaccgcccggggacggcacagtctatcatcccgtgtttattccccgcacagcgcgaccgcccggggacggcacagtctatcatcccgtgtttattccccgcacagcgcgaccgcccggggacggcacagtctatcatcccgtgtttattccccgtacagcgcgaccgcccg

SEQ ID NO: 56961 - DNA, 601 bp, Human
tgaaccttaggaggcagacgctgctgtgttgtgatcagtgtctctgcactgcgaggaggagcccacgccagggtggggtgggggtgtgacctccctgggctcagccaggagagccagcttttggtgctcactactgatgggtcttgcttgggacatcaacattggggacacttttgattgtcgaagcagagggtgggggtgctcctgacatggggcgggtgaggccaggggtgctgccagcgccctgcggtgcccaggacgaccccacagacaagacccatctggttccagaagccagcartgccaaggcaaggaagccctggccagtagcggacacagcagatgcgggcctggggggtggcgcagacaccatggacagggaggaggggcgggccgttaccatgctcatgaagccagggttgttcagcaggccggcgatgtcgaagctgcccacgcctcccgtctgaggatgagaacagccctggttagtggggcctggaccagaggccacggtgaataaccccctggaactcagaaacaacggccccccacggggctcagacattctatcaaccctgcggccagagggtgctttgaggca

SEQ ID NO: 56962 - DNA, 601 bp, Human
acccggcgctctgcttcccttgcctgaaccttaggaggcagacgctgctgtgttgtgatcagtgtctctgcactgcgaggaggagcccacgccagggtggggtgggggtgtgacctccctgggctcagccaggagagccagcttttggtgctcactactgatgggtcttgcttgggacatcaacattggggacacttttgattgtcgaagcagagggtgggggtgctcctgacatggggcgggtgaggccaggggtgctgccagcgccctgcggtgcccaggacgaccccacagacaagamccatctggttccagaagccagcagtgccaaggcaaggaagccctggccagtagcggacacagcagatgcgggcctggggggtggcgcagacaccatggacagggaggaggggcgggccgttaccatgctcatgaagccagggttgttcagcaggccggcgatgtcgaagctgcccacgcctcccgtctgaggatgagaacagccctggttagtggggcctggaccagaggccacggtgaataaccccctggaactcagaaacaacggccccccacggggctcagacattctatcaaccct

SEQ ID NO: 56963 - DNA, 601 bp, Human
tttaaccacaacaagacccgaagaaacccggttgtcacttacagctgctgaatctggggattgttcattaggttcgaagcctgaagaacagaacaaatttgtcaggaagacaaagctcccagcgcatcattctctttcatcagacactttccatcttaaccagccttggttctggactccagcacgccaaccaacagtaagagccgggcattcggtctttcatacccttttccctacattttcgcccccccacccacgagctgtgacctccacattgtgacttaaatcctgttttgggttyctgcttcaggagcgatctcgcagcgccacagcgctctctcactggctgctgcggttttgctgtgtggaggcgttttggttctttattttagctgctgtctgctttagcatatttcatttagcatatttggttccagttttgctctatcaataaatagcactgtggctgggcgcggtggttcacgcctggaatcccagcactttaggaggccgaggcaggcagatcgcttgaggtcaggagttcgagaccagcctaaccaacatggtgaaaccccgtctctactaaaaatatgaaattagc

SEQ ID NO: 56964 - DNA, 601 bp, Human
accactgccctccagccggggggacagagcaggacggtctcaaaaaaaaaaaaaaaagattaagattgttcttgctgctttttaacatttttgtattttaaatttgtctacagtaattatggtttaaaaatgaaagagagtgtatatgaggaggggacaacgacaaaatgaagaggccacatgggagcagaatggaaacacctctggggaggcccggagcctcccgcccccagggagccggcgtctgctggagacagacaggactgaactcaggggagcctcccacccctgggaagccggygtctgctggagacggacaggactgaactcaggggcccctggggaaggaaaccaagccagccacgggcccctggaacccatgggggacactgagtgtatttttaaacaactgtaagtgcaacacctgctcacagtgagaaaaggacaaaaaatccctcacaaaatgcaggcagaacgctcgggcgcagtcaaaggcaggtacccggcttgtcctttccaccactcgatgacctcgcccccacccccgaggtggcagccccgacactgcagaaacaaagagcttctgcaggcggccttaggc

SEQ ID NO: 56965 - DNA, 601 bp, Human
gacgtgactgcaccactgccctccagccggggggacagagcaggacggtctcaaaaaaaaaaaaaaaagattaagattgttcttgctgctttttaacatttttgtattttaaatttgtctacagtaattatggtttaaaaatgaaagagagtgtatatgaggaggggacaacgacaaaatgaagaggccacatgggagcagaatggaaacacctctggggaggcccggagcctcccgcccccagggagccggcgtctgctggagacagacaggactgaactcaggggagcctcccaccccygggaagccggtgtctgctggagacggacaggactgaactcaggggcccctggggaaggaaaccaagccagccacgggcccctggaacccatgggggacactgagtgtatttttaaacaactgtaagtgcaacacctgctcacagtgagaaaaggacaaaaaatccctcacaaaatgcaggcagaacgctcgggcgcagtcaaaggcaggtacccggcttgtcctttccaccactcgatgacctcgcccccacccccgaggtggcagccccgacactgcagaaacaaagagcttctgcagg

SEQ ID NO: 56966 - DNA, 601 bp, Human
tcggccagggaaggacgcggtcacaccgggagcagctggaaggggacagacatgaaggctgtcagagcgcaggtggggaccaaggctgcaccacacactccaggcagcaggagaggcccagagtggacagccaggggccacagcggctatttcaacgaacgtcagagccacagctgcaccagaagcgttccacacactcggggccacgtgtggctggtggcgcagagaacatcgccatgacctagaagggtctacagtatggtggtactttgtgtatgaggttacggtggtaaaaaatccmcctcaactattaaaaaaagaaaaggaaaaataaataaaagcttatttaaaaaaaaaagggaagactggaagaaaaggcggccaaaatattaatgttggtggctctgggtgagaagattaaggttgggctgaatgcacggctcacactttgggaggccgaggcgggaggatcgcttgagcccaggaggttgaggctgcagtgagacgtgactgcaccactgccctccagccggggggacagagcaggacggtctcaaaaaaaaaaaaaaaagattaagattgttcttgctgctttttaaca

SEQ ID NO: 56967 - DNA, 601 bp, Human
cccctccttagaggtacagagtgcacatcagcatattaaaggccctgagaagtcctgcagctatgaaactcattggggcaaaggacttgaatagacattttctccaaagaaaatatacaaatgggaccaaaaagcatatgaaaagatactcaacatcactaaccatcaggtaatgcaaatcaaatctacaatgagccatcacctcacaacaaaacaaaaaatagcaagtgttggtgaggaagtggaagaactggaatgctgtgtaccattggtgggaatgcaaaatagtacaggtgctgcrgaaaacagtatggaagttcccccaaaaattaaaaatagaaggatcatatgatctggcaatctcacttgtgggcatatatccaaaagaatggaaaacaggatctcaaaaagatacttgcaaacccatgttcattgcaacattactcacaatagccaagaggtggaaaaaactgaaatgaccatccacagatgaacaggttaaaaaaaaaaagtctctaaataaaatggaatattattcagccttataaaagaaagaaatcctgtcatatgttacaacatggatgaaccttggacactatac

SEQ ID NO: 56968 - DNA, 601 bp, Human
cctaggctggagtgcagtggcgcaatctcagctcactgcaacctccacctcctgggttcaagcgattctcccaccacagcctcccaagtactcaggactacagccatgagccaccacgcccagctaatttttgtattttttggcagagatggggtttcacatgttgaccagcctggtttcgaactcctgacctcaggtgatccacctgcctcaaccttccaaaatgctcggattacaggcgtgagccaccacacccagcctgaagttgaccaatcttatttgtctattctaatgaacacaracgaacctcaccaagtctatccttaccttcccactgcctactagatctaacagttatgcacccagcctcatggcttcctcacatgccaccaccccgattccagcttgatattctacttttcctatattctgccaggctgaacagccagtgagctggtgcctgaatacacctctcactctgacctctcccttcatccacctctacatgcaagacccatcatcggatgaaaagtactatcacagaacaacatataaaggtattccatgaaacactagagtctcccaccccgcccctgaaata

SEQ ID NO: 56969 - DNA, 601 bp, Human
tcaaatcagcctagggcaactgtccaatgcttgaagggcagaaaattaaaaatgccactggtgaatccagcagagaatccaggtgacatgaagcccacatccaaaggctgaggcctaggactgacaggaaacaaggaagagctcatcagaggggcccaaagaaaagaaaaaacaaaattccttgaagacaaggcaatggtctgcccttcttaaatgggggagtgcccagctcctctgctacctacgactcataccataactcaggctcaaatcacagtggccagcctacttcctcacccartccttggtcaagatgatattttgcttcatatgaagttggtcaatctttttttttttttttttgagacagggtcttgctctgttgcctaggctggagtgcagtggcgcaatctcagctcactgcaacctccacctcctgggttcaagcgattctcccaccacagcctcccaagtactcaggactacagccatgagccaccacgcccagctaatttttgtattttttggcagagatggggtttcacatgttgaccagcctggtttcgaactcctgacctcaggtgatccacctgcctcaacc

SEQ ID NO: 56970 - DNA, 601 bp, Human
cttcaagcattcacatctacagtatgaacccatttcatcctaacaatagcccatgcggtacataccacactgtcacaatctcctttttgcgaatgcagaaactgagacccagaaagtttaattgacacttcagaatttcatgtaacttgcctgatgtcaagcaactagtaagtagcaaatctggcatctgaacccagagaggctctagagctcatacgcttacctatatgctaactacctgccctctgcatttgccccagacctagccctgagcagcagtcagaaaacatgcaaacaaacmaaacacaatttctccacgtatgtaagacagacagctaagctacagcaatagaaatgacagttaagattataaaagaaagagtggagaggggtgatgaagatggaaggacagcaagagtgcaaaaatgtaagtctgtgaagtctaaacagtgacttctgcaataagagcaacagctaacaccaagcaagcttgatacattttgtattttcaggatgttgctacaaaacacatctgtctcagattagagcctcagtttcctcatggagggaaaagccatctaattctgatattgcaggatca

SEQ ID NO: 56971 - DNA, 601 bp, Human
cccatgacattcaccagtttctttttgtgttctcatttatgactgtggcttacctattatttaatctcttcaaagggaatctcattcatctccacaacagtaataacaacaatagcggcagctaatatgacgagacttttcaagtgacatcaagcattcaagcagcaagcattcaagtgcttcaagcattcacatctacagtatgaacccatttcatcctaacaatagcccatgcggtacataccacactgtcacaatctcctttttgcgaatgcagaaactgagacccagaaagtttaaytgacacttcagaatttcatgtaacttgcctgatgtcaagcaactagtaagtagcaaatctggcatctgaacccagagaggctctagagctcatacgcttacctatatgctaactacctgccctctgcatttgccccagacctagccctgagcagcagtcagaaaacatgcaaacaaacaaaacacaatttctccacgtatgtaagacagacagctaagctacagcaatagaaatgacagttaagattataaaagaaagagtggagaggggtgatgaagatggaaggacagcaagagtgca

SEQ ID NO: 56972 - DNA, 601 bp, Human
cgcatgccgaacatctgatgaactgcagcacttattgctatgaactgcaccgagcttgactctatagcaaacataagaaactatcttctcgaagtggacaatcggcaatagtagacagatattccatgaaatattaacactaataaacagccatataaacgatgctgaacatgcagtgtggtatttgctatagtttaaaggatgctcagatgtgccttagatccatcagaccaagctcagaggtttgactgggccaccaaggataggcgaagagagcaggaaaacagtccagagggaaagstgtgacaaggcccagaagcaagaggcaagaggcctgtcatgaggcgacacccaattagcctaatggcaggggcaagaagttcaagggagcagctgcagagatttctgtaaaggccgtctgaagacaaatagtcaaagacctcaaacaccagactaagaggcttgaactttatcctgcaagttctagagagacactaaaagttgaagagagggtggtgacatgaccagagctgggttttaagaagagggatcaacatggctggtcacatgccgatggaacttgccaagtaaagctgacagc

SEQ ID NO: 56973 - DNA, 601 bp, Human
attacaggcgcccaccaccacacccagctaattttggtatttttagtagagacagggttttgccatgttggtcaggctggtctcgaactcctgacctcaagtgatccgcctgcctcgacctcccaaagtgctgggattatggacatgagccactgcacccagcctcaggtctgactttcgaaagcccatacccttgcaagctgccaagcaacctcttctacttttgtacagaagttgtacacatctagtctcacaattggattataaattctgagggaacaaggaatacgaggtgtatgcygcacttacctctactttcatcagccacagaatagacatctcctacaaccagcagttagaactctgttcaagcctggttccccacttactagctgggtgaacctggggctcaacttcctcatctgtaaaatggggatgaacataatgcccaccttgaagggttgaggtgtgacataaagcaattagcgcatgccgaacatctgatgaactgcagcacttattgctatgaactgcaccgagcttgactctatagcaaacataagaaactatcttctcgaagtggacaatcggcaatagtaga

SEQ ID NO: 56974 - DNA, 601 bp, Human
catagccctgctgacccattttagacttcagacttccagaaccataagagaataaatttgttttaagtcactgtggtaatttgttatagcagtgataggaaactaatacattatctaatggggaaaagatcgtaagggattataaatggggtttcaaattcaaatacctcagggtacaggacaaaggatatcttttctaaagacagcagctcctactcagctctgatttctgaaatgcaggccacatgttgctaaccttcaatatttcagaagaagccagaaatatgggttcatgagaaaytacccaatttttaaatgttggcatctaattccaacaatataaacaatacatagccaaataaagcatctgtaaactacaaaaaaaaaaaaagctagtcatctctcaaaaatctggttcaagtgctcccttttccatgaagcttcctgacccacttcagctttcagaggctcccacatttctgaattttacaggaccatccatgttggcacttatccataccctaccttggataatgctgacaaataatgttagctaagattatttagtctgtattgtttattattgtctcaacacctacta

SEQ ID NO: 56975 - DNA, 601 bp, Human
gaagcacagctgctggctttttctcaaaaccacccacttctctccatttctaatagcagcactcagtccaagcctccatcatctctacctggactaccgcccctacaatccactctgcacatacactcagagtgagcttttccaaatatctaagatcatgttagcaacctccttaaaaccctccaatggcttcctattatatttaagataaaatccaaactctggcccagtcaaggtaccagctgatctgactttgccagtcctcttgcagctctgctcccattcaccatgctccagacayacccacctcctttctgctctttgcatatcctgagctcattcctgcctcaaggccttggcacatgtgcttccttgtgcctataaaagtatttctgatcatggtatggctaggtccttctcatcattacatttgagatcaaatatcacctctacagagaggcctacctgtactacccagctataatagccacctggccacttttaagtctctgtatagcacacacatactctagatatttgtctttttttttttttttttcttttggagacaggatcgccttctgttaccctagctagagtg

SEQ ID NO: 56976 - DNA, 601 bp, Human
agttaatgtctttcaaaactcaccagaaacttgaaagtgctgcacatatgcaatggaagagatattattaatctcttcttcctaaacagtgagaagacatctaaggggctgggaaaactaagttaaaaataactcttgtgctaaaaatcactgcgcacaatggggaatacacagtgagggcactctccaccaacatgacgccacaggcttggggctcttccacccgtgacacagggtgaagatactggcaaagactggcagagaatgcagtgcaggtctgagcccggctggactcttccaytcagggacatagtactctagggatgccccacccctttctgggcaagcttgggagagatggaagatccgcagggtttacctagacttctccatcagcaaaggcaaggaaagagttcctccaaagggaggtggaattaacagcaaatggacatgtttagtttgggatggagacaaggtctggggtaagaatgtccagacatgacctaagtggtcaacattccagaaagacattgctaagcaaggctggccacagcctcacctccacactgacaggctatgcagaagccagacaagcactggg

SEQ ID NO: 56977 - DNA, 601 bp, Human
ctgtaatcctagcactttgggcggctgaggtgggaggactgcttgagcccaggaactcgagaccagcctgggagcatggtgaaacctcatgtctacaaaaaatacaataattagccaggcatggtggcacgtgcctgtagtcccagctatttaggaggctgaggtgggaggataatctgagcccgggaggttgaggctgcacagtgaggcatgattgtgccactgtattccagcctaggcaacagagtgagaccttgtctcaaaaaattaaaacaaaaattaaaaaaaaaaaaaaaaaggwctgcctctttcaccaaggcaccggcaatcacagcctcaaaccagcctccagggagatactagaagggccagcatagagaaccacaatggcaggataaagcagctctgggccacctgcccactagcccaggcccagctgcatagtctgcaacaagtcctggcagctctctcagcctcatttcctcatctctaagacaggtcatttcagattgctaaatgcaacagcaagcacgttttattcctaaagcataaagaacattcggtcaacagcactaaggaaatagaaagaaatggccaccag

SEQ ID NO: 56978 - DNA, 601 bp, Human
gcctgagtacagagctgctgctccttctgcagttaccaggattctcccaagccaaaggacctggcaaggttaagaaagtttagggtggggaatggggctgctggccagacccaaggcatttttaggacagtcaacatgatgtagggggaaaaggccctcatgttcctttcctgctatatggttaagaactacccctttcagccaggcacagtggctcatgcctgtaatcctagcactttgggcggctgaggtgggaggactgcttgagcccaggaactcgagaccagcctgggagcatggygaaacctcatgtctacaaaaaatacaataattagccaggcatggtggcacgtgcctgtagtcccagctatttaggaggctgaggtgggaggataatctgagcccgggaggttgaggctgcacagtgaggcatgattgtgccactgtattccagcctaggcaacagagtgagaccttgtctcaaaaaattaaaacaaaaattaaaaaaaaaaaaaaaaaggactgcctctttcaccaaggcaccggcaatcacagcctcaaaccagcctccagggagatactagaagggccagcatagaga

SEQ ID NO: 56979 - DNA, 601 bp, Human
ttagagttaacctttgttatttaagccaagagtgaaaacagaaaccaaaagccaagcacttgggagaattatctgggaccaataagctaagagaggaggttctgaaactatattaaagtctcatttcttatttggggtgctagtaacacaggtatattcagtttaattgatagaacttttatatgtatgttatattcaataaaaagttcaaaaactttttaaaaataaaaattgttaaaactttgaagcaaagatacagagaggaataaaaagggttactgaaaggtgaccttggggagcrgggaaagactgggaacccacacctttctgcagagagtcaatgtggagcatctggtttgcattttctttttgcttctatatcacaggctgaaactcggttcagttatttttaggaggcgaacaaaggtgcagcaagaacagagaaaaagtagtgactcacccgcagagccatcgaatccagagacaaaagcccgccgacagtcacatggagcaatatactcactctggaaaacaaagatgacaacaaagtgggcctcgatcagtcatgagcagactgttctgcctgcttagccttgtgcta

SEQ ID NO: 56980 - DNA, 601 bp, Human
cacggcagaaaattaaatgaaaacacagagtatatacacacattattcaataaacattgatctatatgctttccacatagtaatgctttaattctcaccactttatatgttacttactgtgattaacccattttacagatgaggaaactaaagcactcaagtgaagcgactagcccaagcaagttccagacctgttcgcttgtcctgaatgctgctcttctccagagctaagcttccagaagcaaatccaagatcctcagagagagcctcaggggaaagctttctggcttctgttgccaawgactccttgcctttatctcactctgaatcatgaggcagcaaatagtagaaggcccccagtacaggagtgaaatgcacagcaatgtgatctgcagcaaatcaactgtcctctctagccctcagtttcccctcagtaaaataagtatcctgaaccagcgtcctccaaaattgaatgcacattggtacgtatgtataggcatgccatttttttttttctcagttttccttggattctcaaaagggtccatgactgcataaaaggattaagatccaggagtcctgaggacctctaggatccctg

SEQ ID NO: 56981 - DNA, 601 bp, Human
tgtgtgtgtgtgtgtgtgtgtgtgtgtgagagagagagagagagagagagagagaaagggaaagagaaatcaactgcagcaacaggcaacaatctgtagctttggtgtttttatatttatgaaatgatttttgagaaatagaaacttaatccaatgccaagacaaaaatgttccttgttcctccctaagacaaagaacacatgtgtgtgtatgtggagggtgtgtggcatacacctgagtgcacacacccctcagtcagctggctgcctggatctcaaggtcatggtctagtcctctgttycctgctgtgagtctgaggactattttctttcctcattatttcctacaacaaacaagaagcatcaggtattttgtttcatcttctctttctcacttggcccttccttatcttctgttctccaagttcaaaattcaggaagcaaagactttgtacagtccctaaaaccgtgtttctaaagactattttaatgacaggaaagtacacacggcagaaaattaaatgaaaacacagagtatatacacacattattcaataaacattgatctatatgctttccacatagtaatgctttaattctca

SEQ ID NO: 56982 - DNA, 601 bp, Human
gctccaactcgacttggattcggaggacgaggttggagacaatagcaagaggtggggggacaatggcaggggccctgctgggcagaaccattgattctgacctgtgtaatccaggcccagtgtgaggagaggcttgcaagggcgctcaggacggtctgtccagattttgtcaacgaggttctccttgacaggaatgaggtgatggccggcacttctcagaactttggccattttcttccaataatctgaggagacacattgtggcccagccatgagccgaacgcccattgcagcagggcasggagcagggccttgaaagtccagaaccttcagaaaggtggtcctgccatggcccagagctgggtgtgcaggatgaggaactgtaaaagcacatcttcaccaccagtggaactcttctcttcaccctgacctctactataaaatcagtcatgctgagccccccagtgctccacaccccacaagcaaatgaggagaatggaggggaatctagaagccacttccttacccaagcagaaagggaccaagctcacttacctgtaggaatgatcaaggggtccacaccaaccctggatccttcagg

SEQ ID NO: 56983 - DNA, 601 bp, Human
tacaaatgctgacataagaagggaaatggaacctagaaacctctatgctctatttccaatatcaaatacgttcgagtggcagttagcagctgagtggataaaaaaaactcagtcttttcagcagcacccaaaaagccacccaaacgagctttgcgaaaataaccaaagccaaactaagtggcaagtaggtggcaacagtggaaacaaacaaagctcctgcttcttcaaatatcccactggggcagagtagggcaaaatcctcctgtcagctccaactcgacttggattcggaggacgaggytggagacaatagcaagaggtggggggacaatggcaggggccctgctgggcagaaccattgattctgacctgtgtaatccaggcccagtgtgaggagaggcttgcaagggcgctcaggacggtctgtccagattttgtcaacgaggttctccttgacaggaatgaggtgatggccggcacttctcagaactttggccattttcttccaataatctgaggagacacattgtggcccagccatgagccgaacgcccattgcagcagggcagggagcagggccttgaaagtccagaaccttcag

SEQ ID NO: 56984 - DNA, 601 bp, Human
caagacttgcctttcagtgctaagacctaggaattccctgtagtctgactcactgtgattaccacttccaaatcacacttgccctttcagacactgccaaggcctctctgttgctctgcaagatgaaatcgtggtgctagaggagctcaccccattgccaccacaaccaccctaccagggcagcattcataactcagggaacagccacctgtgagcagggtgggcatctgtcttattcactcagcacctcgcacagcatcctgcagatagtaggcacccaaatgtgtactgaacagcaacatttgctctcccctctcctataagcaacaagtcagagcttctgctctagtgaaaaaaacttcaaaccacgctgatggaaaatatttagctgaccctgggccactcactggacccatcctccccattccgcaatacccctctggtgaggatgtcacacaagaaagcaggctggggctgcccccacacccagggctgcactgaagatcagttcgggaatgctgtttaaaacttggcccagaatctaggctgtcacgctttcttcccaggacccctctgggcaatctgcctacattccacagcc

SEQ ID NO: 56985 - DNA, 601 bp, Human
tgcaagacttgcctttcagtgctaagacctaggaattccctgtagtctgactcactgtgattaccacttccaaatcacacttgccctttcagacactgccaaggcctctctgttgctctgcaagatgaaatcgtggtgctagaggagctcaccccattgccaccacaaccaccctaccagggcagcattcataactcagggaacagccacctgtgagcagggtgggcatctgtcttattcactcagcacctcgcacagcatcctgcagatagtaggcacccaaatgtgtactgaacagcagcatttgctctcccctctcctataagcaacaagtcagagcttctgctctagtgaaaaaaacttcaaaccacgctgatggaaaatatttagctgaccctgggccactcactggacccatcctccccattccgcaatacccctctggtgaggatgtcacacaagaaagcaggctggggctgcccccacacccagggctgcactgaagatcagttcgggaatgctgtttaaaacttggcccagaatctaggctgtcacgctttcttcccaggacccctctgggcaatctgcctacattccacag

SEQ ID NO: 56986 - DNA, 601 bp, Human
ctgcaagacttgcctttcagtgctaagacctaggaattccctgtagtctgactcactgtgattaccacttccaaatcacacttgccctttcagacactgccaaggcctctctgttgctctgcaagatgaaatcgtggtgctagaggagctcaccccattgccaccacaaccaccctaccagggcagcattcataactcagggaacagccacctgtgagcagggtgggcatctgtcttattcactcagcacctcgcacagcatcctgcagatagtaggcacccaaatgtgtactgaacagctacatttgctctcccctctcctataagcaacaagtcagagcttctgctctagtgaaaaaaacttcaaaccacgctgatggaaaatatttagctgaccctgggccactcactggacccatcctccccattccgcaatacccctctggtgaggatgtcacacaagaaagcaggctggggctgcccccacacccagggctgcactgaagatcagttcgggaatgctgtttaaaacttggcccagaatctaggctgtcacgctttcttcccaggacccctctgggcaatctgcctacattccaca

SEQ ID NO: 56987 - DNA, 601 bp, Human
gctgcaagacttgcctttcagtgctaagacctaggaattccctgtagtctgactcactgtgattaccacttccaaatcacacttgccctttcagacactgccaaggcctctctgttgctctgcaagatgaaatcgtggtgctagaggagctcaccccattgccaccacaaccaccctaccagggcagcattcataactcagggaacagccacctgtgagcagggtgggcatctgtcttattcactcagcacctcgcacagcatcctgcagatagtaggcacccaaatgtgtactgaacagtaacatttgctctcccctctcctataagcaacaagtcagagcttctgctctagtgaaaaaaacttcaaaccacgctgatggaaaatatttagctgaccctgggccactcactggacccatcctccccattccgcaatacccctctggtgaggatgtcacacaagaaagcaggctggggctgcccccacacccagggctgcactgaagatcagttcgggaatgctgtttaaaacttggcccagaatctaggctgtcacgctttcttcccaggacccctctgggcaatctgcctacattccac

SEQ ID NO: 56988 - DNA, 601 bp, Human
gggctgcaagacttgcctttcagtgctaagacctaggaattccctgtagtctgactcactgtgattaccacttccaaatcacacttgccctttcagacactgccaaggcctctctgttgctctgcaagatgaaatcgtggtgctagaggagctcaccccattgccaccacaaccaccctaccagggcagcattcataactcagggaacagccacctgtgagcagggtgggcatctgtcttattcactcagcacctcgcacagcatcctgcagatagtaggcacccaaatgtgtactgaacagcaacatttgctctcccctctcctataagcaacaagtcagagcttctgctctagtgaaaaaaacttcaaaccacgctgatggaaaatatttagctgaccctgggccactcactggacccatcctccccattccgcaatacccctctggtgaggatgtcacacaagaaagcaggctggggctgcccccacacccagggctgcactgaagatcagttcgggaatgctgtttaaaacttggcccagaatctaggctgtcacgctttcttcccaggacccctctgggcaatctgcctacattcc

SEQ ID NO: 56989 - DNA, 601 bp, Human
ttcccgtccttcattaagaccttgggacccacagcctaaatctccatctaatctgtccagctcatctacagcctcgcccagtcaccactcaggttcaggtcccaccatctctcacttgggttagtgccacagcctctaagtctttccccatctaccgatgtttcagtcataatattctttacaacttgtacatctaacatgtggttccctctgaaaaattcgttcaatagcttcccactattcttgttcagaaaaagaacccaagctcctgaatgtggcccacaaggcctctcttttctgyggcccctgctcacattctggcctcactatgttctgacctcactgaaccacttcaggtcctccacatgcactgtgctctctactgtccagagtctctgaaaatgctgttccctctgcttggatcatggttccccgcccctcctcaccctgccattcacctaactcacccacatttatccttactctctgcttcaaaatattactttccccaagagtctgctctgatctccaagtctaggtcaggcccctctcgtaacacctgtatctgtcccacaagcagactggtgcccacttatgtgcc

SEQ ID NO: 56990 - DNA, 601 bp, Human
cacacctggcacttgcacaaagcttctaaaattgcttttgtgatcttatctccttttctctttctctccagagagagaggagagagagagaggaggagtcacactgtgtgtgatgatggcaggggtacaatggcaagccagatctagagagccaggcctggattcttcccaggatgccccactgctcagtggagaagaaaggacatcactgggcttgccaaaggccacttggcagccagaggcccaggggaggacagtagaaaagcctacctctaaagaggcctggattccagtcccatcycagaccctaatgaaaatgaggcaacaagtgtcagctgcttagcactgcccagcaagggctcagtaaagggcaaggctatcactatcacttgaatttgacaaatccccaaatccccaactccccaatcctctctgagcctcaagtgtccttagctataaaatgtggtgcggcagaaggagggggtagagaagcatttcccaagcttcaagcattcttataccacctgcacagcttttaccctagcttcttaactgctgtacccttattcacttagtactttactttagaccatctttaaat

SEQ ID NO: 56991 - DNA, 601 bp, Human
tattttcttttcccaattaaagagttgtttatacaatacttaaagggaacatgatattgtttaataacaccacagagaaaccaccctcttgtcaactagagcaagaaattaatggccaagagtcaatttaatataaaaaggctcaaggcttaaactgaagttcaaaatgtacacaaagatctttttctcctaatacaatcagcttgcctataataatattataagactcatttttccttataatgaaattccacttagttatgattccctaacccaaaaagcatccactctattatggaayttttcttcattcttgttactattttcataattaaggaattttgaaatctacacacaccaaatttccagagagaattattaaaatagagcccaaaaatttgatgaagatctcagatctcatggtcagcagagcatgggagatgctagagttagaatcacatataggtaggtctgaataatgtatatccacatattaaacaaagactaagaaccaacctctttctccagccagttaaagagttcacagagagcaacagcatctttaatctgtgcaaacaatggagacattttttaagttatc

SEQ ID NO: 56992 - DNA, 601 bp, Human
ataataaaaatgtaataataataatttacataaagtccaggcatggtggctcatgcctgtaatcccagcactttgggaggccgaggtgggtggatcacaaggtcaggagttcaagaccagcctggccaagatggtgaaaccccatctctactacaactacgaaaattagccaggcgcagtggcaggcgcctataatcccagctacttgggaggctaaggcaggagaatctcttgaacctgggcagcagaggttgcagtgagccgagatcacaccactgcactccagcctgggtgacagagkgagactccgtctcaaaaaataaaataaaataaaataataataataatttacatagatgaacaatcaccagaaggaaacatgagggaaaaagttacactagtgggaataaagacaatattttcttttcccaattaaagagttgtttatacaatacttaaagggaacatgatattgtttaataacaccacagagaaaccaccctcttgtcaactagagcaagaaattaatggccaagagtcaatttaatataaaaaggctcaaggcttaaactgaagttcaaaatgtacacaaagatctttt

SEQ ID NO: 56993 - DNA, 601 bp, Human
ctccagcctgggtgatggagcaaggctctgtctcaaaaataaaaaaaaataataaaaatgtaataataataatttacataaagtccaggcatggtggctcatgcctgtaatcccagcactttgggaggccgaggtgggtggatcacaaggtcaggagttcaagaccagcctggccaagatggtgaaaccccatctctactacaactacgaaaattagccaggcgcagtggcaggcgcctataatcccagctacttgggaggctaaggcaggagaatctcttgaacctgggcagcagaggtygcagtgagccgagatcacaccactgcactccagcctgggtgacagagtgagactccgtctcaaaaaataaaataaaataaaataataataataatttacatagatgaacaatcaccagaaggaaacatgagggaaaaagttacactagtgggaataaagacaatattttcttttcccaattaaagagttgtttatacaatacttaaagggaacatgatattgtttaataacaccacagagaaaccaccctcttgtcaactagagcaagaaattaatggccaagagtcaatttaatataaa

SEQ ID NO: 56994 - DNA, 601 bp, Human
gagacatgtaaaaataatttatatttttaaaaataatttacggccaggcacggtggctcacgcctgtaatcccagcactttgggaggccgaggcgggcggatcacaaggtcaggagatcgagaccatcctggctaacacagtgaaaccccgtctctactaaaaatacaaaaaattagccaagcatggtggcgggcgcctgtagtcccagctagtcgggaggctgaggcaggagaatggcgtgaacccaggagacggagcttgcagtgagccgagatcgctccactgcactccagcctgggygatggagcaaggctctgtctcaaaaataaaaaaaaataataaaaatgtaataataataatttacataaagtccaggcatggtggctcatgcctgtaatcccagcactttgggaggccgaggtgggtggatcacaaggtcaggagttcaagaccagcctggccaagatggtgaaaccccatctctactacaactacgaaaattagccaggcgcagtggcaggcgcctataatcccagctacttgggaggctaaggcaggagaatctcttgaacctgggcagcagaggttgcagtgagccga

SEQ ID NO: 56995 - DNA, 601 bp, Human
ctgaggcaggaggattgcttgagtccagaaattcgagacaagcctgggcaacacatcaagatcctcatctctacaaaaaaatctaaaaattagccaggagtggtagcacatgcctatagtcccagctactcaggaggctgaggcaggaggattgcttgagtctaggagttcaaagttgcagtgagttgtgatggcaccactgcgctccagcctgggcagcagagcaagaccttgtctccaaaaaaaaaaaaacttagtcatcaagatgcaagggctatgcatacagttcctgcagcttcaraaaggaaagagggacacccatctgactaccctgcagagaatgccagtgccatactgagcctaagaagaggctcccaaaaggcagaggcttggggattgggagaaaataaaatcttagaagtcttatttcccttcattttacagtctcaacagacagatgaaggtgggcacagaggcctctggtaaaataatgtctctcccctgctcaggctcctgtgcagaagcagcaaggccaggcagcatgctcctccgcatgccttacgcgtagtgaatgatggcgccgttgggtcccgtactggaa

SEQ ID NO: 56996 - DNA, 601 bp, Human
aaattaatcccttacttcataaggccctggggcagctgagagtacagggaaccggcaggcggttcatgggctggggtggaaaactttcaacggttccaaaagcttgctttacttcacagttgtttacttatatttttaaaacttccagccaaggactgtaacatttctatcaaacagtcttttgtgagaacagagtcacaactgggctatttcaaataggggtgaaaaaaatgacaagacacaggaacgattccattagtggccagcacagagggcgatgaccagctgagtgctctcagcyggagctcagctgtccaccttctccactgcctcgaatccatagtcaagttccacagcagtcctggtttacttacttgtattgagcacccgagtcaataaggtacacctcatccagggacaaggtcctattcgtctcagggactggcctaacaaagttaattaaaaattaattattccacaaatgtaaacacttagtgaatctgggaggaggacacacaagagctctttgtactattcttgcaacttacataagcctgaaattatatcaaaatagaaagttatgcaataatgaattatttca

SEQ ID NO: 56997 - DNA, 601 bp, Human
tccaaaataggcaaatccatagatacagaaaggagagtagtggttctccagggtagtggaaaagggggtagtgaccgctattgggtatgaggtttctttttggggtaatgaaaatgttctaaaattgattgtgctgatggctgcaaaactctgtgaatatataaaaaaaattaattgtatattttaagtgggtgaattacatggtacataaattttaccccaatgaagttattttaaaaaatgaaacaaagtgtgaatgcagggatggctaaataaactgggagtgacgtcagcccctgayacacacattcttggtctacagcataagggctgtttcacgagagacactatcactggggttatgaacaagacagaagaaggcaaagaaaacaggagcccatctctagcaaaagagggccaaaacccaacttctcctgttagaacagcagggggtttcctggacagagaccctaaaaatatccaagtacatatcttaacacacactagactatatccctgacatagaaaggataacttctagaatcctgctaaaaatttagaagtgaagaaaagtttacaccattatcaagcaatccttagc

SEQ ID NO: 56998 - DNA, 601 bp, Human
agtttccagagagttaagcctgtaaataagaatctcaaaaaaagaagggggtggccttcaaaatcaaatctaggcactgcttataaagcatgtatttcactatctcatccccagcctcaaaggcatttcctgactcaagagaaggccaaagctactatatttaaacttacacctgagctgccctaaccttagcagaatgctttaaaaatttctccaaatgtcttattccaataattagttaaatgaacctcgtaaagcagataagcctgactccacagcaaggagcaattttactaccccmcatgtaatttttacttctttatacaatcccttttcataaaagcaatgctcttcttaagaaagcagagaggacctcttgagttttttacctccaccttaccttctcgtaggctgtaggggtcccaaaatgcattgtccgcgtcacatctgtggtgccatccctttccaaaaaaaggacaaattggtttcccgtcaaaataagctttaagtcaaatatgacacaggcaagcatgtggacaagtgagaagccccatacaatgctggtgggcatgtaaaatagcacagccatctttgcaaatag

SEQ ID NO: 56999 - DNA, 601 bp, Human
gttcaacgtcacagagctagtaaatggcacagaagctctgaagccaggtctccagacccctagtacacatctctctgcctcacagctctctttcccctttccatgccaatcataccagaaacttaatagagtctgtcatttcagaaagtttccagagagttaagcctgtaaataagaatctcaaaaaaagaagggggtggccttcaaaatcaaatctaggcactgcttataaagcatgtatttcactatctcatccccagcctcaaaggcatttcctgactcaagagaaggccaaagctaytatatttaaacttacacctgagctgccctaaccttagcagaatgctttaaaaatttctccaaatgtcttattccaataattagttaaatgaacctcgtaaagcagataagcctgactccacagcaaggagcaattttactaccccacatgtaatttttacttctttatacaatcccttttcataaaagcaatgctcttcttaagaaagcagagaggacctcttgagttttttacctccaccttaccttctcgtaggctgtaggggtcccaaaatgcattgtccgcgtcacatctgtggtg

SEQ ID NO: 57000 - DNA, 601 bp, Human
agaattacaaagatgagactctaaccagactgcaagcagacaggcaggcatgacagatgaggaaactgaggcctagggagatgagtacatgtctaatctacccaaaagcaaggcagcccaggtcttgtcaatgcccagtccaatgctccacccaccaggcctcaagcaaagtagtacatagctgaagtcagggtcccagtaaaataaatcctaagaatcccgaaaggaagcactggcccagtactaaagggcagacaggaggctgcaccaacttccactcaggccctgtgaccttcatatmtggtttgtcctctcctgggagccatccacatgtgtcatccaataccataagtggtcaggagaatggtgcacagggggtactgggcccaatcctaacccggctccctgaggcctctgggctcagtcagtgggttatggagactcaccccatgagcacctggctgggcctgaagtgggatggggacctcacagtgaaggaacgacatgttctttcactcaaacatagacatatttgattctcaaacaagaaaaagagcctgccatgtgacagaatgcaccacctacctttggttccagtcgg

SEQ ID NO: 57001 - DNA, 601 bp, Human
aaggctaatgtctactgtgataggaaacaggggcaggatatgggggtatctgggcttaggggcatctctggttttggttctccaggatgcaggggtgtaagtcctcaaaatcatttttataacagtcaactgtgtggtctgccttgacccagccaggcccatcaggcgacaacacatctatccactggagcacacaagaacatgtcgggtttctgttcatggcagcttttgggaataagatgggaggtcacttccaagaatagtgacttccatgccaaagcagagagcagatccccgcagwtaacctccttgtagacacaggaagctacttccctccaattgttcaattccaccaatggaggaggcacaaacaggtcttttaggtaaagcctagagcctaaaaccctgcaaccttggtaacactgatgggggaagagggtgaaacacctgtcttgtattgcctttgaggctgacccatggataactcagggttcctcaactttacctaataaaagtcacctggggagtgtgacaaaattacagcttccaggccccccaccctggaaattctagggtctgggaggggccctggaaattagcg

SEQ ID NO: 57002 - DNA, 601 bp, Human
gcagctcaacagtaaggcaacggcagcatcctggtgtaagcctggggccacagccaaacgcccatggcccttttggttggaagtagggagggaaaagtgggagtgtggacagcctcggtggagcctgaggagcagcacaaggccctgacagtctgcagctggccatattcatatctgaccaaggtcctttgctgccatctggtgataagtgatgacgatgcagacccaaaccaaaaactccctaaagtgactccaaaataaaggctaaatagtaaagggcaaatgaccagatattttaaaagccagatattttaagaagacattatctgccctacaaagagtaactggccgaaagaatagttcaatcatgtgggcatgcaaggtgcagcaatgaaacactgggtaacacagatccctggtctatgtccaatgtcacgggagtagactgattctccttcgaggaaaaatggcctggcttaaacttcctcatatactacttccctggataaaggggaatgtcatatgggagaaatgcctcctgatgggtacactttatgtggacaggaaggactgcatgacctagaattacttggcaggaatc

SEQ ID NO: 57003 - DNA, 601 bp, Human
acctgggaggccaaggttgcagtgagctgagatcgtgccactgcactccagcctgggcgacagagtgagactgtgtctcaaaaaaaaaaaaaaaacatacacacacaaaaaaaacaaaaaaaccagatattgtaacaaataaatcagcagaaagaaaatactttatctattgaataaaacaaaatgattatcttgattgatgtaggagatgaatatgactggatccaggaggacatcaatgtcctacactaaaatttaaatgcgactgaccgtccccactctgttaagccctttactacgygcttactcgctgctatgcccccagtcggagcacaaagccctacacacaaaactaacatttattgaagtcttgccttgtgccatgcactgttctaagcccttcatttgatcctcccagccatcctataaaacaggttctcttattatccccagatgagaaagtcaaggcacaagaggttgaatgactttgctgtgttcacacagctaggttgtagcatccaataaacatttgtaaatgaatgaattttcattttcctttccttaaaagggagctcgttagccctgactactagactaactg

SEQ ID NO: 57004 - DNA, 601 bp, Human
aagcgggcagatcacctgaggtcagcagttcaagaccagcttggccaacatggtgaaatcctgtctctactaaaaatacaaaaattagccaggcgcagtggtgcacacctgtaatcccagctactcgggaggctgaggcaggagaattgcttgaacctgggaggccaaggttgcagtgagctgagatcgtgccactgcactccagcctgggcgacagagtgagactgtgtctcaaaaaaaaaaaaaaaacatacacacacaaaaaaaacaaaaaaaccagatattgtaacaaataaatcarcagaaagaaaatactttatctattgaataaaacaaaatgattatcttgattgatgtaggagatgaatatgactggatccaggaggacatcaatgtcctacactaaaatttaaatgcgactgaccgtccccactctgttaagccctttactacgcgcttactcgctgctatgcccccagtcggagcacaaagccctacacacaaaactaacatttattgaagtcttgccttgtgccatgcactgttctaagcccttcatttgatcctcccagccatcctataaaacaggttctcttattat

SEQ ID NO: 57005 - DNA, 601 bp, Human
tagaaataacaaaatacaggccaggtgcagtggctcacgcctgtaatcacagcactttgggaggccgaagcgggcagatcacctgaggtcagcagttcaagaccagcttggccaacatggtgaaatcctgtctctactaaaaatacaaaaattagccaggcgcagtggtgcacacctgtaatcccagctactcgggaggctgaggcaggagaattgcttgaacctgggaggccaaggttgcagtgagctgagatcgtgccactgcactccagcctgggcgacagagtgagactgtgtctcaaaaaaaaaaaaaaaacatacacacacaaaaaaaacaaaaaaaccagatattgtaacaaataaatcagcagaaagaaaatactttatctattgaataaaacaaaatgattatcttgattgatgtaggagatgaatatgactggatccaggaggacatcaatgtcctacactaaaatttaaatgcgactgaccgtccccactctgttaagccctttactacgcgcttactcgctgctatgcccccagtcggagcacaaagccctacacacaaaactaacatttattgaagtcttgccttgtg

SEQ ID NO: 57006 - DNA, 601 bp, Human
tcatgattccattcgtcagccactctgatgctgataaattgtaaatgacaaaagcagagagataccatgattcctgtttcaaaacactttattttctctcaaaaaagtcactttccagtctgttacaaaccaatacacttttgaaatacaataaaaatgtaaaagtaaaataataaaaatgattttctagtaagaaaatgaaacggaaaaagaacaaatacatataaaatacaacgcccaaatttttattcttagtcaacagaccacattactctgccaatttgccttaaaagtttctaartgtttactctctaaccctacaccactgtcgatggggacacaggacaagccatttgtggaccagcacccatccacagaccacagtgtaagttctggttccacaaaacaacagtcacattctctcgtatactattggctttttaccacctgtgatggccttgtgtgcccaagtctgtgccacattttggagggtaacgagcaattgttagtttcttctgtatcattctaggggctggcattgaacacatggagacaggctgatcaatgagagaagataagaggcagcaaaggaatgagaagg

SEQ ID NO: 57007 - DNA, 601 bp, Human
aagccactttccagctgggcacagtggctcacacctgtaatcccagcactttgggaggccaaggcaagcggatcacttgaggtcaggagtgcgagaccagcctggctaacatggtgaaagcccatctctactaaaaatacaaaagcactagccaggcgtggttgtgtgcacctgtaatcccagctactaggaggccgaggcaggagaatctcttgaacccaggaggcagagtttgcagtgaggcgagaccgtgccattgcactccagcctgggcaagaagagcgaaactccatctcaaaaaaaacaaacaaacaaacaaacaaaacaaacaaacagacctttttaaaaaagccactttccaaagacagaattcagctaagtccgagaaaatagtcaatacttttcttgtgaatcatgattccattcgtcagccactctgatgctgataaattgtaaatgacaaaagcagagagataccatgattcctgtttcaaaacactttattttctctcaaaaaagtcactttccagtctgttacaaaccaatacacttttgaaatacaataaaaatgtaaaagtaaaataataaaaatgattttcta

SEQ ID NO: 57008 - DNA, 601 bp, Human
tcctttctagcacatagaaaatatgggacctggggaccaggcgtggcggcttatgcctgtaatcccaacactttgggagcccaaggcaggaggattgcttgagcccaagagtttgagagcagcctgagcaacatagcaagaccccgactctgccaaaaaaataaaaaattagccaggtgtagtggtgagtgcctatagtcccagctactggggaggctgaggtgggaggattggttgagcacaggaggtggaggttgcagtgagccaatatcaagccactgcactccagcctggcacagarcaaggcactctcgggggaaaaaaaaagcgagagagagaaagaaaaaagaaaagaaaatatgggaccctggacgggcgtggtggctcacacctgtaatcccagcactttgggaggccgaggtgggcggatcatgcggtcaggagttcaagaccagactggccagcatggtgaaacctcatctctactaaaaatacaaaaattagccgggcgtggtggtgcatgcctataatcccagctacttgggaggctgaggcaggagaatcacttgaacccaggaggtggagattgcagtgagctgag

SEQ ID NO: 57009 - DNA, 601 bp, Human
ataattgttgaacaagtgaatgaatgaaattcattattgaaatttttcatgtaatccatactggtgctgtaataattcatttgttaaacccccttcaagctccctctttgttctccttgccttcctcaaatatgggtctaaactcattttaagccagtttatcaaccagagggacatagagggaacatggttttctgattcttctttgccagtgtcctccacacgcacacacacacatacacacacgcacgcacgcgcacacacacacgcacacacacacagacacgcacacacacacatccacacacacacacacatacacatacatgcaataatccaaggctgcagcatatttaaatctgtcatttttctagaaccgaggtgtgctcttctatatgcaagctttctccacctcagcactattgacatttggggcagcatcattctttgctgggaggctgtcccgtgcacggtaggagttgagcagcattgctgacctctactcactagatgcaatagcccctaatcaccaccatcaccaccgagcggtgaacactgcaactgtctccagacactgcaaatattcccagggacgaaattg

SEQ ID NO: 57010 - DNA, 601 bp, Human
aaaaaagaatgaaagagcaaaccacagaataggaaaagatatttgcagctcatgaacagcagactaaaaacttcctatacgttagtaagaaaaggacagacaatcctatgagaaaatactcaaaagacttgatcaggcccttcactaaagaggaaatccaaatagccaaaataacatgaaaaggcgtctaacctcactagcaaccaggaagtgtaagttaaaaccacaatgagatacaactatccacccaccatatcgataaaaataatctgatgataccaagagttatcaggggatgtgragtaacaggaaactcattaccgccaggggagtgtaaatggggtccaatcatttaggaaaacagtttggcatattcacgaccaagatacacatgttccttgtagctcagcaacgttatttctaggttaaaaaacaaaaccaagccagaaacacgtgtttacgtgtgctgagatacacggacaaaaatattcaaacgtcattacatgtaataaccccaagctggaaatgatcccgctgtccatcagtactagaataggtgaacaatgatgtcatcattcaacaagagtgtgcaacagtggaa

SEQ ID NO: 57011 - DNA, 601 bp, Human
ttgcccaggctggagtgcaatggcacgatctcagttcactgcaacctccacctcccgggttcaagcgattctcctgtctcagcctcctgagtagctgggattacaggcatgcaccaccacgcctggctaattttttgtatttttagtagagacggggtttcaccatggccaggctggtgttgaactcctaacctcaggtgatctgcccgcctcagccccccagaatgctaggattacaggcgtgagccacagcgcccagccagaaggaaggcttccctgaccaggaatcgaacccgggtcrtgatggcgagcgcggaatcctaaccactagactaccagggagtgtcctaaaaacttttaaaaaatggattacagttccattgaaactcactaattactcataaatacttttgaaaagcattttataacgaactttgttgcagtctggggtgtggatggaactttgttgcagagatactcctttaaatcaggattaagtccagcactttgggaaaccgaggtgggaggatcgcttgagcccaggagtttaagactggcctggacaacaccgtgaatcccagtctctacaaaaacactaaaa

SEQ ID NO: 57012 - DNA, 601 bp, Human
gtcaaaattgaaagttcttttgaacgacctaaaaccttttttttttttttttttttgagacggagtttcgcttttgttgcccaggctggagtgcaatggcacgatctcagttcactgcaacctccacctcccgggttcaagcgattctcctgtctcagcctcctgagtagctgggattacaggcatgcaccaccacgcctggctaattttttgtatttttagtagagacggggtttcaccatggccaggctggtgttgaactcctaacctcaggtgatctgcccgcctcagccccccagartgctaggattacaggcgtgagccacagcgcccagccagaaggaaggcttccctgaccaggaatcgaacccgggtcgtgatggcgagcgcggaatcctaaccactagactaccagggagtgtcctaaaaacttttaaaaaatggattacagttccattgaaactcactaattactcataaatacttttgaaaagcattttataacgaactttgttgcagtctggggtgtggatggaactttgttgcagagatactcctttaaatcaggattaagtccagcactttgggaaaccgaggtggg

SEQ ID NO: 57013 - DNA, 601 bp, Human
gtgccaatgtcaatttcctgctttgccattgtactggagaatggaacccagaaaccgcatgagagatgttcctgtcttggcaaattcctgtgaatctataattacgtcaaaattgaaagttcttttgaacgacctaaaaccttttttttttttttttttttgagacggagtttcgcttttgttgcccaggctggagtgcaatggcacgatctcagttcactgcaacctccacctcccgggttcaagcgattctcctgtctcagcctcctgagtagctgggattacaggcatgcaccaccaygcctggctaattttttgtatttttagtagagacggggtttcaccatggccaggctggtgttgaactcctaacctcaggtgatctgcccgcctcagccccccagaatgctaggattacaggcgtgagccacagcgcccagccagaaggaaggcttccctgaccaggaatcgaacccgggtcgtgatggcgagcgcggaatcctaaccactagactaccagggagtgtcctaaaaacttttaaaaaatggattacagttccattgaaactcactaattactcataaatacttttgaaaagca

SEQ ID NO: 57014 - DNA, 601 bp, Human
caggcagatcacatgaggccaggagttcaagaccagcctggccaacgtggcaaaaccccgtctctactatagccgggcatggtggcagctgcctgtaatcccagctactcaggaggctgaggcacgaaaatcgctggaacccaggaggcggaggttgcagcgagtggagatcacgccactgcactccagcctgaatgacacagggagatcctgtctcaaaaacaaacaacaacaataacaacaaaaaaccaaaaaacaaacaaacaaacaaaaaccctgacaaatggagccagggaaggcygtgaagggggtttcttatgcatgcatgcctgataaaaacaactatcacaaaagatggcagaaaccacaaccttgcaccaaggctactgtatcttaacaaaaaaatacttctgccggtattgatctttgtagcaaaggataattgtttcaaaataacttacataaccctcctcagtttttcttttttttctttttcttttttttttttttttttttttgagacagagtcttgctctgtcgcccaggctggagtgaagtgcaggatgcgatatcagctcactgcaacctccgcctcccaggt

SEQ ID NO: 57015 - DNA, 601 bp, Human
actgacaattacccgacaatcatccccgctttctcactatctcttttgcctaataaatacggagggctgtgtaaagctcagggcccttgtccactagaggcaaggtgccccctgaccccttcttccaaatatactcttttgtctcgtcttttattcccgcttttgcccccctttgttcagtccaataggtccacagcaagtgctggcacactcctgtagtcccagctacttgggaggccaaggagggaggatcacttgagcccaggaggtggaggctgcagtaagccatgatcacaccacwgcactccagcctgggtgacaaagcagagaccctgtctcagaaaaaaaaaatcaagatttaaatatgaaatagaaaactgtaaaagttataagagatagaggaaaaaaaaaaaccctaaatctttgagacccaggactcagtgaagaattcttagacatgactccataaatgaaaaaatccataaactggacttcagcaaaattaaatagcttttctctgtggaagagcctgagaagaggatgaaaaggcaagctactgactgggagaaaatatttataaaccatatatatgccaaaggac

SEQ ID NO: 57016 - DNA, 601 bp, Human
cactgccctgccaccaaaaagtttgctgagggacgctactccctggctccttgaagttatctattgagaaatctagcacctattgttcaaaggatgcagtctcacaagcctgctgtgaaccaaacaccaaacggctaactgacaattacccgacaatcatccccgctttctcactatctcttttgcctaataaatacggagggctgtgtaaagctcagggcccttgtccactagaggcaaggtgccccctgaccccttcttccaaatatactcttttgtctcgtcttttattcccgctttygcccccctttgttcagtccaataggtccacagcaagtgctggcacactcctgtagtcccagctacttgggaggccaaggagggaggatcacttgagcccaggaggtggaggctgcagtaagccatgatcacaccactgcactccagcctgggtgacaaagcagagaccctgtctcagaaaaaaaaaatcaagatttaaatatgaaatagaaaactgtaaaagttataagagatagaggaaaaaaaaaaaccctaaatctttgagacccaggactcagtgaagaattcttagacatgactc

SEQ ID NO: 57017 - DNA, 601 bp, Human
cagatagccccacgtaattgcagccaactgactttgacaaaggtacaatgaaggatgactaatgttttccactagtggtgctagagcaattggacgtccatagtccaacaacaaaaacaacaacaaaaaacttggctaaaacctctcacaccttatacgaaaaatttaaaacgaatcaagcatgggcacagtggctcacacctgtaatcccagcactttgggaggccaaggcaggaggattgtttaaggccaggagttcaagaccagcctgagcaacatggtgagactctgtctcaaaataaaaaaaaaaattacccaggcatgcagagagccaaagcccgtgagacgtgaccaactcaacattccactggaggctatatgatcaaacagcaaagtgttcatcacgaatgcaagatgtgagcaaactcacactgccctgccaccaaaaagtttgctgagggacgctactccctggctccttgaagttatctattgagaaatctagcacctattgttcaaaggatgcagtctcacaagcctgctgtgaaccaaacaccaaacggctaactgacaattacccgacaatcatccccgctttctc

SEQ ID NO: 57018 - DNA, 601 bp, Human
agttaaaaaaaattttttttaagtttataggctgggtgcggtggctcatgcctgtaatcccagcactttgggaggccgaggtgggcagattaccggagctcaggagttcgagaccagcctagccaacatggtgaaaccccatctctaatacaaaaattagccaggcgtggtggcagctgcctgtagtcccagctacttggggggctgaggcaggagaatcacttgaacctgggaggtgcaggctgcagtgagccaagatctcgccactgcattccagcctgggcagcaagaccctgcctcaaaaaaaaaaaaattaaagtttatgaagtaaaaagtcacagtaagctaaggttaatttattattgaagaaagagaacattttaaataaatttaggttagcttaagtgtacagtgtttataagactacagtgatatacagcagaggtccccaacctttttggcaagagggaccagttttgtggaagacaatttttccacggactgggtgggtggggggatggtttcaggatgattcaagcacattacatttattgtgcactttatttctattattattactttgtaatatataatgaaataa

SEQ ID NO: 57019 - DNA, 601 bp, Human
ctgactgggaactagagaagcagcactctaaaaatgccaatagcgtggacaaaacaaagcaaaaaccaagaagaggccaggcgtggtgactcacatctgtaatcccagcactttgggaagccaaagcaagcagatcatctgaggtcaggatttcgagaccagcctggccaacatggcgaaaccctgtctctactaaaaacacaaaaattagctgggcatggtggcgctcacctgtaatcttagctattcgggagtctgaggcaggacaatggcttaaacccaggaggcagaggttgcagaragctgagattacaccactgcactccagcctgggcaacagagcaagactccatctcaaaaaaacacataaaaaactaagaggagcttgtactctctagttatgagaccaggaaaggggcagcatagcaagactacaaacttcttttttttttcttttttttttttgagatggagtctcactctgttgcccaggctggagtgcaatggcgtgatctcagctcactgcaacctccgcctcttgggttcaagcggttctcttgcctcagtctcctgagtagctgggactacaggtgcccgccac

SEQ ID NO: 57020 - DNA, 601 bp, Human
taccccgatttcatatgcttgttgctataaaaaataaccacaccatctcctagaacttatgaaaaactggcaagatgttcagaaataccaacgggatgtcttttgaaattgttcccaggttgaatttcaaaatggagatctcttctggaaagattgagatgtcatgttttccgtatttgtcctgctgagtactgctgaaaacctctcagaaaggcagagagaggaaggccaattgggtcaggatctccagacccaagaaacaacatggcaatgggtttctttctgcctcatttccctctgwctgggaactagagaagcagcactctaaaaatgccaatagcgtggacaaaacaaagcaaaaaccaagaagaggccaggcgtggtgactcacatctgtaatcccagcactttgggaagccaaagcaagcagatcatctgaggtcaggatttcgagaccagcctggccaacatggcgaaaccctgtctctactaaaaacacaaaaattagctgggcatggtggcgctcacctgtaatcttagctattcgggagtctgaggcaggacaatggcttaaacccaggaggcagaggttgcagagagc

SEQ ID NO: 57021 - DNA, 601 bp, Human
cgccattgcactccagcctgggtgacaacagcgaaactctgtctcaaaaaacaaaacaaaacaaaacaaaacaaaacaaaacaaaacaaaaacaggccgggtgcagtggctcatgcctgtaatcccagcactttgggaggctgaggccggtggatcacaaggtcaggagttcaagaccagcctggccaagatggtgaaaccccgtctctactaaaaataccaaaaaaattagctgggcgtggtggtgggcgcctgtaatcccagctactcgggaggctgaggcagagaatcgcctgaaccygggaggtggaggttgcagtgagctgagattgcgccactgcactccagcctgggtgacagagtgagactccatctaaaaaaaattataataataatagtaataataattttaacaaactcatccacaagagaggtaacagcaaggatgaacttcctctagagattatttgaaatttgtttcctcttaccaaatatttgtattggtctttaagaactattttctttattttctacattagctaaaaaagcatgaatcttaagcatgaatcactaaaccataaaatattagccatatcccaat

SEQ ID NO: 57022 - DNA, 601 bp, Human
tggaaggccgaggtgggcagatcacttgaggtcaggagttcaagaccagcgtggccaacatagcaaaaccccatccctactaaaaatacaaaaattagccgggcgtggtggcaggtgcctgtaatcccagctactcaggaggctgaggcaggacaattgcttgaacccaggagacagagattgcagtgacttgagatggcgccattgcactccagcctgggtgacaacagcgaaactctgtctcaaaaaacaaaacaaaacaaaacaaaacaaaacaaaacaaaacaaaaacaggccgggygcagtggctcatgcctgtaatcccagcactttgggaggctgaggccggtggatcacaaggtcaggagttcaagaccagcctggccaagatggtgaaaccccgtctctactaaaaataccaaaaaaattagctgggcgtggtggtgggcgcctgtaatcccagctactcgggaggctgaggcagagaatcgcctgaacctgggaggtggaggttgcagtgagctgagattgcgccactgcactccagcctgggtgacagagtgagactccatctaaaaaaaattataataataatagtaat

SEQ ID NO: 57023 - DNA, 601 bp, Human
atcatcagaaagctgcttgggatgaacttttagagacgagaaactataaaatccttggcttaaaagagggtttgtttgttttttttctttatttaaaaaaagcctatttaaaaagtactcaagattaaagataagattaaatctagttaagtttttgatggaacctaatccccaagcattagctttctcatttctctaactaaatggaaagataatggcaaaatgagaaactacttgactgatgtgtatttctttaactcaacttagacttaaactgaattaacataaatcaaaaggaaaygatcaatatacttggaagtctatgaactccctagttccctagtttgtcatttactaaaaaatttttagtaaacatttttgtttcgtagaacacatatcagatgatttttttaaacaaaaggtgaaacaaataaatccattaataatctataattagaacaaccagtgctacattcaaccagttcatttaaagtaaaaactaaaagtaatgatgttttaaatttcatgcaatttttaaaattggaaaaatgtatatattacccaaaacaagagtacagaggtaacatgaaacaagcaatta

SEQ ID NO: 57024 - DNA, 601 bp, Human
gaggtggaaatgctaccagcccgtgtgccagccagcagaatgggaagccgggagacgtggatctgacacccgcgtgatgagccaagcccctcggctgcctcgaacgagagctgagggataagccacagcctttctcaaaaccattttggttcaaaaagtctgactctccctcatttctgcttatctactgctgcctactgcctttttgcttttagatatttgggtggtgacattggagaggaaaaagaaagatcgtttacaatcttcctataaagccagtaggatggtatcacctcttctyttactgaacttcaagatttcaatacaattattatacttagaattggcttcaaaatcatctgtaaggaacttgattgtggcatttcctatgtgaaatgtggtcgaccagatggcatatagaatgcatggtaagtgcgcttaaggtgtgtggaaagggcacaccggagtgtgaggcgtggtaagtgcagacctgctgctgtgttgcgattcgaggctgtgggagtcagggtgggaggccatgtgtgggaccagcgtgccacaggcttacaaatagctgcaaccttgattggaggacagtgag

SEQ ID NO: 57025 - DNA, 601 bp, Human
gaagggaagctctttctagctcctccggagttaagcgcgcgtcttcatgaggtgctacagagtaaaaacagatacttagaattgggttcatccttcagttagttatttctgttccttgtgtctttggcgagcaccagagatagggagatgaacactagaaaaacttccaacgctgagttcatgacgtgtcatcagtggtattctagaagaggtggaaatgctaccagcccgtgtgccagccagcagaatgggaagccgggagacgtggatctgacacccgcgtgatgagccaagcccctckgctgcctcgaacgagagctgagggataagccacagcctttctcaaaaccattttggttcaaaaagtctgactctccctcatttctgcttatctactgctgcctactgcctttttgcttttagatatttgggtggtgacattggagaggaaaaagaaagatcgtttacaatcttcctataaagccagtaggatggtatcacctcttcttttactgaacttcaagatttcaatacaattattatacttagaattggcttcaaaatcatctgtaaggaacttgattgtggcatttcctatgtg

SEQ ID NO: 57026 - DNA, 601 bp, Human
agaagggaagctctttctagctcctccggagttaagcgcgcgtcttcatgaggtgctacagagtaaaaacagatacttagaattgggttcatccttcagttagttatttctgttccttgtgtctttggcgagcaccagagatagggagatgaacactagaaaaacttccaacgctgagttcatgacgtgtcatcagtggtattctagaagaggtggaaatgctaccagcccgtgtgccagccagcagaatgggaagccgggagacgtggatctgacacccgcgtgatgagccaagcccctyggctgcctcgaacgagagctgagggataagccacagcctttctcaaaaccattttggttcaaaaagtctgactctccctcatttctgcttatctactgctgcctactgcctttttgcttttagatatttgggtggtgacattggagaggaaaaagaaagatcgtttacaatcttcctataaagccagtaggatggtatcacctcttcttttactgaacttcaagatttcaatacaattattatacttagaattggcttcaaaatcatctgtaaggaacttgattgtggcatttcctatgt

SEQ ID NO: 57027 - DNA, 601 bp, Human
ttctagatgaggacagacggtaagttcagtagcaattaaatcagacacgctataaacatgagaagcattttacctgctttcctgagaatatcccctctttctgcacccagcatctctggcagtatctgtagaagggaagctctttctagctcctccggagttaagcgcgcgtcttcatgaggtgctacagagtaaaaacagatacttagaattgggttcatccttcagttagttatttctgttccttgtgtctttggcgagcaccagagatagggagatgaacactagaaaaacttccaaygctgagttcatgacgtgtcatcagtggtattctagaagaggtggaaatgctaccagcccgtgtgccagccagcagaatgggaagccgggagacgtggatctgacacccgcgtgatgagccaagcccctcggctgcctcgaacgagagctgagggataagccacagcctttctcaaaaccattttggttcaaaaagtctgactctccctcatttctgcttatctactgctgcctactgcctttttgcttttagatatttgggtggtgacattggagaggaaaaagaaagatcgtttacaat

SEQ ID NO: 57028 - DNA, 601 bp, Human
ccagcaaaaggctcaattttgtttccagaacttcctgagcatatgtgtcaatgcttgggggaatgtggccacgggggaataagctgacattttattaatgactttctgtgtgactcgagcattttacttgccttgactcattgactcttcacaagttaccttctgaggtggaaacttaatcattcctgattacagattaagaaactggagtacagaaagattactttaagttttcagtaaacgggaaactaggattttaaattgcactcactggaaactggaataattaccaccaagctcyaccccgcaaaaataaaagtccacacagaaagacaaaatgctgaggtaccaaagagcacagtgcgagcaaggagctgctggggaaaagaaggttgcacaggccgggaggggagagtgttggtaattacttattttatatagctcatctttatattccaaaatagagctttacctcttctagatgaggacagacggtaagttcagtagcaattaaatcagacacgctataaacatgagaagcattttacctgctttcctgagaatatcccctctttctgcacccagcatctctggcagtatc

SEQ ID NO: 57029 - DNA, 601 bp, Human
gagatcttggctcaccacaacctctgcctcctgggttcaagcaattctcctgcctcagcctccctagtagctgggattacaggtgcccgccaccatgcccggctgatatttgtatttttagtcgagatgggttttcaccatgttggccaggctggtcctaaactcctgacttcaagtgatccgcccacctcagcctcccaaagtgctgggattacaggtgtgagccaccgcacccagcaaaaggctcaattttgtttccagaacttcctgagcatatgtgtcaatgcttgggggaatgtgrccacgggggaataagctgacattttattaatgactttctgtgtgactcgagcattttacttgccttgactcattgactcttcacaagttaccttctgaggtggaaacttaatcattcctgattacagattaagaaactggagtacagaaagattactttaagttttcagtaaacgggaaactaggattttaaattgcactcactggaaactggaataattaccaccaagctctaccccgcaaaaataaaagtccacacagaaagacaaaatgctgaggtaccaaagagcacagtgcgagc

SEQ ID NO: 57030 - DNA, 601 bp, Human
ttggtacttgagtctgaaaaacagttttgaagccagttcatcagatctgttgtttctcttgtatgcttgttttaaaatatacaaaataatattactaaattatgtctagtttctggtctttttccacactgcagcaagcttttcttgaatgcagacagacaggcactcctgttcttatctcgaattcacagaagtcactgcattgtcctcagtaacttcgcagtccagtagctcgtcaaagatattttataacaaatgaactcctgtctattaaacaatacctatcttaaaaggctcaaattttttttttttttttttgagacagagtcttgctctgttgcccaggctggagtgcagtggtgagatcttggctcaccacaacctctgcctcctgggttcaagcaattctcctgcctcagcctccctagtagctgggattacaggtgcccgccaccatgcccggctgatatttgtatttttagtcgagatgggttttcaccatgttggccaggctggtcctaaactcctgacttcaagtgatccgcccacctcagcctcccaaagtgctgggattacaggtgtgagccaccgcacccagcaa

SEQ ID NO: 57031 - DNA, 601 bp, Human
atttttgtatttttagtagagacagggtttcaccatgttggccaggctggtctcgaacttctgacctcaggtggtccgcccgcctcggcctcccaaagtgctgggatcacaggcatgagctaccgcgcctggtcatgctggccaattattttaaggtgtggtttccaccaagaacactcctctagttcatgaattcagagtcctgtaaaaccagtacagaatgttcacctttttaaacctaactcataaatagagtcacttacctttctcaaatttcctcttgggttaaaaatgttggtayttgagtctgaaaaacagttttgaagccagttcatcagatctgttgtttctcttgtatgcttgttttaaaatatacaaaataatattactaaattatgtctagtttctggtctttttccacactgcagcaagcttttcttgaatgcagacagacaggcactcctgttcttatctcgaattcacagaagtcactgcattgtcctcagtaacttcgcagtccagtagctcgtcaaagatattttataacaaatgaactcctgtctattaaacaatacctatcttaaaaggctcaaattttttt

SEQ ID NO: 57032 - DNA, 601 bp, Human
tgtattcttttgagatggagttttgctctgttccccgggctggagtgaagtagtgcgatctcctctcactgcaacccccgcctccaggttcaagtgatcctcctgcaccagcctcccgaatagctgggattacaggtgcatgccaccacgcctggctaagttttgtattttttgtagagacggggtttcgctgtgttgcccaggctggtcttgaactcctggcctcaagcaatccgcctacctcggcctcccgtgctgggatgacaagtgtgagccaccgcacccggccttctgtacatcrttcaggtcaatgtctggagcatggccttcctccattagatgttgtcttgcagtgcccttcacactttcccatgcatgtgaatcacctggggatcttgttaagatgcagattttgcttccgcaggtcctaggtgggcctaagatcctgcatccctcactggcttccaggtgctcccggtgctgctggcggtgggccgcatgttagatggtgaatgagagcacaagtggatgccagactggagagcagggacctcacccatttttttcattctttcacaacttatttgatttacccaaaaca

SEQ ID NO: 57033 - DNA, 601 bp, Human
gtatactgtattgtattgtattgtattcttttgagatggagttttgctctgttccccgggctggagtgaagtagtgcgatctcctctcactgcaacccccgcctccaggttcaagtgatcctcctgcaccagcctcccgaatagctgggattacaggtgcatgccaccacgcctggctaagttttgtattttttgtagagacggggtttcgctgtgttgcccaggctggtcttgaactcctggcctcaagcaatccgcctacctcggcctcccgtgctgggatgacaagtgtgagccaccrcacccggccttctgtacatcgttcaggtcaatgtctggagcatggccttcctccattagatgttgtcttgcagtgcccttcacactttcccatgcatgtgaatcacctggggatcttgttaagatgcagattttgcttccgcaggtcctaggtgggcctaagatcctgcatccctcactggcttccaggtgctcccggtgctgctggcggtgggccgcatgttagatggtgaatgagagcacaagtggatgccagactggagagcagggacctcacccatttttttcattctttcacaac

SEQ ID NO: 57034 - DNA, 601 bp, Human
aaacaatccaaacgaacaacaacaacaaaaaaaaacagataagttaccaacgagtgacgattcctataagaaaaaggaatcttgagtcaagacactggacttcttaaaagtatttgcatttttccctggactataattgtaacaagagtgtcccgggcccgtggggctcctgtgcccacctccctacctctaatgagtgtccttccagtctgttcagcccagcgattgtcctgaattttcctaaaccctcattgaccgatttctatttaaatcatttcagcggctgggcaggtggctcatrcctataatcctagcactttaggaggctgaggtgggcagatcacttgagcctaagagtttgagaccagcctgggcaacatgatgaaacctcgtctctacaaaaattagctgggtgtggtggcgggctcctgtagtcccagctactcgggaggctgaggcattagaattgcttgaacctgggaggtggatgttgcagtgagccaagatcacaccactgcactccagcctgggtaacagagcaagaccctgtctcaataaataaataaataaatagtaacatgttctgtgcatgtattgtctt

SEQ ID NO: 57035 - DNA, 601 bp, Human
agaggatttattttccaggtaacaatgaacagggtgtagtttgcctagtttttctccacactgttttcaaatcaagcattgtgttatttttcatattctaagatgggtgtttctgagctgactaacagatgcttatttcacttcagacacagtatttccagaagcaatcaggagtctcacgtttcttgtatggtttccagattctggccaaaagatgactcagtaaaatgttaggatcttgtccagagaaatcctgaaactaaaacaatccaaacgaacaacaacaacaaaaaaaaacagrtaagttaccaacgagtgacgattcctataagaaaaaggaatcttgagtcaagacactggacttcttaaaagtatttgcatttttccctggactataattgtaacaagagtgtcccgggcccgtggggctcctgtgcccacctccctacctctaatgagtgtccttccagtctgttcagcccagcgattgtcctgaattttcctaaaccctcattgaccgatttctatttaaatcatttcagcggctgggcaggtggctcatgcctataatcctagcactttaggaggctgaggtgggcag

SEQ ID NO: 57036 - DNA, 601 bp, Human; identical to SEQ ID NO: 25088

SEQ ID NO: 57037 - DNA, 601 bp, Human
tatacccataaattctttggttagtgtaaatttggatgatggggattggggcaagaagagttactgatatatttaaaatccattgaggaagtacagagatttttttggttcccttaccagcagaactgattcttaaaggaactgtaccttgaaaagctttccttagtgaaataattgcattttaatattgtttacattagaagagtaaggagtacggcaattcatgaactattctggtcctttcttcttctcctaactgtgatttcattttcactggggttagtttgattgcatataagcmtccctctgaaaaataaaacatggcctagagccagttcttcagaatcatttcaaaatacctgcagaaaccctcccaaagaacaggctcctccagcccatatgggtcttctgaactcttccccacagctcgtaaagccatgcccaggaaggccatgaccacttgctgtgaatcttaataggacacatgagctggtttggccctcctaggatccaggaggatctggcaactcctcaaaagaggctgagttttcagcacctgaaggtacaaaaaatgtctcactcaactacttcccagcctacc

SEQ ID NO: 57038 - DNA, 601 bp, Human
tgggtggctcagtgagcccttttggagaaagcaagtattattcttaaggagtaaccacttcccattgttctactttctaccatcatcaattgtatattatgtattctttggagaactatgttatttgtactgtctattccagataaaacttaccttacaccactttggattcttacagaacctaaggcctagtacaattaagttattccgatcaaattgggaggatgttgtaggcagtttcagatttgtggggatctcccaggatgcctttgatacattcatttatatatcaattattaaytgagtacaagtaagtgcccgaaagttaattgcccccggttcctactgtgtaaagaaatcacctttctttttttttttttttttttttaagacagtatctcactctgtggcccaggctggagtgcagtgccacagtctccgctcactgcagcctttgcctcccaggttcaagtgattcttgtgcctcagtatctcaagtagctgggattacaggtgcccaccaacacgcccagctaatttttgtatttttagtagagacgaggtttcgccatgttggccaggctggtctcgaaccgctgac

SEQ ID NO: 57039 - DNA, 601 bp, Human
tggagaaagcaagtattattcttaaggagtaaccacttcccattgttctactttctaccatcatcaattgtatattatgtattctttggagaactatgttatttgtactgtctattccagataaaacttaccttacaccactttggattcttacagaacctaaggcctagtacaattaagttattccgatcaaattgggaggatgttgtaggcagtttcagatttgtggggatctcccaggatgcctttgatacattcatttatatatcaattattaattgagtacaagtaagtgcccgamagttaattgcccccggttcctactgtgtaaagaaatcacctttctttttttttttttttttttttaagacagtatctcactctgtggcccaggctggagtgcagtgccacagtctccgctcactgcagcctttgcctcccaggttcaagtgattcttgtgcctcagtatctcaagtagctgggattacaggtgcccaccaacacgcccagctaatttttgtatttttagtagagacgaggtttcgccatgttggccaggctggtctcgaaccgctgacctcaggtggtccacctgcctct

SEQ ID NO: 57040 - DNA, 601 bp, Human
cctcccagagtgctgggattacaggcatgagccactgtgcccggccaagaaatcacctttcactggaaatttctcttttccagtcaaaaagaaattttatcaacctcaaactagacaattgcaatagcctttcttccgtggcagaatctctgttcattaaagaatagtatgaatggctgttaaacccataaaaatgatttcctcagaattttacctctggaatatgtaatgattaaaaccataaagcctgattctttaacatcctgcgacaactgttaactggattcctttaattttttayttattttttatctttttgagaaaaggtctcattctgtcacccaggctggaatgcagtggtgcaatcatggctcactgcaaactctgcctcccaggctcaagcaatcctcccacctcagcctccccggtagctaggaccacagatgcatgccatcatgcccagctaatagctgattttgttatttttagtagagatgggggcctcacaatattgcccaggctgttctcgaactcctgggctcaagagatccacttgtctctgtcttctaaagtgctgagactacaggtgtgagccactgtg

SEQ ID NO: 57041 - DNA, 601 bp, Human
tgattttgttatttttagtagagatgggggcctcacaatattgcccaggctgttctcgaactcctgggctcaagagatccacttgtctctgtcttctaaagtgctgagactacaggtgtgagccactgtgcctggcctattaactgtcagatactataaaacccagaaaaattctcttctaaaacactgagttgaggccttaacatgaatttcactttttgtttctgatttatcagaccttattatatttaatgtacttaacttgtccgaaaaggcaaaagttcctctttggtgcttgtgygtcattcgaaaaatctcaagagagtcactgtagttttctcatgttccgtgtaagatctcttcttgaaaactcaaacgtatggccaatcacaggttcctttatgaccataattttaaggtgccattctgataactttaggaagcaaaggcatggctttgttactgcagattattttgctgtgtcaacatacaatattcatcttatccatcttggtctacatttcaataggaatagatgggaccatggtaatagagaacagttttgttgttgttgttgttgttggggtccataagggttttt

SEQ ID NO: 57042 - DNA, 601 bp, Human
ggaagcatttttgttacttttatttaaaattattgcaattgttttatttaaaaattatttttaggctgtttgtggacacagagaagaattttgattataattaataatgactatttttatcttcactgctccttaattagtctatgaaaactatattaagagacacaaaatactcttggctgccagtatgttctgtggtaattctaaacttcatctctagacatacttaagtgtgttagatgataaagaacaggattaaagttctagcaatcaaacataagtatggaaattttaatttcaygtgtgtacctgagagcatgtggccacatcttctttgttattattccatgttagttcttgatggaaacagatgtcttttctggaatccatggtttgttcaaagtactgcatcctggggaaactgaataaatacacagaaaggtagtagctgaattagtgttctgagttaggttaatcatgaagtagctactgtttattcatgaggggtttcctaaaatttgagagcataccagttaaggaaagccaaactgtgaaaaagaagaaaagactttgtcacttaattttctacatgtatgcaaat

SEQ ID NO: 57043 - DNA, 601 bp, Human
aggaaagccaaactgtgaaaaagaagaaaagactttgtcacttaattttctacatgtatgcaaattatctcataactggataagaagagggcttctgtccttgcagctttttacaaagacagcccccccaaagtcaaagtgatcatactgtcttgtcgtaattctgctctgtgtggataggctcagttttaatttacaaagagtatgtttgttttagacagcccaaagatggaccacaggccaaatttcaagatgttcccattcatgggacagagtatttatgggctttaacgtacatttycagagtaaacttttaggtcccatcagattggggcatgaattgattgatttggcagaggcggagaccagaatcattcaatctcacacttatttctctttctataatgagttcacaaaaagctaactgtaatctgactttcattatgcctttcaagtctaaatccactttgataagacttgcccttttatactcccttaggaatcctttttaggccaatttggcacatcagggcagcgtctaaaattacatttaataatatgtcaaatgttagatcttatgattttgttctattcttttttt

SEQ ID NO: 57044 - DNA, 601 bp, Human
atgggacagagtatttatgggctttaacgtacattttcagagtaaacttttaggtcccatcagattggggcatgaattgattgatttggcagaggcggagaccagaatcattcaatctcacacttatttctctttctataatgagttcacaaaaagctaactgtaatctgactttcattatgcctttcaagtctaaatccactttgataagacttgcccttttatactcccttaggaatcctttttaggccaatttggcacatcagggcagcgtctaaaattacatttaataatatgtcaratgttagatcttatgattttgttctattctttttttttgatgtgtatttagctattttggtaagtattcttcttctctaaaattgtccaaatctttcctaaatactctttataaattgctttgcttgcatctggtgatatcgtttgccttctaaaaattttaatgaatcttggaacagaatgctctacttaaaactcaaaatgtgtcctttttaattctacattttgtcatgtttagagttagatgtctttagggttgttatgcacacagtatgtgtcttggctttttctttatgcatct

SEQ ID NO: 57045 - DNA, 601 bp, Human
catgaccacatatggatgtggtgggtgattgattgagtgtcactgtgtttattgcggtggaattttatttttatgaccccacctggcgtcaggactcttcttcctctatttttaaaaagtcacccaatgtgaggtccagcaacagtttggagcaaggcctttaagaaatttatcctataaccctatagccacataaataagtgatacaagatcaggtacaatggctcatgcctgtaatcccagcattttgggaggccaaggccagagaattgcttaagcccaggggtttgagaccagcccragcaacatggtgaaacagcatgaaaaaatacaaaaattatctggatgtggtggtgtacacctgtagtcccagctacttgggaggctgaagcaggagattcacttgagcccaggaggctgcaatgagccatgatcatgccactgcactcctgcctgggtggcagagtgagactctgtctcaaaataataataacaataataactgattcaagatccccaaaaaagacacagtaaaggaggaaactgttaacaattcaaattgcttttgcaataatttctttttgacctatgctaaaatttt

SEQ ID NO: 57046 - DNA, 601 bp, Human
agtgaggaaggcaagtcctcagatcttagcaattttcccccagccccatgttaacaatgagaagctatttgttgctatgtaataaggaccatattttaatcctcttcctgtgtgaaatgacatcctgagatgaaacttgcataattagaaggacaaaagaatgaattgactaggggaggaaaaaaaaccctgtagattcagggaaattccaaaggttgaataatgagtcattgaatatttacatgatcaaggtacaattagacttcatctattcagaacattagagtacagtacagtcttyggcaacattcgaccatagtaaataaatatggattaaattgattgaatcattctgaatagctggattctctgcacagctaaaggttaattttgttatataacctcagagccttattttttccaccagtttgaatagaaacattcttaaaatgtaatatattactccttgctttaaaaaataaagtacagtggatataatttgtcttaaattatagatatcagttattagtagcatgtgacaccctgagggcccaaattatttgctcttttgaaaaatggactcatattgatttgtattttg

SEQ ID NO: 57047 - DNA, 601 bp, Human
ttcgaccatagtaaataaatatggattaaattgattgaatcattctgaatagctggattctctgcacagctaaaggttaattttgttatataacctcagagccttattttttccaccagtttgaatagaaacattcttaaaatgtaatatattactccttgctttaaaaaataaagtacagtggatataatttgtcttaaattatagatatcagttattagtagcatgtgacaccctgagggcccaaattatttgctcttttgaaaaatggactcatattgatttgtattttgaatttctktccaatttttcttagctttcctactttatccctcctagaagtgtgctgtcttctttagtactcttgtcagtcagcatatgaaactgttcccctcactcccctttgtcctttattatagacgccattccaggtaattaatctggctgagtagagtttagcaccacctaaggcacaacatttaagaaggcactgactttctgggtcaccaaaatgcaggttcagccccttaagtgacctccttaaattttgctcctcaggcaccctgcttacctttcccaagtcccaggccctgggtttact

SEQ ID NO: 57048 - DNA, 601 bp, Human
agtccccatcccaaatgcaaacacgttttaacacatgcagctcacagacctagaaataaggcatatccttagcaggcagcatgtggaggaagacataagtgtcttttcgtaggtgtgtccgagtaaaaatgatgatcataatgataaaagccatgaaaagttaaagtctatgtgacacttgccatgttctctacccctgttaatgcattcattcctgccaataacccctgagttaggctgtgctattatttctctcatacttgaggaaatcgatgtgcaccccactcctacaaatagggarggcaacatccatatgaggttatgtggtcttgagaataagaccaagcaattcagtggggaaaatggtgtaattgcgctgagaagtccaccagtcctcctctgccttgtccaacataggtagcagggaaaggaagtgcaggcccgggctgcagagcccaggctctgagtcaagcaagcctggatcacagcctggttccacactccctaggctgtgggatctcaaagagtctcagttcccacttgcaaaatggagataatcatagtactgatttcacagagttgtaaggattataaggattaa

SEQ ID NO: 57049 - DNA, 601 bp, Human
tggcaataaggataaagattgccaaatgatagtaatggtaacagttcaattatagagctctttctacatagcaggaactaccctatgcatcttacatagaattggcaccctaagaggttatttatcttgttattcttatttcacagatgaagagcccaaggctgttagagattaaggaattgcccatgattgcacaatgaataaggcagagtcaggattcagacctaagtctgactccatcacatgttcagaaaaagcaggaggtctgctgggaagaacagtggcagaaaggtcagaaggkgaacagaaatggctctagaacagagaggccactgagacgtagtaagagaagggagagaaagaagtgcccatgaacaacggctttgaatgcgaacctggggagtgtagacctaaccaaataataatagaaatactttcaagtagaataatgggatgaaacacagttgtaggataaataacttctgcagctgtggagaaaggagactggagggatgagaaacttgtctgtagacagagccaggaagaagtccttgggcatggcatggcaatggcccagtctgaaagatagcgtgtcaaagaa

SEQ ID NO: 57050 - DNA, 601 bp, Human
tggtaacagttcaattatagagctctttctacatagcaggaactaccctatgcatcttacatagaattggcaccctaagaggttatttatcttgttattcttatttcacagatgaagagcccaaggctgttagagattaaggaattgcccatgattgcacaatgaataaggcagagtcaggattcagacctaagtctgactccatcacatgttcagaaaaagcaggaggtctgctgggaagaacagtggcagaaaggtcagaaggggaacagaaatggctctagaacagagaggccactgrgacgtagtaagagaagggagagaaagaagtgcccatgaacaacggctttgaatgcgaacctggggagtgtagacctaaccaaataataatagaaatactttcaagtagaataatgggatgaaacacagttgtaggataaataacttctgcagctgtggagaaaggagactggagggatgagaaacttgtctgtagacagagccaggaagaagtccttgggcatggcatggcaatggcccagtctgaaagatagcgtgtcaaagaaattggcatctcgctctcagtattctgatatccgtg

SEQ ID NO: 57051 - DNA, 601 bp, Human
ggtcagaaggggaacagaaatggctctagaacagagaggccactgagacgtagtaagagaagggagagaaagaagtgcccatgaacaacggctttgaatgcgaacctggggagtgtagacctaaccaaataataatagaaatactttcaagtagaataatgggatgaaacacagttgtaggataaataacttctgcagctgtggagaaaggagactggagggatgagaaacttgtctgtagacagagccaggaagaagtccttgggcatggcatggcaatggcccagtctgaaagatagcrtgtcaaagaaattggcatctcgctctcagtattctgatatccgtgtgctgcaacaacttattcaaagccaagaggacaatattagatttccatttctgcactcagatctctgaaaataaaatgctttgactgacagtttcatgttttggttgacgataaccctagtgattctttccatgatgtagtgaagaaacaaaaacatttctgacaatgccatccaagggacatttgtgttttcactgtatctgcaaattacatcacatcctgccacgttttcttctgtccatctataagtttatg

SEQ ID NO: 57052 - DNA, 601 bp, Human
aaacaaaaacatttctgacaatgccatccaagggacatttgtgttttcactgtatctgcaaattacatcacatcctgccacgttttcttctgtccatctataagtttatgttttttgtcttttggttatatatatccttctccctcactagtaaatagtaataaacttatttatggccatctgaataaaagtttttaaaaaacaataaattggagtttatactagccccaaaatcagtgatggaaaaagacatgattgcatcctggcaggcctgcattactgttttcttgatttctgttayggtgcaatccattcatttttctatgctcattccagccttcctagactagaacggggcatttggcctacacatagtggtgactgttcagccaaactgcttgttatggggcatcgtccgccctgcttaacaagagtcacttgtggaaaaaaatgtggaaaatcccatatgctgacaaaggctcccaggattccacaatgtgcctataatacaaaaactttgttatctttatattttatttagtaatcaagtagaagataattttagaagcgatcaccttcattaactgcctcttcttgtcct

SEQ ID NO: 57053 - DNA, 601 bp, Human
agaacggggcatttggcctacacatagtggtgactgttcagccaaactgcttgttatggggcatcgtccgccctgcttaacaagagtcacttgtggaaaaaaatgtggaaaatcccatatgctgacaaaggctcccaggattccacaatgtgcctataatacaaaaactttgttatctttatattttatttagtaatcaagtagaagataattttagaagcgatcaccttcattaactgcctcttcttgtcctggagatgaagcaggtggttcatgagtgagtgatactcacatgtcactrattcccaattctgggcatccacagggatttggcacgggaaatgctatgctctttgttcatgtggatgcctttacctacttggaaatagtatgttctttaacagaagtttctttgtcagacttcatagccagactgctctgtaataaccagacatcgaaagccaggtaaaccaaaaccaaacctcaaaaccagagcctggaaaattttggataggtgtaggtgggaatctactccaagcacgtatgcttccagaaacaactctgagagggcttaattctgtttcccagtgaattgcaccgt

SEQ ID NO: 57054 - DNA, 601 bp, Human
caagagtcacttgtggaaaaaaatgtggaaaatcccatatgctgacaaaggctcccaggattccacaatgtgcctataatacaaaaactttgttatctttatattttatttagtaatcaagtagaagataattttagaagcgatcaccttcattaactgcctcttcttgtcctggagatgaagcaggtggttcatgagtgagtgatactcacatgtcactaattcccaattctgggcatccacagggatttggcacgggaaatgctatgctctttgttcatgtggatgcctttacctactkggaaatagtatgttctttaacagaagtttctttgtcagacttcatagccagactgctctgtaataaccagacatcgaaagccaggtaaaccaaaaccaaacctcaaaaccagagcctggaaaattttggataggtgtaggtgggaatctactccaagcacgtatgcttccagaaacaactctgagagggcttaattctgtttcccagtgaattgcaccgtccttgtaaaacaacaacaacaaagcactgcaaagccagaggactttcatgtcatctgctttcagaaagtgtctctcatgc

SEQ ID NO: 57055 - DNA, 601 bp, Human
tggaaaaaaatgtggaaaatcccatatgctgacaaaggctcccaggattccacaatgtgcctataatacaaaaactttgttatctttatattttatttagtaatcaagtagaagataattttagaagcgatcaccttcattaactgcctcttcttgtcctggagatgaagcaggtggttcatgagtgagtgatactcacatgtcactaattcccaattctgggcatccacagggatttggcacgggaaatgctatgctctttgttcatgtggatgcctttacctacttggaaatagtatgytctttaacagaagtttctttgtcagacttcatagccagactgctctgtaataaccagacatcgaaagccaggtaaaccaaaaccaaacctcaaaaccagagcctggaaaattttggataggtgtaggtgggaatctactccaagcacgtatgcttccagaaacaactctgagagggcttaattctgtttcccagtgaattgcaccgtccttgtaaaacaacaacaacaaagcactgcaaagccagaggactttcatgtcatctgctttcagaaagtgtctctcatgcaggcagaacaatg

SEQ ID NO: 57056 - DNA, 601 bp, Human
tcatatatattagggggacaattcttatgaaacctttcaaattatgtaaaagttattatgtccgcattttacagtgtggaggctgagcctccatccaaggggctgaagaatttgtgaggctttttcctatatagtgaaggtcaaacaaacccacatcttctttatgagagtggggagtggatccatctctaccctggaagatcagctgtcccttctcaacttgacatatgtcactattgagcacctccagaaactccctagcagctatccagaaaggtttggtgacctctgaggttcaacrtgaggaccaacttcttgagttcttagcaccatattgtccaccagctggcaacaggaaatgagtacagagatccagtgagacccttggcaggtagggcagtcccctatgacacacaatatatgaagcttgtttttatgtccacatacacctaaagaagaaaagaaaattaaaagattaaaagattgaaagctcaatgtggcttaaactcccaacatggctcttcagagtcatttatcagccaaatagccccaagatggaagcaaccaaaatcatgtgcattttcccataaagactccaaag

SEQ ID NO: 57057 - DNA, 601 bp, Human
ccagaaactccctagcagctatccagaaaggtttggtgacctctgaggttcaacgtgaggaccaacttcttgagttcttagcaccatattgtccaccagctggcaacaggaaatgagtacagagatccagtgagacccttggcaggtagggcagtcccctatgacacacaatatatgaagcttgtttttatgtccacatacacctaaagaagaaaagaaaattaaaagattaaaagattgaaagctcaatgtggcttaaactcccaacatggctcttcagagtcatttatcagccaaatasccccaagatggaagcaaccaaaatcatgtgcattttcccataaagactccaaagtggccttcctcatccctcttcctccttgaaaaggatgagaaactggcatcccactcaataattattcactaggtatttaccctgtgcacaactctgacctaacccttcagagggattcagacatacctatcatgtacgtattgatagctaggtgcaagcatattgtaccagatgtagtggggaactctacatagaaaacatctccctgtattcagtttgtttgcagccaagtagaaaatagaatac

SEQ ID NO: 57058 - DNA, 601 bp, Human
aactctacatagaaaacatctccctgtattcagtttgtttgcagccaagtagaaaatagaatacagcctgggaaacaattaaataaaatgcagccaaaacattaaaacattaggcaatattataagaaccccccgccccccccccgcccccccacaccaagcagtatgtgattacttgtgagttgcttaaactggcaatgtgttatgaagccagcaggtgactgtagacctggtccagcttaggtgaaagcaggagtttggagaaggtctcagtttctaatcatcttttcacacaaaaacktatgaggcaattataaagctcttcctcttcctccctggagatcgtttttcttttttctttgttttcttttttcttttctttctctttcttgagacagggtcttgctctgttatccaagctggagcgcagtggcaccatcacagctcaccgcagcctcaaactcttgggcgcaagcagagattgtttttcaggagggcagtttgagaaatctagctgctcacaagaggccctttgtccagctaagaatactagattcacacactcaaaccctaaacagtatagagaagtattactatgtgt

SEQ ID NO: 57059 - DNA, 601 bp, Human
gtcaaagtttaaacaaagcctgtgcctgacccttaatttgaaaagtcaccatattatacttgtatgcttaaatgagaaaatgtctttccttaaagtcaaccaaccaacaaaaactcttttatttatggagaacacagcgtgatgaaagagcaaggctagatgactagggcattttgaaattagtagcatttttctgacgtttgcagaagataagcaaaaccatgaccacatgcagttgcatgcccaggtacaaaaactgccgtgtgtgtgtgtgtgtgtgtgtgtgtgtgtgtgtgtgtgtctgtatatatattatataatggcaaatacatgtatatatatatgtatttgccttacatacctaggaagcaaatcaatttgggatagaaagtgacatccctaaataaagaaggtaagtgaatggaagtttataataaatatacagtcctcttcatcaaggacagagaaaatacctatgcaaaaagtagacacaataattactgctacttggatatccccagttgagaaaggagccctgcacgagcataaacaggattgatgggtgcaacctaccttttctccagcatgagctagaactctc

SEQ ID NO: 57060 - DNA, 601 bp, Human
tttttttgtcaactaagatccaacatcctatgtctgaacatagggtaattggagtaggtttctgctgtgcctcaacagctggccctgtggaaagttccgaaaatggttctgtggctggtccaaaaagtgacagcagcattagaatcagaggccactttgaagacctgtactcatttccatgcctaagtgctgatattttatttttacatcttattagcttagagtctgtatcttttcaattggtaaagttacttcctttttttattactgcttttggtaatcgtgaaaagggaaataaaamcttattttcttttcccaggcattcaccacataaactatcgtgaatgaaccctgtgtgtattaaatatctcacataacctgagatgaagtctttctttttcatgaatgtgactggcagatgaggaagtgagtcagcagaagttccaacctgaattatgtgattttgttttaaatttaaaaaaatgatttttaaaaaaatttaggttcttttacatctgcaataacattaccctggtgctttttactagcatgctaaaatatttttgtacgatttacctttaggtgtcaatcagccatctac

SEQ ID NO: 57061 - DNA, 601 bp, Human
tctctcactcatattacgaagtatttatgtgtactcccctaaaaccccaggcttgtaatataagactgggttctttccctactttctagaatttcttctctgggaacttcagttgtttaaagaatcatttttacagtcttacaaatgctattttcccatgacttacagatgaataaaattctgctttagtaaactgcccttctatgtagctagggggaagatagccctgctacgctgagtgtgtggtttccctgtatgtcatattccaacaagctaaaatctgatgtttatgtattcatcrtcaccacgtttagatagaaaaaaatgaaatatgacttacatatattttttgttttgtttgaaaatgttgtaagatgctacgtcattcatatatatgttgttgaactggacacaaccagaaagatttggatattcaaattacctcctagcaatagaacctggtttctatgaaaaataagaaccattaaacatttcagtctcatcgaactcaaccaaatcaagccaggcaattttttgagaatttaaggtcagaatcccaatatcttaactacatttcccaatctaaaaaaaagtgccagga

SEQ ID NO: 57062 - DNA, 601 bp, Human
tcctagcactttgggaggctgaggcaggaggatcacttgagctcaagagtttgagaccagcctagccaacatggtgaaaccccatctccaataaaaatacaaaaattagccaggcatggtgacaaacacctgtatttccagctactcaggagaccgaggcagaagaattgcttgaacctggaaggcggaggttgcagtgagctgagatggtgccactgcactccagcctgggcgacagagtgagactctgtctaaaaaaaaattaattaataaataaaaataaaagaaaggaaacagtaarctttgctcatgttgattatgttttctagcactttcataaatttgaaaatttatgtgcaatgaatccaagattgccaattgagaagtaattgctatttgacactactgttgggtgatctagacgaagactatttcatgatactctgaagcgctgcattcatatgtattccttcatggtctaaaacaactgtgcatgtcctccaaatagtcttaacatttagtagactttgaaactactcacctatcaaatttttgcttaaaaaacagattgccggccaggtgctgtgcctcctcatgcctg

SEQ ID NO: 57063 - DNA, 601 bp, Human
caccacaaaacctttataaagtattcatttgaatcaaaatggttcaagcgtccagtttatatttaataaagaaagctcctttctaggacttgattgaattttaacttcatttctgttaatttttacaggactttaaatcaacaatcttatatatttcagtaaataaaaacctctgaataggtaacaagaataaagtactaaatactgaattaaatctatggcaagtaatattatgggaaaattgtgagttattttcgttttgaacatgtaaaattttaattatttcacagtcttctgaatmacggaattcttctaatagctcagaaatacctataccgggcaaatgcacaatgttgtggaatgtgaatgcatgcatattagttcaggagaaaaaattcaaaatgaactaagtttgggaggtgctaacgaccatatcatttcttgtcacccccacttccagtacacattatttgcacactgagagctttgagatatcctgcagtaaacacataaacacaaaacaataaaatacaagcatttaattccagcctagcatttttcaagcttctttgaccacagagagcttcctgttaagaatctc

SEQ ID NO: 57064 - DNA, 601 bp, Human
tcctttctaggacttgattgaattttaacttcatttctgttaatttttacaggactttaaatcaacaatcttatatatttcagtaaataaaaacctctgaataggtaacaagaataaagtactaaatactgaattaaatctatggcaagtaatattatgggaaaattgtgagttattttcgttttgaacatgtaaaattttaattatttcacagtcttctgaataacggaattcttctaatagctcagaaatacctataccgggcaaatgcacaatgttgtggaatgtgaatgcatgcatwttagttcaggagaaaaaattcaaaatgaactaagtttgggaggtgctaacgaccatatcatttcttgtcacccccacttccagtacacattatttgcacactgagagctttgagatatcctgcagtaaacacataaacacaaaacaataaaatacaagcatttaattccagcctagcatttttcaagcttctttgaccacagagagcttcctgttaagaatctcaaatcccacatgacccagtgaatcacctcttggattctgaagtaatgatattaatatattatattagtaattttat

SEQ ID NO: 57065 - DNA, 601 bp, Human
cagcctccaattcctggactcaagtaactctctagcctcagcctcccaagtggttaagactacagcacacactaccaagtgctcagtgtgcaaataatatacaagcccggctaattaattttttttttttttttttttttttttacggagagagtcttgttatgttgcccaggcaaattcacaaatattctagtattttaagtacgaagattttattattcataaaaacactagtttatgctttgggaagagcagagcagaggttcagataacaacaaatgctctttaaggatgtaaaatrtgaactttgttcacagacctcagtgatgtgagcactgttgcttaggagtaacaagttgctaaaatgcagaagggatgggtagtgtttcttgcttctcatgatgaatgtttctgtatgttagtgacttgctgggtaactagtaaggtactagaattgataaatgtgtacagggtcctttgcaataaaactggttatgacttgatccaggtgtttaaaaatcggggctgttaagtctgaccatacatcactgtgatagaatgtgggctttttcaaggatgaagacacaagtcttaaccacac

SEQ ID NO: 57066 - DNA, 601 bp, Human
gagtcttgttatgttgcccaggcaaattcacaaatattctagtattttaagtacgaagattttattattcataaaaacactagtttatgctttgggaagagcagagcagaggttcagataacaacaaatgctctttaaggatgtaaaatgtgaactttgttcacagacctcagtgatgtgagcactgttgcttaggagtaacaagttgctaaaatgcagaagggatgggtagtgtttcttgcttctcatgatgaatgtttctgtatgttagtgacttgctgggtaactagtaaggtactagaattgataaatgtgtacagggtcctttgcaataaaactggttatgacttgatccaggtgtttaaaaatcggggctgttaagtctgaccatacatcactgtgatagaatgtgggctttttcaaggatgaagacacaagtcttaaccacactgtaacttatagttcccttaaaaaaaaaaaaaagaataaacctggcagctatagaatataccaggtgcattcataatagctgttttatatattggagtgttaacatttttaaattaaatgttttacattcacaagtgatggggagtcttat

SEQ ID NO: 57067 - DNA, 601 bp, Human
gagcactgttgcttaggagtaacaagttgctaaaatgcagaagggatgggtagtgtttcttgcttctcatgatgaatgtttctgtatgttagtgacttgctgggtaactagtaaggtactagaattgataaatgtgtacagggtcctttgcaataaaactggttatgacttgatccaggtgtttaaaaatcggggctgttaagtctgaccatacatcactgtgatagaatgtgggctttttcaaggatgaagacacaagtcttaaccacactgtaacttatagttcccttaaaaaaaaaawaaagaataaacctggcagctatagaatataccaggtgcattcataatagctgttttatatattggagtgttaacatttttaaattaaatgttttacattcacaagtgatggggagtcttatcattaaggtgtgtgtaatttagagttcagttggttttattctaactggactgcacttgttttcatagtggtgaaatgctatgcgcatttataccttgcgtaagtcctcattctaccacacgataaataacccgctggctgataatataaacactaactggagagattttatttataagg

SEQ ID NO: 57068 - DNA, 601 bp, Human
cactgttgcttaggagtaacaagttgctaaaatgcagaagggatgggtagtgtttcttgcttctcatgatgaatgtttctgtatgttagtgacttgctgggtaactagtaaggtactagaattgataaatgtgtacagggtcctttgcaataaaactggttatgacttgatccaggtgtttaaaaatcggggctgttaagtctgaccatacatcactgtgatagaatgtgggctttttcaaggatgaagacacaagtcttaaccacactgtaacttatagttcccttaaaaaaaaaaaaaagaataaacctggcagctatagaatataccaggtgcattcataatagctgttttatatattggagtgttaacatttttaaattaaatgttttacattcacaagtgatggggagtcttatcattaaggtgtgtgtaatttagagttcagttggttttattctaactggactgcacttgttttcatagtggtgaaatgctatgcgcatttataccttgcgtaagtcctcattctaccacacgataaataacccgctggctgataatataaacactaactggagagattttatttataagggct

SEQ ID NO: 57069 - DNA, 601 bp, Human
actgttgcttaggagtaacaagttgctaaaatgcagaagggatgggtagtgtttcttgcttctcatgatgaatgtttctgtatgttagtgacttgctgggtaactagtaaggtactagaattgataaatgtgtacagggtcctttgcaataaaactggttatgacttgatccaggtgtttaaaaatcggggctgttaagtctgaccatacatcactgtgatagaatgtgggctttttcaaggatgaagacacaagtcttaaccacactgtaacttatagttcccttaaaaaaaaaaaaaakaataaacctggcagctatagaatataccaggtgcattcataatagctgttttatatattggagtgttaacatttttaaattaaatgttttacattcacaagtgatggggagtcttatcattaaggtgtgtgtaatttagagttcagttggttttattctaactggactgcacttgttttcatagtggtgaaatgctatgcgcatttataccttgcgtaagtcctcattctaccacacgataaataacccgctggctgataatataaacactaactggagagattttatttataagggctc

SEQ ID NO: 57070 - DNA, 601 bp, Human
tgttgcttaggagtaacaagttgctaaaatgcagaagggatgggtagtgtttcttgcttctcatgatgaatgtttctgtatgttagtgacttgctgggtaactagtaaggtactagaattgataaatgtgtacagggtcctttgcaataaaactggttatgacttgatccaggtgtttaaaaatcggggctgttaagtctgaccatacatcactgtgatagaatgtgggctttttcaaggatgaagacacaagtcttaaccacactgtaacttatagttcccttaaaaaaaaaaaaaagaataaacctggcagctatagaatataccaggtgcattcataatagctgttttatatattggagtgttaacatttttaaattaaatgttttacattcacaagtgatggggagtcttatcattaaggtgtgtgtaatttagagttcagttggttttattctaactggactgcacttgttttcatagtggtgaaatgctatgcgcatttataccttgcgtaagtcctcattctaccacacgataaataacccgctggctgataatataaacactaactggagagattttatttataagggctcta

SEQ ID NO: 57071 - DNA, 601 bp, Human
ttgcttctcatgatgaatgtttctgtatgttagtgacttgctgggtaactagtaaggtactagaattgataaatgtgtacagggtcctttgcaataaaactggttatgacttgatccaggtgtttaaaaatcggggctgttaagtctgaccatacatcactgtgatagaatgtgggctttttcaaggatgaagacacaagtcttaaccacactgtaacttatagttcccttaaaaaaaaaaaaaagaataaacctggcagctatagaatataccaggtgcattcataatagctgttttatrtattggagtgttaacatttttaaattaaatgttttacattcacaagtgatggggagtcttatcattaaggtgtgtgtaatttagagttcagttggttttattctaactggactgcacttgttttcatagtggtgaaatgctatgcgcatttataccttgcgtaagtcctcattctaccacacgataaataacccgctggctgataatataaacactaactggagagattttatttataagggctctagaataaaatacaagtttttcacaccagcatcatctgttactaatactcttaat

SEQ ID NO: 57072 - DNA, 601 bp, Human
ctaacaggaaacaataccgacgttctttttcttatagcatttgtattataaaaagcacaaagctccagcccactgaacctctgccaattaagatggtgttgggttaggctgcatctggttactgtcctgggaaaatcactttaatagagatggtcttccaagcagttttaaaatttatccttctgccaggcgcggtggctcacgcctgtaatcccagcactttgggaggccgaggcgggtggatcacaaggtcgagagatcgagaccaccctggccaacatggtgaaaccccgtctctacyaaaaatgcaaaaaaaaattagccaggcatggtggcaggtgcctgtaatcccagctacttgggaggctgaggcaggagaatcgcttgaacccgggaggcggaggttgcggtgagccaagatcacgccattgcactccagcctgggcaaaaagagtgaaactctgtctcaaaaaaaaaaaaaaaaaaaaaaaaaaatttatccttctactgaagtttttaggtcaattaggtaggctgactaaatttacaaatgaacttgtttatccaaaacaaataaataaaatgtgaactttgaagttca

SEQ ID NO: 57073 - DNA, 601 bp, Human
atcatgaggttttctgggtagaaatgagttctcagatagtacatatataggcttttatgtctgtgtccaaacgaatgtgatatatgaataaggtctgccattcactttagttacaaaatcaggacttgaaaaccacttccattattgatttcatcaaggtttgatttttagcattcattttttcctaacctacagtcacataaaaaatttgcagtgttccatttttaaatctgtgcttccatttggattaccctactctgtcaactttttatttattattttttctttctttgcctgaaawactcaggtttcacttttcaggtaccaagttttctaaggcttgctcagcagttgaaagtgtattgtgtggtttctcatcttctttttcagatttctcttttctcaggttacttgggatgaagtcttttctccttgactttttactcctatttcttgtttcagatgaagaggaagtctccccgcctagcgccttgcctccaggttgggataatttctacccttttccctgcttttaaatatattattcattgacggtagaggaaaagaaaaggcagtgagcctccttgctgagtcagtgcac

SEQ ID NO: 57074 - DNA, 601 bp, Human; identical to SEQ ID NO: 25089

SEQ ID NO: 57075 - DNA, 601 bp, Human; identical to SEQ ID NO: 25090

SEQ ID NO: 57076 - DNA, 601 bp, Human; identical to SEQ ID NO: 25091

SEQ ID NO: 57077 - DNA, 601 bp, Human
tgagagttcaggatacccagatggaagggagaatttctcttataacgactaatgtcaggcatggcagttcttcatccatatgttctgtgcactacccagagtaaacatagaaggcctaaatgcatacgatgaggttggaaaaaaactcgcttttacaagtatacaaaggaaaagttgacttggcagcaaatattataaacttaaggtgaatgtaaagtgtgatgtagttgcaaaagacaaaaaagtgaatgtaattttattttatttgagacagagtctcactctgttgcccaggctagartctagtggcactgtcttggttcaccacaacttccaactcctgggttcaagcagttctcatgcctcagcctcccaaatagctgggattacaggcgtgtgccaccacacctggctaattttgctggggtatttttagaagagacgggatttcgccatattagccagcctagtctcaaactccaggcctcaagtgatccacctgccttggcctcccaaagggctgggattacaggtgtgagccactgtgcccggccatgaatgtaattttaaactgggctattccaagtgctataggatctaa

SEQ ID NO: 57078 - DNA, 601 bp, Human
gggagaatttctcttataacgactaatgtcaggcatggcagttcttcatccatatgttctgtgcactacccagagtaaacatagaaggcctaaatgcatacgatgaggttggaaaaaaactcgcttttacaagtatacaaaggaaaagttgacttggcagcaaatattataaacttaaggtgaatgtaaagtgtgatgtagttgcaaaagacaaaaaagtgaatgtaattttattttatttgagacagagtctcactctgttgcccaggctagaatctagtggcactgtcttggttcaccrcaacttccaactcctgggttcaagcagttctcatgcctcagcctcccaaatagctgggattacaggcgtgtgccaccacacctggctaattttgctggggtatttttagaagagacgggatttcgccatattagccagcctagtctcaaactccaggcctcaagtgatccacctgccttggcctcccaaagggctgggattacaggtgtgagccactgtgcccggccatgaatgtaattttaaactgggctattccaagtgctataggatctaagtttaggaagtgatacttctctctac

SEQ ID NO: 57079 - DNA, 601 bp, Human
gtcaggcatggcagttcttcatccatatgttctgtgcactacccagagtaaacatagaaggcctaaatgcatacgatgaggttggaaaaaaactcgcttttacaagtatacaaaggaaaagttgacttggcagcaaatattataaacttaaggtgaatgtaaagtgtgatgtagttgcaaaagacaaaaaagtgaatgtaattttattttatttgagacagagtctcactctgttgcccaggctagaatctagtggcactgtcttggttcaccacaacttccaactcctgggttcaagcarttctcatgcctcagcctcccaaatagctgggattacaggcgtgtgccaccacacctggctaattttgctggggtatttttagaagagacgggatttcgccatattagccagcctagtctcaaactccaggcctcaagtgatccacctgccttggcctcccaaagggctgggattacaggtgtgagccactgtgcccggccatgaatgtaattttaaactgggctattccaagtgctataggatctaagtttaggaagtgatacttctctctacaacatgctacttattctacatttggag

SEQ ID NO: 57080 - DNA, 480 bp, Human
gattacaggtgtgagccactgtgcccggccatgaatgtaattttaaactgggctattccaagtgctataggatctaagtttaggaagtgatacttctctctacaacatgctacttattctacatttggagtgatgtctttagccgtggtcactatacctctgcctggacctcttctcgagtagagtaaccaggaagatgaagaatccaaaaaccacaccctatccagcttgagtgtgtgggtgaaggaagtcaggcatacatggcttgttgcaaagaggggaaggggctgtcacacagaamatggaaaacaaatttccatgcatgagaagcatttaggcagtttagaatcaaaaggtggaaatgatgaggaggtgaattttgtcttaacgttaggatgagctggccaggcacggtggttcacgcctgtaaccctagcactttgggaggccggggcgggcagatcacgaggacagcagtcc

SEQ ID NO: 57081 - DNA, 601 bp, Human; identical to SEQ ID NO: 25092

SEQ ID NO: 57082 - DNA, 601 bp, Human; identical to SEQ ID NO: 25093

SEQ ID NO: 57083 - DNA, 601 bp, Human; identical to SEQ ID NO: 25094

SEQ ID NO: 57084 - DNA, 601 bp, Human; identical to SEQ ID NO: 25095

SEQ ID NO: 57085 - DNA, 601 bp, Human; identical to SEQ ID NO: 25096

SEQ ID NO: 57086 - DNA, 601 bp, Human; identical to SEQ ID NO: 25097

SEQ ID NO: 57087 - DNA, 601 bp, Human; identical to SEQ ID NO: 25098

SEQ ID NO: 57088 - DNA, 601 bp, Human; identical to SEQ ID NO: 25099

SEQ ID NO: 57089 - DNA, 601 bp, Human; identical to SEQ ID NO: 25100

SEQ ID NO: 57090 - DNA, 601 bp, Human; identical to SEQ ID NO: 25101

SEQ ID NO: 57091 - DNA, 601 bp, Human; identical to SEQ ID NO: 25102

SEQ ID NO: 57092 - DNA, 601 bp, Human; identical to SEQ ID NO: 25103

SEQ ID NO: 57093 - DNA, 601 bp, Human; identical to SEQ ID NO: 25104

SEQ ID NO: 57094 - DNA, 601 bp, Human; identical to SEQ ID NO: 25105

SEQ ID NO: 57095 - DNA, 601 bp, Human; identical to SEQ ID NO: 25106

SEQ ID NO: 57096 - DNA, 601 bp, Human; identical to SEQ ID NO: 25107

SEQ ID NO: 57097 - DNA, 601 bp, Human; identical to SEQ ID NO: 25108

SEQ ID NO: 57098 - DNA, 601 bp, Human; identical to SEQ ID NO: 25109

SEQ ID NO: 57099 - DNA, 601 bp, Human; identical to SEQ ID NO: 25110

SEQ ID NO: 57100 - DNA, 601 bp, Human; identical to SEQ ID NO: 25111

SEQ ID NO: 57101 - DNA, 601 bp, Human; identical to SEQ ID NO: 25112

SEQ ID NO: 57102 - DNA, 601 bp, Human; identical to SEQ ID NO: 25113

SEQ ID NO: 57103 - DNA, 601 bp, Human; identical to SEQ ID NO: 25114

SEQ ID NO: 57104 - DNA, 601 bp, Human; identical to SEQ ID NO: 25115

SEQ ID NO: 57105 - DNA, 601 bp, Human; identical to SEQ ID NO: 25116

SEQ ID NO: 57106 - DNA, 601 bp, Human; identical to SEQ ID NO: 25117

SEQ ID NO: 57107 - DNA, 601 bp, Human; identical to SEQ ID NO: 25118

SEQ ID NO: 57108 - DNA, 601 bp, Human; identical to SEQ ID NO: 25119

SEQ ID NO: 57109 - DNA, 601 bp, Human; identical to SEQ ID NO: 25120

SEQ ID NO: 57110 - DNA, 601 bp, Human; identical to SEQ ID NO: 25121

SEQ ID NO: 57111 - DNA, 601 bp, Human; identical to SEQ ID NO: 25122

SEQ ID NO: 57112 - DNA, 601 bp, Human; identical to SEQ ID NO: 25123

SEQ ID NO: 57113 - DNA, 601 bp, Human; identical to SEQ ID NO: 25124

SEQ ID NO: 57114 - DNA, 601 bp, Human; identical to SEQ ID NO: 25125

SEQ ID NO: 57115 - DNA, 601 bp, Human; identical to SEQ ID NO: 25126

SEQ ID NO: 57116 - DNA, 601 bp, Human; identical to SEQ ID NO: 25127

SEQ ID NO: 57117 - DNA, 601 bp, Human; identical to SEQ ID NO: 25128

SEQ ID NO: 57118 - DNA, 601 bp, Human; identical to SEQ ID NO: 25129

SEQ ID NO: 57119 - DNA, 601 bp, Human
cacctggacctcgtggcatttttcaaaagaacaaacctgtgattgatcttgcagagcatacccccacactgcgggaatgggccagttctagaaagtatgttattctaccgaatcctatttctccacccctcccttctttgttgcgttcatagcaatgctgaaggctaagcacctgcaactgtagatgccttcaagttcttcagtttttgtgaaatccagggaaaaaaattactcaagttatagccttagtgaatttcaaacttcattagatgtcaaaactatatttttaatagttctagtrtaacacatttaagtgcagcgatacatataagtctctggaacttaagaatttaagattttttttaaatagatttctctttttcttttttttttttttgctgagttatattgtcagataaatctcagtacttacagttctaggacaagacagaacctctagtgcattttcctttagtgtagggaacagtccagtacacccacagagaaccagagaattttatgttcccacaaatgaaaacaataccgaacttgcttaggagtttaaagtgtgaaacaagtggtcccatatgttcattatttc

SEQ ID NO: 57120 - DNA, 601 bp, Human
atgacaatactgacaagaacatatgatttacaaagccactttctagctaaagtcatatagtaagaatcaagatttgctatatataacatttccttttcaagttattgagatacaatttttaaaaatttgctgaaatttgattgttgcagtaacagaataagagaacctggaaattggtttccattttagttgtccaatatccttaagtgtctgtgcaaacacttataagtatcatacagttacttaggaacaatcattttttccattctcatttttcatcatttaatgcaaacatcatagrcatagaaagatccagttttcatgcactgtgcatggaaattctggagcaatgtcgtgttgaacatcacaattcaacctggcacgtaacagaggacacttctaggcttggcaattacctagtgaactggatcaaaggaaattgcacaaatggattatcaaggaaaaaaaaagtccccttgggcataataagtgagaaccactttttcatttctttaaaaaatgaggatcagtagctgcaaattatagaataattatgacccactgttggatcatgtgatgtcccacagttatcttccacagg

SEQ ID NO: 57121 - DNA, 601 bp, Human
ctccatcaggagggagatggtcttgaagggcattagcatgtcagaaaaaaatgcaaattattttctaattttgcatcattttcttagtggtcctatggttgcagaaactggtcctttactatttaaagacaggaacaagcatttggggtcaatataaaaacacattgcttctctttaataatatctgtagcctattagcttagtggtactaatgaggccagggtcataaggtcaaaccccacatgtaccaattagtttcaaagagaaaagctttcccacagctagtgactgtacccctaamtttgaccagctgtcacacagatgcatagcaggcagtctaaggggtaccaataaaaggaatgaaaatgatgcaactcaaatccagccccactcaaaacaatgctaatggtgggtgagtgtgatgtcaaattcaccaattatacactctcttctttaattgaaaaggtaataggctgggaagaggcttttggtgaaggtttagaaacctgtagattcttatttgtcccctctaatttaataaagggcatctaaaaatgtacatactcacttgacctcacagtcaggagagtgagagaatgta

SEQ ID NO: 57122 - DNA, 601 bp, Human
caccactgtactccagcctgggcaacagagcaagactctgtttcaaataaataaataaataaataaataaataaataaataaataaagataaccaacttctttttaatttgctccaggtggtctcaatcaaacttctaagcacagggttctactctgaaccatttctgcctgcccttccttctcttactaaaatacatgaattccatggctataaggcaagaaagaaaaggcctgcaaaaggttttaaatagcctataggaagaacttttatttttcagagaaaagctttcaaaaccacartgactcttctcatggcttgctccaggcaatggaccataggctctggattaaacagtgactgagaattgatgtgttactttcactcatggttttccaatctctctaattgcctctcttctggagacttgtctagtctaggaatctcgactcgggggtgattttgcccccaggggtacatttggcaatgtctgcaaacattcttgatggtcgtgactgggaggaagggactgctggcacctagtggatagaggccaagtatgttactagttatcgtataatgcacagggcagctccctctcc

SEQ ID NO: 57123 - DNA, 601 bp, Human
ttaaggtcaaagacaactggctgggtgcggtggctcacgcctgtaatcccagcactttgtgagtccaaggcaggcggatcacctgaggtcaggagttcgagaccaaccaggccaacatggtgaaaccccgtctctactaaaaatacaaacattagccgggcaaggtggtgcatgcctgtcatcccagctactcgggaggctgaggcgggagaattgcttgaacctaggagacagaggttgcagtgagccgagattgcaccactgtactccagcctgggcaacagagcaagactctgtttcaaataaataaataaataaataaataaataaataaataaataaagataaccaacttctttttaatttgctccaggtggtctcaatcaaacttctaagcacagggttctactctgaaccatttctgcctgcccttccttctcttactaaaatacatgaattccatggctataaggcaagaaagaaaaggcctgcaaaaggttttaaatagcctataggaagaacttttatttttcagagaaaagctttcaaaaccacaatgactcttctcatggcttgctccaggcaatggaccataggctct

SEQ ID NO: 57124 - DNA, 601 bp, Human
ttaattcccctaagtcaggctgtgataagaaaacagtttggatgtacaacttgagagtgcgaagatactttttctgattagtgagtacatttcctctgctgaatgctgctttttgaggctaagcagaaatcaccaatagctgacttgagagaatagaaatcttttgcctatatgtgatatctctcagtgactacccaatcacctcgtggggaacaaagtctttaagcaagctcagtgtggtaaaatgataggccccatctctttgctgcttcttccaatgagaggaaatagtgatactgastgagcattctgaagatacattaattaactcttgggtggtctcaatgtaaagtgatatgtgaacaggaggcagcaacatgcttttcttttttaattaatgaggttgagaagatacactgccaaattaacttttccagattataattgttgcctaaggttttacagaaatcatggcattgatctaatttgtgagccatgatttgggatacaaggcaaaaagcatccaattcagttcatcagttgtgactatttggatggcccttcgtttccaaagcacttctacagctgagcctcagaacaa

SEQ ID NO: 57125 - DNA, 601 bp, Human
gggcccacagactgtctaacttaagggaagcctgaaatgatgcttattgtatgtgtgtcattgatcttctcaaaattcatcctcaaatatctgttccatactaggaggtaagaatcagcagaaaagaaggaatctttggagagccaaaaccatctctacaccaaattgagagactggaattataaggtgaatgcaattaactggcagtcgcatccatgttgagaacacagtcatccctttaatagagaacatttgctgtgcttgacaaactcacagtgaaatggttggatccataggaagsaacatgctgaaaatggtttcaatatgatcctgttttttcactcaatagccattgattgagggtgtccagccaaaaacaatgagaaaatgagccaacaatagtcttaccctttgaccatattagataaagtcgcagctgaaatttgttatatgtttcaggaataacaaagcatccatatggaacatatatttggcagtgtggcagctgatgaaaccaggaaaattagacaaattatcaattgctcgctcccaaattaccccaaaaagaaattagatccattttcagtagctttgccttcaa

SEQ ID NO: 57126 - DNA, 601 bp, Human
acttacagattgccagtttgtgagctctgctgtagggatacattaagaaagtcagatagagaccttacgtaaaatgccttactgtcaaattggggagtttggactcactcaatttacatagccatgaatggtccctggatgttgtttagaaaagggataaagtgataagaattgctttggaaagattaatctcatgggtgggacggctggcctcaagcagtcttgcacacagcacgatcatggaggaggctgttgcaatagttttggtgggcgatgaggaggatctaaatagtgatgggaytggaaggatcttccagtaaataggtaacagctgttatggatctcggtgcaaaacaaactgtaaggctacagcttgttttgtctgaagagttgggttgatggtctccactgtgctcaacacttagggtgattgtgcaacccatccattgcattggctgggaacctggcctttcctgctttacaaggtcaccggctaaaaactccacttgctcttgaggaaatatccctttgatgatgtctaaatttttgaatgttcagtttttaaaatctgccttcttccttcaccagaatgacttgattg

SEQ ID NO: 57127 - DNA, 601 bp, Human
tcctggagaatgaaaaaatatggctccatatcaggcaggtgctcagcagcgatggcttatggcccttcctctactgatcttttcctttatctctttggtcattatgctcagtgttaatatgggttgctaaggaaccatatgtacatggtaatttggtaaaacatctccctcacagaaagcagaattttggaggagggcgtagtggccatcttaggagcatctgaggagaaagttttgcccccttttaaattcctaacacggacattcaacttattcaattttttccatttaaaaaaggtgtgtgtgtgtgtgtgtgtgtgtgtgtgtgtgtgtgtgtgtgtattgtctaatctagagatcctgaggagctaagaagtatgaacaaacgcacttcaaagactaaactggacataaattcaaacgagaagaaagtcttcatttagggaaaatcagagaaaatacttcagggaggaaaaggtatcaaatctaactgttagcatgtaataatattttgtcaggagtttttccctcatttctgctcaactacagagtttcagctagcattaatcttctaatcaaaagggaacaaatctatttataa

SEQ ID NO: 57128 - DNA, 601 bp, Human
atgtttgtcttagctgagtctgaaggccattgccacctttgcgaataagccagggcatgacactctccatgaagctcccaagaatatttaggccagcctatttaagaatggaaaagggccttatttcctcaattttgaaaattgttcatagattgagccagtagagttatccaatgtggatgtaagattcgccatgaaggggtcaattgagtcagaggcaaatgtttgctgcagatccaggctgttggatagagccccaaatatttgggaatgcagggatgagagggaagaagaaggcttycctatttgctgtttacctatcagtctggggacaaattggtgatttcaggctcatgcctctatatcacaatgcgttagtgtccaccattaatgtggtgcttggcagagaggttcagggctgaacacacaagggccagagctgcttttccacatcagctctctcaagcctggagaatcttggctggaagtgtgggggaagggaaagggaagaagggaggacatggccccagccacccaccgtgccattcctgggttttgattaaagaggaaaatattggctctgacattctcgatttgcaag

SEQ ID NO: 57129 - DNA, 601 bp, Human
tttttatattattcccctgtcattctttttctttttcctcactaaatttcatgctctccttgcccagttcacttatttgctgctcaaagctaaaaatctccctacttttatgcgactctcctagaaattgctccatgacaaagagtaagagagtagcataaagagctaaatgaactattttggatgtgacaggaattgtatttgccttttggcgctgctttccactttctttgtgaagcatctcttgctccgatggccccagcagctctctgccacgaatggaaacagccatcgtacactrctccacttggagacaaatggatgcccaattgctctgggactaaattcgacttgataaaatgctgcatttccagatttttcaatctcttcttcgccttccatctgaaggctaaggccttcatcatctaatctggagatgattattattactctttctgtgttggcaaatacagatacagggcacatttgcctttctttcaaactcatttgggagacttaaataagttctcttgctacatttaatttcattttctcaatatctacatgctgtttgtcaatacaataatatacttccatctct

SEQ ID NO: 57130 - DNA, 601 bp, Human
tcccaataccacctcaacttcatgggcaaaaagggggcaccctccatgagcagtcagtcattgatgtatttacgcgtaagttcattcaacaaagttatttactgtctactatgtgccaggaatactctttatagattaaatattaagaaaatattaaggacattttaaatttatgatgacaaaatcatatctcatctagtcttcttgcagaactaagctcaagtcaatttaaaaacaactactttaaaagcaagcaaaacaattggttacctgctacattgaaagcactgccctaagtgcygcgtagtatgtgaaaatgaataggcaaggcaaagttgcaaccttcaaggaatttgggacccagtaaggagatgcgttaactcataaataactatgatataaagcagaatatacttgattgcctcaggtggtacaagatacaaggaccgtgcagaggacaaattttgctgagtcactgagaggtggcctccactcaagagccaaatgaccatctcataaattggtatgataccccaacatcatttattaaatagggaatcctttccccattgcttgtttttgtccggtttgtcaaagttca

SEQ ID NO: 57131 - DNA, 601 bp, Human
agtttatttatttgtctcaggccactcacttattaaatgcccaaaccaggatccaaactcaagactttctgagcactaagtcattctattacactgctgctgctgctgcttcttcttcttcttcttcttcttcttcttcttcttcttcttcttcttcttcttcttcttcttcttcttttttttttttgagacagggttttgcactgttgcccaggctggagtgcagtggtgcaattgtggctcactacagcgtcaacctctcaggctcaagagatcctcccacctcagccttctgagtagytgggactgcaggcatgcattaccatgtctggttaatttttgattatttgtagagacagggtctcactatgctgctcaggctggtctcgaactcctcagctcaagcaattttcctgccttggcctctcaaattgctggaatttcaggagtgagccactgcatctggcaacactgcttcttaacttgagtagaatcttcctgcctagacagaagtgaatgggaaagcttagtgcatcttagagtatcttctaagagaaacttggtgtgaaaccatggggaataaagcccagtacttgacatg

SEQ ID NO: 57132 - DNA, 601 bp, Human
cccatggaatgtgaaaaggggttgcaggttattttatgtagatattggagaaaagcgtgacccaaggagactggaaaacctgagtgcatctggtttatacatatgctgtatcatttaccttttacaacaatcctatgagatggacactgttatcatcttcactttacagttgaaaatattgagccatagaaaagtttatttatttgtctcaggccactcacttattaaatgcccaaaccaggatccaaactcaagactttctgagcactaagtcattctattacactgctgctgctgctgattcttcttcttcttcttcttcttcttcttcttcttcttcttcttcttcttcttcttcttcttcttcttttttttttttgagacagggttttgcactgttgcccaggctggagtgcagtggtgcaattgtggctcactacagcgtcaacctctcaggctcaagagatcctcccacctcagccttctgagtagttgggactgcaggcatgcattaccatgtctggttaatttttgattatttgtagagacagggtctcactatgctgctcaggctggtctcgaactcctcagctcaagcaat

SEQ ID NO: 57133 - DNA, 601 bp, Human
gcttcccatggaatgtgaaaaggggttgcaggttattttatgtagatattggagaaaagcgtgacccaaggagactggaaaacctgagtgcatctggtttatacatatgctgtatcatttaccttttacaacaatcctatgagatggacactgttatcatcttcactttacagttgaaaatattgagccatagaaaagtttatttatttgtctcaggccactcacttattaaatgcccaaaccaggatccaaactcaagactttctgagcactaagtcattctattacactgctgctgctkctgcttcttcttcttcttcttcttcttcttcttcttcttcttcttcttcttcttcttcttcttcttcttcttttttttttttgagacagggttttgcactgttgcccaggctggagtgcagtggtgcaattgtggctcactacagcgtcaacctctcaggctcaagagatcctcccacctcagccttctgagtagttgggactgcaggcatgcattaccatgtctggttaatttttgattatttgtagagacagggtctcactatgctgctcaggctggtctcgaactcctcagctcaag

SEQ ID NO: 57134 - DNA, 601 bp, Human
tggcttcccctgggaggagctcaattgttctcttctgaatgggaaggaaactgattgtgttgcctcagctgcttcccttctccagcccccacagagagaggacagctttggtcctgatgggcctccccaaatactgggatgggcctgcttctccatcttgtgtgggattggaagatgtggattcagttggagatagccgatttctccaagaatcatggaatgtcagagctgcaagacatttcagagcgaatccagacccatctccttgctactcaaatcaggaaactgagaacttggaagrccaaatgattctctccaggtagtgcggctggttctttttccacgggactaaaatccaggcctctggctccttattctacactgtctccttgctacctgtgtttccgctgcagttagaaggaacattttaaatgtagatagaatgtctaaaatcctatctttggtagctggactgcaggtgaaaaaatgagcaagggagagcagaaattctaacagtagaatttctggcagcattattcaacttgagtgaacaaggataggtcactcagactcttcagcatgtcagtttccccgtatttaa

SEQ ID NO: 57135 - DNA, 601 bp, Human
tttagaaacgagaagtcattaaaaacagaaagatgtttaaaatagacaaaaatgggctccatctggcagagacaagtactataacaaaatagctgtgggccctgagtgagcaggaaagtactacaacaaattgtaatatgaggcgggtgtatgtagagaattatgaaacgaaagcctagagagtaatctttccacaaaacttggcattgctgaggttttaattagagtgggaactcagatttcattctcctattttaaggctcatttggagaacctggaaaagatccagctaggagaaggaaaaaaaaaaaaaaaagattaactgggtggaaaatgaagttaagatctagcccaaaaaagaaaaggctaagaagtgacttaatcaccagcaccaggcataagaagagtgattattacacagaagattattcctcatctcttctgaggactagacaagggtaaacagactcgggccacattggaagcatttccacttaaacatcgggaagaatttcttgattataaggggaaacttgctgaccccaggcgctgtgggaagctgagcaattgctactctggagatctttaaatgtaggatgac

SEQ ID NO: 57136 - DNA, 601 bp, Human
tttcatgctcaaagcatgcttgtgagtattgggagaaatgagtgctattcaggcccttctcggattgatacaaaattgagtttccttcctcaatgatgagtaatggactagaatgtttttcagatggcactaagtcaggtaaagaaacattagaaggtaggatttgaatttaaggagacctttaacaatttagaaacgagaagtcattaaaaacagaaagatgtttaaaatagacaaaaatgggctccatctggcagagacaagtactataacaaaatagctgtgggccctgagtgagcargaaagtactacaacaaattgtaatatgaggcgggtgtatgtagagaattatgaaacgaaagcctagagagtaatctttccacaaaacttggcattgctgaggttttaattagagtgggaactcagatttcattctcctattttaaggctcatttggagaacctggaaaagatccagctaggagaaggaaaaaaaaaaaaaaaagattaactgggtggaaaatgaagttaagatctagcccaaaaaagaaaaggctaagaagtgacttaatcaccagcaccaggcataagaagagtgatta

SEQ ID NO: 57137 - DNA, 601 bp, Human
aactgttcaatgggtacaaagttacagttagacaagaggaataatttctggtgttctattgcacaatagggtgactctggttaacaatatcgtattgtatatttcaaaatagctaaaaaagaggatattgaatgttctcaccacaaagaaatgataaaggcatgaggtgatcgatatgctaaataccctgttagacttttacacaatgtatgcatgtatcagaacatcatgtgtaccccataattatttacaattattatgtgtcaattaaaagcaagcatacaaaccaaaacaccaagakgtcaatatgaccagagcagaaacctatttgaactttcacactggacagacagatccttagaaatcctccagttcagagatgcattttggtaggaggcatatcaaccctctgcatgatgtataattatgtatgtttgtggattttcctggaaagaggacatttagacactcagaagattctcagaagattccatgatctgagaaaactaaagaagcatagttcacacgtgaccagggtcacaagagaagctgaggcaaagtcaggaaggactccctgccttcctctgcggtcttctttcta

SEQ ID NO: 57138 - DNA, 601 bp, Human
caaacttaaaggaaactgcaatgcagggatgctgaactcaacagttcaaggataattgctcagagaaattgttgaagtctcagtctagcaacacaaaatttcttcaggcccccatgagaattcttgtgtgatgacctcattcccattaaccttctaaatatggaaaatgattactttatgtatcataaacaagctcttaactgtatattagccttttttttctgttttgtgaagactggcctattctttcctatttgattttgagcatctcgagggcagacactgtcatctcatccttctstgtttagaagcactacactgggcatttggacacttcacaaatgctcactgattggtggattgacaagttgggtgcacaaacggtacaaagagagaagcaatagaagaaatttgtactttggaaagaagaaacctaacaccagggccagtctcaagtctccatttcctttcttgttaaaagaggatgatcatcatttccctctacagggtttttgtgagttaaggcacaaagagagcttgagacagcttgtggcacagagcaagcactcccagaatgtcatctcaccccaccctccttagc

SEQ ID NO: 57139 - DNA, 601 bp, Human
tcatttccctcagttggactctgagccatcacaaattctttgcatttttcagaacatctgtgccttcttttgccacatcttttttcttggtgctcaacaggtcacaaatcagcctgtacttctctttccaggctgttgatgtcttaatactctcttttcaaaccaaattcctctcttgtgtctggctgtggctcttagctccccagccttctcatctcccccatctgggttagtcatctgtggcatcaccaaggggtctctttctcttagccttctatctggcctgaacttctgcatttcyctgaatgtcagaataactacacataccacactactaggcttgaagcttagttaagttctctaacgtgatttaaacacagtgcagaaaacacttccatggaagcgtgaacgcttgaaaagactcaaacttagaggatactaattagctactgagagagaaggcactataacaagacccaaagatataatcaaatgaagttgaaaactattccattaaacacaagtttctccttgacatttagaaaaatcagggcgtttgcaataatacactaccaatagcttccctttattgagtgcttcc

SEQ ID NO: 57140 - DNA, 601 bp, Human
atgaaaactatttttctgaattgaagaaatgaactatgaataaggaaaaagaaaaagagaggtgtggtttaagttacagtttgtctccaagctaaatcatgttctcatctttatttcatctgggaccaacatcatgcccagattcccaaacctccttaaatgctttttaacaaatgtaattatccatcgagaaaaatctctgatttattttactgaattcagcaaagagaaatattctcagcttatgatattggcaggagaaatcatactctttcttatttttcttttttcttacatactsaaacatgctgtgaatggccacatcactctgctttgggatccactctgaggcaatggccttttggccttctggccaaccgctcacttctgtgaatttcctttctgagaactagagactgttgccccagaagtcattttccaatttatcacaggacctatccatggttacagaattagttggcctccttgagaatacgcaatgtgagacctaatgtgacacacagctggggaagctcctttggtgcagggacactgggccaggataactgcttgtgggccattttatttccctggacacttg

SEQ ID NO: 57141 - DNA, 601 bp, Human
acagtgtcaccaggccgcttaatcactactccatcttggacccatgcctgaataagatgaaaactgccagagaaagaataagaagggatgttgaggaatcgcatacgtgggccttagctgtctcatttttttttcttttttttagaaagactgacacaactgtaagctgagactggctccagcttggagattgtagctatgccaccagcattatctcctgtacttacactcttattgttattttactctttcagatgtgggaagagaggccttgtaacaaaacataaggcattcgtgagtmgagggtaacgccctctttctggtgccacagaaagatgaatcagccaaagggatattaaaacacattctctttatttttagtttctctctaaagtctttcatttctttttttctttgtaacttggcacctgccctctgttctcaggggccctgcaccccattagtctcctcactcagggacctgttttttgctcagggcacatctggaccttgtcccaggggtgggagtgacatggccaggatggcaggtgaaggggtggcggctgccagggcagtctggcgtgtctggagggagagtgtt

SEQ ID NO: 57142 - DNA, 601 bp, Human
gaagattaagtgagaatgtatgcaaagtgttttgcacaatggctggtatatggtaaactatataaatgttgacaattattattatggtgttgaattggttaacatagctagttgggcaggtatcctcttcctccattaatcttaaaaatgcatcctttccaaagtttggtcgaagcagatggcctttctagatattgttattcactaaagtaaatgaaaggctgttctcttgaaagaatgtccaaactttatgttgtatagactggtctgaatagttttaatctagaatagacactatgaraatgaatctttcaatcaagtcaaataaggcgtatgggcttatcttgaccccttgttacctttgatttgtcccaaataatccactggttaaaatcattggctttttggtattaatatcaatgcttcttatttcaaaacaatgctgcaaggcctgggatgagtgtggtgaaatacatggtcagaaatggtttcccaatcactttcacccagcatagtatttctctcatctctctctacttcatgtctcatctcattctgttctcttcttttcctatttcctttcctcttctgctactgacag

SEQ ID NO: 57143 - DNA, 601 bp, Human
agtttgtgtttcttatagatttctgggaatgcagttggaacaatgcattcagctttaatttcctttgaaacttcccatcttgcttcttgagaaagttttattttaactatttcaactctatcattggaaagggaagacattgatttgaagagtcagtatttaaataataaaaaaacgcaaacgttttcaagttgggaagcaactagttcttaagatatacatttgttattctttgagttctaaggaataaaactattctttagaaatttgctaacaggaagaggttccaaagttgatccctttttttttttttttgaaaggaggaaaaaagaggtaagacaattaacctggattttaagggctatttctagaaaatgttcaattatatgtctgataaaaaacacaaatgaaattattagctaataaaaatgaacctgcatttcacttagattaactaaggattgattacacaaccaaatattacagttaagatctgaagaatctggaaacttaggtttttcacaccagttatttatttcagaactccagacacattgccaatttagaataacttggaacggttagttttttagggcaagat

SEQ ID NO: 57144 - DNA, 601 bp, Human
cagaaacaactgatttcaaaattcatggttagcctttgaagatagacaagggcaggctttgggattccaggacctatttagtatttccctttcaagctcctctaacttaattctgcttctgaggtcccacaggtgctggagctccttgtctgctataagaggaagacattaaccttcatcttgggatggcagagagagtttctatgattgtatattcacttcttggtgactgtaaacaaccatgaaactcaccacatgtcgatttcctcttgtaaaatagaaagtcatcatcatcacagcaaaaaaaataacaggaaataccaggcatctggtttatcaccttgcttaaatgagctcagaatttgacatgactcagtcaaactctaagctcatctaaactctgagctcatgctttttagtctgtagatcgatgggtttaggtacagagaattttaggacttttctgcaatgttccatagagaaagtttatcttatgtctacatttgtttttttaaaaaatattgttgaaatagtggtatacagacttcgattttgccataaatataattaccaattatctctagctaccacaatcctagag

SEQ ID NO: 57145 - DNA, 601 bp, Human
atgcctgtctgaggcgccctccgactgctggagccataccctgtgggcttgtctgcacaaatcaaacagagtggcctcatgttagggtgcaatctgctttcttcagtcttccacccagctcctgcctctccccacagctagtcaacctacatattctgcaatgtctcaacctcttcttgaaacttccccaatgattcctgaccccacgtatctttctgaatgccagtatgtctcccggagtctgtaccacactcattagcactaactcattcaccatgctatttgtggtaactctccccargttttgcaacctgtaggcaaggatcttgtctatgcccaatcctagtcttttcttatatattggcttcagaggatgatagaaatattaaaataagatcatgcattgttttcttaatcttgttggcaacgctgcattgcttttataagcaggacagctcacatgtttgcctttttgtttaactgctttgactatatagtcaggttgaacatcaaagagtttttaagtttggaaagggctcctcattttactaatgtgaaaactgagactcagaggtggcaaagacttgctgaaggtcattca

SEQ ID NO: 57146 - DNA, 601 bp, Human
aacattaaggggagtaataggtgtataatattcactatgaaattcttagccagttgccacctgtagcaataggtccttgaacaatttcaatttggccagcgaaggaaattccaaacatacaatacttgtataagcatagctcctatgcctttccttttttactctgtacttgcctcactgtcttgtgtaggagaataggaatcatttcatctcagaagtgccacttgtttttatggtgtgtctttctaccactattcatcagcctatgttactcatttgtccatccaaccatccattcatccatccatccatccatccatccatccatccatccatccatccaacattatatgccatgtatcactagaggcttgggtattgatactggaaagaaggaaatggaaagataatatagattctttctgttttcttggttcatattattcagtaatcacatgtaggcattcaagataattgctttagagttgataaaactcattccgaaaagaactgtcttatagtacatagtttgctagttaagcattctttaactagaaagtctttttgttcttccttccctttccttccttccttccttcct

SEQ ID NO: 57147 - DNA, 601 bp, Human
aaagaaacattaaggggagtaataggtgtataatattcactatgaaattcttagccagttgccacctgtagcaataggtccttgaacaatttcaatttggccagcgaaggaaattccaaacatacaatacttgtataagcatagctcctatgcctttccttttttactctgtacttgcctcactgtcttgtgtaggagaataggaatcatttcatctcagaagtgccacttgtttttatggtgtgtctttctaccactattcatcagcctatgttactcatttgtccatccaaccatccattcatccatccatccatccatccatccatccatccatccatccatccaacattatatgccatgtatcactagaggcttgggtattgatactggaaagaaggaaatggaaagataatatagattctttctgttttcttggttcatattattcagtaatcacatgtaggcattcaagataattgctttagagttgataaaactcattccgaaaagaactgtcttatagtacatagtttgctagttaagcattctttaactagaaagtctttttgttcttccttccctttccttccttccttcc

SEQ ID NO: 57148 - DNA, 601 bp, Human
agaagacaaaggaatcctgcagtttttactgaatgatggttagtttttacagaggaatttaccttcactgaaagacaatccaagaaactgttctcacctataattttggaaaatagttccccccagctctgtaatgggtgcaacaatgctagaacacaaaggtgcacacacacacacgcgcacacacacacacgaaggaaggggagaaactaatccccttcccctcaaaactgtttggtgtagtttattacagattctaaattgctgccaaggacatttagaattaaaatcagcttgatgyacctttagcattcttatttctaaccatcatacttccactttttaaaaagttagcttcttgaccaatggttcttaaaactataatcatattagttaaaaaaataaagatgggaatttccaaaatgttttctagctcctgttactcatctaacaataggcaatgaaagttataattgagttcctggtatgataagaactttcttaggggctctctggaagaatcagacatggactcataaacctcttttcccatagctctcatcatttccctattgttctcaatctccatttctctcttctg

SEQ ID NO: 57149 - DNA, 601 bp, Human
ttccctatagctcttgccacagggcaagtacctaatcaatatcagctattatgattctttttaatttactttttaattgttactattgtcaaagcagtttgcatgctagagtgctgccctttctctggctgaatgtggggaaacagtagctagctccttggtttccggagctccgttgagtgctgggagagtggacttacagctctgttttctagtgactggggcatccctaggaatccccaggaatcagaggactttattccaagattatcttgacttagcaactttcttactcttttawagactaccacctgactctatttcaaatatttctgcctgtgatgtaaaaaatctctatcaaaatggtttaaaagcctggggaacaaagaaaaaaaaatgccaagggtagtttcccttgctgacaagaggtgtttatgttgcctttaatagtcatgaaggatgttgtaaaatacttcaggatcagggctccccagactgttgattttatgggcagcttgtttgcttagctgtttgtttgtgttacatttttaaatttaaaaaatgtttaagcttattatctttcgcagagggagttgatttt

SEQ ID NO: 57150 - DNA, 601 bp, Human
gccgaggtgggcagatcacttgaggtcaggagctggagaccagcctggccaacatggtgaaaccccgtctctactaaaaatacaaaaaattagcctggtgtggtggcgtgtgcctgtagtttcagctactcaggaggctgaggcaggaaaattgcttgaacccaggaggcggaggttgcagtgagctgagattgtgccactgcattccagccttggcgacagagtaaaactctgtctccaaaaaaaaaaaaaaaaaaaaaaaaaaaaaaaaaaaaaaagatcactgaggactaataacaayggcaataataataatcttgcttaacatttgcaaaggctttacagtttacaaaataatatcactgaatccttacaatcaccacatgaggtgatgcggtgttattcctgtcagtcccacgtacaagctgaagctcgctaacatttagtaatgtgcttgaggtcacagaggaacaaactgatagacaaagggctaaaataataacagttcccattacttgaacatttgtcatgtgctggggattgtagtatgtatgtaaattgcatatattttcttgtttcctatacttctctcagggataag

SEQ ID NO: 57151 - DNA, 601 bp, Human
ccttctcccattatctcttggttcttatccaagctccaagctttcctttggaaagctatccacagacttttcaattaagattactgtgccaggtgtggtggctcacacctgtaatcccagcactttgggaggccgaggtgggcagatcacttgaggtcaggagctggagaccagcctggccaacatggtgaaaccccgtctctactaaaaatacaaaaaattagcctggtgtggtggcgtgtgcctgtagtttcagctactcaggaggctgaggcaggaaaattgcttgaacccaggaggyggaggttgcagtgagctgagattgtgccactgcattccagccttggcgacagagtaaaactctgtctccaaaaaaaaaaaaaaaaaaaaaaaaaaaaaaaaaaaaaaagatcactgaggactaataacaacggcaataataataatcttgcttaacatttgcaaaggctttacagtttacaaaataatatcactgaatccttacaatcaccacatgaggtgatgcggtgttattcctgtcagtcccacgtacaagctgaagctcgctaacatttagtaatgtgcttgaggtcacagagga

SEQ ID NO: 57152 - DNA, 601 bp, Human
ctgtagctgatcaaacccgcaaaatagatattattaaggatgccatctctctgcctaactactaaccaaattaattaacaggcggagaaacacactaatttgaattttaccttttgtttttctgtttaagaggcataccagctcaaaataagaagttctttaaacatctgcaatgcccaaactaagaaaatattcaggaatgaaatgggaacaaattaaaagaaagcctcataaagcgtttaatctccattcttcctctcaagccaaattaatcccaaatttctacaagaaaacattaagrtaccatctatgcttcactctttaaattagcggggggctatagcaaaaagaattgaggttagattgaccaaccacatacatcctattttttgtctccaatagagagattctttttcttttctctcaaagcacaaggtataaagtgtaaagtctgagcggagggattccctggtctgtttcttctgggtctgtctcagcatcacagcaaagccatgggctgaaactcacttgagtgaagcagatgctgtaccaagtagcatgattcccatgcacacacgtgcacggtggaggccattcaaac

SEQ ID NO: 57153 - DNA, 601 bp, Human
tattaaatcatttttctcttcttagtattgtcatctttattggaaagtaaccatgccaagactaaaagtcctgggttcctaatttggtgttaacgttcactcatcaacaagcaatgatgttatcttaaggatagtgagggttttttttttttggacagggtctcactctgttgcccaggctggagtgtggtagtgccatctcaggtcactgcaacctctgcctcccaggcttacacaatcctcctgcctcagcctcctaagtagctgggaccacaggcgcatgccaccatgccttgacaatttttttttttttttttttttttttgtagagacggggttttgctatattgcccaggctggtcttcaactagtgggctcaggtgatctgcctggccttggtctcccaaagtgctggcattccaggcatgagccactgcacccggcctggatattgagttttgcttagaatagaagccctgtgagaccagagatgtatctgtctgtttactgttatagtcccagtgtctagagcagtgtgcaggttattgcaggtgctcaataaatatctgtaaaatgagtgaaatgaatgaatgagtatgag

SEQ ID NO: 57154 - DNA, 601 bp, Human
ttcctagtaagaaaaaaaatcaatcacattctggattcatcctctgttgttttattgcagtttgttctgttttaatttttgtaaaaaagagacatttatttttcattgtttttcttgttttcctctagagcaaggcagagtttcagaaatcgaagattaggaaatcttataattaattttgagtctgtaaaatcatagacatactgggctgagctcaactcgtagcttttctattttctggctgtgtaaacttgtatgagtggcaatctcttgtgtttccgtttcttcatctataaactakggtaacaataatatctaccttataggatcaaagattaaataattaatatatataaaagtacttacaatagacctggcacatggtaagcactacataagtattagccactattatcattattaaatcatttttctcttcttagtattgtcatctttattggaaagtaaccatgccaagactaaaagtcctgggttcctaatttggtgttaacgttcactcatcaacaagcaatgatgttatcttaaggatagtgagggttttttttttttggacagggtctcactctgttgcccaggctgg

SEQ ID NO: 57155 - DNA, 601 bp, Human
atgtataggtggacaggcccttagtacttttgccaaacctcactcaggcatcttctatgtacccctggtggcgtgaataccacagacagctttataatcacacaaagatgagatttgattcatctgcttctatcacagattcattgattgaaaggagatcctgaaaaatccagccttctggcctctagatcctttcctagtaagaaaaaaaatcaatcacattctggattcatcctctgttgttttattgcagtttgttctgttttaatttttgtaaaaaagagacatttatttttcattktttttcttgttttcctctagagcaaggcagagtttcagaaatcgaagattaggaaatcttataattaattttgagtctgtaaaatcatagacatactgggctgagctcaactcgtagcttttctattttctggctgtgtaaacttgtatgagtggcaatctcttgtgtttccgtttcttcatctataaactagggtaacaataatatctaccttataggatcaaagattaaataattaatatatataaaagtacttacaatagacctggcacatggtaagcactacataagtattagcca

SEQ ID NO: 57156 - DNA, 601 bp, Human
aactcgtgcagagcaaaggatcctgcggtggcatgtcactcttcactcctcaggagggtcttcctacatcctgtagttcttgtttcctgcactccctctacttgcgttcttcaaatgtacttcctataaataaaggagaaaaagtgacattaacttgatgaagttttatgtatccatctatttctaacattgggcctcaaccttccatgtcttacgccttaccagttgagctaatagagagcttgaaccttggttttcctgagaagggcatgtataggtggacaggcccttagtacttttsccaaacctcactcaggcatcttctatgtacccctggtggcgtgaataccacagacagctttataatcacacaaagatgagatttgattcatctgcttctatcacagattcattgattgaaaggagatcctgaaaaatccagccttctggcctctagatcctttcctagtaagaaaaaaaatcaatcacattctggattcatcctctgttgttttattgcagtttgttctgttttaatttttgtaaaaaagagacatttatttttcattgtttttcttgttttcctctagagcaaggcaga

SEQ ID NO: 57157 - DNA, 601 bp, Human
cgggcacggtggctaatgcctgtaatcccagcactttgggaggctgaggcaggtggatcacttgaggtcaggaggttgagaccagcctggccaacatgctgaaaccccatctctactaaaaatacaaaaattagctgggcatggtggtgtgtgcctgtaatcccagctactcgggaggctgaggcaggagaatcgcttgaacccgggaggtggaggttgtagtgagccaagatcacaccattgtactccagcctggaaaatagagcgagagtctgtctcaaataaatgaaatgagatgaaraatagaataaaataaaatagaaatcaggccaattaacaaccctacaatgacctcaaagtgttcaagtgaaagaagagtcttatgtctctcattttaaatcaaaagccagaagtgattaagcttagtgaggaaggcatgtccagtgctgaaacgggctaaaaactaggcctcttctgccagttagctaagttgtgaatgcaaaggaaaaattcatgaaagtaattaaaagtgctactccagtgaacacatgaatgataagaaagtgaaccagtcttagctgggcatggtggctcatgcctg

SEQ ID NO: 57158 - DNA, 601 bp, Human
cattcctcatccttcaagtctggctgtggaaccccctccaaatcccagttccctccctgtttctctgtgagatccccaaaactcagtcttgcttctcccccagtggggtcccctggccttcaggcttgtccactggtcctgggttgcatggccggccctgctcccctgcctggaacagcgatactcatcactggtgtcgaccttgagcatatccgtgcaggtcccgtgctgagagctttctgtgtgtttgctgctttagcgtgctaaccctctgggacccacaccacctaggttcaaatctctattattgccagcatccccattttacaggagaggaaactgaggctcaggttttaagtgaggaggttaaagttgcactgcaagtggcagagcttttgtaaacccagctctctgggtccacagccacacttatgtggggctccccgctaggactctggaagccacatctcaaaacttgccctggactacgtctgatctccacactttccagtccccagtgatctttcctctgatatcctttcccagccattcaggctgccctgtttcttggatgccctgtcacccaggtcctgaacaagct

SEQ ID NO: 57159 - DNA, 601 bp, Human; identical to SEQ ID NO: 32268

SEQ ID NO: 57160 - DNA, 601 bp, Human; identical to SEQ ID NO: 32269

SEQ ID NO: 57161 - DNA, 601 bp, Human; identical to SEQ ID NO: 32270

SEQ ID NO: 57162 - DNA, 601 bp, Human; identical to SEQ ID NO: 32271

SEQ ID NO: 57163 - DNA, 601 bp, Human; identical to SEQ ID NO: 32272

SEQ ID NO: 57164 - DNA, 601 bp, Human; identical to SEQ ID NO: 23025

SEQ ID NO: 57165 - DNA, 601 bp, Human; identical to SEQ ID NO: 23024

SEQ ID NO: 57166 - DNA, 601 bp, Human; identical to SEQ ID NO: 23023

SEQ ID NO: 57167 - DNA, 601 bp, Human; identical to SEQ ID NO: 23022

SEQ ID NO: 57168 - DNA, 601 bp, Human; identical to SEQ ID NO: 23021

SEQ ID NO: 57169 - DNA, 601 bp, Human; identical to SEQ ID NO: 23020

SEQ ID NO: 57170 - DNA, 601 bp, Human; identical to SEQ ID NO: 23019

SEQ ID NO: 57171 - DNA, 601 bp, Human; identical to SEQ ID NO: 23018

SEQ ID NO: 57172 - DNA, 601 bp, Human; identical to SEQ ID NO: 23017

SEQ ID NO: 57173 - DNA, 601 bp, Human; identical to SEQ ID NO: 23016

SEQ ID NO: 57174 - DNA, 601 bp, Human
cctgacctcaagtgatccacccacctcggattcccaaagtgctgggattacaggcgtgagccaccctgcccggccctaatatggaaaacttcacataaaacattaagtcaaagaatgaaagaggagaatggtatttctaagatagtccctgccatgcaccttgaagacagcatttagtcaatatgctcacagctgtcaggcggaacctcacagagaatggacttctggggtgaagctggcagcaaagcagccagagaaaaaatttttaaaaataataataataattattattattataatwattattattattattattttcttgagatggagtctccctctgtcacacaggctagagtgcagtggttcaatcatggcccactacagcctcaacctcccgggtcagcctcccaaatagctggaactacagacatgtaccaccacgcctggctaatttaaaaaaatttttttttttttttttttttttttgagacagaatctcgcttttgtcgcccaggctggagtgaggtggcacgatctcggctcactgcaagctctgcctcctaggctcaagctattctcctgtctcagcctcctgagt

SEQ ID NO: 57175 - DNA, 601 bp, Human
catgaaccgtgattatttctggatggcgaggttacgggtgattctacttttttcctgaatgcttttctgcatttgtctatgattatcatgaattaatttgatgatcaaaataaatctgaatgtgaaccaacccttctgtggccttgtctgggcctgtcaggaggtggtgcctgtcggctcagcagcaccagcctcagacccagcccctcacaccgccttgcctgtgtaccggttcctctgcctgcgactccctggcactagtctatgtggacgtcacagcatggcccctgacttggctcakccatccctgtccactctgggaagctcccttgacccccagcccaggctggcagagggggtatcccccagggtccctggcttccccctggttgggcttgagaatttttttttttttttgagacggagtctcgctctgtcccccaggctggagtgctgtggcgcaatctcagctcactgcaacctccacctcctgggttcaagcaattctcctgcctcagcctcccgagtagctgggactacaggcaaccgccacaatgcccggctaattttttgtatttttagtagagacggggtttcacca

SEQ ID NO: 57176 - DNA, 601 bp, Human
cctggccaacatggtgaaaccccatctctactaaaacacaaaaaattagctgggagtggtggtgtgtgcctgtagttccagctatgtgggaagctgaggcagaagaatcgcttgaagctgggaggtggaggttgcagtgagccaacatcacgccactgcactccagcctggcaacagagcaagactccatcaaaaaaaggggaggggaggggagggggaaggaaggaaggaaggggaaggaaggaaggaaggaaggaaggaaggaaggaaggaaggaaggaaggaaggaaagaaggaaggmaggcaggcaggcagggacggagggagggaggaagggagggagggagggaagggaaggtgaagcaggctgcctgtggtgtggcttctttgattgctttgatgtctcttgcatagcaataagggcctgggccgctcccacctgatattctcgttccctgcattgtgctcttctccacaaactaggggtttctcatcctaaactatttatggatgaaatggtgacaaatgtgcatcagcataatccagtgtgtgttccaggtggtggggaagaaacaaggtgtgccgtgtgctgactgccgct

SEQ ID NO: 57177 - DNA, 601 bp, Human
acggggtttcactgtgttagcctgcatggtctcaatctcctgacctcgtgatctgccctcctcggcctcctgaagtgctgggattacaggcgtgagccaccgcgcccggcctgtccagcgtccttttctaccccccagcccacccaccattattttctttttgggacagggtctcactctgttgcccaggctgcagtgcagtggcatgatcacggctcactgcaacctcgactcccaggctcaagtgatcctcctgcctcagcctcccatgtagctgagactacagtcacgcgccaccacatccagctaatttttgtatttttagtagagacagagtctcaccacttttcctaggcttgtctaatttctgggctgtgattccatctcagcctcccgaagtgctgggattacaggcataagtctccacacctggcccctcacccacctacctttccacataaacatccaaccacatcgcctttgtggaaacattcttgaaataaccactttggaagatggtttcggagttgctatcaaacatcccccaccccaccgaccgagtaatccgactcctaggttttatacccaaaagagaggagga

SEQ ID NO: 57178 - DNA, 601 bp, Human
tattagagacggggtttcactgtgttagcctgcatggtctcaatctcctgacctcgtgatctgccctcctcggcctcctgaagtgctgggattacaggcgtgagccaccgcgcccggcctgtccagcgtccttttctaccccccagcccacccaccattattttctttttgggacagggtctcactctgttgcccaggctgcagtgcagtggcatgatcacggctcactgcaacctcgactcccaggctcaagtgatcctcctgcctcagcctcccatgtagctgagactacagtcacgcaccaccacgtccagctaatttttgtatttttagtagagacagagtctcaccacttttcctaggcttgtctaatttctgggctgtgattccatctcagcctcccgaagtgctgggattacaggcataagtctccacacctggcccctcacccacctacctttccacataaacatccaaccacatcgcctttgtggaaacattcttgaaataaccactttggaagatggtttcggagttgctatcaaacatcccccaccccaccgaccgagtaatccgactcctaggttttatacccaaaaga

SEQ ID NO: 57179 - DNA, 601 bp, Human
tttattagagacggggtttcactgtgttagcctgcatggtctcaatctcctgacctcgtgatctgccctcctcggcctcctgaagtgctgggattacaggcgtgagccaccgcgcccggcctgtccagcgtccttttctaccccccagcccacccaccattattttctttttgggacagggtctcactctgttgcccaggctgcagtgcagtggcatgatcacggctcactgcaacctcgactcccaggctcaagtgatcctcctgcctcagcctcccatgtagctgagactacagtcacacgccaccacgtccagctaatttttgtatttttagtagagacagagtctcaccacttttcctaggcttgtctaatttctgggctgtgattccatctcagcctcccgaagtgctgggattacaggcataagtctccacacctggcccctcacccacctacctttccacataaacatccaaccacatcgcctttgtggaaacattcttgaaataaccactttggaagatggtttcggagttgctatcaaacatcccccaccccaccgaccgagtaatccgactcctaggttttatacccaaaa

SEQ ID NO: 57180 - DNA, 601 bp, Human
cgtcctttttttttttttttttttttttgagacagagtctcgctgtgttgcccaggctggagtgcagtggtgcgatctcggctcactgcaagctccgcctcccgggttcacgccattctcctgcctcagcctcccgagtagctggcactacaggcacctgccaccacgcccggctaatttttttgtatttttattagagacggggtttcactgtgttagcctgcatggtctcaatctcctgacctcgtgatctgccctcctcggcctcctgaagtgctgggattacaggcgtgagccaccrcgcccggcctgtccagcgtccttttctaccccccagcccacccaccattattttctttttgggacagggtctcactctgttgcccaggctgcagtgcagtggcatgatcacggctcactgcaacctcgactcccaggctcaagtgatcctcctgcctcagcctcccatgtagctgagactacagtcacgcgccaccacgtccagctaatttttgtatttttagtagagacagagtctcaccacttttcctaggcttgtctaatttctgggctgtgattccatctcagcctcccgaagtgc

SEQ ID NO: 57181 - DNA, 601 bp, Human
gaggatggtgatggtgcccaggggcagcgggatgttggccatgatgaacagcaggaagggcgtgatctccgggatattgctggtcagggtgtaggcaatggacttctttaggttgtcgaagatcaggcggcctgtggcacaggcaggctcagagcaggcgcccatgccagggagccccactccctctgcccctcctctgccctcatccaacgtcctttttttttttttttttttttttgagacagagtctcgctgtgttgcccaggctggagtgcagtggtgcgatctcggctcactgcargctccgcctcccgggttcacgccattctcctgcctcagcctcccgagtagctggcactacaggcacctgccaccacgcccggctaatttttttgtatttttattagagacggggtttcactgtgttagcctgcatggtctcaatctcctgacctcgtgatctgccctcctcggcctcctgaagtgctgggattacaggcgtgagccaccgcgcccggcctgtccagcgtccttttctaccccccagcccacccaccattattttctttttgggacagggtctcactctgttgcccaggct

SEQ ID NO: 57182 - DNA, 601 bp, Human
gccaacagctataaatcaccttgtacagtgcctggtgcacaatgttcactcagccaactgacatttggtggagaaggcatttaataagcacacaaacaaacacataatgaaattcccagcagtgatacgtgccgtgaagaaaagataaagcagggtgaggggactgagagtgacaggatcagtgccagtttagatggggaggtcagggaaggctgccctgaggaggtgacatctgaggtgaatgaagtgaagaagggagccaggcaatcatcaccccacaatgccacacacaacagccccytacactcacaagcacacagcagtcccactcagagcactcagaactactgcacacacacatgcacacgcacacctgtaccagatgtgcacacacacactcaaaagggaatgacatcccccaagtccagcaacttggcattccaatccctttgcagcccttatccaaggattgcccatgtcacccaccccactggttctccacatgagggcccgctaccaacacccagctccctccctcccgtccccagacccttcggaacagggcaacagagaagagaagatgttggaagttccggtgcct

SEQ ID NO: 57183 - DNA, 601 bp, Human
ccataaatatatacaatgattatttgctacttaaaaataaaataaaactcagctggatgcagtgactcacgcttataatccctgcactttgggaggctgaggtgggaggatcacttgaggccagaagttcaagaccagttgggcaacatagtgaaaccccatctccacaatttttttttttttttttacttatccagatatgatggtacatgcctgtagtctcagctacttgggaggctgaggtgggaggattgcttcagccaggaggttgaggttgcagtgagttatgatggcgccactrcacctcactgcagtgagttatgatggtgatagagcaagacctcgtctctaaaaaaatgaataactacataaataaaataaaacttaaaattaaaatgaggtcaggctttctgacactctgagtaatctcagtctgtctggtggtgggacgcactgcctgggaagggagtgggtgcctgccatggaagccacctgggtgaaaatccccacctggcaacaacaccaacaaggaaacgcctaacctaggggaaggttagactagtggggtgcaagggtcccttccagcttggaaactcggggg

SEQ ID NO: 57184 - DNA, 601 bp, Human
aaaaaaaaaaaggactgggagggcaattagagagatttacaaaaaagcaacagctctatctgggattcttcattgccctaacaataaaggatatgaagcaggtggtgggtacagggatgtttgtcgctcaggtcctttatccattattctccaaaatgctggggcagatgtttaggaatttttcagttttttttttttttttttttttgagatggagtttcacccttgttgcctaggctggaatgcaatggtgcgatcttggctcaccataacctctgcctcctgggttcaagtgatactmctgcctcagcctcccgagtagctgggattataggcatacgccaccacacccggctaattttgtatttttagtagagatggggtttcttcatgttggtcaggctggtctcgaactcccgacctcaggtgatccacccgctttggcctcccaaagtgctgggattacaggggtgaccactgcgccctgcctttttttttttttttggtataaatttaaggacagccgagtgcaatggctcacacctgtaatcccaatactttaggaagccaaagtgggaggatcgcttgagcacaggaattt

SEQ ID NO: 57185 - DNA, 601 bp, Human
cctgggcattgctgtaaatgttctttaaaagaaacgtctagcccgtgtgagattttatttgtaagagagcaacagtgattgggtgttgccataaataactgaagcatttatttttcagattctgttaatggacattttgttttttactttatagcccaactcatcagagtcaaagctggaacttgtgagcataaattgtgtgatttgggcagagtgttaaagtgaggagggcagagtcttaaagtgaggtgaatttttaaaaatgtcagtgggctgggcgcggtggctcacgcctgtaatyccagcactttaggaggccgaggcaggcggatcacgaggtcaggagttcgagaccagcctggccaacatggtgaaaccccgtctctactaaaaatacaaaaaattagccaggcatggtggagcgtgcctgtaatcccagctactcaggaggctgaggcaggagaatcacttgaacccaggaggcagaggttgcagtgagccgagatcacaccactgcactctgagactctatataaaaaataataataataataatgacagtgctctggaggaaatattggctgttatccctaaaagaatc

SEQ ID NO: 57186 - DNA, 601 bp, Human
cccagctactcaggaggctgaggcaggagaatcacttgaacccaggaggcagaggttgcagtgagccgagatcacaccactgcactctgagactctatataaaaaataataataataataatgacagtgctctggaggaaatattggctgttatccctaaaagaatccctaatttagaggaggaagacaaacaagacagccttgaacgtgaggaggaggacagcctcaaacatgaaggggagggtgttttgagaatctgaggtggacagaaccatgggatctctggccttgcccagagatyctggggaatctacctccgaggcgccacatgtgacccaggcagtttgctagccagaagcttcacgcacatcccagtgatagacagacttcaaggtgggaatttatttcagccaaagtatctgccatgaaaccttctactctgatgaatgttttgcctgcagaagaacgtaggcagacggataggaaatgtattattcagtacattgaacttcctaacacccagggagatttttgtattaaaatcaaggtggctgtgaatctgggtaacactcctcagaattcattaagatagaattcgtta

SEQ ID NO: 57187 - DNA, 601 bp, Human
attctggggaatctacctccgaggcgccacatgtgacccaggcagtttgctagccagaagcttcacgcacatcccagtgatagacagacttcaaggtgggaatttatttcagccaaagtatctgccatgaaaccttctactctgatgaatgttttgcctgcagaagaacgtaggcagacggataggaaatgtattattcagtacattgaacttcctaacacccagggagatttttgtattaaaatcaaggtggctgtgaatctgggtaacactcctcagaattcattaagatagaattcgwtagggattctctggcatttgatgggatggaagcccttccccagtgtccccagctgcttggtggcagttgactgatggagggcctcatctagaagggggaatcacacaacagtccacctccctagggttctggaaaggaagagtggggtgatttcccttggctaagcctgatcccttgagtgagatctgtgaccatttctcttccaaggagagtgctgggaattttaagtaaaaccattcttattcttcagttggataaaactgaatgataattctcattgatacattctaggctatgcac

SEQ ID NO: 57188 - DNA, 601 bp, Human
atttatttcagccaaagtatctgccatgaaaccttctactctgatgaatgttttgcctgcagaagaacgtaggcagacggataggaaatgtattattcagtacattgaacttcctaacacccagggagatttttgtattaaaatcaaggtggctgtgaatctgggtaacactcctcagaattcattaagatagaattcgttagggattctctggcatttgatgggatggaagcccttccccagtgtccccagctgcttggtggcagttgactgatggagggcctcatctagaagggggaaycacacaacagtccacctccctagggttctggaaaggaagagtggggtgatttcccttggctaagcctgatcccttgagtgagatctgtgaccatttctcttccaaggagagtgctgggaattttaagtaaaaccattcttattcttcagttggataaaactgaatgataattctcattgatacattctaggctatgcacaaagcattcttgattgctttggtttcttaattttgaaactactgtaagggaattattctgagggagcataataaggacataacctttgagggattctagca

SEQ ID NO: 57189 - DNA, 601 bp, Human
taaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgaygctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagcc

SEQ ID NO: 57190 - DNA, 601 bp, Human
gtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctrgaaaagctgaaggaggactgtaacaacactgagaacaaagaacggaagtccttccagaaggagcttgtgatggtgagtgctcagcaggtgcctgggcgttcaggggtgctgctcagcaaagcctttccgccttcccagtgcacatgggcgtgggccgtggtgtcgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtggct

SEQ ID NO: 57191 - DNA, 601 bp, Human
tgaaggaggactgtaacaacactgagaacaaagaacggaagtccttccagaaggagcttgtgatggtgagtgctcagcaggtgcctgggcgttcaggggtgctgctcagcaaagcctttccgccttcccagtgcacatgggcgtgggccgtggtgtcgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtggctgatgtccygctgcctgagataggtgcggctcagcacagcctttcgccttcccaatatgcgtgggcgtgggccgtggtgttgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtggctgatgtcccgctgcctgagataggtgcggctcagcacagcctttcgccttcccaatatgcgtgggcgtgggccgtggtgttgtaagtcaccag

SEQ ID NO: 57192 - DNA, 601 bp, Human
catttgttttgccagcacaaccgtgaactggaatccaaagaaataaaagggggaagtaagcatcagactgtgggttacgccctggcccacgagccaaccggggagcatttgctcaacgctttcttagcactgctccccgcaggcagccccaccgtcagcagagctgggtcctggcggttaccttggctaggcttagccatatccgtgtcctggcatccccaggggtgtttgtggtggagagtccctgtggacttctccctgtgatagaacggagtccacccctatcctccggagaggggcrcattgctggtgttcattcctgtgggaaaaccctgtgaccttggcgtgtgccgctcttcctcgttcctctgagcccgcaggctttcttgcatcctagcttctgagaggcgtgcttcttggtgcccggcctttctgccacctccccggctcccctggattgagccctgtttgtctgggagagcccagagtgtcctgtagacacaggtgtgcaggcaagggtcacatgtggcacatacccggctcggctgcccatgttgagccaggagacagaagggacgcagcccggcaggagtggggcagg

SEQ ID NO: 57193 - DNA, 601 bp, Human
aggcgtgcttcttggtgcccggcctttctgccacctccccggctcccctggattgagccctgtttgtctgggagagcccagagtgtcctgtagacacaggtgtgcaggcaagggtcacatgtggcacatacccggctcggctgcccatgttgagccaggagacagaagggacgcagcccggcaggagtggggcaggagtcgggtgagaccctctctgggtggcctgcagtcgtgtgcagtgccagaagcatggagccacgagattgcccaggggagggagatggaactggaagcggccgtyaggggggccaccttggcaaccaggaaatcactgcacttgggtggggaggaagcgaacaaacgcagcagggaagcctccgggcccccatgtggggtcacctgcagggaggggatggcctgcgtccctcccatcagccatcacccatgtgtgattcagagcacacctcctggctctccagaacctggtgccgggccgtggcctggtctcctcacgggtgcacccagcacagtggcagacaaagcgcctccatcccgtgagagcctctgtgcgggcggccccgagaccacagccgtggctgtg

SEQ ID NO: 57194 - DNA, 601 bp, Human
agggagatggaactggaagcggccgtcaggggggccaccttggcaaccaggaaatcactgcacttgggtggggaggaagcgaacaaacgcagcagggaagcctccgggcccccatgtggggtcacctgcagggaggggatggcctgcgtccctcccatcagccatcacccatgtgtgattcagagcacacctcctggctctccagaacctggtgccgggccgtggcctggtctcctcacgggtgcacccagcacagtggcagacaaagcgcctccatcccgtgagagcctctgtgcgggcrgccccgagaccacagccgtggctgtgcatgctgtcgtggaacctgacagcattgctgagcccaggacactcacctcgacgttgcaccagaggtggaaaaatgacacaaccaggagtaccacaccagctgtggaaaataaccgccgagtaggtggcttttacactcattttcctgcttttttatctttttccaaaagacataaatgatcaaactctctcaattcgattggtgagcatctctgggaggggattttttggtgggcctccctgtccgctccagggaggggtgtgtcctctgtgc

SEQ ID NO: 57195 - DNA, 601 bp, Human
tgtgcatgctgtcgtggaacctgacagcattgctgagcccaggacactcacctcgacgttgcaccagaggtggaaaaatgacacaaccaggagtaccacaccagctgtggaaaataaccgccgagtaggtggcttttacactcattttcctgcttttttatctttttccaaaagacataaatgatcaaactctctcaattcgattggtgagcatctctgggaggggattttttggtgggcctccctgtccgctccagggaggggtgtgtcctctgtgcccgagtccttccgctacccagaraggaggaagtgaaacttgcccttggccaggtcggctccctgaggcaaggttagattttgtggtgataaagtgaaactggttttgcagtgtccccacccgccccccacacctgtgtcagtcatcatcttggccaaacttatagaaaccacagacggatttctcccaggtcgtttattaggagaccctgaaaactggctgttctattccgcttgtcatcacagggctgccacgatttctgcggcctctgccaccgctttacctgcccctcccagagagtcacagccaggccaccccctgcct

SEQ ID NO: 57196 - DNA, 601 bp, Human
ctccctttcccagacctcctcatctccctcagctgccagctcaaatgccgtctctccaggacgtccttctctgcagccccgcgcactccatcatcctctgtctccatggtgtttcttgaatcagaagcggtttgttttggccaggcatggaggttcacacctgtaataccagcactttgggaggctgagacaggagaatcgcttgagcccgggaattcaagaccagcctgagcaacatagtgaggcttcatctctccaattttttttttttaaatcagccaggtgtgttggtgtgcacctrtagtcccagctacttgggaggctgaggtgggaggatcacttgagcccaggaggtcgaggctacactgagctatgatcgcagcactgcactccagcctggacaacagagtgaaaccctgtcttgaaaataaaggaagagaagaaaagaaacaagtttgtttatgttcttgtgcacttgtttctcattattactctaactgaacataggtcccatgagaggaagggccccggcacataagaatcactgaggtactagatggataagtgattgaatgaatgaatgatggatgaatgaatgaat

SEQ ID NO: 57197 - DNA, 601 bp, Human
agcctcattcctcataaagggttgcagcctgtgggtggctattctgacaggttgggaagcagagcctcctgccagaagccaaaaacagacacttcaagggaggggcaaaggcaacaagaatttatggatattggtggccaaatatacatattcaataagccgtagggggagtcatgagtatttatgaaaggagaaatgtgcacattcacatttaagccttgtgctccttcaggggtcccatgtacaaaaaatggtggcagtggcatgattcaagggtagggttttctttcagccccctgaygcgtcagaggcgaagcaggggacatgaaaccctcgctgtgcatcctctgtagactggccagaaacactgcgtggtcggtgggctcccgtcaggcaaagaggaggggcagcgtctggcagtggtagaggcctttgaaagggaacccagctttttaagaatcagaaaagtcattcagcagcgcccttttgatgcaagagactattcccaattctcgggatactgtcagcactcggcacatggtctctgttatggtggggaaggaaggggagtcagctggagatagccgtgggcagtggccat

SEQ ID NO: 57198 - DNA, 601 bp, Human
gagtatttatgaaaggagaaatgtgcacattcacatttaagccttgtgctccttcaggggtcccatgtacaaaaaatggtggcagtggcatgattcaagggtagggttttctttcagccccctgatgcgtcagaggcgaagcaggggacatgaaaccctcgctgtgcatcctctgtagactggccagaaacactgcgtggtcggtgggctcccgtcaggcaaagaggaggggcagcgtctggcagtggtagaggcctttgaaagggaacccagctttttaagaatcagaaaagtcattcarcagcgcccttttgatgcaagagactattcccaattctcgggatactgtcagcactcggcacatggtctctgttatggtggggaaggaaggggagtcagctggagatagccgtgggcagtggccatcagccatgggagcagaagcagcccacggtggcctcaggcccagggagaacttcctaaggggccagagtgagctgtcacaactggtcctggatccaccataagaacgaagccgtggggtgtggtgacctggagccgtcggtgatggctgtagcaggggcgttttggtcaagttgcg

SEQ ID NO: 57199 - DNA, 601 bp, Human
cccagggagaacttcctaaggggccagagtgagctgtcacaactggtcctggatccaccataagaacgaagccgtggggtgtggtgacctggagccgtcggtgatggctgtagcaggggcgttttggtcaagttgcgggaggtagggaaataggcgtgtcgggctctgtagagaagtttctatgagaaagggaaggagttgctgtgggatgcaaagcaagggagggtggttgttttgggagtggagtgggggccggaataaacccaaagagacttgaaaactaacagaaataaggaagctrgcaagtgcatggggcgcattggggcgggaaagactggtgtggtgtgaagggactctctgtggattgggagaagacccactttaacctccagaagaggaggagttgatggacagtgtgcattggatggggtcctgagggattcctcccaggcagccccaaagccagagcctgtggctgttaatgtgggagagggaaggaggatgggcccattgtccagatgccatgtgcagaaggcttcccctcgagttttggggcatgttgggaaggaagcaggatggaataaacatgcagcaaaaaagc

SEQ ID NO: 57200 - DNA, 601 bp, Human
gaactcagccacacccattcccatctgcatcgtctgtggctttcaggcttcgtgtgtcccacaaaggcaaaagtactatctgtccctttataaagttcagtcaccctgactgaaatcatggtgtactcactgtaacaaaattccagttgaaaccagggtagtgcagcagtccatcgagtgtttcctggtgtacctgtgtgcccataaaaagaggaagctgcaaggatcaagttcatagagctagagcctcctgctgtgaaatttttctattgctaagaattggttggcacccaaaatttgycctttaaaaatatgcatcagttatgccttgttgatggtgtgggtggtttgtaacaaactaaaccagggctgggctcagtaaaagttgtgtaagtgagtgagggagagatgccttcattcttggtgttggaagtgccgacctctcctttcatctgggatccatggaaatgggaccttggctgcccctggatggagtccaggcgctctccttcccaggggccagagaacacctgtgtttcccaggaccttggggacctgtgcccagttcccctggggagagagcggttttgatcactcgcac

SEQ ID NO: 57201 - DNA, 601 bp, Human
tctgacagcctaccagctaactacacaccctcctgacacgtgaatacacacgtgtatgcttttatcttctgaaacaaatctagtcaacatttaattttttaaaacaatttgttttgaatatatccaaattcaaatagaaacagaccttcttctgaaatatataaatagttgatatgaagcataatccagaccggtattacatttggttcaattcccaattccatgtggggctcatggaattgggaaggccgctggccgagtgctgagaagtttgcatatttgcctccacgcctgtcacttscagctgtgggacccgggacaagcctggggtctgcaggcttcctgtgcttatctgtagaacagatgccttgcggcccacacagcagggaggacctggggttgggtgcccagaggcagctctggctctggcatttctcggtgtgaaacccacttcccctctctcagcttcttctgtaaagtgggttgaactcagcctctgcttcatggggggctctggggagcggaggagctgagtgtctggctcacagcaagccctgggtttctttttttttcttttcttttttttgagacggagtctcgc

SEQ ID NO: 57202 - DNA, 601 bp, Human
gtgtacaggactagcaggcctgctgtcttgtgctagccaatttgatttgtttctttaaaccagaagtgtgagtttgaccccagcctggggtcccccagatatattagccatatgttcaatgcctgtcccatccagcccccgtttttaggagggaattgagtcccaaggcggccacgtggttgttccagcctcagctgggacttcactgtcccagcagggctgtctgtcctattacctcccctctgacttcctctgtggttagtaatccctgtcctaaagacacagtagaaagttcttgcarctttgacgtgggagcagtcccaccaattgtggaaaccgttttctcatgttgcacagtcctgggggaggtctgtgcatctcctggtcaccgtggttcttggtggtacaccctgtctctgaccagggcctcttctgttctctgtcttcttctccctgggtggtccctgcctgagtcccccagccttctacccgcggtgctctctaactggccaatgtcagcaccgcacactcagcaggtccagctcgccctccatccgtctcggcctcaggctatggtgtctatttggtgaaatgcattcgt

SEQ ID NO: 57203 - DNA, 601 bp, Human
caatttgatttgtttctttaaaccagaagtgtgagtttgaccccagcctggggtcccccagatatattagccatatgttcaatgcctgtcccatccagcccccgtttttaggagggaattgagtcccaaggcggccacgtggttgttccagcctcagctgggacttcactgtcccagcagggctgtctgtcctattacctcccctctgacttcctctgtggttagtaatccctgtcctaaagacacagtagaaagttcttgcagctttgacgtgggagcagtcccaccaattgtggaaacygttttctcatgttgcacagtcctgggggaggtctgtgcatctcctggtcaccgtggttcttggtggtacaccctgtctctgaccagggcctcttctgttctctgtcttcttctccctgggtggtccctgcctgagtcccccagccttctacccgcggtgctctctaactggccaatgtcagcaccgcacactcagcaggtccagctcgccctccatccgtctcggcctcaggctatggtgtctatttggtgaaatgcattcgtttctctctggtgtccccagagagtgggagtggtgaca

SEQ ID NO: 57204 - DNA, 601 bp, Human
tggttgttccagcctcagctgggacttcactgtcccagcagggctgtctgtcctattacctcccctctgacttcctctgtggttagtaatccctgtcctaaagacacagtagaaagttcttgcagctttgacgtgggagcagtcccaccaattgtggaaaccgttttctcatgttgcacagtcctgggggaggtctgtgcatctcctggtcaccgtggttcttggtggtacaccctgtctctgaccagggcctcttctgttctctgtcttcttctccctgggtggtccctgcctgagtccmccagccttctacccgcggtgctctctaactggccaatgtcagcaccgcacactcagcaggtccagctcgccctccatccgtctcggcctcaggctatggtgtctatttggtgaaatgcattcgtttctctctggtgtccccagagagtgggagtggtgacaactctaatccatattcaccctgtctgttagcttcctggggctgccaagacaaatgaccacaaaccaagggacatcaaacaacagacacctgtcctgtcaccattcaggaggccacaggtctcagtcaggggtcccaggg

SEQ ID NO: 57205 - DNA, 601 bp, Human
tccaaacaaatggcacagagagaaagtgccataaagattgtaaggaaagagaagtcctttctgtttattcatttgttgcgcacctactcttgcacaaagccctgcttttccctctggaatgtgctgaccctggccccgagatggttccactgtttcttctgtgggcttgtctcactcgtgaaagagtgtcccaaatagtgactactgaagctgcaccaagtaataggaacaaatctcgttctgtctcctaatctttcttcctctctccctccttttgttttttacaactccacctcccaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagc

SEQ ID NO: 57206 - DNA, 601 bp, Human
accagaggtccgggctcgaccaaagaccccaaagaccctcccaaagccgaaccccctccttcgagcgcggggaggggccgacttgccattacctcgcagagggtgaagagtccgtaggccgccagccacaccgtgcaggtgacagcggtgagcgaacgcagcgagagccgagggcagctgaggcagaattcccggcaggacggggagtagtagcggcgctgcagcgccaggcggccgccgcagatatccgaaaagctccgctcatcctccatgacgcccccactcggccgcccgcaccgcrcggcgctgcactgcgctcgccggccctggtcgtctcgcccgctccagacccgcttccggcagccgcgtcaccacgccccgccctaagcctgcgcagcctcagttgcgcgccgagagctctgctgggggctgatggttgtgcgttcttccgggccggccttgactgtcttcgaacaaacctcgtcggggcaatagttcagtggaaagattaaaatcgtttttagaccgggcgcgttgactcaggcctgtagtccagcactgggaggccaaggcgggaggatcgcttgagcctgggaggtcg

SEQ ID NO: 57207 - DNA, 601 bp, Human
gccttccgagtagctgagactacaagcgtgcaccaccacacccagctaatgtttgaatttttcgtagagacgtggtttcaccatgttggccaggctggtctccaactccagacctcaagtgatcccgcccgcctcagcttcccaaagtgctgggattacaggcgtgaggtacagtgctttgcctgaacaaacatacggtttagatagttagatagtttcctgcaattagggcagtcttaattctgcatatttctatgctaaattaccatgctctgaaacacgctttgacagcaaaaaagcraatggatgcagtaatggaaacaatatccaagttacaaaaataaatagccctgctgtacttagctctgattagatcacttctgggataatacattcaattcaggcactacatatgaaactagaacttatcctgaaaattaggataattctttttatttgagagctgtcacaaagttactgcatttaaccctcacaatatcatgaagctggtatggcaggcatgaattctattttagagatgtagaaaattgaggctcagagaaaacaggaatgaatctggaaattgagcacagctatcaca

SEQ ID NO: 57208 - DNA, 601 bp, Human
ggcatgagagagataagtacagaagggacctggcataaaagcaggcttttgtttttaaattttgcctaagatcagctatacaatggtataaaggaaaagaaagggtctcagagtcagaaagcccttggtttgaagcccagatctgccatttactgctttgagactttggataagtcattgctctttgtgagccttggtttccttcgttctagggctaaagtaaggaattcagtaaagcatctggcagtcagtgggcatttaataaatatctatttcctcctcctcacatgaccacatacayaggctataagaactcaggctagtactaaaattcaactatacaataaattaaattttaggggggctatcaagtcaacttaatcatcattttaactgacttatgaacaaactttttttttttttttttgagacagagtctccctctgttgcccaggctggagtgcagtggcgtgatctcggctcactgctacctccacctcccaggttcaagcgattctcccgcctcagccttccgagtagctgagactacaagcgtgcaccaccacacccagctaatgtttgaatttttcgtagagacgtg

SEQ ID NO: 57209 - DNA, 601 bp, Human
ttagaaagtgttgcagtagagtttaaaggaagatgcggtcactgattcctcgggtacttgatgggggtaagcagagtacaccggcatgagagagataagtacagaagggacctggcataaaagcaggcttttgtttttaaattttgcctaagatcagctatacaatggtataaaggaaaagaaagggtctcagagtcagaaagcccttggtttgaagcccagatctgccatttactgctttgagactttggataagtcattgctctttgtgagccttggtttccttcgttctagggctaaagtaaggaattcagtaaagcatctggcagtcagtgggcatttaataaatatctatttcctcctcctcacatgaccacatacataggctataagaactcaggctagtactaaaattcaactatacaataaattaaattttaggggggctatcaagtcaacttaatcatcattttaactgacttatgaacaaactttttttttttttttttgagacagagtctccctctgttgcccaggctggagtgcagtggcgtgatctcggctcactgctacctccacctcccaggttcaagcgattctc

SEQ ID NO: 57210 - DNA, 601 bp, Human
actactcactagctctggttttctttgatggtctctttctactttttcatagttaacccatagtgttagatcagggatctgtaaactatttgggcctgtggtctggttttgtctggcccatctcaagcaaagaatgatttttaagtttttacagggttgtagaaagaaagaaaagaatattatgagacagaccccacagaacctgctatatttactatctagtcttttaatgaaaatgtttgggccaggcatggtggctcatgcctataatcccaacactttgggaagccaacatgggggratcgcttgaggccaggagttcaagaccagcctgggcaacctagtgagaccctgtctctacaaaaaatacaaaaattagccaggtgtggtggcacatgcctgtagtcccagctactcaggtggctgagataagaggatcgcttgagtccaggagactgaggctgtagtgaggggtattcacaccactacactccagcctgggcaacagagtgagaacctgtctcaaaaaaaacaaagaaacctgtctcaaaaaaaaaaaaagtttgcttatctctgtgctagataattatttgttgattga

SEQ ID NO: 57211 - DNA, 601 bp, Human
tttgtaccacttcaactactcactagctctggttttctttgatggtctctttctactttttcatagttaacccatagtgttagatcagggatctgtaaactatttgggcctgtggtctggttttgtctggcccatctcaagcaaagaatgatttttaagtttttacagggttgtagaaagaaagaaaagaatattatgagacagaccccacagaacctgctatatttactatctagtcttttaatgaaaatgtttgggccaggcatggtggctcatgcctataatcccaacactttgggargccaacatggggggatcgcttgaggccaggagttcaagaccagcctgggcaacctagtgagaccctgtctctacaaaaaatacaaaaattagccaggtgtggtggcacatgcctgtagtcccagctactcaggtggctgagataagaggatcgcttgagtccaggagactgaggctgtagtgaggggtattcacaccactacactccagcctgggcaacagagtgagaacctgtctcaaaaaaaacaaagaaacctgtctcaaaaaaaaaaaaagtttgcttatctctgtgctagataat

SEQ ID NO: 57212 - DNA, 601 bp, Human
ggcatgtgacacaactctggccaatgaaatgtgaggggagatctgctggaggggcttctggaaaacttgagtttatctttaaaaatctgcagaagagacgttcccttcatcatgaggtttagatacctggaactactatggcctctgccagacccagtggagagctagtagaggacaactagaggacgctaagggttggaagtgcagtttctgcacttggaggaccaggtggaggacaagtagggcacactaagggtgtcagcagtaagatgacaagagccggaatcaaatgagtctccaygtgaactctggagccctcctaccttatgacttcttgttaatagaaaaggtccttatctcttaaggctattttagttgttctgtgttacttacagttgactaagtgatgtgttaagggctcaaaaaatggtgtctattatttattcccttgattctaagaccaatgtataatctttaacatttctgaagttaaaatgtgttttcctattggtgtgtgtttctttcatgtggcattgttttatcttttttcccagaagcttgcattcattcattgattcgagacagaatttcactcgtttcc

SEQ ID NO: 57213 - DNA, 601 bp, Human
tccagacaacaaatggataggtctaggggaaacctccatcagcaaaatgtccatcacagcaatctcagaaatttttcttccaaaattccaactttagggcctaaatcagctgaacgcagtagcttgcacctgtaattccagctactagggaggctgaggcaggaggatcgtttgagcccaggagttcgaggctgcagtgagctatgatcatagaactgcactctagcttgggtaccagcataagacactgtctctaaaaatcgaaaggacccagccgagtgaggtggctcacgcctgtacycctagcactttgggaggccaaggcaggtggatcacaaggtcaagagatcgagaccatcctggccaacatggtgaaaccccatcactactaaaaatacaaaaagtagctgggcgtgttggcacgtgcctctagtcccagctactctggaggctgaggcaggagaatcgcttgaacctgggaggcggaggcggaggttgcagtgagccgagatcgcaccactgcactccagcctgatgacagagtgagacatctcaaaaaaaaaaaggaccccaaatcttttcctttcacactccctcagca

SEQ ID NO: 57214 - DNA, 601 bp, Human
cctaagagggtgatgaagatggcagcagagaggatcatgctgttctgaagagagagccagacacagacagtaagattaccaagtggtaccagtcaactccaggcaatgaggggaacatgcatggaggaaaaggaaattgcttttatttgggttctaaggtgctatgaaagtatacagtgaaacagatccagacaacaaatggataggtctaggggaaacctccatcagcaaaatgtccatcacagcaatctcagaaatttttcttccaaaattccaactttagggcctaaatcagctgaaygcagtagcttgcacctgtaattccagctactagggaggctgaggcaggaggatcgtttgagcccaggagttcgaggctgcagtgagctatgatcatagaactgcactctagcttgggtaccagcataagacactgtctctaaaaatcgaaaggacccagccgagtgaggtggctcacgcctgtacccctagcactttgggaggccaaggcaggtggatcacaaggtcaagagatcgagaccatcctggccaacatggtgaaaccccatcactactaaaaatacaaaaagtagctgggcgt

SEQ ID NO: 57215 - DNA, 601 bp, Human
gtgcatgcctgtagtcccagctactcaggaggctgaggtgggagaatggcttgagcctgggaagttgaggctgcagtgagctgtgatcgagccactgcactccagcctgggcaacagagtgagaccctgtctcaaaaaaaaaaaaagaaaaaagatagaaagagaaggaaaaaatgccagtgataattttgaagttggtcttgaagataaagttgaaatgctaattccctatccatgaaaacctgctgcatctctttaaaaataaagagatttaccttttaaatataagtctcacttttayggttttagtttaaatctgggaacatcccatgggctggctacctcctccagagaggcctgtaatacttaccttttaaatacttaccatgtaaatggcctcattgatgacaatatccttgaccttgcccatttctatgaaggtagtgctttctttgcctgaagcataagatgaagtcatctgaatgccaagggaatcaatgattaacagagtctcctgatcaatcttcacaaaatggagataaccaagcagacctaagagggtgatgaagatggcagcagagaggatcatgctgttctgaag

SEQ ID NO: 57216 - DNA, 601 bp, Human
accttaggtgatccgcctgccttggcctcccaaagtgctgggattacaggcgtgagccaccacacctggccacattctatttttctaagggaaggctcaacgctttttcacaaatgtttaagtagtagaacacttgatagcttttgaagtggaagaaaagtatattctcattctttaaatgaaaaaagacagggccaggcgtagtggctcaaacctgtaaactgaacacttggggaggccacagcaggaggatggcttgagcccaggaattcaagaccagcctaggcaacatagtgagacygcatctctgcaaaacatagaaaaaacgagccaagcatggtggtgcatgcctgtagtcccagctactcaggaggctgaggtgggagaatggcttgagcctgggaagttgaggctgcagtgagctgtgatcgagccactgcactccagcctgggcaacagagtgagaccctgtctcaaaaaaaaaaaaagaaaaaagatagaaagagaaggaaaaaatgccagtgataattttgaagttggtcttgaagataaagttgaaatgctaattccctatccatgaaaacctgctgcatctctttaa

SEQ ID NO: 57217 - DNA, 601 bp, Human
tggttcctaggactgtgtccacctgatggtttggagtacggaaaaccagcccctatggcttaagagtcatctcccatggaagacaatgctggccttctgaacgctggggctcatgggcttgttgatgtggctttctggtgtgccaggatctcctggcagctcctgtatacttcaatcaagcagtccagccggggcttggcactctgaattccaaaggggagaaatgcggagtcaaggtgagaatataagggagtgcagtggtgctgcatccacttgcaaatttttttttttttttttttttgagacagagttttgctctgttgcccaggctggagtgcagtggcgcaatctcggctcactgcaacctccgcctcccaggttcaagtgattctcctgcttcagcctcccgagtagctgggattacaggtgctcgccaccacgcccagtggcacaatctcggctcactgaaacctctgcatcccgggttcaaatgattcttgtgcctcagcctcccaagtagctaggactacaggcacgaaccaccatgcccaactaatttttgtatttttagtagagacagggtttcaccatgttggccagg

SEQ ID NO: 57218 - DNA, 601 bp, Human
tgctgggattacaggtgtgagccaccatgcctggcctgcagtctacttttttttcttttcttttcttttttttttttttttgatacagagtcttgatctgttgcccaggctggagttcagtggcatgatctcggctcactgcaacctccgcctcctgggttcaagcaattctgcctcagcctcctgagtagctgggactacaggcaactgacaccatgcccggctaatttttgtatttttagtagagatggggtttcaccatattggccaggctggtcttgaactcctgacctcaagtgayccgcccgcctcggcttccccaagtgctggaattacaggtgtgagccaccgtaccctgcctgcagtctacttttcaatcacataaatcagatcccacaatgcttctgcacagtatcttttaactgcatcccatcatatttagaaaaaggcacaagtctttcaccatggtccacaaggccctacatgatctggccctgcttatcgctctcctttgctcactccatcccaaacacatggaacttcctgctcttcgctgaacacaccaagctcatttctgcttaaaggcatttgcagtgctatt

SEQ ID NO: 57219 - DNA, 601 bp, Human
aaagctctgaaaactttatgatgtggtctctgaactagaaaaagaggattcagagatgaggcaccatgtgtttgcttagataaattcaatttattcaacaaacatttattgagcagtgtgaatgaggtagtgaataagaggtaaagttgttggacttattataattctagggatatgtatatattttctttacttatccattaaacaactatgtctgttaccagcaacttagagtattttgtggttgggcgcagtggctcacacctgtaatcctagcactttgggaggccgtggcgggcaratcacttgaggtcaggagtttgagaccagcctggccaacatggtgaaaccccgtgtctactaaaaatacaaaaattggctaggtgtggtagcatgcgcctgtaatcccagctactcggaaggctgaggcatgagaatcacttgaacccaggaggtggaggttgcagtgagctgagattgtaccactgcactccagcctgggcgacagagcaagactctatctcaaaaaaacaaaaaaaagaaagaaaaaagaaaagaaattcacatatttctgattgtcctctttgcaggatggagaaaa

SEQ ID NO: 57220 - DNA, 601 bp, Human
tttttttttttgtagagataggtctcaccatgttgccaaggctggtctccaactcttggcctcatgcaatcctcctgcctcagcctcccaaaatgttgggattacaggcacgagccaccacacctggcccccatatgttatttttaatggcagaagaagaaacattttgtaaggctatattatgtcatgatctctgttctacaggtacctttgatattctcatccacaacccaaactctgcttctcctcttatgtttcttacttaagttcatcattcacccagttgaccaagtgaaaaaaygcagacaccctggaacctttctccctcactcctcatatccattgaggctggttaatttctgcctcaaaaccaactcttgggccgggaactgtagctcacccctgtaaccccagcactttaagaggctgaggtgggtggatcacttaagcccaggaattcgagaacagcctggataacatgggagacccttactaaaaatacaaaaaattagccaggcctggtgccatgcacctgtggtcccagctactcgggaggctgaggtgggaggatcacctgagcccgggaagccaaggctgcagt

SEQ ID NO: 57221 - DNA, 601 bp, Human
ttatcggccagctgattatagtactccatagtgactattttttctggctctgaaaataatagggtcttgtgttatacatactgatctaaatgatttaaaatggaaaactttcaatatttttatgatacacgttaagacatatggagagatgtcttcaggtatgacaaaaccaaaactagaaatcatgaccacaggcatttaacattgattagattaagaaattatagcacattatagtactctgaggtaattggagagacctcttcagaggttgtaaaaccaagagtagaaattatggccrtaggtatttaatgaaatattaaatggattaataattattgtaagtggtaatggacagttacacaaaaacttcctaaaacaggacacattgtctctagtatcattcaaaggcagaaagtgaatggagactgtactttggagaaatacagtttttgttgttttaataggtggaatatacccatttttaaagtaatgaaaatgtggacaacagaatagaaataaatcacaatcatatatcaatattttctttccaacaattcacacattccatcatccaataggtatctatgaagcacctagt

SEQ ID NO: 57222 - DNA, 601 bp, Human
ataaatagaaaccaccattgtttctgaaagtaaatacttaggaagaacctaagagcaaaaaccaaattcagtagaaaatatgaggagttagaggccaggcgcggtggctcacgcctgtaatccctgcactttgggaggccgaggcgggcggatcacgaggtcaggagatcgagaccatcctggctgacacagtgaaaccctgtctctactaaaaatacaaaaacttagcccggcgtggtggtgggcgcctgtagtcccagctactcgggaggctgaggcagaagaatggcgtgaacccggraggcagaagttgcagtgagccgagatcgcgccactgcactccagcctgggtgaaagagcaacactccatctcaaaaaacaaaaaacaaacaaacaaaaaaaatgaggagttagaatagttaaaattctacagtctgtaagtaattggtgtttatcggccagctgattatagtactccatagtgactattttttctggctctgaaaataatagggtcttgtgttatacatactgatctaaatgatttaaaatggaaaactttcaatatttttatgatacacgttaagacatatggagagat

SEQ ID NO: 57223 - DNA, 601 bp, Human
ccttttaaagctatgtatttttcaatgtgactcctaaacacaagccagcagcacttccaccaactaaagagcaatttttttttttttcttgagacagagtcttgctctgtctcccaggctggagtgcagtggctcggtctcggttcactgcaacctccacctcccaggttcaagcgattctcttgcctcagcctcccgagcagctggggttacaggcacccaccaccatgcccggctaatttttttacatttttaataaagacagggttttgccatgttggccagtctggtctcaaactcytgacctcaagtgatccatccacctcagcctttccgctgcaaaagagaacagatgagccgggcttatggagaaatggcatgtgggtattcagttgctgtcctgagattttcttagatgatttgtctactctgattttcatcttaagacctggctttttttgagactgtgtctcactctgttgcccaggctggagtgccgtggcgtcatctcagctcactgcaaactccaactcctgggttcaagtgattctcatgcctcagcctcctgagtggtgggattacaggagtgcaccaccacaac

SEQ ID NO: 57224 - DNA, 601 bp, Human
ctgtattcccagctactcaggaggctgaggcaggagaatggtgtgaacccaggaggcggagcttgcagtgagccaagattgtgccactgcactccagcctgggcgacagagggagactccatttcaaaataaataaataaataaataaaatgtaagtgacagtaataatgatacttgcggatggcaaaaattatgaaggtggtaccagaatgctgtcacctggtaaacatttgtatgggggaaaggcatacaagcaccttttctggttagtcagcggggtgaggttctggtgccaggttcrggcctgcctcagcatgtaaacttagataatttccttcatttctttgggacctcacattctccttcattgactacaaaatgaggaagtaggtcattcccttatatctaacaagcaaaaattagctccttttaagaggagcttgattttttaaaaaaatttatacatccaaatgactgttctccctggaaatctacacataatctacttatcaccataaagttaccatcatttacaatgtttgtttgtttgtttcaagacagagtctcactggtcacctaggctggcaaaatacatgtaata

SEQ ID NO: 57225 - DNA, 601 bp, Human
aggcaggagaatggagtgaacccgggaggtggagcttgcagtgagccgagattgcgccactgcactccagcctgggtgacagagcgagactccgtctcaaaaaaaataataataatttctgaaactcataattttaaagcaaaattgtttggacttcctccccaactttggcaacatgactaaagtcacttttacaactcccactttaaccagctccacctgcctgcctgtttccagtctccctttacaagtgatcttctgtcagcttctaatctgtgataatccctcgcgcatccatttkaaaattttaagtacttcattctcaagggatctagttttggcatcagcaatgtcaagccaatatcatcctgaatatctcttaaactataatcaggatgcatcgtgaaacaggatttgtttaaaattgtagtatgagcctttcagtctgcactggtgggcccctttccatttctctgccatgctacttgccagagaatttctactttgtgttgtgtttgtggaagacagaccaaatgcagcacatttaatctttcagacgttttattcctttaacgatctagctgctctagatggtttcaga

SEQ ID NO: 57226 - DNA, 601 bp, Human
agaacttcacctaaggtcaaacaaaaaaccttgagcctgccacactgggggtgatttggtctcagggaaattagtatctggggcttgagcaagcttccccacctgccctaatttctcaactgccctaattttctaaatccccaccgaagttttactccacctgtaatcctaaatacagacagcaggaagaaaaaagtagccttgtcaggccagaattaacaaccactgacagaaacggaggcagctccaagttcttagctgttcaaagcacgcgcgcgcgtgcacacacacacacacacayacacacacaaaatcaaaagggacccagctcacagaggcctagtacagagcaagtgaccactggcagtaggaccatcaaggagccaaaagattggctcccagaacagaagtagcaaggagcattttctttctttctttttttttttttttttgagacagagtctcgctctgtcgcccgggctggagtggagtggcaagatctcagctcactgcagcctctgcctcccgggcacaagcaattctgctgcctcagcctcccaagtaactgggattacaggcacccgccaccacgcccagctaa

SEQ ID NO: 57227 - DNA, 601 bp, Human
ggtttccaggtgcagtggccccctaattaccccatacttgcccctttccctgtctgcccagacttactctactcttggtacgttctaactggtctcgttgttcccccagctcttctatgatttctgagccaatctggtcagtctctgtggcaatccgatgagaacgttcaatactttgggtggcccggttcaggctttcagtgccctgcagaagcattgccctttgagactgtagccgattctgaaagaagtatggaagagaaatgttagactttttccattataaattcattgccagcayattcctcatcaccttccccatgttagaagggatatagtgagcaataattttcattccttttaagacagaaccaaagaagctaatgattcttttcaaggtcacagactaaagcaggacctgaaatccaatcaataggatcacaatacccccactccactgccttttacacttacgcgaggcaaggaaagatggattaaaaatactggagcactttccctgtgtttgtaatgaatctgaactggtccatgtgcctcctggactatcaacttctgaaaggtggcagcccagatgtgggagcta

SEQ ID NO: 57228 - DNA, 601 bp, Human
atccttaagtgccttttgacatattatttctcttgccaaagagagaatgcagccactttatccttattaatttctgtaatcttgtaagtgtagaaatcaggtccttccatctttttttcccctcactgaagcaaaaatttccagtgatgtctaaatcttaggggtaaaattgcttctaagggacatctctcagccaagcaaactaaaaattgagcaaagcggccgggcacagtggctcacgcctataatcctagcactttgggaggccggagcaggtggatcacctgaagttaggagttcragaccagcctggccaacatggcgaaaccccatctctactaaaaatacaaacattagctaggcatggtggcgcatgcctgtaatcccagctactcaggaggctgaggcaagagaatcgcttgaacccaggatgcggaggttgcagcaagtggagatcacgccactgcactccagcctgggtgacacagtgagactctatctcaaaaaaaaaaaaaaaattaataaataaaaattgagaaaagcataagaacttaaaaaagactattccctgaatacagaactgctgtagcttttggcctta

SEQ ID NO: 57229 - DNA, 601 bp, Human
atcacttgagcccaggagtttgaagctacagtaagttaaaattgcactgctgcactccagcctgggtgacagagcaagaccctgtctctaaaaaactaaaaaattcctatgtaggttaactcatttatggaaaggaaaaaataaatgagttatttttctgaggctctcagagtgacagtagactagagatccctgatatagtcatcatttgatttaaatatttgttttctttccacaatgatccagcttaccttactggataatccttagacatttttttccctattacttttttttttttacttttacttacataacagtaaagggttatagtccaggattgaagcataatttataaatctataaactgtggtactattttatgaaatctggaaaacagccttggctctaaataacaggatataagcagatgatgttttcgtaagaatagcagaataccctattagatgtgtgagaaattaaaatctcagattggaagctttgaatccttaagtgccttttgacatattatttctcttgccaaagagagaatgcagccactttatccttattaatttctgtaatcttgtaagtgtagaaa

SEQ ID NO: 57230 - DNA, 601 bp, Human
gctcactgcaacctccaccccccaggttcaagcaattctgtctcagcctcctgagtagctgggattacagtgcccgccactacgcctggctaatttttttgtatttttagtagagacgggtttcaccatttgagccagactggtcttgaactcctgaccttgtgatctgcccgcttcagcctcccaaggtgctgggattacaggcatgagccaccgcatggggctgagattatataaatatatttcaaggaataggaagctgttattcccatgtgttgccttctctaaagaacatcagctrtgattaaatgtcctttcagtggagaaatttttcactgctccaagtcaaagcagtatatacttttaacaaatgattttatcctgagttatttaattatccaagaccatattccttagcgtctttattctggtctgctgggtggtactgagtatacagggactatgcgtcaactgctgaggtgctttatgaggacctttgtaagtcactattttaagctttttggttgaaagccactgagttaagagaaatttcatgactttaataaaacttactttctggacattgaacggagaatcttcc

SEQ ID NO: 57231 - DNA, 601 bp, Human
agattttacaaatatatttcttttttttttgagacggagtctcgctttgtcccccaggctagagtgcagtggtgccatctcggctcactgcaacctccaccccccaggttcaagcaattctgtctcagcctcctgagtagctgggattacagtgcccgccactacgcctggctaatttttttgtatttttagtagagacgggtttcaccatttgagccagactggtcttgaactcctgaccttgtgatctgcccgcttcagcctcccaaggtgctgggattacaggcatgagccaccgcayggggctgagattatataaatatatttcaaggaataggaagctgttattcccatgtgttgccttctctaaagaacatcagctgtgattaaatgtcctttcagtggagaaatttttcactgctccaagtcaaagcagtatatacttttaacaaatgattttatcctgagttatttaattatccaagaccatattccttagcgtctttattctggtctgctgggtggtactgagtatacagggactatgcgtcaactgctgaggtgctttatgaggacctttgtaagtcactattttaagctt

SEQ ID NO: 57232 - DNA, 601 bp, Human; identical to SEQ ID NO: 48373

SEQ ID NO: 57233 - DNA, 601 bp, Human; identical to SEQ ID NO: 48372

SEQ ID NO: 57234 - DNA, 601 bp, Human
accaaataaaataagaatgctgtgaaaaagataaagaggtgaagtcacctagtgtgacttcgatattgcggaatgatttttttaagttaaaaaaaaaatttaagttattagcatttcattaggcaatatgttcaaaaattgtcaaccaatatgcaggtttttgtggtatggattctttttgtacttaactactatctatctttactatgaataacataccatcaacagtattcctttacttaccctttatgttgcaaagagacttgtgcctcctgaagaaatagtattcatagtcatatcscttcaggattctcttacatgattgcccatgttttttaaccatcaaattaagccttgcttcccctaaaagcatcacctttactgtttggagaagcttggtaagtaaatgtggttttcactggtcaaatgtcttgcaactgttccatacatttctgtaacatagtttatttttatgcccaatttgaaactttttagctctcaaatttgagagctttacatacacatattcaacaacagtttccccacccccaccctcgaaaagccctgtttaaaaacgaaacaaacagtcagctgtttcttg

SEQ ID NO: 57235 - DNA, 601 bp, Human
ttttgagcagtgacaacagtgaaggttaacagaaaaacatgaaaatcatcagccatgattagtttgagagcttccttttttaaatatgcttctacccaggctatgatttcaggcttgtggatcataaaaggagtagtgctgaaagtaggttgggtggatcaaagggaataattgtaaatatctttaatgcttggaggttaagagaaacttgaactttgtagtaatggagattaaagctattctcaagattaggtatacctattcaataaaagaaaggaatatttgggagtattggggatargagaagctagacattgtgaattcaaggaaaaagaattatgagaggaggatgcattttagtttattttgtgattaaaatttttttagtttttgttgttttgacatgtgacactgtaattttggctataataaatgacagaatgtatcatttggtatattggttagggtttaggtagaaaattttttcctttatatagtgagtggtagcgtatacaatgtttgctcacttcggcaaagagtagctttagttttctgattagttataatagtgatgcttcccatcatttgatatgccttaaag

SEQ ID NO: 57236 - DNA, 601 bp, Human
tagagaaaggaggcggcaggcacaaagggagatcccctaagtctatataaattcttcccaaatctctggtttgtccctgaactactgaaacacagggtggactccaggtagcctaataggggaaaaatctgaacagatttcagttgcttaccatctggggagacagagcttatagttttgagttcagattctgactgcctgctaaaacaaaaaatctatattctctttttttgggggatggagtctcactctgtcgccaggctggagtgcagtggcacgatcttggctcactgcaacctcygactccctggttcaagcaattctcctgtctcagcctccagagtagctgggattacaggcacacaccaccatgcccagctaatttttgtatttttggtagagacagggtttcaccatgttggccagaatggtcttgatctcctgaccttgtgatccacccgccttggcctcccaaagtgctgggattacaggcgtgagccaccacgccccaccccatccaggtcactttgtgctaagtgttctacacttggtcagcattctcataaatacggtgcatggaatggaacacggtgggcacgtt

SEQ ID NO: 57237 - DNA, 601 bp, Human
aattacccaggcatggtgttgtgcacctctagtcagttccagctactagagaagctgaggttggaggattgcttgaggccaggagaacaagtctgcagtaagccgaggtcatgccactacactccagcctgggtgactaagaccctgtctcaaaaaaaaggaaaactctaggccagatggttaaattgatgagttgtatcagacatttaaggcagaaataagatgagtcataataaaatttcagaaagttaaggaggtaggccaggcacggtggctcacacttataattccagcaatttcrgatgctgagacaggaggatcgcttgaggtcaggatttcaagaccagcctggcaatatagggagaccccatctctataaaaattttaaaaaattagctgggtgtggtggtgtgtacctgtaaagtagttccagctacttgggaggctgaggtgggaggacggcttgagcccaggagtttgaggctgtagtgagctgtgatcacactgctgtattacagcctgagcaacagagcaagactgtctcccaccaaaaaaaaaaaagttaaggaggcgggaacactttcgaaatacagtcatgtgg

SEQ ID NO: 57238 - DNA, 601 bp, Human
atttatgtgtgcttttatatgatcagttaattaacaaaagtacaaaggcagctgatcaaagaaaaaattatctttttaacaaatggtgctgggacaactggatgtccatatgcaaaaaagaacctcaattcaaacacctcaccttatacaaaagttagcttaaaatgaatcatagatgtaaacttctaagtacctctagaagaaaacaggaatctttctgaccttggattaggcaaagatttcttagatagcacactaaaagcgttatccatgaaaggaaaaattgattaattggaccttrtcaaaattaagaacttatgttctttaaagacactataaagagaataaaaagacaaaccagcatattttaaaaactcttgaacaacctaaaaaatcctgtatctaggctgggagcggtggctcacgcctgttatcccagcactttgggaggccaaggtgggcagatcatgaggtcaggagattgagactatcctggccaacatggtgaaaccccgtctctactaaaatataaaaaattagcgggcatagtggtgcgtgcctgtagtcccagctactcaagaggctgaggcaggagaatcac

SEQ ID NO: 57239 - DNA, 601 bp, Human
aatctaccatgcaggattgttgtgagggttcaagaagatgtttaagcacctaacatagttacttgtatatggtagtcatacagtagattagatagttttaatttgttcagtgtgtgtgtgtgtgtgtgtgtgtgtgtgtgtcttctgtgacgatagcctctttccttaaactaaatgaacatcttagtgaattttcctattctggagaaggaaaaggaagaaataggggaaagataggcatttgactacctttcatttggataattgaaaattattagttctctccagtaaggtaatggartatatataattacctgataataaaaatttatttctgaaaacaattcagaatctctcatcttgtacagattgagtatcccttatccccaaatccaaaatgctccaaaatctgaaacttttgagcaccaacatgacactcaaaggaaatgttcattggagcatttcagattttggattttcagattcgggatgctctaactagtaaatacattgcaaatattccaaaatctgaaatccaaaacacttttggtcccaagcatttctgatgagggatactcagccttgtaatacttatgcagta

SEQ ID NO: 57240 - DNA, 601 bp, Human
atctaccatgcaggattgttgtgagggttcaagaagatgtttaagcacctaacatagttacttgtatatggtagtcatacagtagattagatagttttaatttgttcagtgtgtgtgtgtgtgtgtgtgtgtgtgtgtgtcttctgtgacgatagcctctttccttaaactaaatgaacatcttagtgaattttcctattctggagaaggaaaaggaagaaataggggaaagataggcatttgactacctttcatttggataattgaaaattattagttctctccagtaaggtaatggaawatatataattacctgataataaaaatttatttctgaaaacaattcagaatctctcatcttgtacagattgagtatcccttatccccaaatccaaaatgctccaaaatctgaaacttttgagcaccaacatgacactcaaaggaaatgttcattggagcatttcagattttggattttcagattcgggatgctctaactagtaaatacattgcaaatattccaaaatctgaaatccaaaacacttttggtcccaagcatttctgatgagggatactcagccttgtaatacttatgcagtat

SEQ ID NO: 57241 - DNA, 601 bp, Human
tgagtcaaattagtccactatctgtgtgtttaataaataatttgaaatcttaatttcatactgctactaccttaaagtattgcttatgatctaatattctcaaattagtactagaagtgttttgaagccgttttaggttaaattaactgtgggtgacttcaactgctttaacttgtttacagttggaatgcctcataaaatacggggtttttttgtttgtttaaatagaaatgaggtctttctattttgtccaggttggtctcagaccctgagcttcaagtgatccttgagcctcagcccyccaaagtgctgggattacagaagtgagccaatgcacttggccaaaatacagttcttgattttcaaccctgttctgggatgagggtaacggagacaaccagctgttatatgttaagaatgaacaggggtttataaaatgtctgtgaatccaggaaagcaaggcagaggcctgttactagttttggtttttttccccctccactagcgtgttaggattatttctttttgcattcttatttttgctattacttcctgcttgtcatccacagtaagcagcagcaaagcaaagatagccatttaa

SEQ ID NO: 57242 - DNA, 601 bp, Human
gttaatacagcagattaataaaatctcaagcatcctaatagttgtgggttctgtaggtacattcataaatgaatttttgtctttctcttttagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggaggtgagatcaatagattcatttttaataatgactcaggaggttcctaaaaggagttcttgtaggyaaataagagctgtcggccttggaatgtcatattgtaggatggtcattcaggcctttgatcactaatggtgttagggtcaccccccgtccccagccagggggaagggaataaacaatataaatgagaagtttttttatggtttgaatttgcatgtggcatgtctaaaatttgatctcagaattggagaaaaaaaaagttgtctcctgtcttttccttgtccaacaagaaagaagtgtgtgtacgtgcgtgcgtgcgtgtgtgtgtgtgtgtgtgttatggttccttctatggaaaggacta

SEQ ID NO: 57243 - DNA, 601 bp, Human; identical to SEQ ID NO: 31880

SEQ ID NO: 57244 - DNA, 601 bp, Human
tttattatttttattttttgagatggaatctcgctctgttgcccaggctggagtgcagtggcgcgatctcagctcacggcaagctccgcctcccaggttcacaccattctcctgcctcagccttccgagtagctgggattacaggcacgggccaccacgtctggctaattttttgtatttttaatagagacagggtttcactgtgttagccaggatggtctcgatctcctgacctcgtgatcctcctgcctcggcctcccaaagtgctgggattacaggcgtgagccactgcgcctggggkttttttttttttttttttttttttttaatttttagtagagatggggtcttgctatgtttcccaagctggtctcaaacgcctgagcgcaagtgatcctcctgcctgggcctcccaaaatgtaggtattacaagagtgagccgctgtacctggcccccatccatttactttcaaccaatttgtgtctgtctctgggagactctacttcactgggtcttgccattttatctggattgacaatctctgccttttaattggtgtactagtccattatatctaattattgatatcattgggtttaa

SEQ ID NO: 57245 - DNA, 601 bp, Human
aatctcgttctgtcgcccaggctggagtgcagtggcgcgatctcggctcactgcaagcttcgcctcctgggttcacggcattctcctgcctcagcctcccgagtagctgggactacaggcatctgccaccacgcccggccaatcttttttgtattttattagtagagatagggtttcaccatgttagccaggatcgtctcgatctcctgacctcgtgatccgcttgcctcggcctcccaaagtgctgggattacaggcgtgagccactgcgcccagccttttttttttttttttttttttkgaaacaaggaggaaaaggaaagtttatagttatagaaatattctttgtagttaagatgtgaaagtgggctttattgttaaataagctattttttaaaaaaattactatttgctaaagaaacataaatctgaaatcttgcagcctgattttagctgttctgctgatttaggaaaaggtcctttggggaagcaaatcattttggttggttgggtacaggttttgcaaagttagcatcaggggaacaaaaatgtctgggtgataccaaatatacaaatgttgtacgtggttccaaatatggaa

SEQ ID NO: 57246 - DNA, 601 bp, Human
aaagacactgtggccaggcacagtggctcacacctgtaatcccagcaatttaggaggtggaggtgggaggatcacctgaggttaggagttcgagaccagcctggcccactaatgtcatctctactaaatgacatctctactaaatgtcatctctactaaaaatacaaaaattagccaggcatggtggtggatgcctgtaattccagctacccgggaggctgaggcaggagaatcgcttgaacttgggaggcggaggctgcagtgagcagagatcacacctctgcactccattctgggcaayagagcaagactctgtctcaaaaaaaaaaaaaaaaaaaaaagacattgtgtggtaaaatgattatgatattctttttttttccttcccttacattatggtattttgtcagtaatttttctatatgctaaaccaaaaactaaattgtgactaccacttggccggaaatttttactgagctcagtggtaaatttatataaacaaaataaagaaaacataatttcttgtagctcagtttgcagtttggtttatcagttgttgtatagagatagcttattatcatgtatggactttaaagccaaa

SEQ ID NO: 57247 - DNA, 601 bp, Human
tcgccacattggccaggatggtttcgaactcctgacctcaggtgatccacctgcttcgacctcccaaagtgctgggtttataggcgtgagccaccgcgcctggcccagtttagttttttgaattatggctaacttcattcctgcttgaggttgagtgtataatattattgtattactcatttattaagagctccggaatgtgtctgctcataaataggtggttgtcttcaatagtatttgtaattttgaagagttacatgtttaataactttctccctggttgacttttaaaggtcttggytgacttcttaaaagttttgttttggttttaaatgatatgttctacagaaacacaaggacaaattacaaaggttttaggagttatatctctgaacaggatttttctaacctttctttcaggtaatatcaaaatctttcaaatggaggtggagaagagggagatgagaataacctgggagggttttaaaaattactactacttatacagaaatgtttactgtgtcctaggcataatgctgaatgctctttattcgttatctcatttaatctttataataactctaattggtaggtattgtaa

SEQ ID NO: 57248 - DNA, 601 bp, Human
atttgatttgatacttgagtgatgagaggaggcagccatgggaagattgggaagaacagaatgtatggctgagaagacaaatgcagttgccctaaggcttgaataaccttggcatgttggaaggaaagaaagaagagaggggtagaatgataggaatgaagctggagagttaggtaggggtcaggtcatgtagtatcttcagtggtgtggtaagtcatttgtattttatgctatttaatatgagacaccattgggtcatgaacaagggtgagaaatgagctaattttcattttaaagataygattttggctgttctgtagagactacatttggaggaagaaggtgggtaagtgttggggataagtagtcgaagtaaggagaacagttgggaaatcttagcagtacttcaagtaataagtgatagtggcatataacagtgcaaatggccaaaagcagatgtattttagattgtattttagatgtagagtcatcagtcttggtattaattagatgtgggtaattaggaagtggaaaaatcaaggaagcctcctaggtttttggcattagcaactatgtggattgtgtgacatttagtgaaata

SEQ ID NO: 57249 - DNA, 601 bp, Human
tctttatgtagaccatgctttttagaagcaaagttatgtaccttcaaagtagcatattctcttactttgttataataatacataccattatgttggtacaaatttggaagaatgtattattaccagcaaagctgtgctctagcccaggctggagtgcagtggtgtgatcttggctcactgcaagctctgcctcccaggttcacgccattctcctgcctcaggctcccgagtagctgggactacaggcacctgccaccacgcccagctaattttttgtattttcagtagagacagggtttcmccgtgttagccaggacggtctcgatctcctgacctcgtgatctgccttccttggcctcgacctcccaaagtgctgggattacaggcgtgagccaccgcgcccggcctttagttttacttttaaataaagagcaaaatatttacgtattttttgagatagggtcttactctgtcacccagggtgtaatgcagtggtgcgatcacagctaactgtatctccaacttcctgggctcaagcgatccttgcacttcagcctcccaagtagctgggactacaggccactatgcccagctaatttac

SEQ ID NO: 57250 - DNA, 601 bp, Human
ctcgatctcctgacctcgtgatctgccttccttggcctcgacctcccaaagtgctgggattacaggcgtgagccaccgcgcccggcctttagttttacttttaaataaagagcaaaatatttacgtattttttgagatagggtcttactctgtcacccagggtgtaatgcagtggtgcgatcacagctaactgtatctccaacttcctgggctcaagcgatccttgcacttcagcctcccaagtagctgggactacaggccactatgcccagctaatttacttttattttttattttattwatttaatttgagatggagtcttgctctgtcgcccaagctggagtgcagtgacacaatctcggctcactgcaacctccgcctccgcctcctgggttcaagccgttctcctgcctcagcctccctagtagctgggattacagatacgtgccaccatgcctggctaatttttttttttttttttttttttttttttagtagaggcgaggttttgccatgttggccaggctggtctcaaactcctgacctcaggtgatccacccgcctctgcctcccaaagtcctgggattacaggcatgagcc

SEQ ID NO: 57251 - DNA, 601 bp, Human
aaaacttgtagaatattcttttaaaattccagtttaattcccacttgaaagctgatatcatcaactcatggtgacggttaggaaggagagaaaaataagaaaagaaaatgtctaatattttgttcatcttctttgggccagtttagttgaaaaccctaaccatcacatataaatagtttatttgggaaaaatgtattttgagttccaagtagctaatttgtaagcaaactattggaacaaagtctatttgtaaattgactgccttttctaaaatgcaccaggtgttatttttttcatgtggtttccatgaatccttaaacgcatttcattattggatgttgataatattttaattaactggtgatcatttaggtcatttctacctctaaaatttctatgattcggttagagcagagatttttggcaaatgatttagttgaattaaggtttctaaagttttaatgttcaaagatatggcacttcaatcaatattttcttgtatagacaagttaggtttattttgggaggaaattttttaaaaaataatatcctgcttctttcttacagaatttagtacacatgggcttaaggaagaatttat

SEQ ID NO: 57252 - DNA, 601 bp, Human
gtagtcttaaagtactttgaagcagttgactgttgaagtggcattctattaatcagtattattctggaatcagaggttggagtaatctttgtgccttttctttctgatgtgtttagtcaaaaggaagattttatcaagaaaaaatgatttcagttttcttaaataaaatttcagagatgttaaaaactttggaagttgttatatgttgatttaaaaaataatgctgctttttaaacttgcagtaattattactaagtgcgggtttggaaatgacacaaaggttatatactgtgaacattaraatgagactatgaggatcaaacagcaatcatttttattctttcaaacttaataggtaactgtactcaatatttactattaaaaataagattataataaaatggatcattctttagaagatttatatatgataaacttaacaattcagattcctgaggaataataaatattctaattcctttaatttctttactagaaaatccagaaaatctttttgtttcaactgttacctgaaacttttctcatatgtctaagttcatttgttatgccatagcaaaagcatgtggaaaacataatttag

SEQ ID NO: 57253 - DNA, 601 bp, Human
atttaatttgaaagtgattctgctattatgtgtattcatgaaggactgtcttcagttgcagtatcgggaaactctcttaagcaacctccacttaattgtctcattgaagtaactgtcattccccagttcttccataaaaggtactcactgatacccacagcataatgaatgcattgtgaatgccatcaaccttcttatgccagttgtacttgttattgtagttatgtagttatgtaattaaatacatatttaatattatatgtaatttaaatatttaaagtgtgtaaggttggggaaaaaattgtaaaactctagaaggattctgtttctcaggtttttaagtcacttcttaaaaaatggaaattggccaggtgcagtgactcgcgcctgtaatcacagcactttgggaggccaaggcaagaggattgcttgagcccaggagtttgagatcagcctggacaacataatgagatctataccaaaattttaaaaagtagctgggtgtagtggcacacgtttgtagtcccagctacttgggaggctgaggtggatctctgaagtctaggagtccaaggctacagtgaaccatggttgcgccact

SEQ ID NO: 57254 - DNA, 601 bp, Human
agaagtaatctacagagtgggagagaatatttgcaagccagaaatctgataaagggttaatctccaaaatatataaggaagtcaactcagtagcaagaaaatacttgattagaaaatgggcaaaggacctgaatagacatttctcaaaagaagacatacgtatggtatatgaaaatgtgctaaacaccactaatcatcagagaaatgcaaattaaaatcacaatgagatatcatttcacatctgttagaatgggtattatcaaaaagatgagataagtgttgatgaggatatggagaaaarggaatccttgtatgctgttggtgggaatgtgaattagtacagccattttggagaacagtatggaagttcctcaaatactaaaaacagaactaccatatgatccagtaatcccacttctgggtctataacctatagccctattcacagtagctaagatatggaatcaacctaagtgtccatcattggatgaatagataaagaaaatgtggtacatatgcaccatggaatacttcagccttaaaaaagaaggtaattctgtaatatgcaacaacgtggatcaacctggaggacattatgcta

SEQ ID NO: 57255 - DNA, 601 bp, Human
agctgatttctttttagtgctgaataatattacatttttttaaatctgctgaaggatgtcttggttgcttccaagttttggcaatgattaataaagctgctgttaccattcatgtgtgggtttttgtgtgaacatgtgttttcaattcatttggataaatacctaggtgcttgattgccagattatatgatagagtatgtttagttttgttagaaactaggaagctgtcttccaaagtggctataccatttcacattcccaccagcaaggaatgagagtccctgttgctccagatctgcaycagcattttatgttgtcattggagttttgccattctaataggagtgccttagaagtagtggaagtgataataaagatgaatcagacctagaaactgccctcaaggaacattctaataggtcagacaagatgtgcacattgaaaataattatacagggtaggaagtgggtaaatgccagcagagcgatattagacaatgtattgtaagcattcagggatggagagattgtaactgcaaagtgtctcataaggaggagctggtcattaaaatgggtatagaagggtgagtcatatgtggata

SEQ ID NO: 57256 - DNA, 601 bp, Human
ccaattgatctttatgtataccttactgcctctagtcatctttctaaactcatccctcaaattcccttaatatgttcccagtggccttagtatagcaaaattccactagtatggtataacagaatagttgttttatttaatagtaacgtgtctacatgaaataaagtaaattctattttcttcaatatggaattgctacattattaaataataagtgactagtgtgttttatgcttccaataaagaaagtattagagtgtggtatatgattgctcttggctcctaaatttattccacgccrtatataaatttttgttttagactcgagaacaggaagaactggaagaagctttagaagtggaacgacaggaaaatgaacaaagaagattatttatacaaaaagaagaacaactgcagcagattctaaaaaggaagaataagcaggcttttttagatgagctggtatgtattaatgctaattgtgattgtaaaaaacattcttcaggatttacctttcctagtaggctggatgatggcatttaaagggcttttccacagtgtttgtaatctggttcacctttagttttgttggttatgtatt

SEQ ID NO: 57257 - DNA, 601 bp, Human
tgaaaccaggattaaaacaagctaaagtcttgactagcaactttttttttgaagttaatacgttgcttttatgtaagaatttttgctttttaaaggaaataccagttaaagaagagcacttgaattgatttagagtataaattgaaaagcaatacttttaactttttagctaaggaaatttatttttcttttgttagtttctacatgtgaaaagatagaatagcttttaaaagatatttttttgatcacagcccattaaaaatgttctttaattttatattttattataaaattcttaatrtaaatctagaatagctgcaaggaatcttagcaatacagttactcatgcattactaatgctttggtgtagaatataaaaggtattctagtatattctcctcgtactatatttcatcacttttccttcattattgttaaagccaggtcttaatgattttgctccttaataagtttacatcttataaataaataaaatttgtgttcttccatttactattaaaagttttaaactttgtaacattgctcttgcaaaacacttctattataaaatcttgatgtgcaactttattctaggacaatt

SEQ ID NO: 57258 - DNA, 601 bp, Human
aaatgtgtagcagctgctcctattttctagttctcttccttttatagtatatataatattaaaataagatctggcttacagtctaagtagaagatacaagaactcatcttaagtcttttgcaactttttttttttttttcagttgctgactatagaatttgaaaatctagatacttcggtattaagttggctctacttttaaaatttatcttgaatttacccacttctctccacctcttatcatcttaggataattgccatcatttctttagtggactatcacagtaacattccacctggkgtctctattcatctgtgtaccccataatctagtctataagcctttgggtggtttcctaaataaatgaatgatggtaaataaacaatattaaacaaatcagctcatcacctccttgcttactatcttcctatgtcttcccagtacacttagaataaaattcagaatattatctactttctcacctctgagaaagtgacatttgtactaagaagtcaatggtaaaatggagttagccatgcaaaaatacaggcagagaaaagagcagtaaagaaggcctaaggtaagaaacagcattttcta

SEQ ID NO: 57259 - DNA, 601 bp, Human
atattaataaacttacacattctgattcaggtgtcctctgagagctaagatttgaactcttgtttctaatagtgggctgattgtatgacctaggtaatttaaggggcaggagtcagcataataactttcttttcctgatctgctctacttaaaaaaagtcaaaacacaaaatgaagtcggatgtgctcaacttggagaggaaccaaggaaggatgtataaatatgattaaggtttctggaaatagatcctttgagatgtgacagaaaagactgaatttatttgtttaataaacctagagawagttgaagggttcaaaatgggcataaaataatgactaagaaatgaggattttattattatatattcacataggtagggttcagtcagtcagtgaacatattttgattaggaatattatgaaggttgtgccggatttattatttgaagtatattttctaggaattaaactgtcagggggtggagtaatgttaggcatagggtcttagagaaattaatgtaatttgtgacttcagaatttaagaaggttctacttatcactattttatgcatgaataggagaaatttttttctttttttttt

SEQ ID NO: 57260 - DNA, 601 bp, Human
tttaaaaaaatattatctatgggtgagccagaagggagcagagtactcatttgtgatataaattgccttttctgagtgcaacagatagtatttagctgttcgctttcaagcattgcatattcctctgaactcattggaagatctaaccttgataaaatatgtgagttatagaaaattaatacccgttcgtatctgaaaaagaaaataaaaattacattgagcagtcagttatgtcctgtaaagccataagtttgtgccaaacagcttaggtgctttaccattttgccaaagaacaaaaaayaaaacttgaccaggtgttattaatttattctatttttaatatataatttgcacttaggtagtaaatcaagtataacaactaaagaagtcatgtgccctttctcaagtcttgtgatatgcacatagcattaatttgaatctataaaggtattttgaaatgtaaatcaaattaataatagtcttatcagatcttattatggcatataattaactaggtgagtatcaggtgattactttctcttagcttttaaatgtctccagttatgttatttcactaaagttagcagtatattctaatttt

SEQ ID NO: 57261 - DNA, 601 bp, Human
tgccacaaatgtttgggaatcttataaggctccatctgcaaatgctcatgaccagatatttcctgcgatgatttttaatgtaatattttaatttttcagctaagcagacttagttttcctttggaattttatcaatgcaccatcagtattgccttgagttaactgtggtttttgtgttactattatgtaggaaataatattaggtttttctttggttgatcattttgttatataattcctatacaatttttattgctatttattttggtcctcaccacttcttctgcctttttttttttttaaatcacagattgtttatgtatcagaatacaatttgccacaacttcaggggctgtggttaagtttgaaaaccaaggattacattcagttatttttgcatactctctaactttcttaaacatactcaactgaatggatacattcccattctgtcagtgccgtgcctcctgttaacatttttctacactagaagctcttcccatttttgctgagagagtgtctggcatcttctcccagcctccattcctaatggtggctagagctaagaatgtattgctgctttcttttgttcctttttttt

SEQ ID NO: 57262 - DNA, 601 bp, Human
atggtcatatgcaggagaagcagcagaatattttgagacttgtttttgttgttttgtatatcaagaattagttgctttatattgctatgtaatattccatttgtttgaatataaatgctcctcaatttatttgatggggcatgtctagataaacccatcataagttgaaaataccataagtcaaaaattcatttaatatacctaacctgctgaacatcataatttagtataggcttccttaatacaagtactcagaacacttacattagcccagcatcatgagagagcatcctattgcatrttgctagcccaggaaaagatcaaaattcgaattacagtttctactgaatgcctgttgattttgcgtcatcatgaagtcaaaaacttgtaagtcaaaccgtcataagtcagggaatgtgtgtatatctgtttagcaattctcttgttggggaatacctgagctgtttatagtttttgactattactagtaaagcagctggctgggcacagtggctcatgcctgtaatcctagcactttcagtcatatttaatgttgtcaatctttttaattttagttattttggtgatgattgatagtatc

SEQ ID NO: 57263 - DNA, 601 bp, Human
gggtttcaccgtgttggccaggctggtctcaatctcctgacctcgtgatccgcctgtctcggcctcccaaagtgctgggattacaggcatgagccactgcgtccggcctcgtttgccttttttatatctctttttgtgatgactctattaaaatcttatgtccattaaaaaaattgagttgtttgtgcttttactattgatttgtaaaatgttttacaatgtgttgaacataagtcctttgtcagacatctgttttatgaataatttctcttgtctgtggctcactttttctttttcttaktaatgttttttgatgaactgaagttataaattttgatgaagtcagatttatgaatgtttttcttttaaggtaatttttgtgtcctatctaaggaaccttttccttcccccaagtcacaaagatagttctcctgtttagaaactttgtagtttttgcatttatagttgggttcctgatccatcttgtattaatttttatgtatggtatacagtacctgtttgggtttcttttttgcatatgaacatttagttgtatttgtagagaatacttttcttcattggattgctttcacatatttgg

SEQ ID NO: 57264 - DNA, 601 bp, Human
ttttttgcatatgaacatttagttgtatttgtagagaatacttttcttcattggattgctttcacatatttggtgcctttgttgaaaatcaattgactgcatataagtttaggtctatttctgttttccttattctgtttcaataacttattatcttgattactatagtaattcttgaattaaggtagtataagtgttccaattctttttctttttcaagatttctttttgcatatccttaacattttagattcagtttgtcagtttttacaaaaattcttggtaaaagtataattgataytctgattggatctatagatcaatgtggggagaattaagatctaaaatactgagtcttccactacatgtacatggtatgcttcatttatttagggcctctttatctcagcaatgttttgtagttttcagtggtttgtgttagacttattgtcatttttttccctaagtattttatgtgtgggatgctcttttcaaggaaatagttatttcaaatctcattttctattgcttaatcctggtatgtatatttttacattgggcttgcgtgcgatgagcttttctattttacttattgagtagt

SEQ ID NO: 57265 - DNA, 601 bp, Human
taagcacaggtggacagtggaaatcagagtgagagtatatggctgtagattctataattctttttccattgtaccaccagtaaggaatttgatacagaaaataatgttagatactgaacaaataattttttcttcggtaggaggtcctatattgctgttgtgtatccttagtttctttctttctttttttttttaaatggggtgtcactctgtcacccagtgtggagtgaagtggcatgatctcagctcactgcaacctccccatctcacgttcaagtggttctcccgcctcagcctcctragtggctgggattacaggtgcctggcaccacaccaggctagttgttgtatttttagtagagatgggatttcaccattttgaccatgctggtatcaaactcctgacctcaggtgatgcacctgcctcagcctcccaaagtactggaattataggtgtgggccacctcacctggccttatttagtttctttaatgaagattattgatatgatatggctgtgtaaaatagtctttttatttctgtattattgattttcattttagaaattagatccataaatgtaattacttctgatgcatgg

SEQ ID NO: 57266 - DNA, 601 bp, Human
ttcttttcattctttttttctaatcttgtcttcatgcctcatttcagtaagttgatcctcaatctctgataccgtttcttccactttacagattcagctattgatacttgtgtatgcttcacgaagttctcgtgctgtgtttttcagctccatcatgtcatttatattcctctctaaactgggtattctagttagcagttcttgtaactttttgtcaaggtttttaactttcttgcattgagttagaacgtgctcctttagctcagaggagtttgttatttcccagcttctgaagcctacytctgtcagttcatcaatctcattctccatccagttttgtgcccttgcttgagaggagttgtaatcatttggagaagaagaggcattctggtttttggaattttcagcatttttacgcaggtttttcctcatcgtcgtggatttatctacctttgatctttgaagctgatgacctttggatggggtttttgtgtgtgggtcctttatgttgatgttgatgttgttgctttctatttgttagtgcttctaacagtcagtcccttcttcggcaggtctgctgcagtttgctggaggtccactc

SEQ ID NO: 57267 - DNA, 601 bp, Human
aggactttgagcagttcaagacttaagcggaagaggtaactgcagatgtggtagaaacaataagagaactagaattagcagtagagcctgatggtgtaactgaattgctgcaatctcatgataaaacttgaatggatgaggagttgcttcctagggatgagcaaagaaagtggtttcttgagatagaatctactcatggtaaagatgctttgattatttttaaaattacaacaaagggtttagaatattatataaacttagttgataaagcagtggcagtttttttttattattatacttwaagttctgcggtacatttgtacaatgtgcaggtttgttacataggtatacatgtgccatgttggtttgctgtccccatcaacttgtcatttacattagttatttctcctaatgctatccctcccccagccccccatcccctgacaggccccggtgtgtgatgttcccctccctgtgtccatgtgttcgcattgttcaactctcacttatgagtgagaacatgcggtgtttggttttctgtccttgtgatagtttgctgagaatgatggtttccagcttcatctacatccctgcaaaggat

SEQ ID NO: 57268 - DNA, 601 bp, Human
aacggaatccttgtgcatgtcacagtatagctgtgttgaactaagtcagtcatataatttaggacccttctaggtaacactttgatctttctcaaatgtttcacatgtggaactaactgagggaaaatgactagcttagttcctttcctatttttatttttgcatttttcagggagggaaaaatttgtacgaatgaaattatagtcaaaacagtttaaagcagagggagacaatgctgttccttttatgttttgtgttctcctgtagttttgagactcatgcctttctcaaaagtaattgyatgtgaccacaaatatatcactgtagttagtgtctatatgagccttattagttctaagccaatacaaggaatttataggaatgcttattaaatatccagagtttagttgtaattatatattatttgaggatctttaatgatactaaccttttactagtgatcttttaatggaagatactatttcctaatttttttccaaccttttcaaaattggttacttttcatttttgaagttcttaaggaaaaatttatattgatataataagaattctaaaattagagttgaaatattattaaagg

SEQ ID NO: 57269 - DNA, 601 bp, Human
gcacagaataaataatgttaactattcttattcagtgacctttttggctattgtaaatgatgtccccacaaacttcagagaagactttgaattataagacatcataactttagtaatttgggtattgttgctaatgtttaggtaatgattagttttagtatgttgttttccagtgcaattacttaagaaagcttgtcttccttaagtattatcttccttggaaggtaatccagctcttgaaaatacccattctgtgtgagcctttctggaccttgctgtctaatttctgaaatgcacacgsagtgttggtgagactgtaaatgtacttctttaattgtcacagtatttttcctttccctcacttaccctcctctcttttactcctctcccctcccttttacccccatagctaaaacatgtgacaccaatgctggacattttttatcaaatggcaggagaatttagtgtctgacaatttatgaagaagacactttgaaatagggatgtcagaacaagtctcaaaatatcccactcaggcactgtcttcttaacctatgcaatgctctctgaatcattggtctgaaattggattattctatga

SEQ ID NO: 57270 - DNA, 601 bp, Human
ttgtgtatattcttgagctattcttttgtcattatgatgattacatttattatcctaagttgtagcactctgaatttatacaagcttaacttcagtaacatgcaaaaactctgcttttaaacagttctgtcctcaccccttttagttgacagcaccacagaattacatctttatatattgtgtgtccaagattattaataaattatttttttaaatgtgttagtttcttaaattatgtagaaaacaaaatgtgagttataaaacttagtaataatactggcttttagactaatttttttaraaaagatattagtctcttaaatcttacaatgttataccttttgattatcttttttacttacacctcttgtatgctctattttgtgctttttaattttttaaaaaagtttgttttaaaagttaggataatttctcttgtcccatcttcaagttcacttattcttctattttgcccattctgctgataaggccatcaaaggaattctttttaatattgcaatttttatatctagtattttcattcactttttaaaaatgattttcacttcttaaattccctacctgttcatacatattatcc

SEQ ID NO: 57271 - DNA, 601 bp, Human
cattatgatgattacatttattatcctaagttgtagcactctgaatttatacaagcttaacttcagtaacatgcaaaaactctgcttttaaacagttctgtcctcaccccttttagttgacagcaccacagaattacatctttatatattgtgtgtccaagattattaataaattatttttttaaatgtgttagtttcttaaattatgtagaaaacaaaatgtgagttataaaacttagtaataatactggcttttagactaatttttttaaaaaagatattagtctcttaaatcttacartgttataccttttgattatcttttttacttacacctcttgtatgctctattttgtgctttttaattttttaaaaaagtttgttttaaaagttaggataatttctcttgtcccatcttcaagttcacttattcttctattttgcccattctgctgataaggccatcaaaggaattctttttaatattgcaatttttatatctagtattttcattcactttttaaaaatgattttcacttcttaaattccctacctgttcatacatattatccaccttttccattagatcctttaagttatt

SEQ ID NO: 57272 - DNA, 601 bp, Human
gggctgtttcctgcctctcccctagacttatgctttgcatcagtgtaggaccctaggtgtgagttggtttcctgcctttcctcagtggttggtttctctttcctgtttcaatgtaggactaggaatgcgggcagtaggttttctacccctcctccattggcacccaatctttgctcctccgtagcagtggaggcttggatgttttttttttttaaaataatttatttcctcttgcatttagtgcttcattattgctgattttattgggtctgtttcatggaatatcctcctcatctttctkttttagtcttctatggtggtggtacttcttagaacatgaagatttaaataagggttagaattccctgtaaagtaggtttagcctgattgtctattttttcccagtaagttattaaattaaataaacttgggcaacactttgtttggagccctttttgtgtttctttctgcctttacctctatgggttggagttttaaatgtaggatgtgtcctttagataaggtataaccttagtgttcttacttttcccaagtttttcatacttaacatctgatttgaagggagggaggagcacttttt

SEQ ID NO: 57273 - DNA, 601 bp, Human
ttgtctatttttgttttacttacctatgcttttgaggtcttagccataaaatctttgcctaaaccaatgtcctcaagtgtttcccctttgtttttttctagtagttttatatcatctggtcatacatttaagtctttaattcaccttgagttgatttttgtatatggtgagagataggagtccagttacattattctgcatatgaatatccaattttcccagcaccacttattaaagaaggaattctttccccagtgtacgtacttggtatcattgttgattattaattggccgtaaacaygtggctttatttccgggttctctattatgttccactgatcttgtagaatgaaatttttatcttaatttcatgtagagcttgtctttatactgctttgtggtagctacaatgctctatcacaaagcaatacaaagatatagatgcacgtacttatttctgtcttatgttgacataactggcataagttctgtactatcaatcagcaaactttaaaaatgatttttaactgtgaaggtttaatgtcctgagtcacaagacatgataatatctattattatatcatcagtagtgaaaataatt

SEQ ID NO: 57274 - DNA, 601 bp, Human
tgcaatatgcatgtgtatataacatataatttatactatacttggtggtaattatgaaaatattactaaattaatttttttttctggttatgacagcaaaatgtctttagtatttgtttttttgtttgtttgtttttgggggcatttaaattagaaatgaactcacatatctaacatgaatctttgtgcttaaaattctaacctggctctagtcttgcaagttttaaatcttttttatgcagttatggaaaaaatatgtttctgcttgaagcagttgtcaaacaagcttctttcatcaacrgtcagacacagggcagctgaatgaggctgtttagtctagagtgaatgctcatgagattacaaggtcactgaggaaatataattgtgtagttggttccagaatagttttttgtagtgaggacttaaattataacatcaatttaaaaatatataaaatgagatatattctaaaattaatctcagaaagaaagcactaagttaaaaaaagtaaattattacaataaaatgttttaatttatatttttacaggacccttaaaaaagcagattcagtttattattggactttgtttacttctccc

SEQ ID NO: 57275 - DNA, 601 bp, Human
cagttgtcaaacaagcttctttcatcaacagtcagacacagggcagctgaatgaggctgtttagtctagagtgaatgctcatgagattacaaggtcactgaggaaatataattgtgtagttggttccagaatagttttttgtagtgaggacttaaattataacatcaatttaaaaatatataaaatgagatatattctaaaattaatctcagaaagaaagcactaagttaaaaaaagtaaattattacaataaaatgttttaatttatatttttacaggacccttaaaaaagcagattcartttattattggactttgtttacttctcccgtatcatggtagaattcagtagatcccgtggatcttatttaaaattgtctccattgggaaatgaaacctcattgtatagctcaggttaactgagaaaacaatagattgttcagcagttcctttttttttttttttttttttttttttttgacggagtctcgctctgttgcccaggctggagtgcagtggcatgatcttggctcactgttcagcagttcttttacttttgttattcatttggttgtcagttagcaaatagctatgaagtgcc

SEQ ID NO: 57276 - DNA, 601 bp, Human
aatcttttgtaagatggtattttagcaaatacctgaattagcaaagaaatgagtcatttgatatccttgggagagtcagcaggaactgtaaatgcaccagtgggaatatgaataaggaagaggaaggagtgcagaatgtctggagcaggagtaaatatagggaatggtaggagaataggttcagagaggtagcaggtttttatgtaagggggcaggctagacctagttgatgatacaggtctttatagaccatggtcaagacttgggtttttactttgaaggagatgcgaagtcataggakaattttgaacagaagttgccataatattactttcatctagaaaggtctgtcatcagagagtagatggtgggcaatggtggcaaggggcagcgtgaatgcaagaaaatttgcagtagtcctgctaagatggtagtggcttgtcccagcatggtagcagtatagttcataagaaagtggtcagattatggatataattttgatagcaggggcaaaataatttttgatggattcgttaaggggggtatgaaaaagagaagattacttccaaagtttttatctgagcaaatggttgctcctagg

SEQ ID NO: 57277 - DNA, 601 bp, Human
tcccagcatggtagcagtatagttcataagaaagtggtcagattatggatataattttgatagcaggggcaaaataatttttgatggattcgttaaggggggtatgaaaaagagaagattacttccaaagtttttatctgagcaaatggttgctcctagggttttatctgaacaacaaagctgcaagcaataaggggttgtgttgtttatagagattttttaaaataataaaactgaataaaagtctttttaaaatgaacatgtactgacagttctaaacaatgttggttttcaaatactygtttctgaaaaaatcttttgttggtccaagttctcaaaaatcactgtaattacttttaaatctaatagtatatatgtaagctattaacatctttatttctcgttctttaataacattttatgtatgcagaaattagttcagagaactttgagttttacagtcatccccaagctccacctttccaccccccaaccccaatagccacaaacttagctatatttagcctcactcaagagtaaatttatatggttttggaatttttcaagctcctttctaacaaaatttctatttttaactccc

SEQ ID NO: 57278 - DNA, 601 bp, Human
agaaacagctggacacggtggttcacacctgtaatcccaacaccctcgaggcaggtggatcatgaggtccagagttcgagaccagcctggccaacatagtgaaacctcgtttctactaaaaatacaaaaattagccgggtgtggtggcacgcgcctgtagtcccagctactcaggaggctgaggcaggagaatcgcttgaacctgggaagcagaggttgcagtgagctgagaccatgccattgcactccagcctgtgtgacagagcaagactctgtctcaccaaaaaaaaaaaaaaaaaaagatgaagaaacagaacttaggttctgagaagttttatttgtgtttaaagttttcaattgtggggacatttgaaagttcctagaatcaggcctaagcgggcagatcacctgaggtcgggagttcaagaccagcctgaccagcatggaaaaaccctgtctctattaaaaaaatacaaaattagcagggcatggtggtgtatgcctgtaatcccagctactcacggggctgaggcaggagaattgcttgaacccaggaggcagaggttgcggtgagccaagattgtgccattgcactccagcc

SEQ ID NO: 57279 - DNA, 601 bp, Human
gattttttggaattggtacttttaaaatgttttaaaaatatcctgccaaagaatggttagctgtctttagatttaagtgaaattcagtcaactttcatatctcatgccttgaattttacctcaaacttaactaaaaagaaagtaaaggagtcagaagcaatagtattcttactgtcctgtttactgcattcatcggttcccagctctgcataccagagcgggagaggagttgcaagacacatttggacagctctcatctccctacaactgagtcaacagcaggagggtatttcttggagcrctgtggtaacttttccatgaagcaggtcttcttccttaggaaggcttagttgttgcctttatcccctcatttgttacagttaacatctatagcctgatgttggctctatcacttccatctgttttatgagcttgctactgttgttgctttgaaaggtggttttgtttatttgttacaaataatttatccattatcatcttaaccctcaactttaacatttaaaaatgacatattgaagagctgtattatcagtgttttttagactgtaggttatatacatttttaaaaatagaataaaat

SEQ ID NO: 57280 - DNA, 601 bp, Human
tagcccatttacatttaaggttaatattgttatgtgtgaatttgatcctgtcagtatgatgttagctggttattttgctcattagttgatgcagtttcttcctagcctcgatggtctttacaatttggcatgtttttgcagtggctctggagacccctttttatctgcctaggcatttggctgtctcaaagctttattttttgttgttgttgttttgagacggattttcgctctgttgcccaggctagagtgcagtggcacgatcttggctcactgcaagctctgcctcccaggttcatgscattcttctgcctcagcctccggagtagctgggactacaggtgcctgtcaccacgcccagctaattttttgtatttttagtagagagggggtttcactgtgttagcctggatggtctcaatcttctgacctcatgatctgcccgccttggtcccccaaagtgctggaattacagccgtgagccactgcacctggccgtctgtctcaaagctttcttacttatttatctgaattcaatggcttaataaacttatgatgagatatctaaaaggatgggtttaaaattcagttcttccttatt

SEQ ID NO: 57281 - DNA, 601 bp, Human
taatattgttatgtgtgaatttgatcctgtcagtatgatgttagctggttattttgctcattagttgatgcagtttcttcctagcctcgatggtctttacaatttggcatgtttttgcagtggctctggagacccctttttatctgcctaggcatttggctgtctcaaagctttattttttgttgttgttgttttgagacggattttcgctctgttgcccaggctagagtgcagtggcacgatcttggctcactgcaagctctgcctcccaggttcatggcattcttctgcctcagcctcyggagtagctgggactacaggtgcctgtcaccacgcccagctaattttttgtatttttagtagagagggggtttcactgtgttagcctggatggtctcaatcttctgacctcatgatctgcccgccttggtcccccaaagtgctggaattacagccgtgagccactgcacctggccgtctgtctcaaagctttcttacttatttatctgaattcaatggcttaataaacttatgatgagatatctaaaaggatgggtttaaaattcagttcttccttattccttctcacaaatctcttcaa

SEQ ID NO: 57282 - DNA, 601 bp, Human
aatattgttatgtgtgaatttgatcctgtcagtatgatgttagctggttattttgctcattagttgatgcagtttcttcctagcctcgatggtctttacaatttggcatgtttttgcagtggctctggagacccctttttatctgcctaggcatttggctgtctcaaagctttattttttgttgttgttgttttgagacggattttcgctctgttgcccaggctagagtgcagtggcacgatcttggctcactgcaagctctgcctcccaggttcatggcattcttctgcctcagcctccsgagtagctgggactacaggtgcctgtcaccacgcccagctaattttttgtatttttagtagagagggggtttcactgtgttagcctggatggtctcaatcttctgacctcatgatctgcccgccttggtcccccaaagtgctggaattacagccgtgagccactgcacctggccgtctgtctcaaagctttcttacttatttatctgaattcaatggcttaataaacttatgatgagatatctaaaaggatgggtttaaaattcagttcttccttattccttctcacaaatctcttcaac

SEQ ID NO: 57283 - DNA, 601 bp, Human
ttttggccagttcttcttcctctgctaaagttattgtgtgaagtcattccttgaccttttgttctcattcactatcactaattgagtacctgtgtgtatggtaggctcttttttaggcacttcttgtatatcgttcctgataatttataacaaccctgaacaggccacatacctttcctgagaccagtactatgggggtaggatttaacatcaaatgtttgattctaaagctatatggtaatagtctatttgtctacttcaactgctataaccaaataccacacactcagtggcttaaacratagaagtctatttctcataattctggaggctgggaagtcctggctgatttgattgctggcgagggctctcttcctggccttctatctgtgtcctcatgtggcagagagacagcaagtttgttctctggtatctgttcttgtaagggcattaatatagtcatgaaggctccaccctcgtgaattcatgtaaacctgaatgcctcacaaagaccccatttccaaatactatcacattgagagtaggggcttcaacagaagaattttaagggtagaggtaacacaattcagtacatagcaaa

SEQ ID NO: 57284 - DNA, 601 bp, Human
aactcattagaatgtatttttatttaaaatattataccagcatgtgcatagttacaaggcattgccaaaaaatgtactctggaagcaaaacagaatactgaaaataatgctacaatttttaaaataagaggaaaatattttctttacacatgaaatttttggtccaaatgatatttaaccaactaactggctaatctattaaagcattctatttcagaaaagcttcatttttggtaccgttgattgcattagcacattacttctgatagtgggcatagattatttttttttctaaagtgawgttttttccaaagtgatattgtggttttactcttggaagaaagtacaagttttctgtgggcctaagtattaaaaatgttttttaaaaacttgaaattgttatacattaaactagaactcttggaactttttcagattttgctgctatagtcactagtcctttgacttagatattttatgaaccaatttttactggctggaaaatagaattttccataattaagagaaaacatcagttattttatccagttgactttgtctttgcttgttattgtttgctttagagatttatctaagttgt

SEQ ID NO: 57285 - DNA, 601 bp, Human
gatagaaagcaacaatattattgttggaatagacgtaggaggtcacagggttgggaaaggagaggtacatactattagcagagggtaaaagtgctttggaaatttgggctatggaagatctatcttttgtgaaagcatgctttgtattgaaattatcaaatagaagatagagggtggacaagaacacttacacataattgaatgtaccagatgctttacataaattttcatgtttcatctttcaaaacactaataaggagtgcatatggtagttctgtttttaattttttgaggaacttcygtactgttttccatgatggctttacaatttacattctcattaacactgtactaggggttctctgttctccacacccttgcgaacccttgttatatattgcctttttcatagtagccatcctaacaggtgtgaggtgatacctcattgtgattttaatttgttttgcctggtgattagtgatgttaaagttttttcacataccttttggccatttgtatgtcttcctttgagaaatgtctattccagtcatttgcccattttttaatcaggttatttgttttcttgctatcgagttgtttg

SEQ ID NO: 57286 - DNA, 601 bp, Human
taagtagattcctgagctcttccagttattcccattcatgggtagcgtccaattattgttctttgtgaagaaaacgaaggctgggttttcctacttagccatctttctgacatcattccttgcttttctttatagctttgtcatatttacatattccatgtttagctttgcatgttcagaatttaatatgaatggaaccatgctcttcatattcttatgtaacttggtttttatgttttttttttttttttgctaagcattgtttctgagagtcagtcgtattgatgcatgtacatagctrtaacttatttattttcacttctgatagtattccattgtatcaataacaagtttatccattctcttgtcaatggacatttggttgtttctgttgttcttttgctataagaaacacgtctgctgtaaatactatgcatatgccctttggagtccttaggtgggggaatcaaataggttaccttgtctctgttattattgttttcctcctttccaggtggcttacacctcccttgtgtctacattttttgcaactctagaaaggaggggaagagagtttatgaggtattggggatagcagggg

SEQ ID NO: 57287 - DNA, 601 bp, Human
ctttcctctcccacccttaattgcttctccagttttctatttctctgtgagggcatcttccctgatctatgtgattatgtgactaggtacctggaagttgaccttgacactgctttctccttcccaccctcatattcccacccccatatccacccactcactcactgaaatatttctaaaccagtagttttcattattttcactgccaccaccctaattcaaatcaccattgcatcaagcctggactagagaaacatcctcctaaggaatctctctgtatctactcttgcttttctctaatccattgggcagccaaagtggaccatttacattatcaggtttcctttttactttcttttttctttttttttctttttttgagacggagtgttgctcttgttgcccaggctggagtgcaatggtgcgatctcagctcaccgcaacctctacctcccgggttcaagtgattctcctgcctcagcctcccgagtagctgagattacaggcatgcgcctctgtgtccagctgattttgtatttttagtagagatggggtttctccatgttggtcgggcaggtctcgaactcctgacctcagatga

SEQ ID NO: 57288 - DNA, 601 bp, Human
agatcggtgaagtaattatattatgggaaaggtgtattaagactgataatgtttgaagttaactacctcaattatatttgagaaataatagtcatcaaattgctttttatttggcttgtatctttttatgtattttgtgtacatattgtatctttttacatgaggggctgaggtatatgacctgttgaagggaacagtgcagtaggagacaaggattgtttagtcatggctgtgctccaaaatatctgtgtccatggacaagtcctttaaccttttgagtttcagcttccaaatcagtaargccagttgggcagattatattatcacatgtactgtccagttactacatttaaaaatttttttttatcaatattgtgtgtctagtcaacataccgttgccaaataaatgcctgttatgtgtcaggcacttagatgtttcagtgttctaaggctggatttctttctcggttctgttttatttaacaaattctaagttggtgatggttctttagaaaagctgttcttgtgttcttgtaagctattgatttttcttttgggattgggatgtgtagggaaactcttgagaggaaggaggatggag

SEQ ID NO: 57289 - DNA, 601 bp, Human
tctctactaaaatacaaaaaattagccaggcgtggtggcacgggcatggtggccacccgcctgtagtcccagctacccaggaggctgagcaggggaattgcttgaacccgggaggcacaggttgcagtgagccaagattgcatcactgcattctagcctggcaacagagcaagacatcgtctaaaaaaaaagaagaagaaaaaagaaaatacatagtaaaatttattggctttttaaatggataatttcatatagtcagtcagtgccggcttagatccatttgttagagaacaatgctaaygagacctcttgatactttgtgttcctcttatgttttcctagccttgacgttagcaactaacaatgataactaacattattgagctcttatgtgccagggactattacaatagattttcaattattatctcattaaatcttcatagcagccctatgagctagatactgttactacctatatcttaacagatgaggaaatttgaaacagagcagttatttgccaagagtttcagagctattaacagaagcctaatacatgttcttggactttgcagaaataatttgttgatccatgcggttt

SEQ ID NO: 57290 - DNA, 601 bp, Human
tgcttgaacccgggaggcacaggttgcagtgagccaagattgcatcactgcattctagcctggcaacagagcaagacatcgtctaaaaaaaaagaagaagaaaaaagaaaatacatagtaaaatttattggctttttaaatggataatttcatatagtcagtcagtgccggcttagatccatttgttagagaacaatgctaacgagacctcttgatactttgtgttcctcttatgttttcctagccttgacgttagcaactaacaatgataactaacattattgagctcttatgtgccagrgactattacaatagattttcaattattatctcattaaatcttcatagcagccctatgagctagatactgttactacctatatcttaacagatgaggaaatttgaaacagagcagttatttgccaagagtttcagagctattaacagaagcctaatacatgttcttggactttgcagaaataatttgttgatccatgcggtttcattgctactgcggaaagtaagtctcttggccattgtgatgggtcaaaatctttgtacatgaagggtatgactgttgttccattgtatccagagagtg

SEQ ID NO: 57291 - DNA, 601 bp, Human
agtcagtgccggcttagatccatttgttagagaacaatgctaacgagacctcttgatactttgtgttcctcttatgttttcctagccttgacgttagcaactaacaatgataactaacattattgagctcttatgtgccagggactattacaatagattttcaattattatctcattaaatcttcatagcagccctatgagctagatactgttactacctatatcttaacagatgaggaaatttgaaacagagcagttatttgccaagagtttcagagctattaacagaagcctaatacaygttcttggactttgcagaaataatttgttgatccatgcggtttcattgctactgcggaaagtaagtctcttggccattgtgatgggtcaaaatctttgtacatgaagggtatgactgttgttccattgtatccagagagtgaatcttgtgattgagttgggatttgaggtggcagtgtatactaagtttgaaaagtatattatcatatgttagctccctttagaaattttccccaagaagagctattacattttttaatattaaaaaagcataagatatggccataatacaattagttcc

SEQ ID NO: 57292 - DNA, 601 bp, Human
aaaagacataatctctttcctcctggatcttaaaatctaaagtgagagataattcaccagataaatgctgcgataagggaaatagaggattctatgagcttatgactaaggatagatctgtttcctcagatgtggaactaagaagtggcagtagttgagaagttcattttgggccatgcgatttgaggtgtggctattcaagtataggaggtaggtggttacacattttttaagctattaaatagaactttcacttgaaaaggtttttttctctctttcctcagcatctatctccctacayacacaaaaaaattgcatgtcacaattcatgaactcagtgagtgactctattttgaaaaatgttagattatatcaactgaagtctgttagaggcaaatgcttttggtcatttttttcagcagggacatttcatatgtgtaaaatatttagaatccccatgtatttatatataaatgaatcttttaccatcttaaatgtttaataagttatatttttcctttctttcaacttaagtatacaaggttatcagcaaacatttgtagatgctctatgtgaggtgttttgtttattagttttaagg

SEQ ID NO: 57293 - DNA, 601 bp, Human
aacgacttatggattatgtacttcagatcacagcacaactagaagatgttgatacattacataaaaaatcaggaaacctatgaagaacatcaaaagtggcaaggtgtgttcacttgcactttgtgagattgaaactgctgccattatctgtgcaaactatggtttgagtacttttaatttagcaaagactaattattttttaaaaattttggggtaaaaaaaatggtctttagcgtagaagagctttacccgacttactttagttggttcaattggttgattttggtttgctttttgaaaytttgtattgtcttaatttggggcacattgaactcaataacagttcagttgcattataattcatttgggtaaagtttattgttggaggagggtaagtaaatatttaactgaaaaagtgaagtaaatatttatttaaggctataagttgaaatatttgtcagctgagaaattttcaggtaacttttttaacctttgaaaaaaatttactatagcatgagtattttttatactgctatgtataatccatagtcacgttttttaacctttttatataaaatactgatacagaaaaccatacaat

SEQ ID NO: 57294 - DNA, 601 bp, Human
tgaattgttcagcagcctctcaacttcccgaaaataccacttaagtcttaaactcagacttgcatgagtttactgagatatgtttacctttgcagctggcttgcctagagtctaccttcttactaccctactaagtccagaatgaggaagaattaaaagcaagaaaggagatacagaagaagagattgctcaggctgaggaggggcaaagtgataagagcaggattagaaagagacattaaaaattcaaggatactgagtttgttggcatcagaataaatcttggaggctgttttaagagrgaataaaacctagagggaaggaataaaaggcaaagatgttataaaacataggtaaaatatttaaaatattttgtcctgaattttgaattttaggcatatgtcagtgaagcacaaaggatagcccccttttttgatgagctttagtatccttaagatattttctttctagaaccttgtgtaggaattttacagctgaccataatcatgtgttctctttggtttgttccaacatctttggattggaaccagtacagagtaggaaacccatatcaccttgggattatttttcagataaatctt

SEQ ID NO: 57295 - DNA, 601 bp, Human
ctacttgggaggctgagacgagaggatcacctgagcccaggagctccacgctatagtttgagttgtgatcgtgccattgcactatagcctgggtgacagagcaacaccctacctcaaacaaacaaacaacaaaaaaacccttctacctctgaacatgtggggatttaaagattgctatgatttaaatataaatcatgaatatagaaaatatgagaacagaagagtatttgttaaacaagactaagctgtgctgcataaagtaaggcactatcattgtgctggtattttctgattctcttartgcaataaatgttaaactttactactaccttagccatgttgcagggaattgacatgaatagttcctgggttttggctgggtgcggtggctcacgcctgtaatcctagcactttgggaggcttaggtgggcagatcaggagttcaagaccagcccggccaacatggcgaaaccctatctctaataaaaaacttaaaaattagccgaacgtggtggtgcacgcctgtagtcccatctactcaggaggccgaggcaggagaattgcttgaacctgggaggtggaggttgcagtaagccaagat

SEQ ID NO: 57296 - DNA, 601 bp, Human
tttggttggaagttagtccattttgtgttgctatcacagaatatcacagactgggtaatttattaataatagaagtttatatagctcttggttctgagggtggtaagtctaagattgaggggctgcgtctggtgagggccttcttgccagatggaaggcaggaatgcaagagagcacaagtgcaaacaagggcaagacggggccagactcgattttaccaggaactcactcctaagataagggcattactcaattcatgagggcagagccttcatcacccagttactttttatggactcaytggttattactgtcacaatgacaattcaatttcaacatgagttttggaggtgacattcaaatcatagcagaagtcaatgtttaaaatcaatgtatatcctacatacccttcagaaagatactagttgactctcctacttatgagaggtatatttttttattcctttgccaatattgggtgtaataattttttaatctttgagaaggtaatgtataaaaaacaaatttgtgtttaatagctagcaggattggtcattgctccatatatttattacccatttatattcttttatttatttaa

SEQ ID NO: 57297 - DNA, 601 bp, Human
ttatctcaataaccattatttctacacattgctgagttacagggataagagttggtgtccttgttcttttttctttcctgggaattgttctagtactgagatttcctctttggcttgaagtaagtattatattaaggaataaattttatcaaatccctttcagaatatgatgagatgatcatatggattgtttttaacttttaaaaagatgacttacattagtcagctgcctaatgttggctcattgttacgttcctaaaatgatccctatttggtgatttgtaatatatattttactgaytttttggcatctgtattaataagtatgtttggactatagttttatttttttagtgctgtctttgtcaaattttatagaaggattatgataggtttgtaaaaagaattggaaatttttttcctgtaatctatagataacttaggtaatttgagagttacatgtttccttagggcttgaaggatcttgttttgaaatagtcttgcctgatgcacttttatttttaatagcttattttgagaacaatccaaatttaaaatttgcaaaaataatacagtgaacttccatatttatttaaatggc

SEQ ID NO: 57298 - DNA, 601 bp, Human
gcgtgcgttattatgcccggctaatttttatatttttagtagagatggggttttgtcatgttggccaggctgatctcaaactcctgacctcaggtgatcctcctgccttggcctcccaaagtgctgggattataggcgtgagccatcgtgcccagccgatggcatgtttattttgtctgaattgtattcttaaaatttgtaatcttcaaattatgcttcggtattggtcagtttctactaaatgtatctagtacttgataaacgccattcaatcaccaagttcagtctttagtttatgatktatttcttctgcctttgaaatttaatttttcttccattatttggttttcttatttacaatgtgctaattgagctgttggatctgcattgtttgtatcttttctcaagtctacttgtttttgtttctttatgcttacttgcatactggatgatttttgtcctgttcgtttttaccccttgcagattgtttgctgtagtgtcttcattcctcattattgcttttcatgacatttaaaatattgcaatgatattttttctctgaaatatctttttttaaaagctctgttgatactttttatat

SEQ ID NO: 57299 - DNA, 601 bp, Human
ttttcatctttacaagtttggcagattttctttcccaacagaagaacttgactattgggcattctgctaatttccatggctgctataacaaattatcacgaacttggtggcttaaaacaatacagatttattctcacagttctggaggccacaagttcaatatcattttcacggggacaaaatcacggtgtcaccaagaatgtgctcactcccgaggctttaaggaggaatctgtttcttgctttttttcaccttccagtggctgtcagcctcatcacttgcctggtagccacatcactcsaatctttaagaccagcgtcttcaaatctgtgtctgctctgtcttcacatcaccttctctgtgtgtgtcagatcttcccctgactctctattctaaggacatgtgggttcacttagaggtctctggataatccaggatcctctctccatctcaagattcttaatcacatctgcaaagacctttttttccaaataaggtaacatttataggattaggactggtatctttgggagtcattattcagcctactaggtatcattttgttttgctactttagagtgaggcagacatattagtcaaa

SEQ ID NO: 57300 - DNA, 601 bp, Human
ggtggcttaaaacaatacagatttattctcacagttctggaggccacaagttcaatatcattttcacggggacaaaatcacggtgtcaccaagaatgtgctcactcccgaggctttaaggaggaatctgtttcttgctttttttcaccttccagtggctgtcagcctcatcacttgcctggtagccacatcactccaatctttaagaccagcgtcttcaaatctgtgtctgctctgtcttcacatcaccttctctgtgtgtgtcagatcttcccctgactctctattctaaggacatgtgrgttcacttagaggtctctggataatccaggatcctctctccatctcaagattcttaatcacatctgcaaagacctttttttccaaataaggtaacatttataggattaggactggtatctttgggagtcattattcagcctactaggtatcattttgttttgctactttagagtgaggcagacatattagtcaaaaattggattagagtaaagcctcatagattgtgctgtttgttagaatcacagatactgtcctctttaccgaatgatgcaaactctgatgccatggtggaaaagtat

SEQ ID NO: 57301 - DNA, 601 bp, Human
tgcagtggcaccattataggtcactgcagcttcaaattcgtgggcccaagcagtcctccttcctcagcctcctgagtagctaggactacaggcatgcaccactatgccccgctaatcatttttacagagtcacgctattttgcccaggctggtcttgaactgccctcaagtggtcctcccacctcagtctcccaaagcactgggattacaggcatgtgccaccatgtgtggctctaatcatttttaaagcaacaatcagtgggaaatttcagctccaaatgggagaaaaatttccaaagaktagccttttttttttttttttttttacagatttgctacagttttgttaatgtgcttatttctcattaccatagataactttgagatggctgccttggattacaaactagaatttattactatttcacatagcttgggaaattaagtgtagtttgtgtagcctaaattatcctttatagagatgtagctgcaagggttagcatttcttctttgaaccccaggtatgcagtatattgcttaatactctattgttccataaatatgcattccagaagtcagctgaccatttgtccttatcttt

SEQ ID NO: 57302 - DNA, 601 bp, Human
tgcagcttcaaattcgtgggcccaagcagtcctccttcctcagcctcctgagtagctaggactacaggcatgcaccactatgccccgctaatcatttttacagagtcacgctattttgcccaggctggtcttgaactgccctcaagtggtcctcccacctcagtctcccaaagcactgggattacaggcatgtgccaccatgtgtggctctaatcatttttaaagcaacaatcagtgggaaatttcagctccaaatgggagaaaaatttccaaagattagccttttttttttttttttttttacagatttgctacagttttgttaatgtgcttatttctcattaccatagataactttgagatggctgccttggattacaaactagaatttattactatttcacatagcttgggaaattaagtgtagtttgtgtagcctaaattatcctttatagagatgtagctgcaagggttagcatttcttctttgaaccccaggtatgcagtatattgcttaatactctattgttccataaatatgcattccagaagtcagctgaccatttgtccttatctttgaggacaaagcccatacatatgta

SEQ ID NO: 57303 - DNA, 601 bp, Human
gcagtagagagtttacgctctacatcccactgcaagtaatttgaatattgccatattatccactgtgacctgtgctgtttgttaacgttccttttccccaccttccccgaggagcttgtagtctctcactatatatttttttctctttggatttcccttcagcctttagatttcttatctctaatgcaagtctactctagatttttctcccaaatgtttaaaaccaaacctattatctcagtggtcatcaaaggtcctctagttaccagtatccacccttcttggaatgcctgtttagcartgttcttttgttatatgagtaagaataactctggtatttgctaagagaatataattttctccacattgtatgtatctatgtcctttgtttataaagcctggggggcgttccctattaggttaagtgtccctaggtaaatagaaaaatatgtagggttttattactcaactttttaaggtttctgctcaaattgtcagttgaataactcttgttactttggggctaacatgttgcatagggattttaacaataaaatatatagagcattttaaaaattattcactataattctgagtggat

SEQ ID NO: 57304 - DNA, 601 bp, Human
tatttttttctctttggatttcccttcagcctttagatttcttatctctaatgcaagtctactctagatttttctcccaaatgtttaaaaccaaacctattatctcagtggtcatcaaaggtcctctagttaccagtatccacccttcttggaatgcctgtttagcagtgttcttttgttatatgagtaagaataactctggtatttgctaagagaatataattttctccacattgtatgtatctatgtcctttgtttataaagcctggggggcgttccctattaggttaagtgtccctasgtaaatagaaaaatatgtagggttttattactcaactttttaaggtttctgctcaaattgtcagttgaataactcttgttactttggggctaacatgttgcatagggattttaacaataaaatatatagagcattttaaaaattattcactataattctgagtggattaaaccaaatgaccgggttcaagactctactatgagttcacctttgcttaataaaaggcaagactgaacattaattaatgacttcttggcccagccttagaatttttcagtttagggattagtttggttttta

SEQ ID NO: 57305 - DNA, 601 bp, Human
aactctggtatttgctaagagaatataattttctccacattgtatgtatctatgtcctttgtttataaagcctggggggcgttccctattaggttaagtgtccctaggtaaatagaaaaatatgtagggttttattactcaactttttaaggtttctgctcaaattgtcagttgaataactcttgttactttggggctaacatgttgcatagggattttaacaataaaatatatagagcattttaaaaattattcactataattctgagtggattaaaccaaatgaccgggttcaagactytactatgagttcacctttgcttaataaaaggcaagactgaacattaattaatgacttcttggcccagccttagaatttttcagtttagggattagtttggtttttaaaaggtacaaaatgttcatgaaattttctgattatatcaaatattaattcagtcttgttttttgtcatagtactttgttttgaaaagttcagatcaactgataatactagtgctgtgatgagactcagcttgtactcaagaacagatttatgactaggtgagaactaaaatttctctcagaaactaactaaaaa

SEQ ID NO: 57306 - DNA, 601 bp, Human
tgtgtatctggaaaataactactgtacttctttataaaagtgagagtgaggtccctgctagttgaggctggaatctagacgtggctgtttatgtaggagttagtaattaaacagtgcctgtttgctgactgcctcatttttgccaggctctgtatgggtgccttgcaaggcattgcctcatttaaaccttgcagcagcattcagaggaaagtattaatatgcccactgtacagatgaggaagttgaggaatgctttattagtaggtgtgaagtgtcttaagcataatacctccctcctcarccttgctccctcatcctagttaagggaattgagacacagagataaggcaatttgctattgaccttcagcagatgacttaacctcaccgtggcttagtttcttcatgagtaaaacagggtacctatcttttaggattggtgtgaagattaaagaagttaatacatatacaaaactttagaacagtgcttggctagtagtaatctctccataaatgttagatgttattattaagcctgtgactacctgttatctcatgtagttgttcagagataaaaatgtaggctataggaaagaataagg

SEQ ID NO: 57307 - DNA, 601 bp, Human
gtgtgaagattaaagaagttaatacatatacaaaactttagaacagtgcttggctagtagtaatctctccataaatgttagatgttattattaagcctgtgactacctgttatctcatgtagttgttcagagataaaaatgtaggctataggaaagaataaggaggaaagccaggctcctaatctgtctaagatagaagtgaatcttagttaagttttaagataatcctatgtgcttttaaaagatttcatggtttgcggtttgcttttctttggctcccagtttctttttttttttttttgacttcttagtacaggtaacttttgaaggaattcagcttaccttagatgaaccaaaggaaagctaaaagccgagataatttagaaaaactaaagcagagattatgttcctaaattccctctttctgcttcaaagtccaggaaacaccacctgcagatacagttgtatcccattgttagaccctttcctgaagccatcctcttttctttgtcttcccagagagaaactagtcattcgacaaagattgaacttcttctgtgtgttaggctgtgctccaagtgctgggaagacaccagtgaat

SEQ ID NO: 57308 - DNA, 601 bp, Human
aggatgaggcaagagtttccagttaaggaaactgacatgagcaaaggcttgaaggagcatgcaaatttggagcattgtgagtagattattttttagtttttcagagttcatgcagtgggaataaaactagggagtttggaatcaagcttgaaaattcctgaatgttcaaccaagatatatttgagttagtagattttttgggtatgtcatgaattcgtttggcttttcttaattgatatacatacaacttagtcctgagcttacacatgttcattgtatcattaaacatttagcctggttsgtttaagttgatggccactgccaggtctcctttctgccttctcccctttatcccaatgctttagtttttttctgcctttttgtctgttgtgatctgtgcttcatcaggctttcccccagttcctccttgttaatctccagattccaagtcagcaacacaatgaatgtctgcttatcgcgagttgtgaattcccgcatatctctttcacttattaaaaagattgtttggtacatattttgtttataagacagttattgactttcctgtttctcttcctttgcagacctagaggatcaagac

SEQ ID NO: 57309 - DNA, 601 bp, Human; identical to SEQ ID NO: 39804

SEQ ID NO: 57310 - DNA, 601 bp, Human; identical to SEQ ID NO: 39803

SEQ ID NO: 57311 - DNA, 601 bp, Human; identical to SEQ ID NO: 39802

SEQ ID NO: 57312 - DNA, 601 bp, Human; identical to SEQ ID NO: 39801

SEQ ID NO: 57313 - DNA, 601 bp, Human; identical to SEQ ID NO: 39800

SEQ ID NO: 57314 - DNA, 601 bp, Human; identical to SEQ ID NO: 39799

SEQ ID NO: 57315 - DNA, 601 bp, Human; identical to SEQ ID NO: 39798

SEQ ID NO: 57316 - DNA, 601 bp, Human; identical to SEQ ID NO: 39797

SEQ ID NO: 57317 - DNA, 601 bp, Human
ctgaggcaggagaattgcttgaacacaggaggcggagcttgcagtgagccgagattgcaccactgccctccagctggggcgacagagcatgactccctctcaaaaaaaaaaaaaaaaaaaaaaaatccaagaagtgtggagtatggtctagtgcagtagtcctgggggacaggaaaggaagggaggaaggaaagaagagaagggagggagggagagaggcaaggagggagggaggaaggaaggaaagaaggaaggaaggaacgaagggagggaaggaggactgattctaaggggacacacrgtgatgtctcaagatatttttggttgtcacgacttgggggtgctcctggcccggagtgggtggaggccaggggcgctgctcagcaccccgcagtgcccaggacggccccaccacggagaacaatccagcccagatgtcaacagtgccgacggagggggagaaatcccgctccagtgtgatctccaagcaatgaaaaacacagcacacaggattctgtggcatatgctatcacagggtacgtgtttttaaaggaaaggcacacacgtatcttaggaaagggacatacggagtcgatgacag

SEQ ID NO: 57318 - DNA, 601 bp, Human
aggcaggtggcttacgtcgataatcccagcatgttgggaagccgaagcaggcggattacttgaggccaggagttcaagaccaccctggggcacatggagaaaccctgtctctgctaaaattacaaaaagtagccgggcgtggtggcgcatgcctgtagtcccagctactggggaggctgaggcaggagaattgcttgaacacaggaggcggagcttgcagtgagccgagattgcaccactgccctccagctggggcgacagagcatgactccctctcaaaaaaaaaaaaaaaaaaaaaaaatccaagaagtgtggagtatggtctagtgcagtagtcctgggggacaggaaaggaagggaggaaggaaagaagagaagggagggagggagagaggcaaggagggagggaggaaggaaggaaagaaggaaggaaggaacgaagggagggaaggaggactgattctaaggggacacacagtgatgtctcaagatatttttggttgtcacgacttgggggtgctcctggcccggagtgggtggaggccaggggcgctgctcagcaccccgcagtgcccaggacggccccaccacggagaacaat

SEQ ID NO: 57319 - DNA, 601 bp, Human
atcctctacctactagtagccagcagcaccgcaccaagctgtgacaaccaaaaaggtcccagacattgtcaatgtcccctggaggacagaactggccctgttttacaggaagataaatgtcccctaatccttttgtgtaaaagggggaatgttttttacccttagaccggataagcaagaccagctgagacctactggtataaagcatactgcctgctcacatggtgagaactcaataaatgtttgtatcactacgtaatgagagatcccgagagatgtcactttccaacaggcacagcaragggtgaaagagttgttattagactaaaaacaaaaaaagagacacaaatagtcggatacgtccagataacagctgagatgtcagagggaaccatggcaatgatcacagaagagcatggaacgcagccagggtgacttctaagagcacgactcaggacagaattgaccaggaggccaagacgacagccccgagggtgggctgtggccattgtgctttgggactaggcctcgggatgtggaaataggcaatcctaagcccagctaacaccacactgtcctttccaggcttcaaggcgccatt

SEQ ID NO: 57320 - DNA, 601 bp, Human
aaggcgtgagccaccacacctggccaaactaggaaaatcgtaagaatggctcagtggggatttttttgttcctttgttttggtataattatcctcattttttttccaaatcttcaagcagggtttctcaaattttggtactattgacatttggggccaggtaattcttgggggcagtggggagatgctgccctgggcaccggaggatgtccagcaatatcctctacctactagtagccagcagcaccgcaccaagctgtgacaaccaaaaaggtcccagacattgtcaatgtcccctggargacagaactggccctgttttacaggaagataaatgtcccctaatccttttgtgtaaaagggggaatgttttttacccttagaccggataagcaagaccagctgagacctactggtataaagcatactgcctgctcacatggtgagaactcaataaatgtttgtatcactacgtaatgagagatcccgagagatgtcactttccaacaggcacagcagagggtgaaagagttgttattagactaaaaacaaaaaaagagacacaaatagtcggatacgtccagataacagctgagatgtca

SEQ ID NO: 57321 - DNA, 601 bp, Human
ggagcatcaggcagatttcaaagctatgggaggtgacgcttgtgaatgtccctcctagctcagtctgaagcaatctttccattcaaatgttcaaaccctctccctcctttcaggcaaaaaaaaaaaaaaaaaaagccagcattccaggcagctgccagctctacccctagttacactctcaatctcacacagcccggccacaagatttatcaggaagccagttagcagcttaagcctggaaataatgtcacccaaacccccagcacaccaagggaacttctgagagcagctctcgctagcsgcattctttcaccctccttagtcccccagttctagctgcgcacggatgccaggaggctcttgagggagtgggtgtcacacaggcagaaaggagggaaccagggagatgggaccatgacggacggctttttactgctttcttccagatgattcaactttccccagctcaggccctcaaccagtctatggccagttcatgacaagaagtaaaaactcacaaactgcccactcaagcccaaaccaattttgaacaagttcccaaaaggttttgcagggagatgaactagcctggaacccacta

SEQ ID NO: 57322 - DNA, 601 bp, Human
cagaacaagcagtatcgttgacattctgaaacaccagccatgtcccagacactgcttactctgacctacagcccccaaataggtggggcccaggatcccccggcagacagtcctcccccaaccccactggcctctccttttctcctaggcacaaacccagggcctaaggagcatcaggcagatttcaaagctatgggaggtgacgcttgtgaatgtccctcctagctcagtctgaagcaatctttccattcaaatgttcaaaccctctccctcctttcaggcaaaaaaaaaaaaaaaaaaagccagcattccaggcagctgccagctctacccctagttacactctcaatctcacacagcccggccacaagatttatcaggaagccagttagcagcttaagcctggaaataatgtcacccaaacccccagcacaccaagggaacttctgagagcagctctcgctagccgcattctttcaccctccttagtcccccagttctagctgcgcacggatgccaggaggctcttgagggagtgggtgtcacacaggcagaaaggagggaaccagggagatgggaccatgacggacggctttttact

SEQ ID NO: 57323 - DNA, 601 bp, Human
atcccagctactcaggaggctgaggcagaagaattgcttgaacccgggaggcagaggttgcagtgagcagagatcgcgccactgcactccagcctgggcgacagagctagactctgtctcaaacaaacaaaaaattaatattaaaatttaaaaataaataaaaataaaaataggtcagaacaagcagtatcgttgacattctgaaacaccagccatgtcccagacactgcttactctgacctacagcccccaaataggtggggcccaggatcccccggcagacagtcctcccccaaccccmctggcctctccttttctcctaggcacaaacccagggcctaaggagcatcaggcagatttcaaagctatgggaggtgacgcttgtgaatgtccctcctagctcagtctgaagcaatctttccattcaaatgttcaaaccctctccctcctttcaggcaaaaaaaaaaaaaaaaaaagccagcattccaggcagctgccagctctacccctagttacactctcaatctcacacagcccggccacaagatttatcaggaagccagttagcagcttaagcctggaaataatgtcacccaaaccc

SEQ ID NO: 57324 - DNA, 601 bp, Human
actggctcacgcctgtaatcccagcactttgggaggcaaggcagggagatcactaggtcaggagttcaacaacagcctggccaacatgatgaaaccctgtgtccactaaaaatacaaaaattggccagctgtggtggcgcacgcctgtattcccagctactcaggaggctgaggcaggagaattacttggacccaggaagcggaggttgcagtgacctgagatcggcccgctgcactccagcctgggacagagcaagactccgtcacacacacacacacacacacacacacacacacacacacacacacacacacaaaagatcattccatgtttatggcttaacaagtcaagcactttggtaggaaaaccaagagtggccccacaaagtgaggttttaaaaaagaggtcagggccgggcacgtggctcaggcctgtaatcccagcacaatgggaggccaaggcgggcggatcacctgaggagttcaaaaccagcctggccaacaaggcgaaaccccgtttctactaaaaatacaaaaattagctgggcatggtggcaggcacctgtaatcccagctactcaggaggctggggcaggagaat

SEQ ID NO: 57325 - DNA, 601 bp, Human
ccactggctcacgcctgtaatcccagcactttgggaggcaaggcagggagatcactaggtcaggagttcaacaacagcctggccaacatgatgaaaccctgtgtccactaaaaatacaaaaattggccagctgtggtggcgcacgcctgtattcccagctactcaggaggctgaggcaggagaattacttggacccaggaagcggaggttgcagtgacctgagatcggcccgctgcactccagcctgggacagagcaagactccgtcacacacacacacacacacacacacacacacacacacacacacacacacacaaaagatcattccatgtttatggcttaacaagtcaagcactttggtaggaaaaccaagagtggccccacaaagtgaggttttaaaaaagaggtcagggccgggcacgtggctcaggcctgtaatcccagcacaatgggaggccaaggcgggcggatcacctgaggagttcaaaaccagcctggccaacaaggcgaaaccccgtttctactaaaaatacaaaaattagctgggcatggtggcaggcacctgtaatcccagctactcaggaggctggggcaggaga

SEQ ID NO: 57326 - DNA, 601 bp, Human
tcccactggctcacgcctgtaatcccagcactttgggaggcaaggcagggagatcactaggtcaggagttcaacaacagcctggccaacatgatgaaaccctgtgtccactaaaaatacaaaaattggccagctgtggtggcgcacgcctgtattcccagctactcaggaggctgaggcaggagaattacttggacccaggaagcggaggttgcagtgacctgagatcggcccgctgcactccagcctgggacagagcaagactccgtcacacacacacacacacacacacacacacacacacacacacacacacacacaaaagatcattccatgtttatggcttaacaagtcaagcactttggtaggaaaaccaagagtggccccacaaagtgaggttttaaaaaagaggtcagggccgggcacgtggctcaggcctgtaatcccagcacaatgggaggccaaggcgggcggatcacctgaggagttcaaaaccagcctggccaacaaggcgaaaccccgtttctactaaaaatacaaaaattagctgggcatggtggcaggcacctgtaatcccagctactcaggaggctggggcagga

SEQ ID NO: 57327 - DNA, 601 bp, Human
caagggattgcggcgagggcgggcagaaagttcccagagcttccttccgcagggggcttcctgagaataagggtctctgcttagtgctggggcaaagtcccgaaatgacagcagaaaaataatcagtcagcagttctgcttccagcacgcagggctggatgggggtgtcctggaggaagatatttgcattactgcttgggtgatgtttgggaactcttttttttttttatttctttttcacttttttttttttttttttggagaacagggtcttgctatactgcccaggcagatctcaaaytcccgggctcaagcgctcctcctgcctctgcctccctcagagctgggattacaggcacgagccaccgtgcccaacaatgtttgggaactccttaagaatgctgactgctgggtctccagcttccatgcctttccccaggcactcaggacctggctgttaccaacccatcagccctctttcctgagcccaaatcccagtgtgcaggatcccccgatcctaagaggcgagactgcagagggcatggcggtgggccccaagggaaaaggcaacgtgccttccgtgaggcatttcccacagcgt

SEQ ID NO: 57328 - DNA, 601 bp, Human
cttatgccagggtgggtgaaggttgggagatggggaaattccaaccaggtccctgggctgccctcttctgagccacaaaggctggccttgaagggccagggctgcccatctgtttcaaacaatcgggactctgatgagtgaggctgttaggctgatggatgcctgcctgagtcagctgtggggcctcatcccacagaggcgggtggcaagggattgcggcgagggcgggcagaaagttcccagagcttccttccgcagggggcttcctgagaataagggtctctgcttagtgctggggcaragtcccgaaatgacagcagaaaaataatcagtcagcagttctgcttccagcacgcagggctggatgggggtgtcctggaggaagatatttgcattactgcttgggtgatgtttgggaactcttttttttttttatttctttttcacttttttttttttttttttggagaacagggtcttgctatactgcccaggcagatctcaaattcccgggctcaagcgctcctcctgcctctgcctccctcagagctgggattacaggcacgagccaccgtgcccaacaatgtttgggaactcctta

SEQ ID NO: 57329 - DNA, 601 bp, Human
tttgagacagagtctcactctgtcgcccaggctggagtacagtggcacaatcttggctcactgcaacctctgcctcccgggttcaagtgagtctccagcctcaggcttctgagtaattgtgattacaagtacacaccaccacgcctggctaattttgtatttttaatagaggcagggtttcaccatgttggccaggctggtctcgaactcctgacctcaagtgatccacctgcctcagcctcccaaaatgctgggattacaggcatgagccaccacgcctggacattttttttttttttttgagaccaggtcttgctctgtcacccaggctagagtgcagtggcgtgatcatggctcactgcagccttgacttcccaagctcaatcaatcctctggcctcagtctcccgagtagctgggactacaggcgtgcatcaccacacagagttatttttttttttattttttattttttggtatttttgtagagacggggtttcactttgttgcccatgctggtctcaaactcccaggctcaagccatcctcctgcctcagccttccaaagtgctgggtgacaggcatgagccgctgcacctgtcc

SEQ ID NO: 57330 - DNA, 601 bp, Human
aggttctctacagaatgcgtggtgggcagagctgtgagcgggcactgaggaatgtgccttcacctgtctcctctgcctatctggcacacttacacagggacaccaggctctggtgacaggtgactcatgcccatggtggcccacagtcacgaagacaggttttctgaggtgtggctaccaaaagcacccaggccagaagtcatcccgggtggcacggggcagggcagggggtggtgagaggcggtcagcagctctgcacagccagccgcgcctgtgcactggggccctctgcgagcattakgtgccagcagctgtcaccttgcagtggccactcctgccccctcgccaggtcacgtgcactggctctggcgcatgggtgcccctggccgctcagaggcactgcctgctccttacacagtgatgtcggtggtggaaacccgggctgggaatctcagaattgctgaccacggcctcagcacagaggaagcaggcaaatggcccgagtccccccaccatctcccctgcagcgagaagactgcagcctctcctgtctgaagactcgcgtttgggtcccgggcctgggagattctggcgggtgcag

SEQ ID NO: 57331 - DNA, 601 bp, Human
gtatggggcctaggctggccagtgctgcccaatggtgggggctccctcaccgcccgtctggcagaagccatgggccacacgctgtcccagcacatggtggcagggcggtgacctgggctcggctctaatgaccggcagccctggggctcccatcaccactaccagtctgcccaggaggcagcagagcactgagcccgacctgctcccctcgggcacctacgagacccacctgcccctccatgcgtgggggagaaggggtgccctctgctgtggaaagctgggacctactgtctgtggtgcraggctgaccccacagagctccaggacaaccccgagaggagtggacagagccagccgggccctccagcccccacctggcccagctgccgcctctgggcagatgtctccacttgataaacaggacagctaagggcctaggagagacatgcctggcccaaggccagacagcaggagtggctaggaaggtcaagggatccccactgcaggccccaccaaccctggctctgcctggaatgcagtcagggcaggtggaaggggaggggcaacgccccagggctgggcgaggaatctgggagcaggt

SEQ ID NO: 57332 - DNA, 601 bp, Human
cctggcctcctggccctcgtctgcattgagaggcttggcctctggtccgcatgctgcccttcccgtgctgtggccttgcagcccggcctctcccctgctgtcccccttggctctggcctggcccctgggcccctgagtcacccctgaggtgactcagcagtccttggaaacgcatgccgaggacgcaccctgcctggcccagctccacatgggtgtgggggaggctgcgggctgcgcctggtggccgtatggggcctaggctggccagtgctgcccaatggtgggggctccctcaccgccygtctggcagaagccatgggccacacgctgtcccagcacatggtggcagggcggtgacctgggctcggctctaatgaccggcagccctggggctcccatcaccactaccagtctgcccaggaggcagcagagcactgagcccgacctgctcccctcgggcacctacgagacccacctgcccctccatgcgtgggggagaaggggtgccctctgctgtggaaagctgggacctactgtctgtggtgcgaggctgaccccacagagctccaggacaaccccgagaggagtggacagagccagc

SEQ ID NO: 57333 - DNA, 601 bp, Human
tcacagcacatgaaaatgagggggagaaaaaaacttaggcaagagaaatcctccagatgggccctggaggccccatccaagagtctgaggccaacacatcaggggaactggaagcagagagggaatcagccactggaaagaagtcacgcagacgaagtggtgacagccacgacaggaaattgctcagcggtggccacaacagagtggcagccaggggccaggggccagctctgtgaccatccccgagagagaaaggggacattcaggcctggtctatgatggtctggtggccggaggctcygtgagggcagccccagggccagaaggacctctcctgtgctgacagcaaagtcaccagcgggagtccagcccacactgcctttctgatgaggcctccagctctggctgctgactttaaaccctaaggaaccctgtgcagggcctgcatcccggaaggcctccaccagcccgaacctggcccgtccgccctagatggggcaatcggcgtttctcccgggacagcctcctccctggcctcctggccctcgtctgcattgagaggcttggcctctggtccgcatgctgcccttcccgtgctgtg

SEQ ID NO: 57334 - DNA, 601 bp, Human
atgtgtctgtctgtccttcctggaaaccttcagtggccccagtggcatggggactctccagacctgaggcccttgcgtgctgactatgaaagctcgcctatctacaggggcggcgctggctgcaggcagctctgagctttcctgtgacagtaagtgcctggcatgggtggggttgtggcccctgggctcctggtctgggagcctgcagggcatccgcaggtgaaaagcaggagtagtcattcctgcacatgctcagggatgaggccaggagggggagggagaggagcagtgggagggggggccacaggagcaccacaggtgccaagtgaccctcacaggtgccaggtgatcctcatggcccggcggcgaggaatcagacggcagaaacccactccccagcccaagggaagatggagggagcctctgccttggggctgactgggtcatcacccactgtgtgtgatgcacggagggaagggtcccgacagccggggctcccctcagcatctgggagttctgagagccctggatttgccactgtccttcgagcctccagcctctcagtagagatctcccctcctgtccatcaaggctgaatggt

SEQ ID NO: 57335 - DNA, 601 bp, Human
catgtgggctcccaggctcctggcttgctgatgtgtctgtctgtccttcctggaaaccttcagtggccccagtggcatggggactctccagacctgaggcccttgcgtgctgactatgaaagctcgcctatctacaggggcggcgctggctgcaggcagctctgagctttcctgtgacagtaagtgcctggcatgggtggggttgtggcccctgggctcctggtctgggagcctgcagggcatccgcaggtgaaaagcaggagtagtcattcctgcacatgctcagggatgaggccaggakggggagggagaggagcagtgggagggggggccacaggagcaccacaggtgccaagtgaccctcacaggtgccaggtgatcctcatggcccggcggcgaggaatcagacggcagaaacccactccccagcccaagggaagatggagggagcctctgccttggggctgactgggtcatcacccactgtgtgtgatgcacggagggaagggtcccgacagccggggctcccctcagcatctgggagttctgagagccctggatttgccactgtccttcgagcctccagcctctcagtagagat

SEQ ID NO: 57336 - DNA, 601 bp, Human
ctattcctttgaagcctggcattcattagagtttagacctttggctctctttggaggggagcaagggatgtgacacacagaacagagaatacaaggtggaaaaatacagaaatgaactgtgaagacactgtggactgagagtcaggacagggctaccgtaggcaggagaatcccaggttttacccagaggggtgtgggcagctgccctgtgcccggcaggcacagctgtggtggccacttggcaggagcaggaggaaaattccgaatcctgccgagtggagctggctgctgccgatgggcrgccttgggatttaaacatctcagcggggaaacctgatccacacagcacggaacacaaatgcccgtctcgggcttggtgccccagcagactatctgctctgatgaattcacagggttttgtttttttttctcttttaaagaagaaagccagcgtgggggagggcaagggagggctgctgtggcccagcctgcagggatgcgccacatttgcccgcagaggggtcggccccagggtcctcaggtctcactggcagtcatgctgtggtgcttggtaatttccaggttcacagcagagttcacg

SEQ ID NO: 57337 - DNA, 601 bp, Human
cacggctggtcttgtgtcctggcaacctgcccaaaaagacaccagcccctttgccaaggaattcctggccctcctccaaggcttggctctggaagcccccacaccacgggactgtcctcacccacgcatcgggaccctttctgtccacctgccttcatgtgcggggtgtgccgggcattcagtgagcacaggccccatgcctctgacccctgtccctttcctgcctgtgggttggtggctctcaactcagccacacagcaccttggaagcttcttaaaaatcccctcgttggccgggcgcrgtgactcatgcctgtaatcccagcactttgggaggctgaggcaggcggatcatgaggtcaggagatcgagaccatcctggctaacacagtgaaaccccgtctctactaaaaatacaaaaaaattagccgggcctgatggcgggtgcctgtagtcccagctactcgggaggctgaggtaggagaatggtgtgaacccgggaggtggagcttgcagtcagcagagatccagccactgcactccagcctaggcgacagagcaagactccatctcaaaagaaagaagaaagaaaaaaaaaatca

SEQ ID NO: 57338 - DNA, 601 bp, Human
ccacgtatcccatgtgtgcctggcgccaagggatgccgcacagagtgaggatggacagtgtgaggcccttcccagcacacagcgcttcatgaagagccgagtggctgccaggccctgccacaaatggaggctcccagagggaggccgcctgaggtcacaagcttggccctgccctctgggggccaagtgtcacagggtgtgccatctctgaagtcatcggcaaatttaacatcccgggtctgatcacttgtgtgaagacgtgcacacacggcctgggcaggagagtgaggtgttgcgtgcygtgggccatggcctgtgcccctggtgctccccaggtctgattggtgcttgcctgccccgagctgtcacaagacgtggccaagggatgccatgagggtccgtgtggtgccacactgcgttggctgtgtggggctggggggtgtccagcagggcagtcaggagtttaggacccagcctgggaggaagtgacccaagagcaggaagtgcgggggcaggagaagcttgagcctggggctctgcccacgccaggcacctggtgtaccctctagcccatgcctggaggtcacagcccaaggcacca

SEQ ID NO: 57339 - DNA, 601 bp, Human; identical to SEQ ID NO: 26359

SEQ ID NO: 57340 - DNA, 601 bp, Human; identical to SEQ ID NO: 26360

SEQ ID NO: 57341 - DNA, 601 bp, Human; identical to SEQ ID NO: 26361

SEQ ID NO: 57342 - DNA, 601 bp, Human
ggctggtagattctctttggcacagatgttggcaggtgcgaggaagcacggccctgacacgcgtggccaggccacatgtgcaaggcatgtgcggagcaagctggccagttggagcgggcttaggagttgcaaaggtaacgatgtgcctgtgcctgtggaccccaggctgacacacgcagcgcctagaggcagcacagtatatgcagtgtggcagggctgcaggagggcagtagaggtgccaggctgactcacacatatccatgtgcagagttgtgcagatgtgagccacatgacatgtgtstgcatgagtgagcgtgggtcacagaggtatgtggagtgattgcacacagctgtagatctactgcatgggaatacttgtgccaacctgtgggtcatatgtatctcagttgggattggtagtttctgcctcatgcacagggagtggggtgggggttaccccatgcctgagctgctcatctcttggggcctggaaactcactctatgtattaatgatgaggggacccacgtggaatctggagggggggttggagcccccacctggaagctgaaggaggtgatgatggtgaagaaatattgatt

SEQ ID NO: 57343 - DNA, 601 bp, Human
gagaagatgtccctctctccgagatgaatccatggccccaggaaagaggaaacagataggagactatggatgtttagagaggaaacacagtaaacatagccctgaacccagttcctcctcaatgttctccatagtgagcaccgaagctttctatttctgggttctgggagagggagagatgggggtaggggatggatagatgcttatgttgtattgttctttaaatacttcacctatggtgataagatgacacctttttatggcagatgggtctgatttatacactagctacttggagagkcgttagggagaactgaggcatagtgggcaacaaggcttggaatccaaatgtacttctcagtcctcctccttggctgcctctggccaatccaatttgctgggctctatgaagcacagccttggaatgagttctgggatgaagaaatggaaaaccagattgaactgatttttgttgggaggagcactgtgtgattcttgatagaaaatgacgctgcgttaatggtaaatgagctggggaaaggggcagataaggaagtagttgaaaggtaaagaagggccccaggtccataaatgggagaat

SEQ ID NO: 57344 - DNA, 601 bp, Human
ctctggccaatccaatttgctgggctctatgaagcacagccttggaatgagttctgggatgaagaaatggaaaaccagattgaactgatttttgttgggaggagcactgtgtgattcttgatagaaaatgacgctgcgttaatggtaaatgagctggggaaaggggcagataaggaagtagttgaaaggtaaagaagggccccaggtccataaatgggagaattcaggatggctcccctaacactagtggctcatcatacttaccttgcctgtattccaggtaacagggccctgcgaaagmgtgggtattactagtttcactatctcccacacatttctaaccaaaagcctttcctgaaaatgaattgttgtttcttcctttagtgtgagaagtgctcagtggtgagagaagaggattcccagaaggaggcatgaaacctgggaagagaagggagtagaggcatctgtctctccagagtgccttagctgagatgtccttacatgagattagggtggacaaggatccctattcttattgattagatcattctggtcttcactcacttcagcagtctggtccttaagaatgctagctttgtac

SEQ ID NO: 57345 - DNA, 601 bp, Human
acagagctccatgaagatgtgtctgtttttataagtggcatgtgtaataataaatatattgggaaggtgtgcacttacctgaatacctgaaattgtcctagttatgagatgatgtatgtgtgtatgtaggtaatgggataatacctatgtgtgatcttgtgtatgtatttgtgacactgagattttttgacattcctggggagatccagtggatgggaggaagaagctgagactgggtgcctcattggtttaaccctggcttttgccctctttttgtataggccccatggagtgatcttcyatggttcttaccagttttgaaaatcatgctgccattctcctttttctgtctatggatgtggagctgctgtgaagattgcagcataaactatggttccctggacctctggagaaaaaggagtgtcatttttctcatgccttggtggggacagttttttagtgctatcctcagcagattagtccttcttcctctgcttccagccatagcaaagggaatctcttctccctcggtttcataccccacttttccatcaaatgtctcctgtctctatttcctccatcagctttgtcttgaatgagg

SEQ ID NO: 57346 - DNA, 601 bp, Human
gagcaattgcagttctgagacatggtgagtgtgggaagcccaggggctgccataggtgggttctatgaacattggggaattcccttcggacatttatcccaagtccctaggcctgagggtatcatcagttataccacatcctattttagaaaatcactgaagtctcttagaatccaaatatcactctgcttgtccaggagcctcaggaggtggtttgaaaaaagacagaggattccacatttgaggttgcatttgccacctttgcccagaggaaggcgaaagaggttggggatgcatgggrctagaaggccaggtgagatgctcagtaggaaagaagcctgcacatctatataactacaccctgccagggagttcctgaaatcaaaggaatggtagcttccctatctcccagattcccccaacctttaaatctttctgccaccttcagactgggatggaggagcagaaaaccttgaaaacaggtcttccctctctttttgagtctttaaaggaatccttgagaatttgtgtccaactcctctgctctctctcattttctcttctttgattcttccatcttctcctttgcctcatctttctc

SEQ ID NO: 57347 - DNA, 601 bp, Human
gaagttgagtagctattttccaactctcttcaggatagcagcagagaaagagggacaaaaccaggacagcaggtggggtggaagtgagacaactggggagactggaagttgttagataatgaaattgtcccctaaggcagcaagactacatggtctgagagaactgtgggaccattcctccgttcctttgggaaggggcatagatgggaattgagcagggaaaaaagagtgactgagaagggaaaaggataaaatcaacttattatccatacaatgcagggaggtccttagtgcccctgcycttgcccctgtgccctagtatcccccagtcctgcaactgctccttttccctcagctggggttgcatctatggagcttatcgctgtctgagaagaaaacaccaggtccagattccacttcagcactcagacctggcaaaggtgcactgagggagatgtgttggggttttggtagagaggaaggcttggtgggaaaagggtcaggttgtttttggggtaaggcctgggggcatagggcatggagaagagctagaaagggggtgcttcaggtggtgctgttggaaagagccagacttccaggt

SEQ ID NO: 57348 - DNA, 601 bp, Human
ggaagttgttagataatgaaattgtcccctaaggcagcaagactacatggtctgagagaactgtgggaccattcctccgttcctttgggaaggggcatagatgggaattgagcagggaaaaaagagtgactgagaagggaaaaggataaaatcaacttattatccatacaatgcagggaggtccttagtgcccctgcccttgcccctgtgccctagtatcccccagtcctgcaactgctccttttccctcagctggggttgcatctatggagcttatcgctgtctgagaagaaaacaccargtccagattccacttcagcactcagacctggcaaaggtgcactgagggagatgtgttggggttttggtagagaggaaggcttggtgggaaaagggtcaggttgtttttggggtaaggcctgggggcatagggcatggagaagagctagaaagggggtgcttcaggtggtgctgttggaaagagccagacttccaggtcagttgattccacagctgcagtgagaagtcagatttgcaaataattatggtggctacagtggggtgattaggctgccagctggtgttggcaccatttaggttg

SEQ ID NO: 57349 - DNA, 601 bp, Human
ggggtgattaggctgccagctggtgttggcaccatttaggttgggaagggaacttggctggtggggggttgagggctgggggctgggggctgggggctggttgtagggagaggctgagtgattctctggcaggcaggacctggggaaagtttttccttttattcctatttgttggcttccctgctcccctgtttatcaactcctgcatatctgcttggcaccatgtccctagttctcttctctgtgcccaccttgtttggaaacttcttgtggcctggactgagtgaacacacaggccaamggaattgccaaacttcctaaaccatgagcatctctcttccaagcaattgctttagaaattccaatctggaagatgtataataaatcaaattgcactagacacctcaaagacttcttggtccctcctattctctccccttctgctcttctttgaaatgccaagaaaatttgctgttgttttttaaattgcagtgaaataaattgaagacagatatgcaggagaacttcctggaaagttcctggaggttagactgtggcctttctctgataaagaaaaaatctacccttctcctctaagcac

SEQ ID NO: 57350 - DNA, 601 bp, Human
ctgggttagagctgatttggggaagcagtgagccagtcagaaaggatgaactctggaactgggaaattgaggcccaagcatcctacttccccagtgtctccaacccagtccctgaatctgagaaccataaaggctacagaggaggaacagatccccagagatagttagtaaaatcggggcagtgctgggaccagacccaaatcctgctgatccataatctgatgctgccctcatcacacttgcagtcagactcttgctaagcttttaatttactttcccatcccagactaccttcaacatytgttaggccccatggaagcagggcatctgctgggaacagctgttaggatgtagtttggagggctggtggggtggtccatgtggaggtggttaatgagcaaaatcaaatggtgtagggagggaggagaggggtggagaaatgaaccagagaaagagttcttctggactgggtactgggagcctcctctttagtttgccttcctctgaccttctcacccacccctcccaattcctctctctctcaagggctgaagtctgatggaaaggtgactcatttgtgttcttggctgggagctgggac

SEQ ID NO: 57351 - DNA, 601 bp, Human
ccataaaggctacagaggaggaacagatccccagagatagttagtaaaatcggggcagtgctgggaccagacccaaatcctgctgatccataatctgatgctgccctcatcacacttgcagtcagactcttgctaagcttttaatttactttcccatcccagactaccttcaacatctgttaggccccatggaagcagggcatctgctgggaacagctgttaggatgtagtttggagggctggtggggtggtccatgtggaggtggttaatgagcaaaatcaaatggtgtagggagggagragaggggtggagaaatgaaccagagaaagagttcttctggactgggtactgggagcctcctctttagtttgccttcctctgaccttctcacccacccctcccaattcctctctctctcaagggctgaagtctgatggaaaggtgactcatttgtgttcttggctgggagctgggacacctgggttcttattggtctgggctgaggctcaagctgcttagattattccctttctcgtgtgatctgagttgtgctgggctgttgctaggaacacctgttagaaacggcttctggtcagaagg

SEQ ID NO: 57352 - DNA, 601 bp, Human
gaaaaagaccctgaaagggagctgaatctgcttagctccttttgggggttcttgcagggccccttcccctcccgctacagacctcctctctgtgacagattcaggatggttccctgtccctgcactcttaagcctcttgctaaccccctttttcccaaaagaggagccccacctcctcagagcaaggggctggcctgtgctatttctgtcctttctgggcttcttctgagaacagattcttgttttccgtctgattcagatgtgaaacttttcccgcagcctcccctctcacccagttcckgtaggctgggtctctgcctccccactctcttcttcctgcagccaggcccctccccaaagttctctctggtcagttgctcagttctactgggacctggaggaggaaggcaggggccaaagaggaagttgtcccctcttgggggccctggggctcccggggtcaggattttgatactctgaagcaggaaactttgattcccatggcaaaccctgttcctgttcagaggagccacctccagggccccattctcaggtaggtgccagggatgagaagaggaagggggaggagggagaggacagg

SEQ ID NO: 57353 - DNA, 601 bp, Human
ctcagttctactgggacctggaggaggaaggcaggggccaaagaggaagttgtcccctcttgggggccctggggctcccggggtcaggattttgatactctgaagcaggaaactttgattcccatggcaaaccctgttcctgttcagaggagccacctccagggccccattctcaggtaggtgccagggatgagaagaggaagggggaggagggagaggacaggttgctcatggatccaccagttgtagtttagtgaagtggagagatcaagacctggcagtcccccatatgttttgtgcttgtgtgtgtgtgtgtgtgtcgcgtgccaacttcaccttttactctgtccatcttgccctttaccttattctcctcccatttccatccccccccacctttttaaaaattgcttcttcttgactatggtaggtgacttatcattgtttcttccttttctctccttcctgactgccaacatccttaggacctcacattccttcgaaatttcatcttgtcttaagaacccaaactggaaatagaattcttctcttgactcccatcccctatcttattctaaagtccttcagagttagaatctcc

SEQ ID NO: 57354 - DNA, 601 bp, Human
agggagaaatagtggtaagagataaagaagcagaggcagacatagagatgcagagatagagacaaacacagatatcaagaaggacagaagactgcttcagagttggaagggaccttaaagctcatctattccactgtggaatacctctagatgtgtgctgcccaacatgggagccaccattctgggtggctattgagcacctcaaatgtggcaagtatgaactgagatgtgtacataaaatacatgatggatttcaaagacttagaaaaaagaatgtaagatattcatatatatatatatwtatttttttgttttgagacagagtttactcttgttgcccaggctgaagggcaatggtgtgatcttggctcaatgcaacctctgcctctggggttcaagcaattcttctgcctcagcctcctgagtagctggattacaggcatgtgccactacgcccagctaatttttgtatttttagtagagatggggtttctccatgttggtcaggctggtctcgaactcctgacctcaggtgatctgcctgccttggcctcccaaagtcctggggattacaggcgtgagctaccgcgcccagccgata

SEQ ID NO: 57355 - DNA, 601 bp, Human
ggagaaatagtggtaagagataaagaagcagaggcagacatagagatgcagagatagagacaaacacagatatcaagaaggacagaagactgcttcagagttggaagggaccttaaagctcatctattccactgtggaatacctctagatgtgtgctgcccaacatgggagccaccattctgggtggctattgagcacctcaaatgtggcaagtatgaactgagatgtgtacataaaatacatgatggatttcaaagacttagaaaaaagaatgtaagatattcatatatatatatatatwtttttttgttttgagacagagtttactcttgttgcccaggctgaagggcaatggtgtgatcttggctcaatgcaacctctgcctctggggttcaagcaattcttctgcctcagcctcctgagtagctggattacaggcatgtgccactacgcccagctaatttttgtatttttagtagagatggggtttctccatgttggtcaggctggtctcgaactcctgacctcaggtgatctgcctgccttggcctcccaaagtcctggggattacaggcgtgagctaccgcgcccagccgatatc

SEQ ID NO: 57356 - DNA, 601 bp, Human
catgatggatttcaaagacttagaaaaaagaatgtaagatattcatatatatatatatatatttttttgttttgagacagagtttactcttgttgcccaggctgaagggcaatggtgtgatcttggctcaatgcaacctctgcctctggggttcaagcaattcttctgcctcagcctcctgagtagctggattacaggcatgtgccactacgcccagctaatttttgtatttttagtagagatggggtttctccatgttggtcaggctggtctcgaactcctgacctcaggtgatctgccygccttggcctcccaaagtcctggggattacaggcgtgagctaccgcgcccagccgatatctcattaatatattttataaggctgggcgtgatggttcatgcctgtaatcccagcactttgggaagttgaggcagcctgattgcttgagcccaggaattcgagaccagcctgggcaacatgatgaaaccctgtctctacaaaaaataagaattagctgggcatggtgatgtgcatctgtagtcccagctacttgggaggctgaggggggaggatcacctgaatctggggaggttgaggttg

SEQ ID NO: 57357 - DNA, 601 bp, Human
gaccctgtctaaaaatacacacacacacacacacacacacacacacacacacacacacacacacacacacggtttcatgttgaaatgatattttggaggtattaggtaaaataaaatttattgccgggcacggtggctcacgcctataatcccagcactttgggaggctgaggcggatggatcaactgaggtcaggaattcaagaccagcctggcgtggtggtaggcacctgtaatcccagctactcaggaggctgaggcaggagaatcgctcgaacccgggaggcggaggttgcagtgarccaagatcgcgccattgcactccagcctgggcaacggagtgagactccatctcaaaaaaaaaattatcattaaagtcaatttcacctatttctcttttcctttttaacgtggcctactagacaatttaaaatttcatatatgcggcttgcattttatttctattggatggtgctgctctatagcatccctgaaagatgcgttccatttcctgcttaaacacttccatagttgggatgctcactacctcacatggagacctgtttcattattggagatgttagataaagaaataaaaagat

SEQ ID NO: 57358 - DNA, 601 bp, Human
attaattgatttctagggggagattctcggtctgcaaccatctagcctgggattctgctctctcccgctttgcttttttcccccaacttgtcctctctaggctgacttgcagtgtggacactggaggcctggagttcagatgctgtcagccagtgccctttgggactagaaaccatgtttcctggataaaattggccactccctcccccgtcccccagttctggtctctgtgcaaggaattatatagagaaggtcagctcttgacagggctcggggcgggggcttgtatgacagggggacrgtgtgtgaacttcatttgctcttcagcttgtctggatgggaagaattatatgagattaagtccttcctagatcctgtaccaggagggagcatcttttgggagggaaaaagtgccaggaaaaaaacaaaacactttcacatggacaaatcacatttggaagtagagggtgagggaggttgaagagccgtaatggggatattgggtcagcactttggggagcagtagatgttaaaggtgaagggaaacgtggatgatctgaagggccatagagaggggcggtcaaaggagtccaggtggagg

SEQ ID NO: 57359 - DNA, 601 bp, Human
agaggggcggtcaaaggagtccaggtggagggtcccctcccaggccggcttcgggaggtcattccatccatcctctgcctccacttcactagaacaaattatctgtgcatgtaagcccttccttcacccttgactcctccttttacaacaactccctagggagtttccaaaactttcctgagatgctcagctgaaattttcttaagtgccttccggaagcctgttctgcaattttactttcttctttccaatcctgccctctccaggacagagaatagtagggctctctttttcctaagamttttcccagctcatgtttccccaaactggctctcagacttcagtcactagattctcctaaactctgcctccttacctggaaggactgggtctgggggacctcaagagtagctgttttgggttaggtttggcccagtcccagtctgctttgctccaaggcagttagaggaaggagggggtgcttcttgttttagttttctctgatgatagggccagcagcagctgcccttctcaaactccacattcttttcctgggcacctagcccctcccctactcctccctttttcttcccttccctcc

SEQ ID NO: 57360 - DNA, 601 bp, Human
gggactgattgcttctctttttatgtccgctcagagaactccgagccctggtcattgagatggtgttggccacagacatgtcctgccatttccagcaagtgaagaccatgaagacagccttgcaacagctggagaggtggcatctggtggggtgtggctggggccaggccagagggaggggtgtgtgaactgggggggtatacacaagggtagttggtgtgccaggtctttacctcgctgtagagactccactggcttcaggtatcagactgcatctctatgtgagagagagagagagagwgtgtgtgtgtgtgtgtgtgtgtgtgtgtgtgtgtgtgtgtccttacgtttactcacagccttggcagctgatccactggagagtgctttgggctgggaatctaagatgggggttctcatcgtagctctgggacaggcttactctggaatgttggaaaattcattcaacccttctgccccagttttattacctctgaaatggtgaaaatgatacgcctccccccacaacagcttgcccctagttcctagtctcatagggctattgggagagtcatacgaggtttaaaaaaatgcatagaac

SEQ ID NO: 57361 - DNA, 601 bp, Human
ttgaagttatgtgaggccgggcgtggtggctcatgcctataattccagcactttgggaggccgaggcaggtggatagcttgaggtcaggaatttgagaccagcctggccaacacggtgaaacactgtctctaccaaaaaaatacaaaaattagctgggtgtggtggcatgcacgcctgtagtcccagctattcgggaggctgaggtgggagaatcacttgaacccaggtgacagaggttgcagtgagctgagattgtgccactgcactccagcccgggcaacagagtgagaccctgtctcaaaaaaaaaaaaaaaaaaaggaagaagttatgtgatagggtgtgcgtgggaagttagggaatggtcctaacttccttttcctaaaagatcagtctcccttcccttgccatctgccccaaccaggattgacaagcccaaggccctgtctctactgctccatgctgctgacatcagccacccaaccaagcagtggttggtccacagccgttggaccaaggccctcatggaggaattcttccgtcaggtagcgtggcatctttgccttccctgtgcctatgggggccttctctccccttttgcc

SEQ ID NO: 57362 - DNA, 601 bp, Human
ggccatgccagctgcatgctctgcctagccctccagataatagtaagacatctctacggcattgctcctccactgcagggttcatcgacttcattgtggagcccacattctctgtgctgactgacgtggcagagaagagtgttcagcccctggcggatgaggactccaagtctaaaaaccagcccaggtgagggtggctggggtagccagatatcttggttcaggaaggcagtggtagggagggatttggactcacagagaggaccgactcacagccatggtggggtggtggggaggcagrctgcttcaagcttgggagtccctctgccgtcagggacagaaggatgggatcagaagggtgtgacctgtacctatgctccccttcaccatatttttgtttcttccattagctgtctttctgccttctggctaatcttgttttaattttccttctaccaggagggaagatgtggagagggaggggtgaaatgagggggagagggacagggacttggggaatatctagtagaggaaaagaggaagatgaagttccctgaaccttctcctggtcttccatgtcctgcactcccagggctaaggt

SEQ ID NO: 57363 - DNA, 601 bp, Human
tgtgaagaagaggcccccccatcccctgccgaagatgaacacaaccagaatgggaatctggattagccctggggctggcccaggtgagcctgttgtggtggagggtgtaggagagctggtgtctatcatggcatctttgttgggtcgtctctgggctccagtggatgcgacattctctctccccttttgagcagtaaaatggagcgagtgaagacatagaatggagccaaagtgtgggtggagcagggaaatcctcccacgctcttctgtcccccagtccctgcaggaacaaaggaggtascttctcagaacagcagcagaacagggtgggcccatgccaggtgacagctaacctgcaccgcaccttagggagggttagggaaaaggagcccagccagggcacacagctcagtgagggcagctgaacgtgacttcgacttcagcccctattcacccccttggctgggcacccttctgaagggcattttttgcacagctctactcgggactgagtggggatcaggacttggagaaggaaggtcaggttggaggtgaaggcaaagctcagggcactgaagtttctccctctttccccaggtct

SEQ ID NO: 57364 - DNA, 601 bp, Human
tgttttggatatctttgaatatcagtctatagagacttattatttttaacagttgaataatattacattatgtggttgtaacataatttatttacaaaatcctctattgatggatatttaagctgtttccattttaaaaaatcattgtaaacaatgctgtaatgaacattcttaggcatatatctttgtgaatctgtgaatatttttttattttctttttttttttgagacttgagttttgcccttgttgcccaggctggagtgcaatggtgccatcttggttcactgtaacctccacctsccgggttcaagcgcttctcctgtttcagcctcccaagtagctgggattacaggcatgtacaaccacccccagctaattttttgtatttttagtagagacggggttttaccatgttggccaggctggtcgcaaactcctgatctcaggtgatccacccacctcggcctcccaaagtgctgggattacaggcgtgagccaccgcgcctggccttgaatctgtgaatatttctataggctaaattcttagaagtggaattgctgaagtaaagggtatgtacatttcaaattttaatagctctt

SEQ ID NO: 57365 - DNA, 601 bp, Human
gggattacaggcgtgagccaccgcgcctggccttgaatctgtgaatatttctataggctaaattcttagaagtggaattgctgaagtaaagggtatgtacatttcaaattttaatagctcttaccaaattgtgctctaaccagttattatcaagagcctataagaatactgatttctcacactctcaacaactaagtattgtcattaaaaaccattgccagagttagaaagagtaaatctgagattaataattagaagttacaggaggtggatttgggcatatgcatgaaaaaactttctratgattactgcttctaaggaatggaagagatgttcgaagggtgttcagttctccatcactaagagcagcaactaacttgtgtgatttatagtttagggagttctttgacataaatgatctaatttatcttcatgaaaattcaagaataagtattaatatctttttttataaatgagaaaatggaggctcagtctcagtgtcactcaataagaggtgaaattaggacacaattccaggtttctggactctgaatcttttctctttccattgtgctatgcagagattaaaataattatccaa

SEQ ID NO: 57366 - DNA, 601 bp, Human
caggacaagagaaaacaaatataaggaacatagagagcaaagagtctaagataatgctgggattctgagcatgggtcactagtagaaaaaaagagatgtggttaggagaatcaaatattgcagaaaattaaaaacaatgaaaaggccttctaatttggtgattcaaaagttcacattgactttagagagagcagttgcttagtgctgaaggctttgtgggattcaagggtcagtgagaggtgaggaagtagagagagtataggtgtctctttagagaagtttggtggtgtgggaaaataarcagaattcggtggattgtcagggtcaagcaaggatcttcttagaatacgggaggctttgaacttatttgttgggagaagagaataagccagtggagaaggagagattaaagtattaaatagataactgatacagtgaaattctaaaaggaagttggtgggaatgggacccaaggtagagattgagtaactacttttacttgagagcagggcctgtgttgtatttatacactgctccctttaaccccctcaaacctggaagagtaccttgatttgaaggagtcaaggcaggagcacaggaa

SEQ ID NO: 57367 - DNA, 601 bp, Human
agataatgctgggattctgagcatgggtcactagtagaaaaaaagagatgtggttaggagaatcaaatattgcagaaaattaaaaacaatgaaaaggccttctaatttggtgattcaaaagttcacattgactttagagagagcagttgcttagtgctgaaggctttgtgggattcaagggtcagtgagaggtgaggaagtagagagagtataggtgtctctttagagaagtttggtggtgtgggaaaataaacagaattcggtggattgtcagggtcaagcaaggatcttcttagaatamgggaggctttgaacttatttgttgggagaagagaataagccagtggagaaggagagattaaagtattaaatagataactgatacagtgaaattctaaaaggaagttggtgggaatgggacccaaggtagagattgagtaactacttttacttgagagcagggcctgtgttgtatttatacactgctccctttaaccccctcaaacctggaagagtaccttgatttgaaggagtcaaggcaggagcacaggaagagaagtctagccccacctttgccattaaagccctatgtgaccttgac

SEQ ID NO: 57368 - DNA, 601 bp, Human
taggctggactctctgaggactgggaaggtgaggcaagggccctaatgggtagcatggtcaaccccattgtgcttgtgtcaatcctcaggtatggcaagagagtggcagacataaaggagagcaaggaacatgtaattgcaaacaggtaaagggtggtgaatgcactctctgagaggggatggaataggaatctcttctcacttttgttctcacctaagccatccttagtttctgtacagctttattgcctcaacccaagaacttgctgctaccccataaattcttttttcttttcttttsttttttttttttttgagacagagtctcgctctgttgcccacgctgggtgcaatggcatgatctcggctcactgcaacctccatctcctgggttcaagtgattctcctgcctcagccttctgagtagctgggattacaggcacccaccaccacgcccagctaatttttgtatttttagtagagacagggttttgccatgttggccatgctggtcttgaactcctgacctcaggtgatctgcccacctcggcctcccaacgtgctggaattacaggcaagagccaccactcctggccctttt

SEQ ID NO: 57369 - DNA, 601 bp, Human
ctggggacagggaggcatcagatgaccttaggaggtctcaatttctgccctgatatcactgtgtttgtctcagttcatatttctagtcttattcatctctgttctcatcctaaactttataggagcattgcagagctacttttcttgttggaggggattaggtctctggtccgaagacacatcaaagtgatacagcaataccaccttcagtacttggcaagatttgatgctcttgtgctcagtgacatcattcaggtatgatatttaattgattatactttggaaatttcaggatgatccytagtgattttcctattgaaaccactctggctgaatctcatgctctgtaagttgggtgtcaaaaggtccaatctaggctgggcgcggtggctcacgtctgtaatccaagcactttgggaggcctaggcgggcagatcacgaggtcaggagatcgagaccatcctggctaacatggtgaaaccccgtctctactaaaaatgcaaaaaaaattagccgggcatggtggtgggcacctgtagtcccagctactcaggaggctgaggcaggagaacggcgtgaacccgagaggcagagcttgcag

SEQ ID NO: 57370 - DNA, 601 bp, Human
ggcaagatttgatgctcttgtgctcagtgacatcattcaggtatgatatttaattgattatactttggaaatttcaggatgatccctagtgattttcctattgaaaccactctggctgaatctcatgctctgtaagttgggtgtcaaaaggtccaatctaggctgggcgcggtggctcacgtctgtaatccaagcactttgggaggcctaggcgggcagatcacgaggtcaggagatcgagaccatcctggctaacatggtgaaaccccgtctctactaaaaatgcaaaaaaaattagccrggcatggtggtgggcacctgtagtcccagctactcaggaggctgaggcaggagaacggcgtgaacccgagaggcagagcttgcagtgagccgagatcgcgccactgcactccagcttgggcgacagagcgagactctgtctcaaaaaaaaaaaggtccaatctgccccttcatatttgttaaaagaaaaagaaaggactaataatctcagccgtctttttttccccactaagtgaaattacatagaaataggagagaaaaataaagagaaactggatgttagaatggcagggaacccgga

SEQ ID NO: 57371 - DNA, 601 bp, Human
tacatgaagttgagaggacatgggttgaggaaagatcagtctcatgggattaatttgagaagattttctggagcctgagtgttaaattttgagaagaatgtgaattaacactactgaaggacttctaaattagggggaatggcccaaatcatgccaaggttctaagggaagaatagcaaattttgtgcaaggaaagggaagaagattatcattaaacttgcctggggtcctttataaaagtctggaaggattaagtttcttgggttccgttctatcttaagggttacagaaattaaggagrgagtggtaaatatcggtaaatgttttttgaaagaatgaatatcctctccgcctcaaagggactagctcttaaactctatttttcttttcctttatttttcactcaccactttactaataaggactaaatcttgatttaaagtcttcccgtttctctgcagctttcatcttcgtatctttgagaagatgtttgccatgaccttggaggaatctgccatgttgcgttatgccattgctttccccctgatttgtgctcactttgtccactgcactcatgagatgtgcccagaggaggtaggta

SEQ ID NO: 57372 - DNA, 601 bp, Human
aatgaatatcctctccgcctcaaagggactagctcttaaactctatttttcttttcctttatttttcactcaccactttactaataaggactaaatcttgatttaaagtcttcccgtttctctgcagctttcatcttcgtatctttgagaagatgtttgccatgaccttggaggaatctgccatgttgcgttatgccattgctttccccctgatttgtgctcactttgtccactgcactcatgagatgtgcccagaggaggtaggtatcctgatctccagaccctgtcatctttctagtcrtcatccttatcacccaaaacacaattccaagggttgattttggtcccagaaagggtataaacatagatgtatgatatgagtccctaaatatctcagcttgatgtatcctgtctctgggcctcagtttcttcttctgtaggaatgggtaggaatcttctgtaagattcaggcaagggatgagagcagtattgtgaggaagaagtggccgtgctggtgatgacagtctcttctttggtccctctttcccatagtacccccacctcaagaaccatggtcttcaccactgcaactccttcctgg

SEQ ID NO: 57373 - DNA, 601 bp, Human
aggtcacctgtcttatctcatctttctgtctatctgcatcttaatctgtggctctctggacattttgaagcacctcttctgtgtttatcctcaaggctgctttcttgcctttttcttcttatttttcccctctcctcccttgactgactcttagcacctcgtcataattagttcaacctaaatttcagaaaatttgaaaatgagaaacttgttttgctgttgccctggagtcttctgggttttccagactacccacctttcctgggtttgagtcaggcttggtaaaggggagtgtgtgtatgtgtgtgtgtgtgtgtgtgtgtgtgtgtatacagatgcacagttacattattacttaacctttttatttttcatatgcaaattacatacaatggggataaaaatagtttctttacagaagtgtcttaaggattaaatagggtatatttaatatttgacataaagcactcaataaatgttacctgctatattagttggtacttaccgggcacaaagccctgtgctgggtttttggggacccagaaggaaggtacacaattcctgcccttggggaatgtcccagtttaagagaaaagggagt

SEQ ID NO: 57374 - DNA, 601 bp, Human
aaacctctataggtggttttgatgaacaccctaaattgaaaccactggtttagtagaatgagcaaggcctttgcagtgagcagacctgtgttgacaacctggtcattagctaagacattggagcagatcgtccaacttatttgaaccagtttctttccttgtaaagtaaggataatggtatttaccttatttatggataattgagaattacccataattgagagttggtagagaattaaagttagtaatgagtgcaaagctcctgacatatgttaggctttaataaaatacatccctagcytccactttgcgcttcactccattgccccataaagtaagatgcacattggaattgggcactacagtctgcaagtgggtgaatgggaggaagaattattatgaataagtctcagcacttctgtgttttcttttggagtatgtagcttattcattcattcaacaaatgtttattgaacacctgctgtgtgtcaggagtattctaaaagctgtttatacagcaatatacgaaacaaataaaaacctctgcctccatgcttacttctagtggggaagatagataaacaaaataagaaagcagaat

SEQ ID NO: 57375 - DNA, 601 bp, Human
tcttcccttaagtggtacttgagaaccttttccctttcatttgtggagcagaccagccccacctttcccatcccctcccctgccataagcattttgccaaaaaacacaaaacaaacaaaaaactacctctttcctctgtggtttacattttaacaaggaaaaaagtccttagtcagaggactgactctaattgtgaaatctcagatacttgggggaggtattttgaaaggagttgggggtccagtggtgaggggtcttgctggtgtgcccctacaataatatagtgtggatagttattctmccctctctaatgttgcctatagctgcatgccagccacgcatgatctctattcagccctggcgtgccatggctactcaggattataatatacttccaaggatttctaagcatggttttccatttctggcagtgatcggaactaattcttttcaaggggaaaagataaatactttcactgggaatgcagagggtgtgaactgtcaggtagagttagatggaattagagagcccaggtcttctactacctgagctatttctccagaggaggaagaaaagcacagtaattagggatcaaatgtt

SEQ ID NO: 57376 - DNA, 601 bp, Human
tgccattatgattgtaattctaattttttttttttaaatcacctagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtcagtgttgcttaggcttttccactgccttacttygtgttggcactttttcctttacacggtaggacctcagggcccgagcattttagctcccagggtcatagactccaaaatggagggttgcttctccttgaggaatggagcaataacctgagacaagcccagatccccttctgtccaccacgaagtttccttctcaccctcactggaacatccttcagcctaccctgcagttatttgaccttttctctctaatatctagttcttaacctttcttttttggattcttactgtttcaatttcaaatgatctctcttcctctttccaaagttctct

SEQ ID NO: 57377 - DNA, 601 bp, Human
ttttttttttaaatcacctagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtcagtgttgcttaggcttttccactgccttactttgtgttggcactttttcctttacacrgtaggacctcagggcccgagcattttagctcccagggtcatagactccaaaatggagggttgcttctccttgaggaatggagcaataacctgagacaagcccagatccccttctgtccaccacgaagtttccttctcaccctcactggaacatccttcagcctaccctgcagttatttgaccttttctctctaatatctagttcttaacctttcttttttggattcttactgtttcaatttcaaatgatctctcttcctctttccaaagttctcttatttctctttttgcccttacttct

SEQ ID NO: 57378 - DNA, 601 bp, Human
gccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtcagtgttgcttaggcttttccactgccttactttgtgttggcactttttcctttacacggtaggacctcagggcccgagcattttagctcccagggtcatagactccaaaatggagggttgcttctccttsaggaatggagcaataacctgagacaagcccagatccccttctgtccaccacgaagtttccttctcaccctcactggaacatccttcagcctaccctgcagttatttgaccttttctctctaatatctagttcttaacctttcttttttggattcttactgtttcaatttcaaatgatctctcttcctctttccaaagttctcttatttctctttttgcccttacttctccttctgaaaaccatctgcctactaccatctctctggaacgtctccttgtccccagatgtgactattgttct

SEQ ID NO: 57379 - DNA, 601 bp, Human
aaccactggattcctgtggggaacagacaatcaccacactctacacaaactggtcagtgttgcttaggcttttccactgccttactttgtgttggcactttttcctttacacggtaggacctcagggcccgagcattttagctcccagggtcatagactccaaaatggagggttgcttctccttgaggaatggagcaataacctgagacaagcccagatccccttctgtccaccacgaagtttccttctcaccctcactggaacatccttcagcctaccctgcagttatttgaccttttcyctctaatatctagttcttaacctttcttttttggattcttactgtttcaatttcaaatgatctctcttcctctttccaaagttctcttatttctctttttgcccttacttctccttctgaaaaccatctgcctactaccatctctctggaacgtctccttgtccccagatgtgactattgttcttaatagagaagggagcctcctccctgcaactggagaaggtgggaatcagcactgtttcctttgacatgttaaggaatggaaaggagctggatttctacctccccaagccactgggt

SEQ ID NO: 57380 - DNA, 601 bp, Human
aagtctgcttagacaggcaagcagtgggaccatcatcctctccccagccatgcaggccttcgtcagcctgcccagagaaggggagcagaacttcagtgcagaggagttctctgacatctctggtgagctcagggcctggtcttcttgtcaaggagctgagcccttccttcaatgcacagagaataaaagactaggacatgtatttaggttggtgcaaaagtaatttttgcaattacttttcattgcaaaaaccacagttacttttgcaccaacctaatagtgaagggtaagggataaagtrtaaggaggacattctcctgtttggaattattaaatagtggtctgctgtcatggcatcttcttcttcttcttcttcttttttttttttgagatggagtctcgctctgttgcccagggtggagtgcagcggcactatcttggctcaccgcaacctgcgcctcccgggttcaagcaattctcctgcctcagcctcccgaatagctgggactacaggcaaatgccaccatgctggactaattttttatatatatatatatttttagtagagatggggtttcaccatgttagccaggatggtctc

SEQ ID NO: 57381 - DNA, 601 bp, Human
gtcaaggagctgagcccttccttcaatgcacagagaataaaagactaggacatgtatttaggttggtgcaaaagtaatttttgcaattacttttcattgcaaaaaccacagttacttttgcaccaacctaatagtgaagggtaagggataaagtataaggaggacattctcctgtttggaattattaaatagtggtctgctgtcatggcatcttcttcttcttcttcttcttttttttttttgagatggagtctcgctctgttgcccagggtggagtgcagcggcactatcttggctcacygcaacctgcgcctcccgggttcaagcaattctcctgcctcagcctcccgaatagctgggactacaggcaaatgccaccatgctggactaattttttatatatatatatatttttagtagagatggggtttcaccatgttagccaggatggtctcgatctcctgaccttgtgatctgcccgcctcagccttccaaagcgctgggattacaggcatgagccaccacccccagccagcgtcttatgctttagggatacattttagagtcttagccagtgtttggattgctgatgtttaataat

SEQ ID NO: 57382 - DNA, 601 bp, Human
agggatacattttagagtcttagccagtgtttggattgctgatgtttaataataacgatgatgagatgatacatgacatttattgtgggctaagttctaagtgtttatacatattaactcacttaatcctcataacagccttggggtataatagatacacttattcccgtttttcagatgaggacactgggacacagagagtttaaggaacttgcctaagtccacacattcataaatagtaggacttggagttcgactccaggcagtcaaactccaggaactgggggcttaagcactgtayagcgctgccttccagtgtctagaagtgcttttgtgtctcagggggagacaggtaaggagtgtgtagtgaatgagatgggaagcctttccctttctcaagagggtttgaaactacaagatcctttttaataggtttgtttttaccaactaattcatgaactatcctacttctttctccttcctctcacctccatataaatcagggacgctgcatagtatctgggacagggtgaagatgttccagtgacgctgtcctctccagtcttcttctttggggggtgctaagaaagccaaagtacac

SEQ ID NO: 57383 - DNA, 601 bp, Human
ataataacgatgatgagatgatacatgacatttattgtgggctaagttctaagtgtttatacatattaactcacttaatcctcataacagccttggggtataatagatacacttattcccgtttttcagatgaggacactgggacacagagagtttaaggaacttgcctaagtccacacattcataaatagtaggacttggagttcgactccaggcagtcaaactccaggaactgggggcttaagcactgtacagcgctgccttccagtgtctagaagtgcttttgtgtctcagggggagrcaggtaaggagtgtgtagtgaatgagatgggaagcctttccctttctcaagagggtttgaaactacaagatcctttttaataggtttgtttttaccaactaattcatgaactatcctacttctttctccttcctctcacctccatataaatcagggacgctgcatagtatctgggacagggtgaagatgttccagtgacgctgtcctctccagtcttcttctttggggggtgctaagaaagccaaagtacacagttctgttttccagttctgcctccttcccatcatcccgcctccatca

SEQ ID NO: 57384 - DNA, 601 bp, Human
ctactgtggacaagactctgtgtcagtggctgtgaccagttccatttcctctgtcactgatgaaggtggagatcactggtcctgctttgaaagacttgagtgtggagccttgacttccatttctctctgaactcttattagcgatattaaacttgcctttcttctactggtctcttgttgttgttacttctggtctttcatggttttccctgctgggatggcccacagccagagatcatagctagagctccttcctatctggatttgtcactagtgtttctgacatgggatttccccaggyaggctttatttaattcacaaagggccagagcaggctgggtggcaagggataaagcactgggactactagagaaaagaaggatttagaggaataaagaactgagactctgcgggatgtgtgttgattatgaaaaaagaaaaggtagctcaaggagaggaaaatttggacagtgggacactaagtaagggaagtaaagggaaaaacatacaataaacatcagatcttagatgaggaaatagttgtatctgctgggatgcagtaaggggcagtaagacattgcactaggcttccagtaccagc

SEQ ID NO: 57385 - DNA, 601 bp, Human
accagttccatttcctctgtcactgatgaaggtggagatcactggtcctgctttgaaagacttgagtgtggagccttgacttccatttctctctgaactcttattagcgatattaaacttgcctttcttctactggtctcttgttgttgttacttctggtctttcatggttttccctgctgggatggcccacagccagagatcatagctagagctccttcctatctggatttgtcactagtgtttctgacatgggatttccccaggcaggctttatttaattcacaaagggccagagcagrctgggtggcaagggataaagcactgggactactagagaaaagaaggatttagaggaataaagaactgagactctgcgggatgtgtgttgattatgaaaaaagaaaaggtagctcaaggagaggaaaatttggacagtgggacactaagtaagggaagtaaagggaaaaacatacaataaacatcagatcttagatgaggaaatagttgtatctgctgggatgcagtaaggggcagtaagacattgcactaggcttccagtaccagcccctgctgtggttaagtggctccggacaagcact

SEQ ID NO: 57386 - DNA, 601 bp, Human
tgggactactagagaaaagaaggatttagaggaataaagaactgagactctgcgggatgtgtgttgattatgaaaaaagaaaaggtagctcaaggagaggaaaatttggacagtgggacactaagtaagggaagtaaagggaaaaacatacaataaacatcagatcttagatgaggaaatagttgtatctgctgggatgcagtaaggggcagtaagacattgcactaggcttccagtaccagcccctgctgtggttaagtggctccggacaagcacttaacccccttgcctgtaaaaccaygatgatccttcctatgccacataattcagaggactcataacatcatcataatactcctttatccatatattttccaaagtttttataatgtatcttatttactctcacatcaattctgtgggttgttcatggcagatattcatatcctcattttacagagaagtaaaccaggctcagagaggttcaatgacttaaggtcttacgtctaataaaactagtatagctagtacagcaagagtcaaacccaagtgtcatataaaggaacacgggaaagtatagattcttataggaaagtaaagt

SEQ ID NO: 57387 - DNA, 601 bp, Human
aggattttaggctatttttgctccttgacttctcattttcttttcttgctggaaaacattttaaatattcaaattaccctatagctgttgtacaaatactccagtgccttctgagtcccatctggggcctctgtaactctgttccagagatgcgggccttggcagaactcctgggcccctatggcatgaagttcctgagtgaaaacctgatgtggcatgtgacctctcagattgtggagctgaaggtactatggaaacaatcccttggggaaaagatcctaccttgaggaaagagggtggktataggagactgggggggaagatgtaacattggtctcttcttttcctgcttaatgtctctgtgttcctggactacagaagctggtggtggaaaacatggacatacttgttcagatcagatccaactttagcaagccggacttgatggcttccctgctgccccagctgacaggtaagcatcctcttcccctatagtgagaaggagctgtggaatcacattgcagatgacagggttttcaggaatctggaggctaggcggggtctgtagaatcaaaatcatcaccaatccctctctaaatta

SEQ ID NO: 57388 - DNA, 601 bp, Human
catcctcttcccctatagtgagaaggagctgtggaatcacattgcagatgacagggttttcaggaatctggaggctaggcggggtctgtagaatcaaaatcatcaccaatccctctctaaattatcttttctaacacgcttctttctcctcaggggctgaaaatgtgctaaagcgcatgaccatcattggggttatcctcagtttcagggccatggcccaagagggacttcgggaggtgagttggtggggaggggtctgtcacagagtcacagatacctctgtgggtagggtttgtatgakaatttgtggaagtattgcgggaatcagttttaacttctgcttcagaaggggttggtgagcattgagaagagggagcgtaatttggcagagatcctagaagatccctaggaataaatgagcttaggaaacctagaggcataaggagagggatggcttggaaagctggctaggttcttatctaaattgagtgcccctcctttttttttttttttatttctacctatttttgaaggcattggtcatggtcttgtggactcatttatcttctctttcctccaggttttctcctcccactgccca

SEQ ID NO: 57389 - DNA, 601 bp, Human
ggggtctaggtacttagtatgggagtaggggcttggggctgtgtcctgggaacctgattgtaagtacaatgagacattcaggtatcaatcaatcaatatttattgaatgccttctatgtgctcagcattatgttaaacactagagaaggtaaagagaaatgcaaaactcctgactttaagataaaggaagaggatgtaaaggcatcacattttctctgttagtcactagggtcgatgtgtggtctaatttaatcttcacaacaactatgtgaggtaaatgttattatgccagttttatagrtgggaaaatgagggatcaaagaggttaagtaacttttagtcaaggtcacacacttaataagtggtgttgctaggacttgaacccagatctgtctcactccaaagctttttgctcccttcactatgccatgaggttttaaaaagctatctatttggcaagataaggagatgagtcttgcattccatctaaaaagataactaacaccagatgctgtgtgtgatcaatgctaagtcagtggtaccaacgtaaggagggaagagctggctttgggctgaagtaatcaggtagcgctttacagag

SEQ ID NO: 57390 - DNA, 601 bp, Human
gcgctttacagagaagatgagatctaagggatggacgtaacagatataaatagaggagagaaaaggaccctcaaaagagggaagcacctgaaccagagtatgagagaggaagttgtagtttggggacagtgaataaattatcctggcagcaccgaataaaggaagtatttaggaaaatgaagttgaaaaagtaaatttgtacgatggagtgtcccaaagggttattttccctgtaggatagggagagctatgaagggaatatatagagaagatgacaataaaccagaagtttaaaatctaygattagctggacactgtggctcatgcctgtaatcccagcactttgggaggctgaggtaggaggatttcttgagcccaggagtttgaaaccagcctggacaaaatagcgagactctctctttctctacatatatataaaagcatctttaaaaaaaaaattaaacctgtgatccaaaagtcctggctatgcattccttctgtcaagccattgtgtcctgcgaatcctctctagaatgttattttcttctctccaggtgaccttgagtatctttgagctggcatctgctgcaggtgtgggctg

SEQ ID NO: 57391 - DNA, 601 bp, Human
gcaccgaataaaggaagtatttaggaaaatgaagttgaaaaagtaaatttgtacgatggagtgtcccaaagggttattttccctgtaggatagggagagctatgaagggaatatatagagaagatgacaataaaccagaagtttaaaatctacgattagctggacactgtggctcatgcctgtaatcccagcactttgggaggctgaggtaggaggatttcttgagcccaggagtttgaaaccagcctggacaaaatagcgagactctctctttctctacatatatataaaagcatctttaaaaaaaaaattaaacctgtgatccaaaagtcctggctatgcattccttctgtcaagccattgtgtcctgcgaatcctctctagaatgttattttcttctctccaggtgaccttgagtatctttgagctggcatctgctgcaggtgtgggctgtgacattgacccagccttggtggctgccattgctaatctgaaagctggtaagattggggaaagggggcgagatttgggaaaggagggcttgggccttattttgggtgaaaaaatgtcaatgtcaaagaagcctttatttgagattata

SEQ ID NO: 57392 - DNA, 601 bp, Human
gcctttatttgagattatatattcagaggatataagctgggagtgaaggaaggaccctaaccttcagaaaatacttacataggcgatttagatttatcctcaggtttcaactagttgatctacatcctcaggttccaactagttgatctaccggtcagctaaaaagtactaagtgagagtctgtttggtgctctgcaagtgctcaaagccatttacaatctggttgggaaaataaattaatgcaaatgaaacaatgagagaacaatacaaaatagtgggttgtgtggtatagcacccaaaytccccatagtgattttgtgctttctccctccacataatcaccttgacactgtttatttcttcccatctcacacttaacacttttattttccattacacatttcctctgatttcagtcatacctatacacactcagaacaggatgaaccaaggggctaggattaaggcctttcaaaatggccagacttacccttcttcttctctcatggtgggtgagaaccttttgtcttctttctgcctctccatcctatcaggcagtggacaggcatcctagggttgcattgtacatcagcagagccct

SEQ ID NO: 57393 - DNA, 601 bp, Human
tgggaggccaaggtgaggtgggtagatcacttgagcccatgagttccagaccagcctaggcaacgtggtgaaaccctgtttctacaaaaataaataaactagctgggcagggtggcctgtagtcccagctacctgggaggctgaggtaggaggatggcttgagcccaaggggtcaaggttgtagtgagccatgattgcgccactgcactccagcatagtgacagagcaagaccctgtctttaaaaaaagaaaaaaaaaagaaaagaaaaggaacaaaacaccaaaacaccccctaccctgaaaaaaaaaaaaccagaatgagagaatgaactatgcataattcgatttcaataagatttcataggaatatcctgcctctaatctcaaaatgccttctcatccttttggtgtcaaatactggtggctcagcctgaaaacatgagaaattactagtttgggtcatcctggagtggcttactttgtcatttcctcttttttctctccatctatatcaataataacctaggttacaacaacaatattcattgcttgaccaaagccatcatccaggtgtctgctgccctcttcacgctctacaaca

SEQ ID NO: 57394 - DNA, 601 bp, Human
ctaggcctctgtgtttttaataaggcctctgggagatcagatgcacattcaagttgtagagacactgagttttatcatctctaaggccctttctaactctgtatggacaaatgatcaatgactacttctcaaactttaatgtaaatcagaatcacctggagagtttctaccttagtagattagggtggggctgaataatgtgcatttctgttcccaggtaatcttgatgctgcttgtctgggaatctcactagaaccaatggtctagatttctagggactggaacttaaaactaggcagcrgattccactgtaggtcatatccaatttcttaaaaaaaatgttaaaaattttagccaaaatttgacttcctgtaactctcaccatggatcttaattttgcctctgggaaaactcagaacaaatacaataggccctagaattttccattctaaatcctccatggaggaattttgttcatatacttctgatacatggtccattcccctctgcctgcttgagcattctcagtaacaaagagcttatttctttgcaaagtatggtcccgatataagaaccagggcctcatctgtctccttccagg

SEQ ID NO: 57395 - DNA, 601 bp, Human
taactctgtatggacaaatgatcaatgactacttctcaaactttaatgtaaatcagaatcacctggagagtttctaccttagtagattagggtggggctgaataatgtgcatttctgttcccaggtaatcttgatgctgcttgtctgggaatctcactagaaccaatggtctagatttctagggactggaacttaaaactaggcagcggattccactgtaggtcatatccaatttcttaaaaaaaatgttaaaaattttagccaaaatttgacttcctgtaactctcaccatggatcttarttttgcctctgggaaaactcagaacaaatacaataggccctagaattttccattctaaatcctccatggaggaattttgttcatatacttctgatacatggtccattcccctctgcctgcttgagcattctcagtaacaaagagcttatttctttgcaaagtatggtcccgatataagaaccagggcctcatctgtctccttccaggaggaaacacagcggatcatattgttctctcaggaattataccctcattctgagaagtacatgtcagggatcataagattggttggtgtgtctc

SEQ ID NO: 57396 - DNA, 601 bp, Human
cccccacccttgccttcccttttatcctctgtttgctaaatgcaggtcacctgggcctgggatacaatgaatcatgtttcttctttgatcctttgggggtttggggatgatggagatgacagccatttgggaattgactggagaataccacgagcaagagctgtgtctgaatcagaggctcactgcctctagtcagatagggagtcagccataaacagcctgatgacagtggtgtctggaggctgcctaggaaaagagaggttaatctcctggcatacatcacctgcctttgctctaggtygtttccctgccccttgcaatctctcccctagcactcctggcaacctgttgtctgcactgggaggtcagtgagatccaggctggcttataggcaacatgtatctctgaaacctaggagatttgccactttcccaccctgagtcttcaggaacattctagcacttcttaactctctccttgatcttttcttaacttcctgcagcctgaggccatttgatactgacctgtataaaaatctgctttacaaattcttcccttacaggtggcctctgtcagcctcttgcagctgggccaggagact

SEQ ID NO: 57397 - DNA, 601 bp, Human; identical to SEQ ID NO: 22471

SEQ ID NO: 57398 - DNA, 601 bp, Human; identical to SEQ ID NO: 22472

SEQ ID NO: 57399 - DNA, 601 bp, Human; identical to SEQ ID NO: 22473

SEQ ID NO: 57400 - DNA, 601 bp, Human; identical to SEQ ID NO: 22474

SEQ ID NO: 57401 - DNA, 601 bp, Human; identical to SEQ ID NO: 22475

SEQ ID NO: 57402 - DNA, 601 bp, Human; identical to SEQ ID NO: 22476

SEQ ID NO: 57403 - DNA, 601 bp, Human; identical to SEQ ID NO: 22477

SEQ ID NO: 57404 - DNA, 601 bp, Human; identical to SEQ ID NO: 22478

SEQ ID NO: 57405 - DNA, 601 bp, Human; identical to SEQ ID NO: 22479

SEQ ID NO: 57406 - DNA, 601 bp, Human; identical to SEQ ID NO: 22480

SEQ ID NO: 57407 - DNA, 601 bp, Human; identical to SEQ ID NO: 22481

SEQ ID NO: 57408 - DNA, 601 bp, Human; identical to SEQ ID NO: 22482

SEQ ID NO: 57409 - DNA, 601 bp, Human; identical to SEQ ID NO: 22483

SEQ ID NO: 57410 - DNA, 601 bp, Human; identical to SEQ ID NO: 22484

SEQ ID NO: 57411 - DNA, 601 bp, Human; identical to SEQ ID NO: 22485

SEQ ID NO: 57412 - DNA, 601 bp, Human; identical to SEQ ID NO: 22486

SEQ ID NO: 57413 - DNA, 601 bp, Human; identical to SEQ ID NO: 22487

SEQ ID NO: 57414 - DNA, 601 bp, Human; identical to SEQ ID NO: 22488

SEQ ID NO: 57415 - DNA, 601 bp, Human; identical to SEQ ID NO: 22489

SEQ ID NO: 57416 - DNA, 601 bp, Human; identical to SEQ ID NO: 22490

SEQ ID NO: 57417 - DNA, 601 bp, Human; identical to SEQ ID NO: 22491

SEQ ID NO: 57418 - DNA, 601 bp, Human; identical to SEQ ID NO: 22492

SEQ ID NO: 57419 - DNA, 601 bp, Human; identical to SEQ ID NO: 22493

SEQ ID NO: 57420 - DNA, 601 bp, Human; identical to SEQ ID NO: 22494

SEQ ID NO: 57421 - DNA, 601 bp, Human; identical to SEQ ID NO: 22495

SEQ ID NO: 57422 - DNA, 601 bp, Human; identical to SEQ ID NO: 22496

SEQ ID NO: 57423 - DNA, 601 bp, Human; identical to SEQ ID NO: 22497

SEQ ID NO: 57424 - DNA, 601 bp, Human; identical to SEQ ID NO: 22498

SEQ ID NO: 57425 - DNA, 601 bp, Human; identical to SEQ ID NO: 22499

SEQ ID NO: 57426 - DNA, 601 bp, Human; identical to SEQ ID NO: 22500

SEQ ID NO: 57427 - DNA, 601 bp, Human; identical to SEQ ID NO: 22501

SEQ ID NO: 57428 - DNA, 601 bp, Human; identical to SEQ ID NO: 22502

SEQ ID NO: 57429 - DNA, 601 bp, Human; identical to SEQ ID NO: 22503

SEQ ID NO: 57430 - DNA, 601 bp, Human; identical to SEQ ID NO: 22504

SEQ ID NO: 57431 - DNA, 601 bp, Human; identical to SEQ ID NO: 22505

SEQ ID NO: 57432 - DNA, 601 bp, Human; identical to SEQ ID NO: 22506

SEQ ID NO: 57433 - DNA, 601 bp, Human
gatgacactaaatcaacagttttaacattgctgcattccagatcattccaataaacaatggttcaacctactgagaatctagagacatttcatctctaggcagaacactggtttgtaaagtttagttgctggacctaggccatggaaagacacaagcaaatcctaatgttgaaactctaaatgcattcccacttagaattaaacaggaaagggaaggttcctcccccatgtaggaaactgagccgtaatttactggtttcaatttatagctatgaagtgtgtgtgttttggaggggagggragatgagaagttggagaggtttaaggaaaagacacctgcatgaggtagggcagaagtggacatcctgaagacctgatttctaaaagcagcaggcctactaggaaaacttaaatctctttcatattgaccgcaaaagcgaattttgagcctgtaaggtggatcatggtagttgccggtctgcagatacactaggttgaagactcgcagcacctaatgtcactttttcatgctcacgccctcccagcgcccaatccgtgtttatggaatgaaggggaaaacccaaaagaatgaatgaacaag

SEQ ID NO: 57434 - DNA, 601 bp, Human
atacaccaaatgggacaaagatggataaggggtggtggggggtggggtgttgtctccagaaggagttgctgagctccaactgtgctgcaaatttcctgttgatgtagttctacctgggacaatgactaccaaagacttgaactgcctgtctttgtagagagacctagttaaatgtcaaaagcagcacagggcccggcacattggctcatgcctgtaatcccagcactttgggaagccgaggcgggtgaatcacctgaagtcaggagtttgagatcaccctgaccaacatggtgaaaccctrtctctactaaaaatacaaaaattagctgggcgtggtggcaggcacctgtaatcccagctactcaggaggctgaggcaggagaattgcttgaacccgggaggctgaggttgcagtgagccgagatcacaccattgcactccagcctgggcgacagagcaagattctgtctcaaaaaaaaagagcagcacaaaaaaatgtcaaactttgaactgctctacaatgactagttaccatacagtgggaacttgaaatagtagttcattcactcattcatgccacaaggacctgatgccaactaca

SEQ ID NO: 57435 - DNA, 601 bp, Human
aatggagaattagtatctgcatcccagatcaagggcgggaggtagaacaagcgcgggggagaccaaggtttcactgaagtgccatggcaggaggaaaaagtagagtggggcttctttttctttaatcacctaggcagtcttcacaatcttaattctttcctttgtgtcgggcaactgtcaacacttcagggcaggaatgttattcttctcaaaaattctatactccacccagagacataactgaagcaaatttaaaataataaaaaatgagcagcgggttatgcttttcttctaagatgasttttccacctcagtttgtttactccccactccaaaagacattaatatgttagtggggtgggggggcggtgggggaacaaaggaacttgtggaaaacaaaatagtctagggaaacagaaaggatagatcataaaacagtaaaatgctggtaaaagcagcatttcaaatgaggtttaaaaaatcaatttatagctttgtatttaatttatgacagagtatttggaacaagaaatgtgaaggtatagtcttaacagtcactaaagaaagttttcagtgaacatcatttacacattttaaggta

SEQ ID NO: 57436 - DNA, 601 bp, Human
atgtagagaggtaccacaatggagaattagtatctgcatcccagatcaagggcgggaggtagaacaagcgcgggggagaccaaggtttcactgaagtgccatggcaggaggaaaaagtagagtggggcttctttttctttaatcacctaggcagtcttcacaatcttaattctttcctttgtgtcgggcaactgtcaacacttcagggcaggaatgttattcttctcaaaaattctatactccacccagagacataactgaagcaaatttaaaataataaaaaatgagcagcgggttatgyttttcttctaagatgagttttccacctcagtttgtttactccccactccaaaagacattaatatgttagtggggtgggggggcggtgggggaacaaaggaacttgtggaaaacaaaatagtctagggaaacagaaaggatagatcataaaacagtaaaatgctggtaaaagcagcatttcaaatgaggtttaaaaaatcaatttatagctttgtatttaatttatgacagagtatttggaacaagaaatgtgaaggtatagtcttaacagtcactaaagaaagttttcagtgaacatcat

SEQ ID NO: 57437 - DNA, 601 bp, Human
atgacccttgaggacattatgttaagtgaaatacatcggtcacagaaggacaaatactgcttaattctacttatatcaagtactaaagtagtcaaactcatagaatcagaaagcagaattgttgccaggagctaggtggaggggaaaattgaggaactgctaatcggtgagcatggtttcaattatgcaagataaactagttctagagatctgtaaaacattgcccctgtagttaacaatactatatttgtgcacttaaaaatctgttaaggaggtagagctcatgttaagtgtcttgccccacacacacacacacacacacacacacacacacacaaaagtcctggttggaatcttctaaatgtatgtcaacccactactgaatcatgacctgcagtctgaaaaataatgctcttacaaaagggtgattagattcacatgatgatgccgctagaggaatggttacaggcatcagcaaatacttaggcatgatgagaccctcccatcctcaccccacaaaaaaaagtcacaccttctctctgcatataagagatgtagagaggtggccaggcacactggctcatgcctgtaatcccagcac

SEQ ID NO: 57438 - DNA, 601 bp, Human
ccatagtaagaaataatttacatgcaatccaatgcacaagcctacccttcacacacctcctcagaagataactcagaagttttacataatattcttactatggtatgataaattaatattcttcaccctattccatttaatattttaaaaagtcctgttggcaaagagatattagcactccaatgttcatcgaagttattcacaatagccaagatgtagagacaactaaacgttcactgacagaagaatgaagaaaatgtggtacatacaagcaatggaatattattcagcctcaaaaaaraaaaaaaaaaagaaaatcctacagtatgggacaatttagatgacccttgaggacattatgttaagtgaaatacatcggtcacagaaggacaaatactgcttaattctacttatatcaagtactaaagtagtcaaactcatagaatcagaaagcagaattgttgccaggagctaggtggaggggaaaattgaggaactgctaatcggtgagcatggtttcaattatgcaagataaactagttctagagatctgtaaaacattgcccctgtagttaacaatactatatttgtgcacttaaaa

SEQ ID NO: 57439 - DNA, 601 bp, Human
tgtgaaccatagtaagaaataatttacatgcaatccaatgcacaagcctacccttcacacacctcctcagaagataactcagaagttttacataatattcttactatggtatgataaattaatattcttcaccctattccatttaatattttaaaaagtcctgttggcaaagagatattagcactccaatgttcatcgaagttattcacaatagccaagatgtagagacaactaaacgttcactgacagaagaatgaagaaaatgtggtacatacaagcaatggaatattattcagcctcaaaaaagaaaaaaaaaaagaaaatcctacagtatgggacaatttagatgacccttgaggacattatgttaagtgaaatacatcggtcacagaaggacaaatactgcttaattctacttatatcaagtactaaagtagtcaaactcatagaatcagaaagcagaattgttgccaggagctaggtggaggggaaaattgaggaactgctaatcggtgagcatggtttcaattatgcaagataaactagttctagagatctgtaaaacattgcccctgtagttaacaatactatatttgtgcac

SEQ ID NO: 57440 - DNA, 601 bp, Human
cacctgattatatcatgaaatgtagaaacagagtactaattagcaagctcgttaggatatggtctttccagtaataccagcaatatcagtaatgcttcatatacagttttctaactttaagaatatattcagatgccttgacagtatgtaaaaatgttcagaaacataaatagtgatgttagaggctcaattaatattgtgacatcttttctgaacatacagagtcttactgaatgttactcaggtttatgcttcaaaatgaaactacagacagtaccaatcaatgagtacatctgctaayaccatacttctagacagtagggtcttaacatggaggaattcaaccatgatatggtaggtcacagtaactgataagtcttaaaagattttttctgtaggagataggtatagaagactaatacactttttttcgattctacttttctcatgcttttaaagtacaacataacctctactttttgagaactagacaaagacttctacaagctggctaaacctattcactgcatttacaacactaaactgcacaataaccttcacatactatccaatggtatttctcacctttcctcctttgtta

SEQ ID NO: 57441 - DNA, 601 bp, Human
aatttttttataatagtgaaaaactgaatgcaacacaaatggtgaatgtataaacaaactggtataaccatggaatgaaatattactcagcgacgaaaaggaatgaactactgacacatgtaacaacatggatggatctcaaaatatttatgtagactctaagaaggcagaccaaaagaggatatgctggatgatttcctaggtatatgaaactagatatcaaatgcaaactatgatttcttaaatatgaaaatctagaaaatgcaaactacagaaagcaaatcagctgcatgggatggcsagaggaagaaattaccaaaggggcatgatgacatttttggagataatgaatatacttattatcagaggtgattttatgatgtatacatatatcaaaacttaccaaattgtacattttaaatatgtgcagttaactttatgttaattataactcaataaagctgttaaaatgtttttttaaaaacacctgattatatcatgaaatgtagaaacagagtactaattagcaagctcgttaggatatggtctttccagtaataccagcaatatcagtaatgcttcatatacagttttctaactt

SEQ ID NO: 57442 - DNA, 601 bp, Human
cccacttactgcctggggagaggctccaggtcatgggcaggaaggtgaagaagagcccagtggactccctgggtggaagagatggagctgaaggtccggggaaaccatttacaatagaactgaaacatgagaaacattcagggataacatgacaaaaaagatgtgaaagacctatacacgaaaaactacaaaacactgctgggagaaatgaaagatgtaagtagagtggagagatattcatatacttgaagactcaatattgttgagatgttaatttttcccaaactgatctacagattcaatgcaatcccaataaaaaaccccagcagggtttttttgttttaagtagaaattgccaatctggttctaaaattcacgtggaaattcaaaatatccagaagagtcaaaccagttgaaaaagaataaagctagagagctaatactacatgatctcatggcttattataaagattcagcaatcaaaagagtatgccattagccaggtgaggtggcacatgcctgtaagtcccagctacttgttaggctggggcagaggtttgtttgagcccaagagttctaggacagcctaggcagcatagca

SEQ ID NO: 57443 - DNA, 601 bp, Human
caatactactaactcccacatcaaatttctaggaaattaattaagattactttttcagttgatggtaaagtatgtaatctcaaagaaaatgctgaaacctgaaaggttgcagggggaatgaattctaccacttctggtagaatttaccgattttcataagttacagagtattaagtattaaggtattctgaaacaattaaaaattgttaaaaaatacaactaaaagaatctatatatataaacatgcaattcaaaacaccaaatgatagggttttttaattagtcttacaaatgaggaaaytgtggtccaaagaatttaagttctgtttttcttttcttttttttttttttgagacggagtttcactcttgtcgcccaggctggagtgcaatggcgcaatctcaggtcactgcaacctctgcctctcaggttcaagtgattctcctgccccagcctccctggtagctgggattacaggcatgtgccacaactctcagctaattttgtatttttagtagagagggggttttcaccatgttggtcaggctggtcttgaactcctgacctcaagtgatccacctgcctcggcctcccaaagtgc

SEQ ID NO: 57444 - DNA, 601 bp, Human
aactactaaactctaaccataaaacagacacaaaaatctaatacagaaagctctttagagatcatccatcagagtagaaccttagtcatagaaactcgctcagaacataccaatctaaataaccaaactttccaagtgccaataaagatatatcaaatatgaactcttttggctataagtctgaggctcattacatccttctctgtctttttaaaccatgtctgagaaacagaaccattaagtggagattaagtcatcactcattcagtttcactacacaccagtgataacttagccacasagatattaccaaagtgacccaaactcatatgctgtcccagtgcaggcctgtctccttctaaaaactatcatcaagatttcaaacatcatatgaaatgtaaaaacatgcatgggggctttgtggcatttattttgatctgacaccaacttttgctattctcccaaatccttaatatgttcagatatgttgttgccagacgcccccagtacctgcccaactggcaaatccagaggcttcttgtccttccccacctcttgaaagcctgccatcattcttcctacacacagcaatactactaac

SEQ ID NO: 57445 - DNA, 601 bp, Human
tctaaaattgactatctgctatcaataggaagatactacacatactttcactttttattagggcttcagatgtttttggcaatttcacttctttaactacagctataacagggcagggcccttgtgggcatatcagaaggccacatctggacctgctttgggcagctcctctctcgactgcgccctctcatttctgcctcaatttcttgcagtacatcctgagctgagatactaaatgaccgagtctgcaggaactatgtataaagcgatctgcgtataggcctcaaatatgcttccaggrataaagtttttgtttacttcccagttcttgctctatttgagtagtggagccaacagatcataacccctagacacaacttaacacactggcaggccagggtactaccctgcttagctcaggcaggactgctgaaaagtctgctggaaaacagcagcttctatgaccttttctatctctgtgaagctctggttcccctccagcagttaatctgaatggggcagacttacaacccagatttttactagtttcctggaaaagcgtcatggagtcactcaccttagagtctgaattctgctaagt

SEQ ID NO: 57446 - DNA, 601 bp, Human
gagctggctcttgtgtgcttcaagtcaagtgccactccttcagagacctttgctgaacccccaacactgtaactccttcccctttccaccctcaaggggtgctacccaccctggtgcctcctaaagttgtacaaggtatttatcctgcccagagcagccttaattttccctaatgatagccacttagaatgtgttgtagtctttggcttttaaatcatctgaaaataagagaaaacccaatgtcccttccagttctaaactactgtttttgaaattaaagtcttccagaaactcttagtayaagaccatcatttttctttcactcatcaaacacagaacattcattttattgaaattaattttcttattacccaaaacttacccctttagagcatatgttttctttaaaaagtttacatatacgtgagtggaaatctttctaaaattgactatctgctatcaataggaagatactacacatactttcactttttattagggcttcagatgtttttggcaatttcacttctttaactacagctataacagggcagggcccttgtgggcatatcagaaggccacatctggacctgctttgggc

SEQ ID NO: 57447 - DNA, 601 bp, Human
cagggctgctggggaggattacataaaacaatgcatgtaaagtgctaaaacagtattaagtacactgtaccactcaggggttagtggttactattttctagctccagggcagtgatacactgattgacacagaatagtgtcttgtgtttctcaaacattggttacagctcctttgtgggccatgatgagttgtgatcaacataacaaaaaataatcgttaatagggtagaatagaaatatcagaatatgtcactcatgggaagggaactgctgtttcgtggaaatgttgtttcacagagcrcttgttttagtcaaaggtgaaagctactggcatggaatgctgtctaaccctacagtcaggaagaccatggtccttcagcaagcaggtcaagtcactctccttgaaactcttaaatggctcacactcagcagaaactccaacatccctcctaaagagcattaggaccaatcttctcagcctccttcatttcaacccaccccacacgatgttgcagctacactggccttttctgtctctacaacaatcacttcaaggcctttaagacacttttgttccctctgcctggaagatttttacctc

SEQ ID NO: 57448 - DNA, 601 bp, Human
caaactatttaacccatcatatgcttgacctctgaagagaagaaacctacaccaagcccttcagggactatgagctgtgaggtcctacattcctcccagagacagcatgaggactttcccctccttacaccctgggaaggatctctatccaggtggtcaggccaaggagggcaagacagtgaagggctccccaggacctagtccaggtagagtatgcgtgcagggcagggtcttcagacccctactgacatctggggttcagggccagctcctccattccacactgctggctctcttgcamtggcccaaacaatagttttgatccttttgctagaaccaactgttgcttctcagagacttagttttctccttacactaactcctaaacaagcctgcaaccattttgaggactaaggctctagttagagttgatgactactcagtgccaaaaaacactgtcttgctggacacgctccctgccccccacccccagcactaacccctttgtcctttcatccattcaacaaagctctttgctaagcaggtgctgggaatactgtgaagagccaggcagatgtggctcctgttctcaggcttacac

SEQ ID NO: 57449 - DNA, 601 bp, Human
gaatggcaggcagggcacggtggctcatgcctgtaatcccagcactttgggaggccgaggcgggcggatcacaaggtcaggagatcaagaccatcctggctaacacggtgaagccccatctctactaaaaatacaaaaaattagctaggcatgctggcgggcgcctgtagtcccagctactaaggaggctgaggcaggagaatggcgtgaactcaggaggcagagcttgcagtgagccgagatcgcggcactgcactctggcctgggtgacagagcaagactccgcctcaaaaaaaaaaamaaaaaaacaatttgaggaatggctgggtattttatgaaatactaatttcttaatatctactcctagaggtaaaaacaatgcttaattaggaaacaatacagttctataatactcagagcagttacaggcagttccccatttagggagaaagttcttttgtcagtttctctgtaaatgagaaggaaggaattttccctctcaaactatttaacccatcatatgcttgacctctgaagagaagaaacctacaccaagcccttcagggactatgagctgtgaggtcctacattcctcccagag

SEQ ID NO: 57450 - DNA, 601 bp, Human
agggcaaaagaacaaaaagttaaagctcattctgagttttaaatatcagttttaaatgccaaacggatgacatttaaaatgttaacaaaccaaactctcctcaattaaagtataatcacttcatgatctcattaagcaaatgaaacagaaaaacatcagaatatttaccaaatgagaaagaaaaccaaatttacttttcaatagaataatcatcagttggaagcctcaagaatttcctgacggtttttcaaactaaaatgtaatgccttctgaagtgctccttctctgcagtcaccttgawctttctgcactagtcctcaaagaggttcttcaaacttttagctttttgttaaacacccccaccacctcaacacatttatgtttatttccgattagagcctgtctatatgagcattctgaatcgtaactgcatatttaaaagtcaaactagagctgaaatggggtttgacgcaataaccgagatgattggtgataataaaaagtgatacattaagacaacgattttccaatataaaacatctaaagccccaataaattattttatgatttctggattgtatccccattctaaacttcattt

SEQ ID NO: 57451 - DNA, 601 bp, Human
ttttcaaattcactcttagcccacaagtttaaaacatgggtagggcaaaagaacaaaaagttaaagctcattctgagttttaaatatcagttttaaatgccaaacggatgacatttaaaatgttaacaaaccaaactctcctcaattaaagtataatcacttcatgatctcattaagcaaatgaaacagaaaaacatcagaatatttaccaaatgagaaagaaaaccaaatttacttttcaatagaataatcatcagttggaagcctcaagaatttcctgacggtttttcaaactaaaatktaatgccttctgaagtgctccttctctgcagtcaccttgaactttctgcactagtcctcaaagaggttcttcaaacttttagctttttgttaaacacccccaccacctcaacacatttatgtttatttccgattagagcctgtctatatgagcattctgaatcgtaactgcatatttaaaagtcaaactagagctgaaatggggtttgacgcaataaccgagatgattggtgataataaaaagtgatacattaagacaacgattttccaatataaaacatctaaagccccaataaattat

SEQ ID NO: 57452 - DNA, 601 bp, Human
tctgctactggaattaagttatttgcttaactagaaaacatgcttcctaaagaaagtctaagagatacttccttgcttactgagtgcatcatttattttttaccaaatgagcaagaacttgtagcaattatataaactaagttgcaataactttaattgttagtttcctaactttgaaaaaaattgaaatccttagttttcaaattcactcttagcccacaagtttaaaacatgggtagggcaaaagaacaaaaagttaaagctcattctgagttttaaatatcagttttaaatgccaaayggatgacatttaaaatgttaacaaaccaaactctcctcaattaaagtataatcacttcatgatctcattaagcaaatgaaacagaaaaacatcagaatatttaccaaatgagaaagaaaaccaaatttacttttcaatagaataatcatcagttggaagcctcaagaatttcctgacggtttttcaaactaaaatgtaatgccttctgaagtgctccttctctgcagtcaccttgaactttctgcactagtcctcaaagaggttcttcaaacttttagctttttgttaaacacccccacc

SEQ ID NO: 57453 - DNA, 601 bp, Human
ttatctggacattccagtcaaggtagattacacttacttactggcagagtaataagtaaggtagattacactttcataatcccactaccagtcccacttttggagagttaaatcataatcataaatataccgtgtggagaagttatttgaggggtttcaacaatttaattttggtttatctcaagtaatttaaggcaacttctccactctgaaaccatataaaatttgcaatgcagggtgcactagtacatttattaacaatacctcgtggaattctagtaaaaataaaggacataaacacaaagtcagacttctgggcagaatacaactagaacctacttttgtttttcctgaagttacaagctttcaatcatgacagttggcgtgagcagtgaagattatgaatcactgtgtgtgatggaaacaaaacatccattatccatatataagtgaaaagatacagaattattcaggcaagcccttgaaagtaccctttgcacatggcaccaatacaattactacagaggtaggaaactgattcctcacaaggcaaaccaggctacagtgtatttggtttggcctacaatagtagtttagaaaa

SEQ ID NO: 57454 - DNA, 601 bp, Human; identical to SEQ ID NO: 22290

SEQ ID NO: 57455 - DNA, 601 bp, Human; identical to SEQ ID NO: 22291

SEQ ID NO: 57456 - DNA, 601 bp, Human; identical to SEQ ID NO: 22292

SEQ ID NO: 57457 - DNA, 601 bp, Human; identical to SEQ ID NO: 22293

SEQ ID NO: 57458 - DNA, 601 bp, Human; identical to SEQ ID NO: 22294

SEQ ID NO: 57459 - DNA, 601 bp, Human; identical to SEQ ID NO: 22295

SEQ ID NO: 57460 - DNA, 601 bp, Human; identical to SEQ ID NO: 22296

SEQ ID NO: 57461 - DNA, 601 bp, Human; identical to SEQ ID NO: 22297

SEQ ID NO: 57462 - DNA, 601 bp, Human; identical to SEQ ID NO: 22298

SEQ ID NO: 57463 - DNA, 601 bp, Human; identical to SEQ ID NO: 22299

SEQ ID NO: 57464 - DNA, 601 bp, Human; identical to SEQ ID NO: 22300

SEQ ID NO: 57465 - DNA, 601 bp, Human; identical to SEQ ID NO: 22301

SEQ ID NO: 57466 - DNA, 601 bp, Human; identical to SEQ ID NO: 22302

SEQ ID NO: 57467 - DNA, 601 bp, Human; identical to SEQ ID NO: 22303

SEQ ID NO: 57468 - DNA, 601 bp, Human; identical to SEQ ID NO: 22304

SEQ ID NO: 57469 - DNA, 601 bp, Human; identical to SEQ ID NO: 22305

SEQ ID NO: 57470 - DNA, 601 bp, Human; identical to SEQ ID NO: 22306

SEQ ID NO: 57471 - DNA, 601 bp, Human; identical to SEQ ID NO: 22307

SEQ ID NO: 57472 - DNA, 601 bp, Human; identical to SEQ ID NO: 22308

SEQ ID NO: 57473 - DNA, 601 bp, Human; identical to SEQ ID NO: 22309

SEQ ID NO: 57474 - DNA, 601 bp, Human; identical to SEQ ID NO: 22310

SEQ ID NO: 57475 - DNA, 601 bp, Human; identical to SEQ ID NO: 22311

SEQ ID NO: 57476 - DNA, 601 bp, Human; identical to SEQ ID NO: 22312

SEQ ID NO: 57477 - DNA, 601 bp, Human; identical to SEQ ID NO: 22313

SEQ ID NO: 57478 - DNA, 601 bp, Human; identical to SEQ ID NO: 22314

SEQ ID NO: 57479 - DNA, 601 bp, Human; identical to SEQ ID NO: 22315

SEQ ID NO: 57480 - DNA, 601 bp, Human; identical to SEQ ID NO: 22316

SEQ ID NO: 57481 - DNA, 601 bp, Human; identical to SEQ ID NO: 22317

SEQ ID NO: 57482 - DNA, 601 bp, Human; identical to SEQ ID NO: 22318

SEQ ID NO: 57483 - DNA, 601 bp, Human; identical to SEQ ID NO: 22319

SEQ ID NO: 57484 - DNA, 601 bp, Human; identical to SEQ ID NO: 22320

SEQ ID NO: 57485 - DNA, 601 bp, Human; identical to SEQ ID NO: 22321

SEQ ID NO: 57486 - DNA, 601 bp, Human; identical to SEQ ID NO: 22322

SEQ ID NO: 57487 - DNA, 601 bp, Human; identical to SEQ ID NO: 22323

SEQ ID NO: 57488 - DNA, 601 bp, Human; identical to SEQ ID NO: 22324

SEQ ID NO: 57489 - DNA, 601 bp, Human; identical to SEQ ID NO: 22325

SEQ ID NO: 57490 - DNA, 601 bp, Human
aagtacagtggtatgatcatggctcattgcagccttgatctaccaggcccaagtgaccctcccacctcagccacctgagtagctgggactataggcatgcaccatcacatccagctaattttttatttctattttgtagtgctggggtctcgctgtgttgcctagactcatcttgaactcctgggctcaagcaatcctcccctatcggcctcccaaagtgctgggattaaaggtgtgacccactgctcctggcctgctccgtcttttacttcacctccccacgatctcacaaatgtccatsattagggagggaacgtcactggaggaaaggcactgagctgcagagctgatgtctgggtgacaatgaaacagggtattcatttgtacacagaaaacaacctggaatggaagtgtgtggatttcttgtgtgcttatttcctcataggtttgagaaaggtgagtcccaagccctcgtgaagcattggagaaagtgccgccccgaggttcaggtccacacagcgctgtgaggctgaaggggcgcgctagaagttcctttcacaggacgccacctcacctgaaaccctccttttctgctgacacc

SEQ ID NO: 57491 - DNA, 601 bp, Human
cacgcccaaggcccagcctgctcctggtcatgatgccctgtcatggtctcacccactcaaggaaggacctaaatcactctgtgttctctgtggatggaagaacacaaaatataccgtacagggctctctcctttatgtctttcccgtagaggttgtatttgctggcaatgtagttgagaatggctctggtctgtaccaacttcatcccatcaatctcaaccattggtacttgctggaacatcaaactcccatctttagaaagaaggaaaaaaaaggaacatgaaatttctatgaatcccastatttcaggaagaaaaatgatggttgaaatgactgaggttataaaatgaaaaagaaattattgcctgctaacctcaaaaacgaaatagtattttgattttagctgcctgtagttctttttctgacctgattcctttgaccttttagcctgttatttcatttatgtttttattccccatccaggtacatagtaggtcccttgtattttacttgcgttgatttatcgtcatgatattttaggaaaaagctgagacaggttacaacgggagtgccagagagatgtcacttaaaatgagaactt

SEQ ID NO: 57492 - DNA, 601 bp, Human
tttcacataggatgttatttagaatcaggcagccctattgcaacagtgaggagaccccatggctttgctggtattcgataaatctagctgcttcagccttgaatccatgtttccaggcaaccccagagttctgggtgccagcctctactagccctgctcaagttgaccagtccatataattggctggtaacttgggttcctgggcatcattcttggaattactgggacctgagattcagcttctttgcagtcttccctccccaggccttcatctacagactctcaaacattctatgcctgycctaagctgttggctggagtccagcctctgaaggcttgagcacctggaatcattattccccatcctcctgagttcatggttcatcagtgtttggaaacctctgtcagggtgctggatccatggaatgcatcctcttctagaatcacactcacctgaaccctcctcacgttcactgtttcctcatccccatgggactctgcaatactggacctcagtatacacgcccaaggcccagcctgctcctggtcatgatgccctgtcatggtctcacccactcaaggaaggacctaaatcactctg

SEQ ID NO: 57493 - DNA, 601 bp, Human
ctacagtcacagtcatgagagaaattggtggaatcactgccagtacccaccgatgctgtgccaggatttatcatctccattgtggtttgttctgtgcataaacttcgtgtgagtcaaatggccaaagacttttctcctaagtaatcccaagagagtccctggcacagccatctcagtcatgttccttgtcctgtctcatcatttacatctcccaggcccacttctatgcccaatattagcagtttttccaattactcccatgaaacataattctacagccctatccatgtgctattgcccractctagccatgtgtgccttacttgagaccccacctaaaagatccccttccttggtgaaattctatacacagttacaaccaggacatattttaggaaacctttttttcttttgtgtttaattaggttttccacagtactttttaaaacaacagtttcattgatgtatagtcacacattatcgttgtcacccattaaattatagtattcagtcacttttagtacatttacagaattctgcaaatatcatcacactctaattctagaatatttttatcaccctgataaggacatctgtaccc

SEQ ID NO: 57494 - DNA, 601 bp, Human
ataaaattttgttgaatagagaattctatattggggtctagtaaattgaaattttgctggaaaattataacttgggtataagtggtatcattgttcctccaagtctatcttcataaaatgccttgtctgctttcctcatttcctgttctatctccctgggatctgaagtaaacctgggttgttatatataaagtttcagtgacgcaaaaagaatagtacttgaatataaaattttctttttaattctcagcaaggcaaggtacttctatatagaagggtgcgctctcacagatggaacaayggtgagcgcacacttggacaaaggaggggaagggtttcttatccctgacgcacgtggcccctgctgctgtgtctttccccctgctgctgtgtcgttcccctattggctagggttagactgcactggctaaactaattctgattggctaatttaaagagaatgacggggtgagtgctttggcaggagtcagggcagagcaggtagccggcaatcggaatgagttaggaggagaaggtaatcggaatgagtttgggtagagcaggtaatcagaatgagtcagggtagagcaggtaatcggaa

SEQ ID NO: 57495 - DNA, 601 bp, Human
gtgattcagagccttccacagcccacgttctacttaaaaacataaaattttgttgaatagagaattctatattggggtctagtaaattgaaattttgctggaaaattataacttgggtataagtggtatcattgttcctccaagtctatcttcataaaatgccttgtctgctttcctcatttcctgttctatctccctgggatctgaagtaaacctgggttgttatatataaagtttcagtgacgcaaaaagaatagtacttgaatataaaattttctttttaattctcagcaaggcaagrtacttctatatagaagggtgcgctctcacagatggaacaacggtgagcgcacacttggacaaaggaggggaagggtttcttatccctgacgcacgtggcccctgctgctgtgtctttccccctgctgctgtgtcgttcccctattggctagggttagactgcactggctaaactaattctgattggctaatttaaagagaatgacggggtgagtgctttggcaggagtcagggcagagcaggtagccggcaatcggaatgagttaggaggagaaggtaatcggaatgagtttgggtagag

SEQ ID NO: 57496 - DNA, 601 bp, Human
tttccagcctgacattcccacctgtgttgcctaactggatggtgtgaaggtccaggcctttgtttatgttccctgattgagtgagggagcaagaatgtggctctgctcactcctcagttggagctcaggctcccattttctcttctcattccacatcactgtggcatccacaccatccacctgcttgcattttccacatgggccaggggtttagcacctgctactgcatgttctgtctgccccaggccctacagcgtgtagccttgacattcaggatgtggctctacaatctgctctctcmctctccaatctcccttgggcagtgactccaccttcatgacagcactcttcctccaggagtagactatttcagagtcttcatttctccatatgttccatagactcaacagcaacctctagtgtgattcagagccttccacagcccacgttctacttaaaaacataaaattttgttgaatagagaattctatattggggtctagtaaattgaaattttgctggaaaattataacttgggtataagtggtatcattgttcctccaagtctatcttcataaaatgccttgtctgctttcctcat

SEQ ID NO: 57497 - DNA, 601 bp, Human
gctttattaaaacctgaaaatctttctggcttcttctaaagcttttgcatctgcgggaggcttccttgggctgccaggctgtagaaacttcttcaccgtgggcaggttgctgattctggttttcagggcctgtaattcacaaagcacagcctcagagtgaagccaaggtctgccaccaccattaataccacccagggaatttgacccctcctgccagagaccaagtgagtcccctccatcagcaccagcatggaggcagaaacagacacccagtgataaatgaagataagaggaagaacaygtagctcactttattttccgcaaagatgtcttaaagttttaatcaattcagtcatccctatctttctccttacatatcaatcctgtagattagtgactcttgtataagacaagaaaaaataatgtgcctgtgagatatcaacacaggtcagtctctaagcagaagtgaaaatatggagaaatgagttggaaaggaaaatgttatagaaaatattaaagtcaaaccatgggaccacgttttctcagtgagagatacagggttgggggcagtgtgttgggtgtgctgtgcacagaggaacac

SEQ ID NO: 57498 - DNA, 601 bp, Human
caccgccagcttcgcctcactgccggtgccgggtgcgggccacgcccatctcccagtcccgccccggtcacccggccccgcccgcctccccccccctcctcccttccccccttcccctgtcgcccggcgccgcccatcgccccgtcccctcttccccagtcacccggccccgcctatcgccccgccctcatcacccccagctccgcctcctccccgacccccgcacccctaccccatagctccgtctggttcttcccagaccacacccgagctccgctccgcgccccgttactcggccggstccctgacctcgcccccaccgaccgcgcctcccggccacgacctctcccgacgcgtccccgcttactcgcttcctcccgcagcccctttgtgcccccacccttcgcgcccccaccgctccctaccggccccaccgtcgctggcccctctccctcgccagcccccgaccagcctgagcactgacccagcctccccgctcgccacgccacgttcccattcaccccacctccccacgcccccgtcacccatccctccccacgccccgctgacgcctgagccccctccaccaccccagtcacgt

SEQ ID NO: 57499 - DNA, 601 bp, Human
tccccccttcccctgtcgcccggcgccgcccatcgccccgtcccctcttccccagtcacccggccccgcctatcgccccgccctcatcacccccagctccgcctcctccccgacccccgcacccctaccccatagctccgtctggttcttcccagaccacacccgagctccgctccgcgccccgttactcggccggctccctgacctcgcccccaccgaccgcgcctcccggccacgacctctcccgacgcgtccccgcttactcgcttcctcccgcagcccctttgtgcccccacccttygcgcccccaccgctccctaccggccccaccgtcgctggcccctctccctcgccagcccccgaccagcctgagcactgacccagcctccccgctcgccacgccacgttcccattcaccccacctccccacgcccccgtcacccatccctccccacgccccgctgacgcctgagccccctccaccaccccagtcacgtcccacgcgaccccagccccccggtgtcatccccacctccccgacctcgttccctccgtccgtgactgtcctcagcggaccctggacgcccgccgctctagcccc

SEQ ID NO: 57500 - DNA, 601 bp, Human
ttctaacttctgtggctttttcccatgcccagaggcactctgatgtggagctgttcctcaaacatcaaaactacctttcttcccagctacttgggaggctgaggcagtaggactgctggaggccaggagtttgagaccagcctgggcaacatagcaagagtctgtttttaaataaataaataaataaataaaaattagccaggtgtggtggcgcatgcctgtagttctagctacttgagaagctgaggtgggacgattgcttgtgcccaggagtttgaaggtgtcgtgaaatatgactgcrccactgcactccaacctggtcaacagagcaagatcccatctctaaaaataaagtataagaaactacctttctgtggggcttcctcacaacaatcccaatcatctgcaggaccttccacccattaagccactcaacacagctttaggtctgtgaagatattaggcctagtcaaagagaaattgggttacgaggtgcctccaaacaccaaattcatagactcttagagatggaagtcatgtcagatattaataaaaatggacaatgcaccaaattccttgagcgtgggggtgtacattctgt

SEQ ID NO: 57501 - DNA, 601 bp, Human
cagtaatatttgaatactgggagagatacaggaggatgaagggagaaagagacttgcaataaagtttcccagccccactgctggggagttgcaaatgggtccagttcaagaggtacaatccaggctggccatactcttttcatcactctcgcctagcaagcttcttagtctggttcctttgcactagtacagcataatctttacagaagcctctggtacacctaattccatgaacagatgggaaatgacttatttcagatggaatattcataatctatggcttagggtgtagggtatgggggtgtgtgtgtgtgtgtgtgtgtgtgtgtgcgcgcgcgtgcacgcgtgcgcatgcgcttgcgcacatgtgtatatgtgtagaacaaagccttttctctagggttcattcattcaatctcaagtgagacaacacctttcaagacaggaaatcccactccgtcattcacacaatctgaaaagagtagttttcatcttttcaaaatgcaacaaaaccataaaatgaggctggtgggaaaagcagtgcatcttcctgggaaactggtctgctcaaaaggttgatatggcatcctttatatacttc

SEQ ID NO: 57502 - DNA, 601 bp, Human
ctagtttttaaaaattttttttgtagagacggggtatccctatgttgcccaggctggcctcaaactcctgtgctcaagtgatcctcctgcctcagcctcccaaaatgctgggattacaggcttgagccactgggcctggcctatttttttctttttctttctttttgtttttgagacaggtgcagtggtgatcatggctcactgtagcctcaacctcctgggctggagcaatcttcctgtaaaggcacttttgactctcgttaggacttgagtgtctgtcttctcccttctctgacccctstacaaccaattgtgcagcagttttggcaagaaaatagatgtcaggggctcaaaatagaatgaaccagaaacacggaagctaccaaaaaccagtatgaaatctctggaagttcagctggcccaggagatgggggacaatgatagtcaggatttgaaaagaaaggaatacaagtaatgacgacatttgttgaatattattgagtaagactttctacaatactaccttctgagctgggttactagggctgtggaaagaggtgtagaagtgacaaaaagggtgtcatagcagctatctttatgc

SEQ ID NO: 57503 - DNA, 601 bp, Human
ggaagtgacaccctaactccaccccaccatctgcccccaacccgtagcaactcctactaaaaaaactcagtccttgacttgtagggaggtttgtgagctcctgccaagtgctgtaaatatttcaacatgccttgcttccttgaatgtatatgacctaggatctggcccctcctctccctgggctctcagagaactgaggaacaaagaaaacacagctagtatttagctacaggacacaggggtcaaattgcagaagaacacagtggggagatggaaaagatggagtgggaaggtgggagayggggaggaaatacttagagcaacatttagagaaatggatagggactctgtttttagaggctggaaaaggataataataataacaaccacttcataatttacaaagatctttcacatactcacactttgatttgacccttcattttcttattaaagtagatactgtatgtcttattttgtagataagaatactgaagcccagaaagttatgtgacttattcagggctaaacaactaagaagagacagtttctttttcaacttttattttaggttccggtgtacatgtacaggtttgttaca

SEQ ID NO: 57504 - DNA, 601 bp, Human
gcctcagttgtagtcccagatccactaaaaaaaaaaaaaatatatatatatatatacatatatatatgcatatatatatatgcatatacatatatataagagatgggatcttgctcttttgtccaggctaggttgcagtggcatcattaaaactcactgcagcctcaaactcctgggcttaatctgctaaatattaaatgtattacctcagggcactcacttgccctcaatgaaaatgctgtccattttctgcaactgtaaagtgggaatatgaatctctatacagtccttcactgcagtsaccttttccctaagtaacacaaaccacgttgacttttcattttccagaaactcccaacatagcacttgatgtgaccaaaaatattggcacatgatgaaattcaattgggtattttatttcataactgcctctgttgcaagtgtcaatgtaaactaagatgtagggctgggcgcagtggctcacacctgtaattccagtactttgggaggccgaggcaggcggatcacaaggtcaggagttcaagaccagcctgaccaacatggtgaaaccccgtctctactaaaaaaaaaaaaatacaaa

SEQ ID NO: 57505 - DNA, 601 bp, Human
agtaaaccagtatttagaacctctaaaggtcttaatctggtcctaggtgtggccaacatcagaacagcctagaaggtaccttgataagaaacccctaactccctaaatttctgactgggtaatactgagctcctttgggctcacttgggggtcatatttgctctctgaaacccagctgtatagatgcatgagctgtagtctactcagtagataataagaataggaaacatttacatagtactttgcatatgccaggcactgttctaagctagctagctagagatacatatatagacatagrtatcaactcatttaacaaccctacgtggtaagtactcttgctatcttcctgttacaaatgaggaaatagaggcacagagagtttaagtgccttaccacaataaacagctagtgaatggtggagccaggattaatccagacagtgtggctcactcaagtgggctccatgaaagggggactttcaatagtatcttacccataagacacaaacccctttttaaaagtaaaaccaacgtcttagaaaagtgatcttaaagtggagattattaaagagatttccagagatattgactcagcatat

SEQ ID NO: 57506 - DNA, 601 bp, Human
tctaagggcccagagcagtagccaaatattcatggactttgtgaataggtattttggaacacaggtccaaagccttgtcttgccactgcaggctctcctctctctcccacacactatactcctgcacataccacagaactactactgactgctccccacatggctgccatgcccagatgtctcctcttcagatttttttctcctctggcctctgaccatgccctctataccggaagcaaaatgtaggaggagccacaccctacctcctccactaccccttactccacttgagccctctctrcctaaaatggctggatggacacttaccaaggctgaccctatcctgcacattcttcattgcttcttcatggacatcagcaagcctttcctacccaccccagccagaagagcttctaaattcctaagggtcttttgcttccctctcttatggcctttagtattttctactttatagttaatcccctaatgaccctgagacagctcacttatataatcttacactgtcacttaacctttcaaactttagttactcatccataaaacagggatgacaatccctgctctaactttccccgagata

SEQ ID NO: 57507 - DNA, 601 bp, Human
ttttcaaccctcttctctgtttctaccatcattacaaaagctataaaaactacattcttactttttcagactcacttgcagctagaagttagaaagttaaaaccttcctaaatccatggaaccccctttcctttccaattgcaattttacactgaagtacattgcataaataatataaaagcaggaatgctctgatgtgatggaggcacttgtcagcctactggaaactccaccgattttttttttctcatttcttttgtccccatccatcctctccctctgcagtagtccctggaaaaayctgaagaatctctagagttgtgtatatctcttctttcccaggctagctactttttcactatcctaaaagatagagtccaggtccctcattttataagtgggtaaattgagccacaaagagatgaagagacctgcatgtggtctcacaagaaagaagcagaagttggtggcccaagtgttttgggcttctcaggccagatccctttgttgagtctgtgggcagtgtttctgaaggccttctatttttatgggattttgcttcagttttttcacagatgtcttgagccccctaatgaatttc

SEQ ID NO: 57508 - DNA, 601 bp, Human
cagtagtagcagtagctgtggcagtggcagaagattttaattaggaaacaaaccttagcaggagcggagagccagagaagtggcagggaagctacaggttacaacagatttgtgaatttagcaaagcacagtggtggcagggcctagctgctacaaagcagacatgttttagacaaatactcatatgtatgggaaaaaaactcgaggactgtatttgtgactaattgtataacggattattttagcttctgttctgtggaaagtgtaaagcattccaacgaagggttttaatgtaggttgtttttttttttgcacccatgctgttgattgctaaatgtaatagtctgattatgatgctgaataaatgtctttttaaaaaaaaagaagaaagaagaaaaatgaacaacaaagttgggagattcacacttcctaatttcacatctactacaaaggtacagtaataaaaaccgtgtggtacttgcataagaatgaacgtacagattaatgaaacaaaattgagagtccatttaaaaacccctttatatttcctgtgaattgattaatagcaaggttgccaagataattcaatatagataaaata

SEQ ID NO: 57509 - DNA, 601 bp, Human
aaaaaaagactagtcaaatgctttttgaagttcacatcacttgagtaaaatctttaataaataagctggctttaaaattattggtaaaataatattagaaatgttttaagaattattagcatttttgtttgtgtttattgatcaagtgctttcatgcttattcctccagaatacaagattagtcataagggttataaaactataaaacccagccaaaggcagaatgatctttgcttgtataatttttgataagtaagatggaatattgctggtttaatgaaaacagctaaatcctgagttmttggtaaaaaatacccttatatttaaccctaagtttgttacttaaggaaacacctgaaattcaaagccatcaaaatggttaacagggaagtaacttaaagaatgactaacacctgaaattcacggctatcaaaatggttaaccgggaagtaacttaaggaatgactatcacagtttttgtatataatctaggtaaacaattaaatcaatcaatcaggtaaatataatgaaagaaatgcttgtaaacaaacttgtcatataatttaggatctaaggttattaataaatattaagtatctgg

SEQ ID NO: 57510 - DNA, 601 bp, Human
aatttaaaagtctaagttaggaaacaatgaggtcttatgaatctataagatgtacttctatcggcatgcctaatacatctatgtatttatgtgttgtgtacacaatgtttcactactaaaaatatataaaagagctctaattaattggcttaaagaaaaacaagtgcttaaataaaatattttatcaaaaaaagactagtcaaatgctttttgaagttcacatcacttgagtaaaatctttaataaataagctggctttaaaattattggtaaaataatattagaaatgttttaagaattrttagcatttttgtttgtgtttattgatcaagtgctttcatgcttattcctccagaatacaagattagtcataagggttataaaactataaaacccagccaaaggcagaatgatctttgcttgtataatttttgataagtaagatggaatattgctggtttaatgaaaacagctaaatcctgagttcttggtaaaaaatacccttatatttaaccctaagtttgttacttaaggaaacacctgaaattcaaagccatcaaaatggttaacagggaagtaacttaaagaatgactaacacct

SEQ ID NO: 57511 - DNA, 601 bp, Human
ttgctccctaaggctaccatctccaagcaaccagaactgactcccccagaaatgggcacagccagtgatatggaagtgctaggaaggaaagagcatggtccctttaaatgatacaaggggttaaggtcctggcccctggctggggcttcaccccggacctgtgcctatggacctaagtgaggacaggcatttttgtttatctgcccaaatgttgcatttcccaagacctcccctggcctgccacacccccatcctgtgcctataagaacccctagaccctagcaggcacacacacaagctrctggacgtccagaggagcagatcagcagaaaaagacacaggcagctaaacacagagaggagcgcatcagtggaggaacacaggggcagctggacgtccagaagaatgcaccaacaggcactagcacacctgcaggcctcgaacagccccgaccagcagaacaacgtggagtttgactgggacactcggaggagagcccaggccactgagcgacccgactccaggggaaaaccctcccattctagctccttctggcttcccccaactgctgagagccacctccactcaataaaaccttgca

SEQ ID NO: 57512 - DNA, 601 bp, Human
atagagaatgtgcacaaactgtcttgtgtcccaagacagttttgacataaaaagccaaattatacctcattttaatgccaaaacctcaccccaaagtgaacttgggatgtatgttacaacatgtttagccaatgtgcatgcacttggctcttctcataaatatgtatagctttcccctcaaacctactgaatatgtaagataccagtcctgtgaggcataagacccaatctgtccttcccttctttgaagagagtacctttggtcactctctttgctggagactttctcttcccagcttgyagaccaatattgctaataaagttctcctttctactatttagccatcctagtggttttttggataataccagtaaaaaaaatattttattcagaaactattacaagagatgatggggcgtggtggctcacacctgtaatcccagcactttgggaggccaaggtgggcagatcacttgaggcccagaggttgagactagcccggccaacatggcaaaaccccatctctactaaaagtacaaaaatgagccagatgtggtggcgcatgcttgcaatcccagctacttgggtggctgaggcaca

SEQ ID NO: 57513 - DNA, 601 bp, Human
catatggaaaatttttttaaaatatacattctattccagaatatagctctgcaataagcactgttttaaattactagcaactgagtaatacaggagtttccagctttctggttcctggaagagggtcaaatgccctgtgttccctggacctcaattaccagctctgagaaataagggacaggatgtcaccatacccgtgtttcctccttcatccaaagtctgatgggggtggggcagaccttacgccagttttagccagtttatagagaatgtgcacaaactgtcttgtgtcccaagacarttttgacataaaaagccaaattatacctcattttaatgccaaaacctcaccccaaagtgaacttgggatgtatgttacaacatgtttagccaatgtgcatgcacttggctcttctcataaatatgtatagctttcccctcaaacctactgaatatgtaagataccagtcctgtgaggcataagacccaatctgtccttcccttctttgaagagagtacctttggtcactctctttgctggagactttctcttcccagcttgcagaccaatattgctaataaagttctcctttctactatt

SEQ ID NO: 57514 - DNA, 601 bp, Human
acatatggaaaatttttttaaaatatacattctattccagaatatagctctgcaataagcactgttttaaattactagcaactgagtaatacaggagtttccagctttctggttcctggaagagggtcaaatgccctgtgttccctggacctcaattaccagctctgagaaataagggacaggatgtcaccatacccgtgtttcctccttcatccaaagtctgatgggggtggggcagaccttacgccagttttagccagtttatagagaatgtgcacaaactgtcttgtgtcccaagacagttttgacataaaaagccaaattatacctcattttaatgccaaaacctcaccccaaagtgaacttgggatgtatgttacaacatgtttagccaatgtgcatgcacttggctcttctcataaatatgtatagctttcccctcaaacctactgaatatgtaagataccagtcctgtgaggcataagacccaatctgtccttcccttctttgaagagagtacctttggtcactctctttgctggagactttctcttcccagcttgcagaccaatattgctaataaagttctcctttctactat

SEQ ID NO: 57515 - DNA, 601 bp, Human
aacatatggaaaatttttttaaaatatacattctattccagaatatagctctgcaataagcactgttttaaattactagcaactgagtaatacaggagtttccagctttctggttcctggaagagggtcaaatgccctgtgttccctggacctcaattaccagctctgagaaataagggacaggatgtcaccatacccgtgtttcctccttcatccaaagtctgatgggggtggggcagaccttacgccagttttagccagtttatagagaatgtgcacaaactgtcttgtgtcccaagayagttttgacataaaaagccaaattatacctcattttaatgccaaaacctcaccccaaagtgaacttgggatgtatgttacaacatgtttagccaatgtgcatgcacttggctcttctcataaatatgtatagctttcccctcaaacctactgaatatgtaagataccagtcctgtgaggcataagacccaatctgtccttcccttctttgaagagagtacctttggtcactctctttgctggagactttctcttcccagcttgcagaccaatattgctaataaagttctcctttctacta

SEQ ID NO: 57516 - DNA, 601 bp, Human
taacatatggaaaatttttttaaaatatacattctattccagaatatagctctgcaataagcactgttttaaattactagcaactgagtaatacaggagtttccagctttctggttcctggaagagggtcaaatgccctgtgttccctggacctcaattaccagctctgagaaataagggacaggatgtcaccatacccgtgtttcctccttcatccaaagtctgatgggggtggggcagaccttacgccagttttagccagtttatagagaatgtgcacaaactgtcttgtgtcccaagwcagttttgacataaaaagccaaattatacctcattttaatgccaaaacctcaccccaaagtgaacttgggatgtatgttacaacatgtttagccaatgtgcatgcacttggctcttctcataaatatgtatagctttcccctcaaacctactgaatatgtaagataccagtcctgtgaggcataagacccaatctgtccttcccttctttgaagagagtacctttggtcactctctttgctggagactttctcttcccagcttgcagaccaatattgctaataaagttctcctttctact

SEQ ID NO: 57517 - DNA, 601 bp, Human
ataacatatggaaaatttttttaaaatatacattctattccagaatatagctctgcaataagcactgttttaaattactagcaactgagtaatacaggagtttccagctttctggttcctggaagagggtcaaatgccctgtgttccctggacctcaattaccagctctgagaaataagggacaggatgtcaccatacccgtgtttcctccttcatccaaagtctgatgggggtggggcagaccttacgccagttttagccagtttatagagaatgtgcacaaactgtcttgtgtcccaakacagttttgacataaaaagccaaattatacctcattttaatgccaaaacctcaccccaaagtgaacttgggatgtatgttacaacatgtttagccaatgtgcatgcacttggctcttctcataaatatgtatagctttcccctcaaacctactgaatatgtaagataccagtcctgtgaggcataagacccaatctgtccttcccttctttgaagagagtacctttggtcactctctttgctggagactttctcttcccagcttgcagaccaatattgctaataaagttctcctttctac

SEQ ID NO: 57518 - DNA, 601 bp, Human
caataacatatggaaaatttttttaaaatatacattctattccagaatatagctctgcaataagcactgttttaaattactagcaactgagtaatacaggagtttccagctttctggttcctggaagagggtcaaatgccctgtgttccctggacctcaattaccagctctgagaaataagggacaggatgtcaccatacccgtgtttcctccttcatccaaagtctgatgggggtggggcagaccttacgccagttttagccagtttatagagaatgtgcacaaactgtcttgtgtccctagacagttttgacataaaaagccaaattatacctcattttaatgccaaaacctcaccccaaagtgaacttgggatgtatgttacaacatgtttagccaatgtgcatgcacttggctcttctcataaatatgtatagctttcccctcaaacctactgaatatgtaagataccagtcctgtgaggcataagacccaatctgtccttcccttctttgaagagagtacctttggtcactctctttgctggagactttctcttcccagcttgcagaccaatattgctaataaagttctcctttct

SEQ ID NO: 57519 - DNA, 601 bp, Human
gcttgatatgtgttacaatgtttagctgttaaaagtaagtatttcaaaagtaccacaatttttgagactgtattttggcatttcttcatttacaaatatccagagagcctcacaaaataaatgtgttgtaagccttccaccaactcctgagtgtagagatctttgaatgacagggtcaagaaatgcacttgaacctttaggaactggagagcccacacaagtcctagtggaatgttaaaaactatgactgtggttattatatccgcaagggtatggaggcaggactgaagctgccactgaygaggctggtatctgaattttttagggagggtaggaaggagcctggtctggggacctactgaatggtagcagagataagactgaatcacatacgcaagagtttggaataacaacacagtgatcatctagactaacctcctcattttacatgtggagaaactgaggcccaggaagattaaatgatatcacccaaagtcacaaatctgttagtaccagagcctaaagtaacacactgtatttttctactacacaaagatttaagatatcaaaagagacaagagtctgtctgcagaggggagag

SEQ ID NO: 57520 - DNA, 601 bp, Human
tatgctatttcatttaattttcacaccaactgcataaagtaaataatattagtgttccatttacttgccctcaagtaaataaacataccaagaaagacttggtaagtagactaggtcacacagctagtaagtggtagagttggcatccaatccaggtctgtctgacaataaggtctttgctcttagctattatgctatatgtaccctattttgcaaagaaagaaattgaggctgaagagtttgaatgtcttctccaaggatacgaagcaagttagtaccagaagaccagaagtaggcctamctttgggtcttctgaccctccatctaacgttatttcccttattcccagctgcattatctatggcatgccctcacacacttggtactatgctccaggctcctgtggtcactatgagattggaacatcagggatcaggtaaacatgccatcttccagcaaggtcaagggttaatcttcattccttgatgcctgatctgtaacgaaggtgcaaagaaggcaaacagcttgctccagactccccactgtaccaagagtggagaaattccactcctgaagttcttaactttgaagtctgggcttg

SEQ ID NO: 57521 - DNA, 601 bp, Human
acctatgtaacatatcttcacatgtacccccaaacctaaaataaaagttaaaaacgaacaaacaagacagcaaaaagaaatagaagacacacaggtaggaaatgaagaagtaaaaccgtctttatttacagacaacattataatttacctagaaaaatcaaaggactctacaaaaaaagctactagaactaacaaataagctaagcaagatctcagaatatacaaagtcaatatacaaaaacaaattgtatttatatatactagcaatggataattaaacatcgaataaaaataccatttrcaatgtcatcaaaaatttgtaatacttatggataaatttgatttaaaacatgtcagacctctatattgaaaattacaaaaagttgctaagagaaattaaagaagacaaataaatggagggatatatattgttcatgggtcagatgtcaattctctccaattgttctgtagatacaatgcaaccctaattaacatcccagcgaggtttttttgatagaattttgcaagttgattctcaaatttaagtgtaaaggaaaagaacatagaattgagaaaataattttgacaaggaataaagtta

SEQ ID NO: 57522 - DNA, 601 bp, Human
ctacggttaggaatagggtgccaggtgcagtgggtcacacctctaatcccagcaatttgggaggccgaggcgggtggaccacttgagtccaggagttcaagaccagcctgggcaacatagtgagaccccactctctacaaaaaatacaaaaattagctaggcctggtggcacgcacctggagttccagctactcaagaggctgagtcagtaggatcacctgagcctggggaggtggaggctacagtgagtgtgatcgcaccactgcactccagcctgggcaacagagtgagaccctgtctcaaacaaacaaacaaacaaacaaaaaggatacaaaaaggatgtctgctctcactaattctatttaacattccattggaggttctagctaatgcaataagacagtaagaagacgtgggagggtgggaagagggagagtagcagaaaagatatttactgggtactgggcttaatacctgggtgataaaataatatgtacaacaaacccccgtgacacatgtttacctatgtaacatatcttcacatgtacccccaaacctaaaataaaagttaaaaacgaacaaacaagacagcaaaaagaaa

SEQ ID NO: 57523 - DNA, 601 bp, Human
acagtactcactttggaaaacagtttggcagcctcctgtgaagttagtcatacatttaccatgatcccgaaaacccactgctagatattaactcaagatgaatgaaaacttatgttcacacaaaaacctgaacctagatgattacactagctttttttttcataattgtgcaaatctggaaacaacccaaatgtacttcaactggtgaatggataaacaaatgaatacacattaatacaatggaatacaacacagcaatagacaggaatgaactactgaaacttgaacaatctcaaaggcrttatgctaagtaaacgaagccagactcaaattattccttccacttacaggaaattcgagaaaagacaaaactatggggacaggaaaacaaatcagtaggtggcaggaggagggatgagggagacaattgactacagagggacatgaagaaactttttgggggtaatgaaaatgttatcaagtttcatcttgagtctctcttttctaagctttatatgttacatatcttgatgatggtggtattcttttgtcaaaattcatagaactgagcatgtaaaaaagggtgaatattaccatatgt

SEQ ID NO: 57524 - DNA, 569 bp, Human
agtttcatcttgagcctctcttttctccgccaaataatcttcgtttccttaacttttcctcttagctttaatttctaactctgaaattaatttcagaactctcctttgaacacttccagctcttcatcatcatcatcaaagagtgacacatgagctaggcactgggccaacttctggctctctccaattgtggagccccaatgggccaaaggagctcagtctggggctagtcaactggctgtgtctcttacctcagtgccaaataggttgctcagctccccattgggaatctttactttgytggagccttaccctgagccctctctgcctggcttcaaaagtactagcctgggacagcaggagaccttaactttttatcacaatttcacctcttaccttgccatttcatctcctatcagctgtgagatcttgagaagtcacacagcatttctctaatcctcagttttctcatctgtgaaatggagattaaaatttctgcttgtgcctgcctcaaacatttctttttctttttctttcttttgttttttttttgtttttttttttttttg

SEQ ID NO: 57525 - DNA, 601 bp, Human
agaaatggagttgccgggtgtggtggctcacgcctgtaatcccagcactttgggaggctgaggcaggtggatcacgaagtcaggagatcgagaccatcctgactaacacagtgaaaccccgtctctactaaaaatacaaaaaattagctgggtgtggtggcacgcacctgtactcccagctactcgggagactgaggcaggagaatcgtttgaacccagcaggcagaggttgcaatgagctgagatagccaagattgcaccactgcactccagcctggtgacagagcaagactctgtctcaaaaaaaaaaaaaaaaaagagaaaagaaaagaaattggagttctcttgtcattggttttctgttcctcgttccctgggataccaacagtgcccttctgggaaaatggagggagaaaaccaggagtgctgaaagatggcaagtcaacacttttcctgctgaaggtgagcctcactggcttaattctggggtattactttaatcaaatatcttctacaggctcagttcagaagccagcagaggaggaggaggatgtccctaggttttaataaaaccagagcctgctttctcttctcttcctac

SEQ ID NO: 57526 - DNA, 601 bp, Human
tttgatttctttttaatacgccaatacttttttgcttttctgtatcttttaaggcgttacttaagtaacttacttgaatatattttactgaagaacacctttcggtctttctgtaacagctaagttatttaaaatggtcaatcaattagcacaagaggataatgttagaagagataggggctaattcaaacaaactttgaaaaaaatttcacaaatcaattaaagtctgcccaattttatgtttaaacaaagtcagccaacacattctttgtcctccccagacattcctgagaggttctgycttctacactttcaccaattatttcgacttcgcaaacagcacaatcagccttttctgcaaaccttagggctgtctcccctgtgtatgtccgttcatctaagccaagcttttccgaaatcaccgagtcattcacagtccttaaataaacacctctaagtcatggccgagcatctaatatcacagctactacagcaagactatcttagctctacccactctcgcgggtttccaaattggtgtcatctgctctgtagacacagcgaaaataaaaactggaaggaaactgaaggcgccaaggcc

SEQ ID NO: 57527 - DNA, 601 bp, Human
gtgacatgacatcatgagaccaggcatcaacagacaggtttatcattaaagtaacaaaagcaaaaaaacatcaacatctccctgaaaaccaggctacatatcccaggtggctcgttttcattcccctccaggcaccctatctcctttaggatgttatgggtatgatttttatcaaagaacagtacgcaactaactactacctaggaaggcatcaagatgtcaaaacattttaacaaatacatgccaacaggataaaaatcctattctgcctacgtcatgattttaacaaaccatgtggatrtattttataaattcaagcaccaatataatggcttaacttcctaagtgactaaacatttcaagtattttaaggagaggaagcataggtctagcaaagcacatttggggtgatgatgtgctacagtcagcatattctctaggaagcccacagcaacatgctttttcttttttttttttgagacagggtctcactctgtagcccaggctgagtgcagtggcatgatcatggctcactgcagcctcaacctcctgggctcaagtgatcctcccacctcagccttccaagtagctgggattacag

SEQ ID NO: 57528 - DNA, 601 bp, Human
attcaaatagtttccataggaacacagataagtgtgacccatatcctagtcttccatatggctgcatcatggcgaccctactcttacaaagacatttcaaaactagcagtaattaagttacatggtccccccaaatcccttaattcaagctaaacttgcagttaacagctaccagagtgctatctacacattaatactagccgaagcacaggctgctctgtggcgtttcatcccactctcccaggcacaagacacaggcagggtgctggcatcctgttcctctacttcgggtgggaagtcrgggttctggaattgctgcatgagttgcctgagaaagaaaaagtggcatattaaaaaccctgactcactcctaactgggcatgagagtatttacttcccatcaggaaacaattcaatgtattttttttttttctgagacagggtctttctctgttactcaggctggaatacaatggtgctatcatagctcaccgcagcctcaacctcccaggctcaagcaaacctctcaccttagccaagcagctgggactacaggcgcccactaccatggccaactaattttttaattttttgtagagac

SEQ ID NO: 57529 - DNA, 601 bp, Human
ggatcttgagcaaacacatacccctaacatctgtcggttagagtaaggttattgaaattatcttggcatttttaattagaagaaaatggggcttcagttttctgtttcctccacacaatcttaacaagcatctaagacactaaagatacagaaacctgatgactgagattgcctgagaatcagcaaagaaaacccaatgattataaacacattttaaaagaaaaagagcatcactttacaaaatgtggctacttgcacatgtaaggagttgaagtgaaggattcctgtggagtagaagtgkgatgggtttggaatgcatggattgttttagaaagatcgcctattggaacacagtgccagagtgcatcagtttggaaggtgataaggtgagggtttttttgtttttgtttttgaaaaaagaagaaagaagaagaagggtctttgatagaggagcagttatgggagagattaagtgatccgaagagaaaaaaattagagagtaaaggctagtaacaaggactccaagaattgaggaggctgtagggtaagggaagggtgggccgtgtcaaaactcaccagctccgtccgcagtaacgatggc

SEQ ID NO: 57530 - DNA, 601 bp, Human
gcaaagattaatagcaaatacatttctgtgatgattttgcacaactagcttttggttcttgattaaaatcaagaagacaataggtatattcaaaaagtgataaactaagtgaggtcaccattaaaaagttcttgaaattcttctgtttattttttttccttcagctatttttacaattacttctccttctctcactttgttaaatgagtcaacgtgcacagaaggtaatttttccaaatcaatttcccgataactaagaattactacctggaaatggactggggacatgcgcctagactgygcaagttgaaagaggaaggaaagttgatgcccaagaaataaacagatggaggcaaccaagtcaacacatctaagaacagagttgttggggggtgggggatgtggtatgaaagaggaccactcatgaaaaaaaattgccttctttataaaatatatgaagggtaaaatttgaggttgggttagttggtagaagtaatactgagttagaattaaatggaccataatgaagtaggtttagttggggtcttaaagttacaaatgtcataattagactaaacactagtgagaaaacaacttgtga

SEQ ID NO: 57531 - DNA, 601 bp, Human
aactcagggacacttaatgaaactgcttcctatccatattgactatggctttttgagagccattaaccttgccaaacctcactcactctaggtccacctctaagggaggtttaagagcaagttttgtgctttacggggaggaatgcatttcagcctgaaccactgccacctcattcctagcccttggcctgagaggagcacctgcatttaactgattctaagtgcctggcaaaccagagcggcaactgcactgagcacttccagactctgcagtctgtgactttagtgagtacgaagcctyaagcatgctcttttagcaaagattaatagcaaatacatttctgtgatgattttgcacaactagcttttggttcttgattaaaatcaagaagacaataggtatattcaaaaagtgataaactaagtgaggtcaccattaaaaagttcttgaaattcttctgtttattttttttccttcagctatttttacaattacttctccttctctcactttgttaaatgagtcaacgtgcacagaaggtaatttttccaaatcaatttcccgataactaagaattactacctggaaatggactgggga

SEQ ID NO: 57532 - DNA, 601 bp, Human
ctctggcattttaaagaagcttagaaatcaggtcccatgaactgacaaattgtttccatgcatgtcctatttgagtgcttcaatgaggcaactgtttccatgtttgttccacagtgattggtaactcagggacacttaatgaaactgcttcctatccatattgactatggctttttgagagccattaaccttgccaaacctcactcactctaggtccacctctaagggaggtttaagagcaagttttgtgctttacggggaggaatgcatttcagcctgaaccactgccacctcattcctwgcccttggcctgagaggagcacctgcatttaactgattctaagtgcctggcaaaccagagcggcaactgcactgagcacttccagactctgcagtctgtgactttagtgagtacgaagccttaagcatgctcttttagcaaagattaatagcaaatacatttctgtgatgattttgcacaactagcttttggttcttgattaaaatcaagaagacaataggtatattcaaaaagtgataaactaagtgaggtcaccattaaaaagttcttgaaattcttctgtttattttttttccttca

SEQ ID NO: 57533 - DNA, 601 bp, Human
agtcacacaaagttatgcaaatataaaatgtgtaagatgaataataatggtcaggatggaacccgttcttttcaaaaatatgattacccttagtattttgaaagcaaaaagtagtttcaagcattactccatttcagtaagactgctttgtaaaaggtcctaagcttgtttgtggagtcatgatatactatgagagaacagatccccatgaatgggtaggatttgaaaatcctcttggcatcagaagaatgtgaaagattgtcctattttattcagggagacctcatttttatatctagtkggacagatactagtcaaaagacacagggattctgtttatacccagttgaataagaaaaaaaccttgctttgtgaactatcacttcccactgaaccaaagagtatattggatattgcatggtaaattacactggccacatgtggtagttcctaagtaattccaggtgtctgacagtttgacccagcatagggaatgtaattttcaacaagctggccctggaagccaggagacccttcaggctacaatctacacacttcattcccaatttccacctccccccacctttgagctccccttgcc

SEQ ID NO: 57534 - DNA, 601 bp, Human
agttaaatactactaacataacactgagatactcttccctaacccatccagagtgcctttcagtattttacacaatgaaggatcttcagaagcatgttttccctttaattctaatctaaaatttccatttctcctttccattttcctcctcatatcacactaaataattcttccttcttggtacttggcccctcaaatatttgtagaacagggctaaagaaaagactgcctgtttctctgagagtggagaaacgattaaatggcagctcctgcatatgaaagttggcacggctcatgccargagagagaaggcctgcagaaacgtgttgagcaagagctggggagaaaagttaacactgccccagaagccagcactgactgaggaatgattataaagcccttggcacggcaaactgtaggtgttgtggaaatagctgtgaaatatcataccataaattttcttaactgcttgattcctgggtttctgagatgaattatttgtaattaactcctccaccagactcattcttttttctgtcgctcccaaggggatctgctcttgagcctgaggtctaggtcaatttgtgtaaaaggaaatact

SEQ ID NO: 57535 - DNA, 601 bp, Human
ttaattattcaaaactatctctatttgttggctgttggtctcctcattctagacaccaagtagaactagaagagctaaatataacctagtcagttttgcaatttgtagcaacaactatttgaaggtttagtgggaatgagataaaaagtaaattattaagatttggagactacataagattacattactcctgataatgggggttgctctaaataaagttaaatactactaacataacactgagatactcttccctaacccatccagagtgcctttcagtattttacacaatgaaggatcytcagaagcatgttttccctttaattctaatctaaaatttccatttctcctttccattttcctcctcatatcacactaaataattcttccttcttggtacttggcccctcaaatatttgtagaacagggctaaagaaaagactgcctgtttctctgagagtggagaaacgattaaatggcagctcctgcatatgaaagttggcacggctcatgccaggagagagaaggcctgcagaaacgtgttgagcaagagctggggagaaaagttaacactgccccagaagccagcactgactgagga

SEQ ID NO: 57536 - DNA, 601 bp, Human
aggactataacacccacaattacaattaatgaattactttcccaggtttagtaatcatcagcaagtatttaaaaagcaatatccaagaaaagatagcagtcagcaaacaaacagataagcaagtaacaaacactaattctaaaacatttggctcaacttgggcataaactattaattactaatactttcattatattcaaacatttattcatgataaatgtacccaagtattacagtaacgtgccagtggtttttctatttctgaataatcatgtgataaactacatacaaaaataatgtyttcataaaggaagaaattatattggcccatatttgaaatgtttattgttcaaaggtagaaataagagtgaaaaataaaactttgcttggtgaaagggaatcacttcaaaatagctaagccaaggagagtgttttacttcttccattcttattcaaaggaaaatgtttctacgcttttacaaatgcttagaagtcaattgttagaactgtaagacagaaaacaaaaattttctaataattgatcaaaaaattattgtcagaaagttaaacttaggaattctaacaacaaattaccctaaat

SEQ ID NO: 57537 - DNA, 601 bp, Human
tgtacctagcaatatatccttattgacactccaatttagtactttatataagagttttacatttgtagtaacactttatgctaaactaatttaatgcctctatttattctaggagaaaatagtattcttcctttgtcctttttgtttataggtcctatcaggaataaattaaacaaggggttaatactattttaggactataacacccacaattacaattaatgaattactttcccaggtttagtaatcatcagcaagtatttaaaaagcaatatccaagaaaagatagcagtcagcaaamaaacagataagcaagtaacaaacactaattctaaaacatttggctcaacttgggcataaactattaattactaatactttcattatattcaaacatttattcatgataaatgtacccaagtattacagtaacgtgccagtggtttttctatttctgaataatcatgtgataaactacatacaaaaataatgtcttcataaaggaagaaattatattggcccatatttgaaatgtttattgttcaaaggtagaaataagagtgaaaaataaaactttgcttggtgaaagggaatcacttca

SEQ ID NO: 57538 - DNA, 601 bp, Human
atttgggtaagaatccaattgtctgaaggaagtagatttttattaacgtcatgaggtcggcattcttatcattcatgggttgagtatggatgagacttattttttcatgtggttataaggaaatactcttctgaatactcaactgtgcataaaattttagaatttaataatttatttgaatttcacaaaatttgtaaatgataagcatcctatcatgataaagcctatgcaaatattaggcactcatccaacacttatgacttgatgacaaaaaaaaaaccaaacgcatcttcaataaatrgacatatcacactgaactggtatatatttaaatccttagttcctaaacgaacactcagaaatcattctcatgtcctttaactgcaggctaaataattcttcaacagaaaagaaacctactattcagggactattcaagccagtgcaattaatagatgtgacaataattagaaattgctattgattctttttaggatgccataatcccagaaaatagtaatgataaaggttttctgtgttctaattaagaaagcagcctctaatgaataacagtgcaccagcggaacaccgtgctgagaga

SEQ ID NO: 57539 - DNA, 601 bp, Human
caaagctaaacatatacttaccatataacccagtgatcctattcctacatatttagcctagagaaataaaaacttacattcccacaaaaacctgtactggaatgtttatagtagctctattcgcgattgctccaaactggagacaacccaaacttccttgaaggagtgaatgggtgaacaaatggtcatacatccaagtaataaaatattctgtaataaaaaggaatgcaccattgatatatgcagcaattggttaagtctcaaaggcgtactgtcagtctgtctatatggacaatcgaayctcaaatagagaaaactatagtgataaagaaaagatgagtgattgccagtggatgaagatagggaaaacttgtaattataaagggatacagcttgaaggagttttgggaggtgatggaattgttctgtatcctgatgtggtggtggttacataaatctctacataatattaaaattcatctgtaccaaactatatgtccaaataaaagtccaattttactacgtgctaattttaaaaataaaattaatataaatgagggaattttaaaaagtttacttgtaaaatgtagggcacaagctt

SEQ ID NO: 57540 - DNA, 601 bp, Human
attgaacattttaccaaaaagcatatatgtggatagcaaataaacacatgaaaatgtattcagcatcattagccattagggaaatgcaatttaaaaccatgatgagctattatcacatacctattaaaatggctaacaataaaatatattgataataccaagggctcgcaaagatatagaacaactggaactcttatacattactagcacaaaattgaacagccatcttggaaacagtttggcacttttttacaaagctaaacatatacttaccatataacccagtgatcctattcctacwtatttagcctagagaaataaaaacttacattcccacaaaaacctgtactggaatgtttatagtagctctattcgcgattgctccaaactggagacaacccaaacttccttgaaggagtgaatgggtgaacaaatggtcatacatccaagtaataaaatattctgtaataaaaaggaatgcaccattgatatatgcagcaattggttaagtctcaaaggcgtactgtcagtctgtctatatggacaatcgaacctcaaatagagaaaactatagtgataaagaaaagatgagtgattgcca

SEQ ID NO: 57541 - DNA, 601 bp, Human
acagaatgagctttggttttgcctatttgttttcatcactctcattatgccagagaactggaaaacatttttaaaagacgaacagtaaacactgactctgagaacaccacattcgttctaggtagttttacatgttgaactgttttttgtatattgttgatagtgttgttgatgtgttttctttctttcatacattgaagtgctatattactctaaccataactttggaacaaattggtaacatatacatgtccttggccagaaattttgacccaccaattgcagttttatacaaatgagmttttcagttcgggttgagaaaacataatagaaggagtgacccttcaaatagcaacattactggacagcaatgatttccaactgatttcatgatattgaaaaacattatcaattatataaagtaacaaaacaattctaaaataattttaatttacttatgtatttaatgggataaatatttgttgggacacctttggtagacattccctcagatcaaacatatcaccatgataagattcagtggaagtcaacagagaaaactgtcccaatgtaatgaaagttgatatttcaaacttattta

SEQ ID NO: 57542 - DNA, 601 bp, Human
ttttttctccaataaggtgtggaagttggctctacagtcagtaaacatttgtaccaaagaaaaaaactgaacttcttcccaaaattggtagtaagccagaagggaggaaagaagtgtaatagaaagaaagagagggaatgggtctatactacccaagctaagcataaatcatgtcagcaaaagtgggagtggctgggcaggcctggcagctgcagtcatcaggaatctccagttgctcagtggccaccaggcagctacccagaggagcttctctggagcacctttggaacagcgccaagarcaggttagtgaaaactctgggagagcatctgacttacactaatgttccctaatttaagataaatcagaagggaactcagatcaatacaatctgattttatattaggaaacaggccccaagaaataatttggtcacatttatatatttagtgtcagaatttaccaactctatctccgctctggagacatttgtgtttttcaaatgtgaaagttcataaattggtcaccctcacaaagcagaaaattggaagaattactttttggaattattttaattaaaaaaaaccctttgcattggacc

SEQ ID NO: 57543 - DNA, 601 bp, Human
agccaagcacagagcctcagtgactgtctatagctgagggacaagcagagaagaactaggacaatttgggtaatagctcaaggagagaaatgcttaggaaagagaactggtcaaaagtatcagttgttgcaaagtaatggggaaaaaaaatcctatagttttaagctactgtaaaatcacaaaaatactatttgtctatccttttttctccaataaggtgtggaagttggctctacagtcagtaaacatttgtaccaaagaaaaaaactgaacttcttcccaaaattggtagtaagccagmagggaggaaagaagtgtaatagaaagaaagagagggaatgggtctatactacccaagctaagcataaatcatgtcagcaaaagtgggagtggctgggcaggcctggcagctgcagtcatcaggaatctccagttgctcagtggccaccaggcagctacccagaggagcttctctggagcacctttggaacagcgccaagaacaggttagtgaaaactctgggagagcatctgacttacactaatgttccctaatttaagataaatcagaagggaactcagatcaatacaatctgatttta

SEQ ID NO: 57544 - DNA, 601 bp, Human
gtaatcacaactagagtcataaaaatgataattcagcctatgtagcttgatgaactccaacaggaggaatccctatgaggagagaggaacagaagccaagcacagagcctcagtgactgtctatagctgagggacaagcagagaagaactaggacaatttgggtaatagctcaaggagagaaatgcttaggaaagagaactggtcaaaagtatcagttgttgcaaagtaatggggaaaaaaaatcctatagttttaagctactgtaaaatcacaaaaatactatttgtctatccttttttytccaataaggtgtggaagttggctctacagtcagtaaacatttgtaccaaagaaaaaaactgaacttcttcccaaaattggtagtaagccagaagggaggaaagaagtgtaatagaaagaaagagagggaatgggtctatactacccaagctaagcataaatcatgtcagcaaaagtgggagtggctgggcaggcctggcagctgcagtcatcaggaatctccagttgctcagtggccaccaggcagctacccagaggagcttctctggagcacctttggaacagcgccaagaacaggtt

SEQ ID NO: 57545 - DNA, 601 bp, Human
aagcagccagtcccaagtgtgtacagtatgcttccatttacgtgaagctgaataacgacacccatctatggcaatgaaaatcagaactgtgcttgcctcagggcagaatgggtgataagacaccagacaatttaaagaaatgttctttaggccggggtgcggtggctcacgtctgtaatcccagcactttgggaggccgaggcgggtggatcacgaggtcaggagatcgagaccatcctggctaacacggtgaaacccgtctctactaaaaatacaacaaattagccgggcgtggtggcargtgcctgtagtcccagctactcgggaggctgaggcaggagaatggtgtgaacccggggggtggagcttgcagtgagctgagatcgcgccactgcactccagcctgggcgacagagcaagactccgtctcaaaataaataaataaataaataaataaatgttctttatcttgatctggatgatggttacataaatatatacatttgtcaaaatttaaatgcagcatacacttaagatttgtagtattttactgtaaataaattataccttaataaagtcctattaacaaaaaataagacat

SEQ ID NO: 57546 - DNA, 601 bp, Human
aaaggcaaaccttatagtgggtaagaatgcttggcaatcttgattgtctatttgaattttctatcttgaatttaaagtgaaaccagtcacctcagttgagtaattttctcaaataactggagttgggatttgccagatgagtatggaagaggaagagaaagcaaagaaattgagggtatcttcaagggtatcagtattgcagtagaccatgatatctcacatagacaagaaggccagaggcttagcagatagtaagcagtagctgatggataggtaatctcaacatggtaaaaaaaaaaamaaaaacagcagtgatgatactgcaacaaatcatctggaatgaaaagaggcagcaggcaaagaatgggattcttagaattaatattacaatgctggcaccactgctagcaccactgaaaggcccagaactgctcatggaagtgagtggctggggtagaatagacaagcaggttagtaaagtgaagaaatcagtgcactagatggatcatctaccttatcatcacagctatcaaaacagcagcaggaatggatgccatggtggaacttgttcagatagtccttaaaacagaagatgggcaat

SEQ ID NO: 57547 - DNA, 601 bp, Human
tcatcaaatagaaaggcaaaccttatagtgggtaagaatgcttggcaatcttgattgtctatttgaattttctatcttgaatttaaagtgaaaccagtcacctcagttgagtaattttctcaaataactggagttgggatttgccagatgagtatggaagaggaagagaaagcaaagaaattgagggtatcttcaagggtatcagtattgcagtagaccatgatatctcacatagacaagaaggccagaggcttagcagatagtaagcagtagctgatggataggtaatctcaacatggtaaaaaaaaaaacaaaaacagcagtgatgatactgcaacaaatcatctggaatgaaaagaggcagcaggcaaagaatgggattcttagaattaatattacaatgctggcaccactgctagcaccactgaaaggcccagaactgctcatggaagtgagtggctggggtagaatagacaagcaggttagtaaagtgaagaaatcagtgcactagatggatcatctaccttatcatcacagctatcaaaacagcagcaggaatggatgccatggtggaacttgttcagatagtccttaaaacaga

SEQ ID NO: 57548 - DNA, 601 bp, Human
taagacagagaatatgaagtccataaaggagactgagaagcagcatccagtgatgtggaaggaaatacaggagagtgtggaattgaaaaagcgtcttccaaaataaaagcagggtagtcctctgtgtcaaatgaccctcagagctaaaatgagttcagagagaaaagggtccactaaattcaactggcaacgtgatgactggaccctgagcaaaagagagaataggactttgaaagctagaagactttatccactacacaagaaggaaaaggagagaaaggtactgatattgacaagtttrtaaattggttggtggaataatgagggtgttctttccaatggcttttaccttctcattgaagaatgaagtgaagtcatcagctatggggaatgaggggctacgaaaagcaggatgtgggcatgtaagcaaagaaagtataaagcagttatttcatcaaatagaaaggcaaaccttatagtgggtaagaatgcttggcaatcttgattgtctatttgaattttctatcttgaatttaaagtgaaaccagtcacctcagttgagtaattttctcaaataactggagttgggatttgccagatg

SEQ ID NO: 57549 - DNA, 601 bp, Human
aatatgagatgagaaagggaaagagaactaacatttgttgaactctttcagtcacttacatatgaattcattcattctgcaaatattgggcatctgctacattccaggctctgtgataggcatgtaggacacatgatgggcactacagacaatccagaagaggataaagacattgaacaaagaaagtacacacaaaataatttgtcacatgtgatacatgacatgaaattaaaacacaatgtatatgtgtaataagaacatataacttaatgacctaaactagtctggcctccaatatacygtgagaaaatgatatttaaagctttgggtgagttgtagttctctaggcaggaactacatctttatatataagacagagaatatgaagtccataaaggagactgagaagcagcatccagtgatgtggaaggaaatacaggagagtgtggaattgaaaaagcgtcttccaaaataaaagcagggtagtcctctgtgtcaaatgaccctcagagctaaaatgagttcagagagaaaagggtccactaaattcaactggcaacgtgatgactggaccctgagcaaaagagagaataggactttg

SEQ ID NO: 57550 - DNA, 601 bp, Human
aattttataatttgaagatccaggtccttaactatgacttttttactgagctctagatctatatttccaactgcctgtacgaggtatctatgagcagttccaaaatttttaacagttccataatttttaacatctggtaacatccatcacaccatgaatttgtctttcttctgtagaactgatagtagtatcttctgactccataactctggtgtatccattcttctgtaaatatgagatgagaaagggaaagagaactaacatttgttgaactctttcagtcacttacatatgaattcaytcattctgcaaatattgggcatctgctacattccaggctctgtgataggcatgtaggacacatgatgggcactacagacaatccagaagaggataaagacattgaacaaagaaagtacacacaaaataatttgtcacatgtgatacatgacatgaaattaaaacacaatgtatatgtgtaataagaacatataacttaatgacctaaactagtctggcctccaatataccgtgagaaaatgatatttaaagctttgggtgagttgtagttctctaggcaggaactacatctttatatata

SEQ ID NO: 57551 - DNA, 601 bp, Human
ttgcaaagttaacatgcccagtacttcgcagaagttagtctgcagctcaggggaaatgccccatgatacacgcagtgcccgagcagtgaacagccttgctgcctcagagtagcttcttataaagatcaaaatagttcagaggagacaagaatcttagccttctttattcagttttgctcatacaaatatgctcatttattttttaaaaacaaaaggatactagtatttttgatatgatcttagaagatctaaagaagtctaagtccctgatacagctatgaaatatgacactcactggacygtcactatttaatgcaacattgtttgagttcaagcttaagtgtgataaaactttctaactatccctgacctttgtttgaaattgaatgcttttgggtcttatccagaggtgtaagactataattaacttcatcagatccccaaactctcataacctttcatgtaccatgactttggaggactactatgtttgagtggatatttttctgttttttctaggaaaaaaagcctcagatctgtgcttaggatttattgtcaaaaactatggggaaggagagaagaaaatacaattgtatttgtg

SEQ ID NO: 57552 - DNA, 601 bp, Human
ttaggttattcatgaaaagggtatcttagatcaatagatctgaaacataatcctcatctgaattatgtttacacacatcaacgtacacatccccacaagcccaagaactgtgaaattgtgaagaatcagagagaggtatgttgcatgcattagctgtcaccttttttgtgcctgctaccctaaatcagatgtaacagtttatttttattacctatagttgatttcttgatactctttttggggggcctgtagcattaccatcatttcttgtttaattgctagtaatcttcctctcccaacytcctaatggcacaagttttttagaatggaaaatgaaatctattatttactgagctttgcacaaaaaccattagatattgatttttctgtatttcactgttgagaagaaaagcttataaatgaattagcatctgccttggtgctttatgtaaggaaaaaaaaatactttaaaagttaaaggagttggttttgacaaaataggctaagtagtgacaaagagatcttcaaacatgggcagttttaacattagcaattcatttacctcaaagcctgaaattaatacaataccttcaattgtggg

SEQ ID NO: 57553 - DNA, 601 bp, Human
agagaaatttcattttttaacaatatttggtgagtagtgaccagaatgcatattttatgtatatattaggttggtacaaaaggagttgtggttttggccatcataataataacaattctaattatctcaaaatgtttcatctatagggtagattcatttgacaccttgaagagtagattattataccttttatagaagagctacaaagctaatattacttagctaagaaatatacatcataagcatggcaaattgtcaggaattaatgtcaatataaaagtagaaaataatacacaattaycttaaaatatttaattatatgtaaagatttctttaaataatgcccctgagaaagctttagtaaaaattaaatggtatgtgcttctcttttgacacagaaaggaaataagaacacataaattagagaaaggacatcaacaaaaaaagtttcacttaaaaggcattttatggctgggcacaagcgctcacgcctgtaatcccagcactcactttgggaggccaacatggtgggggaaaaaaaattgctttagcccaggagttcaagaccagtctgggcaatgtggcaaaaccccgtctctac

SEQ ID NO: 57554 - DNA, 601 bp, Human
caaatcctgaggaaatgctgttcacccccatgcatgagaagagcatgaccccttaatcctgaaagaggtatgctttatgcttatggaagtattaatattatgaataccaactgggaggcaattttctgcctatgctcaggtagctggtttgccctgtggactatcacctaatgtttttttacttttaacagatgacacagtactcctcctactattagctcctagatctgaaagcaactcaaagagataagcaagtgttattacaacccagtgaacttggtgaagttcttaagaggggcartgagccccttctataggtaaaatagctaccattcaactcaatggtatttttgtgcttgttggaggaaattatgcaggtattttgaaaagagaaatttcattttttaacaatatttggtgagtagtgaccagaatgcatattttatgtatatattaggttggtacaaaaggagttgtggttttggccatcataataataacaattctaattatctcaaaatgtttcatctatagggtagattcatttgacaccttgaagagtagattattataccttttatagaagagctacaaagctaat

SEQ ID NO: 57555 - DNA, 601 bp, Human
gctctaataggcttacatttacagcgttctgaaaaacacattttagttataagcacatttccaatattagctttcttttgttttgctcagactcacattttttgctcagactagatctcaatttggtggtgagaaggctcttgtcaattctgtgtgtctgaattttttctcctggaactacattcatgtttattctatctacatgtcctcttattcaatgtcagtatgctcatgagaacgagtttccattctcaacaaaccacccaaatcctgaggaaatgctgttcacccccatgcatgagaagagcatgaccccttaatcctgaaagaggtatgctttatgcttatggaagtattaatattatgaataccaactgggaggcaattttctgcctatgctcaggtagctggtttgccctgtggactatcacctaatgtttttttacttttaacagatgacacagtactcctcctactattagctcctagatctgaaagcaactcaaagagataagcaagtgttattacaacccagtgaacttggtgaagttcttaagaggggcagtgagccccttctataggtaaaatagctaccattcaa

SEQ ID NO: 57556 - DNA, 601 bp, Human
atggaaatcacttagcacagtccctgatgcaaaaatggcaggctttttaatccttcagttaagtttgtcagctacatttggattggtggctcttcaattaatatttagtttattagaatgtcggattttaagtcaagctagataacaacacatttccttcgctgaataccagcaacttctacaagtgttactttccaaatctgtcagtgtttttcatgggatagactgactgaagaagtcaagtttgagtcttttaacagttccttatgcatcaaagtgctctgctgttcactcagtgaarcacaactgatggcctatgcaacccaacttgagctcaaatcctccttcagcctccaggcagggaagagtcccatgtatcttgatacttatctctgtgtacttaagtgcatggctctaggatgacaatactgcttgatgtgcttcaacatcaaccaagtgttaagcattttgcccgtgtgagacattttaattggtcggggcagagggactatgctcctaaaaatagtccttctgtttttaagccttattcttaaatggctccactcgtttacatgtgcacatcctcataggtgcatccaca

SEQ ID NO: 57557 - DNA, 601 bp, Human
taaaagtctgtttaatctccatgtttactcattgactcaacatcaatagtcttatgcagagatagtaacataccttttattaataccatagatattagaaaaaatcaaaatgcatatggaatacagtaaatatcagtcccttatgtgtcaacgggaaagctctgttaattgccctttctaaatataatgactgtataaatgaatttatgactctaaaatatacaccagcatccaaagtacattgtgaacaatcaaagaagggactacttaggttcgataatcattgataaaatcaagatgktaatatatctcatggggcagctgagaaaattaaagataatgtatggaaatcacttagcacagtccctgatgcaaaaatggcaggctttttaatccttcagttaagtttgtcagctacatttggattggtggctcttcaattaatatttagtttattagaatgtcggattttaagtcaagctagataacaacacatttccttcgctgaataccagcaacttctacaagtgttactttccaaatctgtcagtgtttttcatgggatagactgactgaagaagtcaagtttgagtcttttaac

SEQ ID NO: 57558 - DNA, 601 bp, Human
aagcttacaaacttagaaagagcatccatcattgactaagaaaagctacaatcctcttaagaggagtagcaggcaaaacatagaaattaattccattgaagaaaaatttgggaaacaaggtggatttgttttaaagagatttaactaaacccaaaattttcaactttatattttttaatacactgcattttgaaagatattgaagctaacttttacagtcttattcatttctctcctttcaattcccaaaagtatagaagaaataaatctgctgtatatatcctatatactttaaaatagygtacataaatgtaataataaaactcttattttaataaggttcactgtaaaagtctgtttaatctccatgtttactcattgactcaacatcaatagtcttatgcagagatagtaacataccttttattaataccatagatattagaaaaaatcaaaatgcatatggaatacagtaaatatcagtcccttatgtgtcaacgggaaagctctgttaattgccctttctaaatataatgactgtataaatgaatttatgactctaaaatatacaccagcatccaaagtacattgtgaacaatca

SEQ ID NO: 57559 - DNA, 601 bp, Human
tccttgtcgacactgttttatcaggtccattaacaggttttctcaagtagtgggcctctgtaatgttataaaattgtcctgctcagtagtgttcccaaactggttctgcaatcttttcaccttcctcatcttggctcactgttcagatattagctcctttctttctttgtggtcagtacagattatcttttatattctcctttaggtgggctacattttcttctttgttcggatattaggtccttttttcctttgtgttcagtacagattatcttttatattctcctctaagtgggctatrtttacttcttgaataaaaatggtcaccactagatcttatttcctccatctgctttgaagtcagacactccaacattcctttccctcacgtgctatggaatatattctcacgtgtcaatggcattattctacctctctcaatggatatattggcacccaatttatctcacaagacttgctttacttatcaatgtaacaacaaattgccttcagttgcaaagttaaagtatgtgactcagaatctagaaagtacagatctgcttcttttctgtatctctcccctttaaaagagtcaagttgt

SEQ ID NO: 57560 - DNA, 601 bp, Human
aggactaaaccaggggggactggcttgagactgaggtttcactgaaagcaagagcttctgctagtgagttttctttagcttcagcacaggctgctggagctggagcaggtctgaagtagctcctctggcagatgttcaagactagagtctccccagtttggaaggatgagcatcaaccagcccctgtgtgctgcgtctccaggagcgagcccttgctgatttctgcttataatgctttgggcagggggttagggggtgctgctgtcttccccttatcagggtggctgagatggggctggcstatctggagtgggtgctgggaaactctaggatctccctggttgtgcctttgcatggaaatgtcattgcatctgatggggaatgagggactttaaagagaaaacatcttagatgaccaggtaattgggaggaccttttggaaattcttgcccgctttgcaggaatttgaggtgctcatttggttccaagtcaccttgatctccctgatgatgtttggaacgaatcacactaccttttaaatctctgggctcaaagcaggcaacttgtccactgttgtaggtggatgcagttctccagaggt

SEQ ID NO: 57561 - DNA, 601 bp, Human
ttttttttttttttttgagagagagacagggtctcactctgttgcccaggctggagtgcagtggtgtgatcatgactcactgtagccttgaactcgtaggctcaaagatcctctcatctcagcctcccaagtagctgggactacaggcatgtgccactatgcctggctaattaaatatatatgtatatatttgtagacacagggttttgctatgttgcccaggttggtcttaaactcctggtctcaagtgatcttcctgccttggcctcccaaagtgctgggattataggtgtgagccacygtgcccagccattctcacttttttcatttaaaaaatctgtcccagtgtcattttgcatcactaggaggggcttcttgactgggttagttttcctaggaaagtttggctaggagtagggtgctgacagacacaagcagatggactttctgggttctgctgctatacctggcattgaatagcgtctccacggaggactaaaccaggggggactggcttgagactgaggtttcactgaaagcaagagcttctgctagtgagttttctttagcttcagcacaggctgctggagctggagcaggt

SEQ ID NO: 57562 - DNA, 601 bp, Human
ggctgccatgagccttgtccagaagccagatccaagaccaagggcttgctttgtagcagagaggatgtggattagacagaggaaagcattttctcacagtgaggtagttgaacattgaaatacctttccgtgggtgatggcacaagccaaatgccctctttgtgcctctcttcccattgactactaaagtgagggctgaatcatatggaaaaagagcccagagcttctcagatggcagatcctgttaaaccccaactctcattcactctcacttttttatttcctttttttttttttttttgagagagagacagggtctcactctgttgcccaggctggagtgcagtggtgtgatcatgactcactgtagccttgaactcgtaggctcaaagatcctctcatctcagcctcccaagtagctgggactacaggcatgtgccactatgcctggctaattaaatatatatgtatatatttgtagacacagggttttgctatgttgcccaggttggtcttaaactcctggtctcaagtgatcttcctgccttggcctcccaaagtgctgggattataggtgtgagccaccgtgcccagccattct

SEQ ID NO: 57563 - DNA, 601 bp, Human
gaggagggagctgccgtccctggctgcattgaggggtctgcttggtggcctggcctcctgggatggcaggctgtccccagactgactccacctatgaggcagagtgagtggagggagacacagtttcccacaaactctgggaaacctctggcaagtctctgacctcagcctcttcatgtgtaaaatgggatctgtgtcttacaattccttccagttctaaatgggatgtagagtattgtgcttatctcaaactggggcctttgggctacagctggccctttgacatgtattgtttggtttrcacatttaaaaaaatggaatgagttgctgatttcacataaaatggatattttaccttcttttgaaaagtgggaagctctggctcccacacaatacttgctgctgagacacgggtgtctgcccatgcctttgaggctgtctggccattttgtttgtggaaatgctgacctggaagatatttcagtaaaagcacaggttccggagccacccagacctggagccaatgtattgacctctctaagattcagtttccttacctctaaatgctacttgttacatgctgtcccccagggtgctgtag

SEQ ID NO: 57564 - DNA, 601 bp, Human
ggggtttcaccgtgttagccaggatggtttcgatctcctgacctcgtgatcggccagccttgacctcccaaagtgctgggattacaggcgtgagccactgtgcccggcccatgattttcaagaacaaagtagggggacttaactttcagataacaaaacttataaaattgtaattaagaaagtgtggaactggtacaagggtagccacatagacccgtagaagagaagagagatccagacacaagccctgcatttatgagagagatgtcattacaaatacctggagaaaaattcactcaaygtggcttggaatcttctatttgtatggaaaagataaaattagttcatgccatacataaaaataagttctacattgattggagctctccatgtgaaaatcaaacatttaaaacttttcaaagaaaatacagggtaatatctttgtaactttgtagacagtaaattttttttttttttttgagacagggtgttgctctgtcgcccaggctggagtgcagtggcatgattttggctcactgcaacctctgcctcctgggttcaagtgattctcatgcctcagcctcctgagtagctgggatta

SEQ ID NO: 57565 - DNA, 601 bp, Human
gtgatactgaaactcaagtgaaagagtaaaaggctaagaatagctaacatgattttttttttttttgagacagagtctcgctctgtcacccaggttggagtgcagtggtgtgatcttggctcactgcaagctctgcctcccgggttcacgccattctcctgcctcagcctctcaagtagctgggactacaggcgcccgccaccacgcccagctaattttttgtatttttaggagagacggggtttcaccgtgttagccaggatggtttcgatctcctgacctcgtgatcggccagccttgrcctcccaaagtgctgggattacaggcgtgagccactgtgcccggcccatgattttcaagaacaaagtagggggacttaactttcagataacaaaacttataaaattgtaattaagaaagtgtggaactggtacaagggtagccacatagacccgtagaagagaagagagatccagacacaagccctgcatttatgagagagatgtcattacaaatacctggagaaaaattcactcaacgtggcttggaatcttctatttgtatggaaaagataaaattagttcatgccatacataaaaat

SEQ ID NO: 57566 - DNA, 601 bp, Human
ttgaaaggtgatactgaaactcaagtgaaagagtaaaaggctaagaatagctaacatgattttttttttttttgagacagagtctcgctctgtcacccaggttggagtgcagtggtgtgatcttggctcactgcaagctctgcctcccgggttcacgccattctcctgcctcagcctctcaagtagctgggactacaggcgcccgccaccacgcccagctaattttttgtatttttaggagagacggggtttcaccgtgttagccaggatggtttcgatctcctgacctcgtgatcggccmgccttgacctcccaaagtgctgggattacaggcgtgagccactgtgcccggcccatgattttcaagaacaaagtagggggacttaactttcagataacaaaacttataaaattgtaattaagaaagtgtggaactggtacaagggtagccacatagacccgtagaagagaagagagatccagacacaagccctgcatttatgagagagatgtcattacaaatacctggagaaaaattcactcaacgtggcttggaatcttctatttgtatggaaaagataaaattagttcatgccataca

SEQ ID NO: 57567 - DNA, 601 bp, Human
attacaaacctttatagaaaggtattaaaaaaggcctaagtaaaagaaaagctatatcatatttatagatgggaagattcaatattataaagatagtctctcaatttatatataaatgtaatgcacatttaataaaacttccagacttataattttttttgtagacttgaaaggtgatactgaaactcaagtgaaagagtaaaaggctaagaatagctaacatgattttttttttttttgagacagagtctcgctctgtcacccaggttggagtgcagtggtgtgatcttggctcactgcragctctgcctcccgggttcacgccattctcctgcctcagcctctcaagtagctgggactacaggcgcccgccaccacgcccagctaattttttgtatttttaggagagacggggtttcaccgtgttagccaggatggtttcgatctcctgacctcgtgatcggccagccttgacctcccaaagtgctgggattacaggcgtgagccactgtgcccggcccatgattttcaagaacaaagtagggggacttaactttcagataacaaaacttataaaattgtaattaagaaagtgtggaac

SEQ ID NO: 57568 - DNA, 601 bp, Human
gaaaggaaatctattagaaaaagtatattaaacgttaaacttaatggtaaatagagggattttctttaacaagaggaataaagcaaagatagtcattattattacctgttttataaattatactatatataggccctagtaagcacagcaaaacaagaaatagaaaaagtatagggatgggaaaagaagaaatgaaactttcttgttttgccaatgataggattgtccacagaagaaatctaagtaattttccattataactggtaagtaagaaaatgtatgaggttctaaatacattagyatcagtcagtcaatcaattgggtctgatatactagaaacaaatatatatatattttaaaagacaccatttatgatattcacaaaactagaaaatacttatacatctaaaggacatgtaagatctttatgaaagaaattacaaacctttatagaaaggtattaaaaaaggcctaagtaaaagaaaagctatatcatatttatagatgggaagattcaatattataaagatagtctctcaatttatatataaatgtaatgcacatttaataaaacttccagacttataattttttttgtaga

SEQ ID NO: 57569 - DNA, 601 bp, Human
aagaatggattttatggtatgtgaattatatctcaataaatagtaattaaaaaccatgcagggagcaaataaagcaattattaaagggcaatttatagcctaacatatttatattgaaaaagaagattaaaaattaatgagttaagcaccttaagaggttagaatgagaaaaacccaataaaaagaaaaggaagaaattttttaagttttgtaaattgttagaatcagtaaaaccaaaaatagggttttttttttttctttttttttttaaaggccaattaaataggcacctctggcaagrcagaccagggaaaagagagatggcacaaattgatgaggttagtgtgaaaaagggaacataactacagagaaaatgaagattttaaaaagtcattaaggacattttcatactttcatttttaacttaaatggacaatttcatgggaaatataacctacaaaaccaagtcaatatgaagccgaaaacctgattcaacttagaatcatttaagacatttaataagcagttcaaaacctatcttctagaaccctacatgatttatactgtcttacggtagtgttctactaaacatgcaaagtgc

SEQ ID NO: 57570 - DNA, 601 bp, Human
ggtgataggttcacaggcttggaattatgctaaaaaccaaggcatcgtacaatttaaagaatggattttatggtatgtgaattatatctcaataaatagtaattaaaaaccatgcagggagcaaataaagcaattattaaagggcaatttatagcctaacatatttatattgaaaaagaagattaaaaattaatgagttaagcaccttaagaggttagaatgagaaaaacccaataaaaagaaaaggaagaaattttttaagttttgtaaattgttagaatcagtaaaaccaaaaataggtttttttttttttctttttttttttaaaggccaattaaataggcacctctggcaaggcagaccagggaaaagagagatggcacaaattgatgaggttagtgtgaaaaagggaacataactacagagaaaatgaagattttaaaaagtcattaaggacattttcatactttcatttttaacttaaatggacaatttcatgggaaatataacctacaaaaccaagtcaatatgaagccgaaaacctgattcaacttagaatcatttaagacatttaataagcagttcaaaacctatcttctag

SEQ ID NO: 57571 - DNA, 601 bp, Human
agtggcgcagtctcggctcactgcaagctccgcctcctgggttcacgctattcttctgtctcagcctcccgagtagctgggactacaggcgcctgccaccacgcccggctaattttttttgtatttttagtagagatggggtttcaccgtgttagccaggatagtctcgatctcctgacctcgtgatccacccgcctgggcctcccaaagtgctgggattacaggcgtgagccaccgcgcccggccaatatatgaagaactcttataatgcaataataaaaaacaagtaaaaaatgggccraggatttgaatgagatattttcccaaagaagatatacaaatggctaatgagcacatgaaaagatgctcaacatcattacttattaggaaaatgcaaatcaaaaccactttgagataccactttatatctactagcatggctataattaaaaagctggacaataacaagtgttggagggtatatggaaaattaggaatcctcatacactggtggtgggaagtaaaatggtgctttggaaaatagtttggcagtttctagaaaatttaaacacagagtcaccatataacccagcaattctac

SEQ ID NO: 57572 - DNA, 601 bp, Human
aggccctccagaaaggtcaactgagaaggaagctgatagggcatctccttagatttatggacatttacattaacaatatatggctctgacttttattccagtgggaagatggttgggaggtgagggcttggcaagatcttaggaaaaccacactcagtgtgtccctcctcctccccacagccctaccctccatctacacttctttcattatttctataaagatggaatatggcttaaatatgcatgaagagcagcctatatcaaaggttccagagcgtagccatcaagaacaataggtagrcatgtcataaggataagagctgttagaggtgagaagagtccctcaaagaaaattgtgaactaggtaataggaactcccccacccccgtgaacacttaaatacacacttgagcttgtaagaaattaacactcaatttaagtgtggcatagtggctcatgcctataattccagcatttagggaggccgaggagggaggattgcttgaagccaggagtttgagaccagcctgggcaacaaagtaagacccctgtctctacacacaaacaaatgaacaaacaaaccaaaaaccacacacaaaaa

SEQ ID NO: 57573 - DNA, 601 bp, Human
caagcccttcctttttaataaggctctttgaccactccagccctcactgttcccatctccttgccttctgcaaatacttgcgtgtacactggaattggatcttgtttctctcgtgtgttacttcattttctttcttttcttttttttttttttttcgttttagagatggagtcttgctctgtggcccaggcgggagtgcagtggcgcgatctcggctcactgcaacccctgccctccctggttcaagcgattctgctgcctcagcctcctgagtagctgggattgcaggcactcgctaccrtgcccggctaatttttttttttttttttgtatttttaatggagacggggtttcgtcatgttggtcaggctggtctcaaacttctgacctcaagtgatccacccgcctcaacttcccaaagtgttgggattataagcgtgagccaccacgccagcctcatgtgttacttcactttctgcaaatatcaaactctggtgacagtgaatccttagagtgcatagcataaaacttagcatctagtaggagcatatgtatgtttattattaatataatgattatatcttatagttgtatatggtgt

SEQ ID NO: 57574 - DNA, 601 bp, Human
aatcgacagtcattgattagatgggtgtgagtggtgagggagaagggaacattgagaatgacttccagtttctggttggggcaactgggcacacacacagtgccaccgactgagataaccacatggggaggagatgactttaacatatattgagttttaaatgtctgaggtatattcagatagaaagacctggtagataataaatggattctggagtgaggatagagttgacatctgatgatgctgttctggaagtctcggtttgcagatggtaattgcagacctgagagggaccagatcmtgtgctgggagaggtctggtgagaaaggcagaaagcttggtctgaatgcagagaagtgcctttgaccagaggaactcataagggagtctgaaggtcatgagaggtaggaggaaagcagcagagcttagagtcactaaagctgacagagaaggcttttgaggaggcagtggtcaattatgtccaatgctgctagaaggtcaaggaaggattgagaaatgtccattggatttggcaaagaaagtggagcaggtggtcatcaagatgctgggtggatgggagaccaaggagagaagagaggga

SEQ ID NO: 57575 - DNA, 601 bp, Human
tgggagtgatccagtgaaagatggtgagtggggtgagaattgggaagaagagtgttccaggtgaagagaagggcacgtgcaaagagaaaagagctgagactggtgaggtcagttgaaaccaaatcaagaagtgccacattaaggagtttaaactatcctagggggaaggagtcaatgagaggctttaagcagtggagtgacatgatagagtttgtacttcacatcttcaccctcaggttagaactgggtgaggaggttggatgagaaggccatttgagttgtctagtgagaggtaaggatrgagaggaatgaatggattccagcaacagaaggtggaatcgacagtcattgattagatgggtgtgagtggtgagggagaagggaacattgagaatgacttccagtttctggttggggcaactgggcacacacacagtgccaccgactgagataaccacatggggaggagatgactttaacatatattgagttttaaatgtctgaggtatattcagatagaaagacctggtagataataaatggattctggagtgaggatagagttgacatctgatgatgctgttctggaagtctcggtttg

SEQ ID NO: 57576 - DNA, 601 bp, Human
cggcaaggtgtggtggctcacgcctgtaatcccagcacttcgggaggccaaggcggggagatcacaaggtcgggagatcgggaccatcctggctaacacggtgaaaccccgtctttactaaaaaatacaaaaaattatccgggtatggtggcgggcgcctgtagtcccagctactcaggaggctgaggcaggagaatggtgtgaactcgggaggtggagcttgcagtgagccgagctcgcgccactgcactccaacctgggcgacagagtgagactccgtctcgaaaaaaaaaaaaaaaaagggtctgagattctgctttttgcaacctcagagaaacacttttaaagctactctgaggtagaaaagagacatgttctcacatcagttgtcattagcactatgacttggtattctgtttcccagttttcccacctataaaatggaggagggcagagtagcattaaatgatagcagtggtcacttcacattttaatattctttatattttatatgcatttctttaagatcgtttatgggtgtataggattttttaaaaaagcaatcttatgcaccccacaaactatcttaaaaaaatgaaat

SEQ ID NO: 57577 - DNA, 601 bp, Human
ccagccaaggtatttcttagcccttttaatgttctctggcttcattttgacttcatttcgtctgtggcattgagtagtgaatgtgcaacacaacaggaacagactggttgaaataatcctggctctgccaagtaacttttccgggcctcggttactctatctgcaaattgggaataaggcaggagactgaacttcatcttaaaggcttctccagctttaagatctgagattctcggcaaggtgtggtggctcacgcctgtaatcccagcacttcgggaggccaaggcggggagatcacaasgtcgggagatcgggaccatcctggctaacacggtgaaaccccgtctttactaaaaaatacaaaaaattatccgggtatggtggcgggcgcctgtagtcccagctactcaggaggctgaggcaggagaatggtgtgaactcgggaggtggagcttgcagtgagccgagctcgcgccactgcactccaacctgggcgacagagtgagactccgtctcgaaaaaaaaaaaaaaaaagggtctgagattctgctttttgcaacctcagagaaacacttttaaagctactctgaggtagaaaaga

SEQ ID NO: 57578 - DNA, 601 bp, Human
agacttattagctaatgaacttctcagtttacctttgcatttttagttgatttccccttttagatttctgtctttcgaatttgtcctttacccaacagtcaaataatttttaatctctatcaagagtggagtggataatgtaggagacattgagttacaggaattgtccacgaatccagaagccctcttcttctgtataggcattcactcttattctctcactcatgttctctgactcttggggactgcacagttgtggttatgagcacataatttgatatgatcctggtgggaaagctgsctctgctagtctccaggtgtgtaagctctggggagtcactcaacctgagtgaggttgacggcataggacctggcatataagaaccgctcactaaactgtaactcctgttattactcaaaggggaggaattaacattctagaggttcctgtcactctcactgctgccatctctggaaatttatcctgtctacaacccctgtctcctgctgagacaagtggccccgggtagttgcttctccataggctaccacattttgtaccacctgacttcattgccctgctcacaactgggatgagtgc

SEQ ID NO: 57579 - DNA, 601 bp, Human
caagttttattaaaagacttattagctaatgaacttctcagtttacctttgcatttttagttgatttccccttttagatttctgtctttcgaatttgtcctttacccaacagtcaaataatttttaatctctatcaagagtggagtggataatgtaggagacattgagttacaggaattgtccacgaatccagaagccctcttcttctgtataggcattcactcttattctctcactcatgttctctgactcttggggactgcacagttgtggttatgagcacataatttgatatgatccwggtgggaaagctggctctgctagtctccaggtgtgtaagctctggggagtcactcaacctgagtgaggttgacggcataggacctggcatataagaaccgctcactaaactgtaactcctgttattactcaaaggggaggaattaacattctagaggttcctgtcactctcactgctgccatctctggaaatttatcctgtctacaacccctgtctcctgctgagacaagtggccccgggtagttgcttctccataggctaccacattttgtaccacctgacttcattgccctgctcaca

SEQ ID NO: 57580 - DNA, 601 bp, Human
gtagaaattggaggtgggaaacattgcaataaaacactggaagtggaaaggaatatgaaagacctttatcttctttttggattcctttctttaaatttttttaaaattattaacattagagacagggtcttactatgttgcccaggctggtcttactcctggactcttagcggtcctcctgccttggccttccaaagtgctgggattacaggtgtgagccactgcacccagcccatctttttagatttcgtatcagtagctaggaagcttggggacagctgattaacactttgattattasaaactcagccaagcacagttactgcttttgacacatctctggatagcagactttcagtgaagtgttacgtgaggctattcaggactcctgcaaaatggatattatttaaaagtcaagtatttttggaacttatatacacattcctacaatactgtcattgttccacatactttgaaactcatgagaacttgtcatacatatttgtctcaaataccttgattacagatagggattttatccattttaggatcaattctggaaattgccaagagtcatttgaaacaaagctggtaaacaagg

SEQ ID NO: 57581 - DNA, 601 bp, Human
ctgcttggcaacctaattacatcttagctaattgcaaagggagagagaatcggcatttgcttgctagtataatgtaacaaattccaatagggaaagttgtgtatttctcctagggtgtaaatcacagtccctagggtctagaaaggttttgaaggggacttcaattcatggacatgaagggacagttgaaggatttgggtaggtacttaggaagaatatactaatgttgagagttataatgaaatgtgttataaagtgggtttgaatgtcctgttttttttttttttttttttttttttttaaattggtgttaaagtgcactttgaggaaggcactctgttctctggtctgtcttgaggttcaattttattttgaaaggtaatactctgagcattttagagaagagatgctatgttaaccccatagtgatcagagtaaagtataaatcatattaagtttattgtggaggtagttactgtttaacaaccgtatgcttaagtttcctttactgcgtaactagagttgaggaatcttttttttttttctttattctgggttatattagggtgcattgctttcatatgtttttcctcatacggag

SEQ ID NO: 57582 - DNA, 601 bp, Human
agagctcctggaattgtttcttcagttgtggcagctgtgtagatcatttttgttttatctgtaaagttaaaaagggttacaggtgtagagagagaacaagaggagtgaacaatgaagcttgtttaatctggaaagtacaaaaataccaactcagccctagagtgtgctaagtatatattttccatctctgtcgtctctcccatggtttactctttaaactcactttcccctcagtctccctaatggtagtactagtagtaaaagtcctaatgaattagactattgtgtcttcatcatcacwtcacttctaacttcgttatacagtaaaacaacaggagatgagtttatgtatgcaaggtctgtgttgcattcagggaatgaggaggcaggcaggaaagatcttcgagaaagtctaaccaagagagtttccagttcttccctccaacccccaattgatctacctcttcttgtccgtggtgtaggcggtgatgcaaatttgaagatagctttgattcctgcacctttctatacagatgggagagttctctatacagagttgttctcccatcaggtgcaggaatgaaaagtataaaaacttgac

SEQ ID NO: 57583 - DNA, 601 bp, Human; identical to SEQ ID NO: 35416

SEQ ID NO: 57584 - DNA, 601 bp, Human; identical to SEQ ID NO: 35417

SEQ ID NO: 57585 - DNA, 601 bp, Human; identical to SEQ ID NO: 35418

SEQ ID NO: 57586 - DNA, 601 bp, Human
tgttgcccaggctggtctcaaattcctgggctcaagcaatcctcctgccttggcctcccaaagtgttgggattccaggcgtgagccagtgcaccctgcttgttagggtgttcctaatatcagggcccaggaatgaggaggaaatgaatttatcctgctaccatgaatctcaaagtatgactactgctagtgggacaagagatgcttgtaggtaaaatgtgcaaaaaatttttgttttaatcattataaatgtattttaatgtggattgggaaaaatgtatctagtagtggttttgcatttrtgataaggatatagaatttcctacctaagtaaagatttttaggttaaacaaaagataaactgatttgaggacaatattaagtgaatgacagtatgggtgatataaggatatggcaaaagttttggtacaaatgtgtttaaagtttagggtacattgttgattggcctacccagcagccattcacagccttcatccttctggcagaggctacctctcatgatggaagctaaaaatgcctaatacttgcttttcccggctctcttgtagctgctgaatgaggatgtgacccaatcctgctaa

SEQ ID NO: 57587 - DNA, 601 bp, Human
cctggctctagcaacccccccacctcagccgcccacgtagctgggcctacaagtgcatgccaccacacctggctaattttttatttgcttgtaaagataggttttccctatgttgcccaggctggtctcgaattcctgggctgaagccctcctcctaccttgacctcccaaagtgctagaattacaggcatgagtcactgtacctgaccctgggggcattcttttacatgcagctgaaactgtcctagctgagaaggctttccaccatgcacagtctttcattgcccaataatgaactgcrttcagcataccccaatgcagccatcacccctagttctcttactttgtttctgctttgaatccccttcttgaaatttctcccattggctttgtctccattactggttctgttacccacttagacttgacagctgacagcttgcccaaagtgagtagtgactatcttctgtcattggatttctttagctcctgctggtcttctgcaaatggtcatctgccaatttgctgcaaactggggtgggagtttgtggggagggcatatctgttgccatagcaacacaaagatgctggagcatatgtt

SEQ ID NO: 57588 - DNA, 601 bp, Human
cactaagcagagattctgaatgtaatgttccagcttaaggagttaggaagggctctaacagtttagctggttggctgaaacatggattaaaagatggcctatcatgagtgagttggagatgcctgacctcccctggtttaatgtagaggaaaggattcaaaagcttagggagattagaatgccagagtggatttgtcatttaatacccgctcacccatgctgggaaggtcagacatacctttaagaaaggtatgtctctgtcaatactttgagaaatatatttgtgaggggagccccagcrtcctttaagagctctgtgatccctcttctctatagaccaaaccttactatgggaaccacagccacttaattggaaaacttaaatgcaatgggaataattgggtcctggagtatcaggggccatttggtggcactcaactgttaaaggcaaggtaggtgcggttaccttaatggatcgcagagttacaacaacaatcggaatagcctgactcatgcagacctatggcactgcctaatcatggtgttgctagaagtgaaataggtgggaagcctactaaattcttacttgatctgtatagca

SEQ ID NO: 57589 - DNA, 601 bp, Human
tttcttctgtcttacataaccccaagtggggacacccacagtgaactttcaaaaataatgctccttccagggagcgaagcagcaatgagggttgaacatctctcttgggatgaccatcacctggaccaaaagacccatttacatctctcaaggataagtaatgtcaggggcaatttagtctaaatgatacagtctccacctcccttcctcccttcctcccttcttccctctctcacttatctattatctccctacatctgaaagtgcaccatcctgctgaaatcacatcctgttcacatarcactgcagtccatagcttctgaatccacacagaagttctcgtgggcgataccaaatgccaagaggatgccttagaaggagtctggagatactcgaggattggcctctctagctcagaggttacactgtcatcaaatgtccaaagagctcttgtatagaatttttgtggtgcagttctaaaggagaagtaggactgaggtccatctgtgcaggctaacgaagaacagcccatactgaccaactggttgctacataataatattagctccccatccgaggatagtaaagctcaattgccagg

SEQ ID NO: 57590 - DNA, 601 bp, Human
aagtaatgtcaggggcaatttagtctaaatgatacagtctccacctcccttcctcccttcctcccttcttccctctctcacttatctattatctccctacatctgaaagtgcaccatcctgctgaaatcacatcctgttcacataacactgcagtccatagcttctgaatccacacagaagttctcgtgggcgataccaaatgccaagaggatgccttagaaggagtctggagatactcgaggattggcctctctagctcagaggttacactgtcatcaaatgtccaaagagctcttgtayagaatttttgtggtgcagttctaaaggagaagtaggactgaggtccatctgtgcaggctaacgaagaacagcccatactgaccaactggttgctacataataatattagctccccatccgaggatagtaaagctcaattgccaggcatgctgtagagggcatagctgtggtagatgtgggtttctaccatgttggtggttctactagcttttgttgttttgttgcatgcaacagaaaccatctttggttaacataagttggaaaggaattcattggaaaagatgtggcatccttcagagc

SEQ ID NO: 57591 - DNA, 601 bp, Human
gctgctgggacttgaatgaagctgatgcgtcccatctataaattattgtggcttctcctagttgggaggcaggaccagcctcacaatttcccagaagaccgtaatttctggagcctgcaggcctgggggcaaatggagaaatcaaaaggcagatgaccttggagataggcagccagaaaggatgtgaaaggccctggttctggactcaagagacctcacgtttcctagtcttctttctgtctctgctcttttgtgttcatgaggttcatgccctcatgagggctcccccacctccagtggyctaggattctaggatgtcttggtattctttttcaaaaaaaaaaaactaagagccagcatttatagatataattctgtcctaaacactttacatataataattcttcattcttcattacaccctgtgagataggttatcattgttataattccatttcacagatgaggaaactgaggtactcagagactaaatgacttgctcaaggtcacttgtgagaggtccagctctaggccctctggcccgtggggctatgctcttacctagtacctcaaactgcctggtagacctcaaccctgtgta

SEQ ID NO: 57592 - DNA, 601 bp, Human
tctataaattattgtggcttctcctagttgggaggcaggaccagcctcacaatttcccagaagaccgtaatttctggagcctgcaggcctgggggcaaatggagaaatcaaaaggcagatgaccttggagataggcagccagaaaggatgtgaaaggccctggttctggactcaagagacctcacgtttcctagtcttctttctgtctctgctcttttgtgttcatgaggttcatgccctcatgagggctcccccacctccagtggtctaggattctaggatgtcttggtattctttttcaaaaaaaaaaaactaagagccagcatttatagatataattctgtcctaaacactttacatataataattcttcattcttcattacaccctgtgagataggttatcattgttataattccatttcacagatgaggaaactgaggtactcagagactaaatgacttgctcaaggtcacttgtgagaggtccagctctaggccctctggcccgtggggctatgctcttacctagtacctcaaactgcctggtagacctcaaccctgtgtacctgcacaaatggtcctgaagcaggcagctttct

SEQ ID NO: 57593 - DNA, 601 bp, Human
cgaggaagacatacaaatgaccaaaaggcatatgaaaatttaaaaagctaaacatcactaatcactaggcaaatgcaaatcaaaaccacaatgagatattatctcacacttgttaggatgactattttttttttttttttgagatggagtcttgctctgttgcccaggctggagtgcaatggcgtgatcctggctcactgcaacctccacctcccgggttcaagtgattctgctgcctcagcctcccagagtgctgggattacaggtgggagccaccacgcccggcctatttttttttttwaaaaagacaagtgttagcaaagatatggagagattggaacccttgtacactgttggcaggaatacaaaatgttgcagatactatggaaaacagtttgcctgcttttgagcacttaaaaaacaaaactaggctgggcccggtggctcacatctgtaatcccagcactttgggaggccgaggtaggggggatcacttgaggtcaggagtttgagaccagcctgaccaacatggcagaaccccgtccctgctgaaaatacaaaaactagcctggcatgatggtttttgtatctgtaatcccag

SEQ ID NO: 57594 - DNA, 601 bp, Human
atgaccaaaaggcatatgaaaatttaaaaagctaaacatcactaatcactaggcaaatgcaaatcaaaaccacaatgagatattatctcacacttgttaggatgactattttttttttttttttgagatggagtcttgctctgttgcccaggctggagtgcaatggcgtgatcctggctcactgcaacctccacctcccgggttcaagtgattctgctgcctcagcctcccagagtgctgggattacaggtgggagccaccacgcccggcctatttttttttttaaaaaagacaagtgttrgcaaagatatggagagattggaacccttgtacactgttggcaggaatacaaaatgttgcagatactatggaaaacagtttgcctgcttttgagcacttaaaaaacaaaactaggctgggcccggtggctcacatctgtaatcccagcactttgggaggccgaggtaggggggatcacttgaggtcaggagtttgagaccagcctgaccaacatggcagaaccccgtccctgctgaaaatacaaaaactagcctggcatgatggtttttgtatctgtaatcccagctactcaggaggctga

SEQ ID NO: 57595 - DNA, 601 bp, Human
cctggtttctgggctgaaatagattttatcccatttttaaacaattccttctgatactttcaggggtagtttgtggatgagagcagagtgaaatgcataggctcaggtttgtggccttgcaagttaataaagagtgtggactttggaactagcctgcctgggctccaatcttggctctggtacctactagctgtgtatcattgttttcattgttttgttttgttttattttgttttgtttgagacaggatctcactctgttgttggggccagagttcagtggtgcaatcatagctcactgmagcctccaattcctgggatcaagtgatcctcccacctcagcctcctgagtggttaggaccacaggcatacaccaccacacctggctaattttaaatttttttgtagagatggggtcttgctatgttgcccggatgggtcttagcctcccaaagtgctgggattacaggcatgaaccattgtgtcccaccttagctgtgcactttaaataagtcacttgacctctctgttcctgtttcttcatttacaaggtgaagatgataatatactacttcttagggtgagtattaaataagttaacc

SEQ ID NO: 57596 - DNA, 601 bp, Human
cagcctccaattcctgggatcaagtgatcctcccacctcagcctcctgagtggttaggaccacaggcatacaccaccacacctggctaattttaaatttttttgtagagatggggtcttgctatgttgcccggatgggtcttagcctcccaaagtgctgggattacaggcatgaaccattgtgtcccaccttagctgtgcactttaaataagtcacttgacctctctgttcctgtttcttcatttacaaggtgaagatgataatatactacttcttagggtgagtattaaataagttaacytatgcaaagaggttaaaacagtgcctagcatatcatagaaatgtttgcttgacccagaggcctgaacctgctttgccttcagtgttggtctttaggtcctggcttcactccttaatgctgcatctcagcctttcctcatgaaactttctgtctttgatccttttcactccttaactgtgaatctcccaaattccactgagcagtgatcaattcttggggcatcttgctctgtgttcccagacattccttcaccctcattttctctccatggccaaatcctatagtgcctcctaaataatt

SEQ ID NO: 57597 - DNA, 601 bp, Human
tgtagagatggggtcttgctatgttgcccggatgggtcttagcctcccaaagtgctgggattacaggcatgaaccattgtgtcccaccttagctgtgcactttaaataagtcacttgacctctctgttcctgtttcttcatttacaaggtgaagatgataatatactacttcttagggtgagtattaaataagttaacctatgcaaagaggttaaaacagtgcctagcatatcatagaaatgtttgcttgacccagaggcctgaacctgctttgccttcagtgttggtctttaggtcctgkcttcactccttaatgctgcatctcagcctttcctcatgaaactttctgtctttgatccttttcactccttaactgtgaatctcccaaattccactgagcagtgatcaattcttggggcatcttgctctgtgttcccagacattccttcaccctcattttctctccatggccaaatcctatagtgcctcctaaataattatagctgacatgtatgtagcacctatcatatgccacgtgctgttctaagtgattgatatatgctaactcatttaatcctcaccctatgagaaagatgctttt

SEQ ID NO: 57598 - DNA, 601 bp, Human
tgtcccaccttagctgtgcactttaaataagtcacttgacctctctgttcctgtttcttcatttacaaggtgaagatgataatatactacttcttagggtgagtattaaataagttaacctatgcaaagaggttaaaacagtgcctagcatatcatagaaatgtttgcttgacccagaggcctgaacctgctttgccttcagtgttggtctttaggtcctggcttcactccttaatgctgcatctcagcctttcctcatgaaactttctgtctttgatccttttcactccttaactgtgartctcccaaattccactgagcagtgatcaattcttggggcatcttgctctgtgttcccagacattccttcaccctcattttctctccatggccaaatcctatagtgcctcctaaataattatagctgacatgtatgtagcacctatcatatgccacgtgctgttctaagtgattgatatatgctaactcatttaatcctcaccctatgagaaagatgcttttttaacacctattttatagaggaggaaactgaggcccagagaagtgaactgacttgccaggtcacataactaataagcag

SEQ ID NO: 57599 - DNA, 601 bp, Human
tgttcctgtttcttcatttacaaggtgaagatgataatatactacttcttagggtgagtattaaataagttaacctatgcaaagaggttaaaacagtgcctagcatatcatagaaatgtttgcttgacccagaggcctgaacctgctttgccttcagtgttggtctttaggtcctggcttcactccttaatgctgcatctcagcctttcctcatgaaactttctgtctttgatccttttcactccttaactgtgaatctcccaaattccactgagcagtgatcaattcttggggcatcttsctctgtgttcccagacattccttcaccctcattttctctccatggccaaatcctatagtgcctcctaaataattatagctgacatgtatgtagcacctatcatatgccacgtgctgttctaagtgattgatatatgctaactcatttaatcctcaccctatgagaaagatgcttttttaacacctattttatagaggaggaaactgaggcccagagaagtgaactgacttgccaggtcacataactaataagcagagtctggatttgagtttggctctagagcctgctcttagccaccat

SEQ ID NO: 57600 - DNA, 601 bp, Human
caaattggtttgttctgttgtgtcagcgtaccacaaggctggtgcccttgtcatcctcacaagagtccctgttggaagatacaggatatgattgtcctactcatgaggccctgcgtgctctggcgtcagggtccctccagcctttgcttgaccactctgagtaccttcgttcactcctctgttcatcctgccaccaggcatttgcacatacttctcccttggctgagatactcttctctctcttcttccctgtgagttcagtgggtctcaattctagttgcattgtagaatcttctgcagrgctttttaactgaatgcagtgtctgcacccattccagaccaactaagtccaaatctctgattgattcagaacctctcagttgcatgcagggttaagggccctggtcaactcacgctggtcctctagactgcagctcaagcatcacttcctcagggaagcccttcctgacctccctgaccaggcccatttccaatattttgtactcagcacaccacatacctcttcttgctgtcacatatcttagggacatctaaatattaggttggtgcaaaagtaattgcggtttttgctattgtaaat

SEQ ID NO: 57601 - DNA, 601 bp, Human
attctaagctaacatttgtcatatggatactacatgccagtcactgtgccaagctaagcatcatcattgtgatttcattaatctgtacacatctagaaagcaggctcattatattcagcaaacacttgcatagtgtatatatgatgtgccaggcactgtgctgagtcttttacaaatattaatccattaaattctcataatcctatgaggatttagtgtgattattatttccttttatttatttatttaagacagagtcttgctcttgtcacccaggctggagtgcaatggcatgatctcrgctcactgcaacctccacctcctgggttcgagcaattctcctgcctcaacttcctcccaagtagctgggactacaggcacccgccaccatgcccagctagctaatttttgtatttttagaagagatggggttttaccatgttggccaggctggtctcgaactcctggcctcaagtgatccgcccgccttggcctcccaaaatgctgggattacaggtgtgaactgccgcgcctggccttatttccattttaaagatgaggaccctgaagctcagagaggttgggtaacctgtccaaagtc

SEQ ID NO: 57602 - DNA, 601 bp, Human
tttactgcatatatcataggtgaagggttaatatccttaaataatacacaggaaaatttgttacaaataatttgaaagaaacaaacttgaattttaaaacaggcaaaattaatgataacagtgaacatttcttctttttttgtttgtttgttttggaagcaggatcttgctctgtcacccaggctagagtgcagtggtgtgatcctggttcgctgtagccttgaactcccggcctcaagtgatcctcccacttcatccccacaagtagctgggactataggcatgcgccaccataactaatttttttttttttttttttttttttagacagagtctcgctctgtggcccaggctggagtgcagcggtgcaatctcagctcactgcaagctccacctcctgggttcatgccatactcctgcctcagcctcccgagtagctgggactacaggtgcccgccaccacgcccagctaattttttgtattttttagtagagacggggtttcaccatgttggccaggatggtctcgatctcctgacctcgtgatccgcccacctcggcctcccaaagtgctgggattacaggtgtgagccactgcgcc

SEQ ID NO: 57603 - DNA, 601 bp, Human
aacttgaattttaaaacaggcaaaattaatgataacagtgaacatttcttctttttttgtttgtttgttttggaagcaggatcttgctctgtcacccaggctagagtgcagtggtgtgatcctggttcgctgtagccttgaactcccggcctcaagtgatcctcccacttcatccccacaagtagctgggactataggcatgcgccaccataactaatttttttttttttttttttttttttagacagagtctcgctctgtggcccaggctggagtgcagcggtgcaatctcagctcactrcaagctccacctcctgggttcatgccatactcctgcctcagcctcccgagtagctgggactacaggtgcccgccaccacgcccagctaattttttgtattttttagtagagacggggtttcaccatgttggccaggatggtctcgatctcctgacctcgtgatccgcccacctcggcctcccaaagtgctgggattacaggtgtgagccactgcgcccggcccataactggctaatttttaaatgttttgtagagatagagacaagatattactatgttgtccaggctggtctcaaactc

SEQ ID NO: 57604 - DNA, 601 bp, Human
gatcttgctctgtcacccaggctagagtgcagtggtgtgatcctggttcgctgtagccttgaactcccggcctcaagtgatcctcccacttcatccccacaagtagctgggactataggcatgcgccaccataactaatttttttttttttttttttttttttagacagagtctcgctctgtggcccaggctggagtgcagcggtgcaatctcagctcactgcaagctccacctcctgggttcatgccatactcctgcctcagcctcccgagtagctgggactacaggtgcccgccaccasgcccagctaattttttgtattttttagtagagacggggtttcaccatgttggccaggatggtctcgatctcctgacctcgtgatccgcccacctcggcctcccaaagtgctgggattacaggtgtgagccactgcgcccggcccataactggctaatttttaaatgttttgtagagatagagacaagatattactatgttgtccaggctggtctcaaactcctgggctcaagcagtcctcccaccatggcctcccaaagtgctgggaatacaggcgtgagccaccggacctggcagaaca

SEQ ID NO: 57605 - DNA, 601 bp, Human
taagcttagatgtggctactaattcacccctatattgacatggactgcagtgcagatcttaacccaggaaatggtattttaaattctgccaaagtttatacaatagaagcttatccttcaaatggaataattacgtattcgccaaatgggcggggttagaagagggcagggtatatcaggcggttgaagcaaatcgtcacccaacacacaagtgtttacatggtgttattggctctattcattctcctctccaggaacaaaatgaaagatcgtcaccaaattatagtgtccccttttcaamtgtgccatgcgtgtgtaattacagcttctaacattctccacttttcatgctcagacaatctccgtccactcagtctcaattaaggtttccctactttttttgtcttttgcaaatttttggccttttgtttgcagttgtgggcatggcagtactgatgtgttactcacggtggtagtacaagaggtgagatttttgtaatacccagataaaccctaaaatattctactttacatcaaaagtatagaaaagtctgtgctgagaagttttactctctgtctactttattctctcttgcctcca

SEQ ID NO: 57606 - DNA, 601 bp, Human
atcaaaagtatagaaaagtctgtgctgagaagttttactctctgtctactttattctctcttgcctccatagatgaacacttgtattaggttttttttttctttttttttttttggtgtatcctgccagaggtgtaattaagagtcgactttccccggttactcaggaggctcaggcaggaggatcacttgagcccagaagtttgaggctccagtgaactatgatctcgccactgtgctccagcctgggcaacatagtgagaccttgtctctgaaaataattttaaaaagaaaggatacayacttaacttattgcacctcgctttctcacacacacaaaaggtaccatgtaatatacacacctcagcaccttgatttttttgtttgtttcacttaaaaaatacaaccttggtcgggtgcagtggctcacgcctgtaatcctagcattctgggaggccgaagcaggcggaccacttgagcttgagctcaggcgaccagcctgactaatatggcgaaaccctgtctctgcaaaaaatataaaaagtagctaggcatggtagcgtgcaccagtagtcccagacacttcgggggctgaggcagga

SEQ ID NO: 57607 - DNA, 601 bp, Human
tccatattaatgcagagaacttcctcattgtactttatacctgagtagtcttccattatgtggctacactatgatttatttaaacaaccctttcccagtgacacttagcgtgtttaaatcttatgctaccctaaacagggcttcagtgaataactgtatctgtatattacttcctatgtatgcaggttattttaccttcgtccaacgtgatggagtgaaaggtgaaaagaatttgtaattttacaaaagcatttgtactttggataggtagtgccaaattgcccccacaggatgacaccarttggcccacccaccaggaatatgtgtctctgtttctccacagcttttcaacagaaactgtcgggatgaacatttaaaattttcattttaaaattttaaattgtctacttcattttaaggtgcattagaaaaggcagtttgcatattgatcccatgagttcacactcttagtttcatttttaaaaataggtttatttaaataaaaatggcagtactgaattgaagaaaaatatcaagtaaatattatgttggtgcaaaagtaattgcggtttttgccattactttcaatggtaaaatccac

SEQ ID NO: 57608 - DNA, 601 bp, Human
ggctacactatgatttatttaaacaaccctttcccagtgacacttagcgtgtttaaatcttatgctaccctaaacagggcttcagtgaataactgtatctgtatattacttcctatgtatgcaggttattttaccttcgtccaacgtgatggagtgaaaggtgaaaagaatttgtaattttacaaaagcatttgtactttggataggtagtgccaaattgcccccacaggatgacaccaattggcccacccaccaggaatatgtgtctctgtttctccacagcttttcaacagaaactgtygggatgaacatttaaaattttcattttaaaattttaaattgtctacttcattttaaggtgcattagaaaaggcagtttgcatattgatcccatgagttcacactcttagtttcatttttaaaaataggtttatttaaataaaaatggcagtactgaattgaagaaaaatatcaagtaaatattatgttggtgcaaaagtaattgcggtttttgccattactttcaatggtaaaatccacaatgacttttgcacctacctaatactgttacaggttgaatgcaggcatgcgaagttatgac

SEQ ID NO: 57609 - DNA, 601 bp, Human
ttgccatgatgattttttctcttgggaataataaaatcaagaggttttatgttctgtgtgcaggacactgtgcttgaggttttataaagtggatacggttattggacccattttatggctgaggaaccagagactcagggtggttaagtcacttccctgaggtcacacagctaactctggagcctgcgcttgttaatttccctctgttctgagggtatttccaactgggaccttcaatttaaccttgcctacctaccccatgggaagtagagcctcaggagctttcatagcttgtaaatgyccagggatgacacagtctgaacttgcaatttgcttttcctttctcctctatggatgctgttagcttgtgttttctctctgtgtgcctcatttcagcttccttattcctgcagttttacttcagcccaaccagatttcagcccacctgtgggcaaagctgcacagcccattcagactgagagagacttttctttaatcttttctttctttctttctttctttctttctttctttctttctttctttctaggtttctttgtactttgctttgctttctgttccactaccctgccgtcacctt

SEQ ID NO: 57610 - DNA, 601 bp, Human
tatccgttccttccttccttccttccttccttccttccttccttccttccttcctccttccctccctccctcccccctcctccatctctctcacctgtgcttcctttcctcttagctgcctgtgtctgggattaagtgatgacctaggatctgcctgtctttgatgctggggattgtttttcactataaagactctggtttgggggtggcagggacccaagtactctgtcactggccggtgctgaatttgtgtgagatgaagagtgttattgtctataacccccgtgttaggtgggagacyctctggggaggctgaggagcaggggggcagccaggggacactgaggggttcccactcggctggctgcatttctggagtctgacaaacttggcttccagtcctggctctcccatgtccttgctttgtgaccttgggcaagttacttctctgagcctcagttttctcatctggaataccaggataacagtctaactcctccatcactgggctgtcaggagaatctggggacatgacatagaggactcagcacagtgcttggcaggtagtatgtgttcaattcaataaaattggtggcagtaa

SEQ ID NO: 57611 - DNA, 601 bp, Human
tccctccctccctcccccctcctccatctctctcacctgtgcttcctttcctcttagctgcctgtgtctgggattaagtgatgacctaggatctgcctgtctttgatgctggggattgtttttcactataaagactctggtttgggggtggcagggacccaagtactctgtcactggccggtgctgaatttgtgtgagatgaagagtgttattgtctataacccccgtgttaggtgggagactctctggggaggctgaggagcaggggggcagccaggggacactgaggggttcccactcrgctggctgcatttctggagtctgacaaacttggcttccagtcctggctctcccatgtccttgctttgtgaccttgggcaagttacttctctgagcctcagttttctcatctggaataccaggataacagtctaactcctccatcactgggctgtcaggagaatctggggacatgacatagaggactcagcacagtgcttggcaggtagtatgtgttcaattcaataaaattggtggcagtaaaagtcacattcgacggttattttgttgttgtattcaacaatctcttgaataaagattg

SEQ ID NO: 57612 - DNA, 601 bp, Human
ctataacccccgtgttaggtgggagactctctggggaggctgaggagcaggggggcagccaggggacactgaggggttcccactcggctggctgcatttctggagtctgacaaacttggcttccagtcctggctctcccatgtccttgctttgtgaccttgggcaagttacttctctgagcctcagttttctcatctggaataccaggataacagtctaactcctccatcactgggctgtcaggagaatctggggacatgacatagaggactcagcacagtgcttggcaggtagtatgtgytcaattcaataaaattggtggcagtaaaagtcacattcgacggttattttgttgttgtattcaacaatctcttgaataaagattggaaatggaaggaaatttgggaatccaagcttgcctaataccaggcatgtggagatggagcctcagcaacaggaaatactgggaagaggaatcgtgccaggatcctgtggaaacctgatttccaggggtgggcgagatgactggggatgatcaaggggtgatgctgcggcaggagtgtaatagtttcaaacctgtttttgagagcacttgagactg

SEQ ID NO: 57613 - DNA, 601 bp, Human
gggagactctctggggaggctgaggagcaggggggcagccaggggacactgaggggttcccactcggctggctgcatttctggagtctgacaaacttggcttccagtcctggctctcccatgtccttgctttgtgaccttgggcaagttacttctctgagcctcagttttctcatctggaataccaggataacagtctaactcctccatcactgggctgtcaggagaatctggggacatgacatagaggactcagcacagtgcttggcaggtagtatgtgttcaattcaataaaattggtrgcagtaaaagtcacattcgacggttattttgttgttgtattcaacaatctcttgaataaagattggaaatggaaggaaatttgggaatccaagcttgcctaataccaggcatgtggagatggagcctcagcaacaggaaatactgggaagaggaatcgtgccaggatcctgtggaaacctgatttccaggggtgggcgagatgactggggatgatcaaggggtgatgctgcggcaggagtgtaatagtttcaaacctgtttttgagagcacttgagactgagtcagacaaactcactcgg

SEQ ID NO: 57614 - DNA, 601 bp, Human
agcaacaggaaatactgggaagaggaatcgtgccaggatcctgtggaaacctgatttccaggggtgggcgagatgactggggatgatcaaggggtgatgctgcggcaggagtgtaatagtttcaaacctgtttttgagagcacttgagactgagtcagacaaactcactcgggagtttaggggatgtgttcacatggggttggattccagcactgttgggaagaaggtagggagtctggcagaggtcccaaatccaaattcctacagggtccaggcaggaaaggggaaagagagaagcagkcctggtgtaagacaatagggaagagtggggactgtggaaaactagaaagtttattacttatctaaaggggaaaaccactgctcagcccacagaaatgagtgttctgtgttgtcacagctgatgatttctcaaaaggaagcaatatttcacattttttattctttctttctttcttttttttgtttgagacagagtctcgctctgttgcccaggctggagtgcagtggtgcgatctcagctcactgcaagctccgcctcccgggttcatgccattatcctgcctcagcctcctgagtagct

SEQ ID NO: 57615 - DNA, 601 bp, Human
cctacagggtccaggcaggaaaggggaaagagagaagcaggcctggtgtaagacaatagggaagagtggggactgtggaaaactagaaagtttattacttatctaaaggggaaaaccactgctcagcccacagaaatgagtgttctgtgttgtcacagctgatgatttctcaaaaggaagcaatatttcacattttttattctttctttctttcttttttttgtttgagacagagtctcgctctgttgcccaggctggagtgcagtggtgcgatctcagctcactgcaagctccgcctccygggttcatgccattatcctgcctcagcctcctgagtagctgggactagaggtgcatgccgccacgcccggctaattctttttgtatttttagtagagacagggtttcaccgtgttagccaggatggtctcgatctcctgacctcgtgatccgcctgcctcggactcccaaagtgctgggattacaggcgtgagccactgtgcctggccaaaatttcacattttaatctgatagttcctgacttaaatatagtaaacttatttggatttctaagaagcaccttgttggccaacggtagctt

SEQ ID NO: 57616 - DNA, 601 bp, Human
ctcggactcccaaagtgctgggattacaggcgtgagccactgtgcctggccaaaatttcacattttaatctgatagttcctgacttaaatatagtaaacttatttggatttctaagaagcaccttgttggccaacggtagcttctttacaggcttgatatagcttctgggttccacactgtggcccctgggcatgaaggagggcccaggccagggatgggacaggctctaggtggcctggaggtgtctagtcagtgtggcctgggtgacgaggatctgatgtaaaatgagactaggggagrgattgaggcagagatggaagctgtgtctttttttttgtttttgagtcagagtttctctctgtcactggagtgcagtggtgccatcatggctcactgcagccttgaattcctgggctcaagcgatcttcccaccttggctgggattacaggcatgagccactgctcccagccaggaagctgcatctttgaatgcgatcagaaccaaaccccatagggggagtgatggcttacaggccatgaggattcccagactcatctcaggcttggtcaatacccacagcatcaaggctaggaagggaa

SEQ ID NO: 57617 - DNA, 601 bp, Human
ctctgtcactggagtgcagtggtgccatcatggctcactgcagccttgaattcctgggctcaagcgatcttcccaccttggctgggattacaggcatgagccactgctcccagccaggaagctgcatctttgaatgcgatcagaaccaaaccccatagggggagtgatggcttacaggccatgaggattcccagactcatctcaggcttggtcaatacccacagcatcaaggctaggaagggaatgtattttggttaaaggcaggactgatacttatttatttattttgagacggagtctygctctgtcacccaggctggagtgcagtggcgggatctcggctcactgcaagctctgcctcccaggttcacaccattctcctgcctcagcctcctgaatagctgggactacaggcgcccgccaccacgcccggctaattttttgtatttttagtagagacggggtttcaccgtgttagccaggatggtcttgatctcctgacctcgtgatccgccagcctcggcctcccaaagtgctgggattacagacgtgagccaccgcacccggccaggcaggactgatatttaacctgcatgccctg

SEQ ID NO: 57618 - DNA, 601 bp, Human
gcgatcttcccaccttggctgggattacaggcatgagccactgctcccagccaggaagctgcatctttgaatgcgatcagaaccaaaccccatagggggagtgatggcttacaggccatgaggattcccagactcatctcaggcttggtcaatacccacagcatcaaggctaggaagggaatgtattttggttaaaggcaggactgatacttatttatttattttgagacggagtctcgctctgtcacccaggctggagtgcagtggcgggatctcggctcactgcaagctctgcctcccrggttcacaccattctcctgcctcagcctcctgaatagctgggactacaggcgcccgccaccacgcccggctaattttttgtatttttagtagagacggggtttcaccgtgttagccaggatggtcttgatctcctgacctcgtgatccgccagcctcggcctcccaaagtgctgggattacagacgtgagccaccgcacccggccaggcaggactgatatttaacctgcatgccctggcactactgtaccagtggtggaaatattgaaatactctgaaaccgatgggtaaatagccactg

SEQ ID NO: 57619 - DNA, 601 bp, Human
actcatctcaggcttggtcaatacccacagcatcaaggctaggaagggaatgtattttggttaaaggcaggactgatacttatttatttattttgagacggagtctcgctctgtcacccaggctggagtgcagtggcgggatctcggctcactgcaagctctgcctcccaggttcacaccattctcctgcctcagcctcctgaatagctgggactacaggcgcccgccaccacgcccggctaattttttgtatttttagtagagacggggtttcaccgtgttagccaggatggtcttgatytcctgacctcgtgatccgccagcctcggcctcccaaagtgctgggattacagacgtgagccaccgcacccggccaggcaggactgatatttaacctgcatgccctggcactactgtaccagtggtggaaatattgaaatactctgaaaccgatgggtaaatagccactgggtcctctgggccttttcccccaaccttccacttacccatatctgcctctgccagctcctaccacaccccctccatgacgtggtgactagagtgctaactcccagcacagccaggctctgctgtccattcc

SEQ ID NO: 57620 - DNA, 601 bp, Human
ttttggttaaaggcaggactgatacttatttatttattttgagacggagtctcgctctgtcacccaggctggagtgcagtggcgggatctcggctcactgcaagctctgcctcccaggttcacaccattctcctgcctcagcctcctgaatagctgggactacaggcgcccgccaccacgcccggctaattttttgtatttttagtagagacggggtttcaccgtgttagccaggatggtcttgatctcctgacctcgtgatccgccagcctcggcctcccaaagtgctgggattacagaygtgagccaccgcacccggccaggcaggactgatatttaacctgcatgccctggcactactgtaccagtggtggaaatattgaaatactctgaaaccgatgggtaaatagccactgggtcctctgggccttttcccccaaccttccacttacccatatctgcctctgccagctcctaccacaccccctccatgacgtggtgactagagtgctaactcccagcacagccaggctctgctgtccattccgtttggtctgtgggcagtccctgagccaaggcaattatagatatcttgactcac

SEQ ID NO: 57621 - DNA, 601 bp, Human
atgaacctggaggacattatgctaagtgaaataagccaggcacagaaagacaaatactgcatgatctcacttagatgtggaatctaatgaagttgaactcacagaagtagagagtagaatgatggttaccagaagctgggggacagcaggaggcaggagtagggaagaaatggagagttgctgagcaaagagtacaatgtttcggataggaggaattgcctttgagatctattgcacagcagggtgacattagtcaataatatgtatgtttcaaagtaattaagagagtaaatttcaaatrtctcatgctaaggaaatgataggcaagttaggtgatggatatgttaattttcttgatttaatcatgccacattgtgtgtgtatattcagaacaatcagaacaatcacattgtaccccataaatgcatacaattataatttgtcaatcaaatataaaattagcagcctcagccctggaactgtatgtctgctggcctcaggactgattacctgtgtcccagccactcagcatatgtgacccttgagccaagtgtccacctctgccccagtcagctgtgttcagggaatgtggatgtctcaa

SEQ ID NO: 57622 - DNA, 601 bp, Human
acattatgctaagtgaaataagccaggcacagaaagacaaatactgcatgatctcacttagatgtggaatctaatgaagttgaactcacagaagtagagagtagaatgatggttaccagaagctgggggacagcaggaggcaggagtagggaagaaatggagagttgctgagcaaagagtacaatgtttcggataggaggaattgcctttgagatctattgcacagcagggtgacattagtcaataatatgtatgtttcaaagtaattaagagagtaaatttcaaatgtctcatgctaagraaatgataggcaagttaggtgatggatatgttaattttcttgatttaatcatgccacattgtgtgtgtatattcagaacaatcagaacaatcacattgtaccccataaatgcatacaattataatttgtcaatcaaatataaaattagcagcctcagccctggaactgtatgtctgctggcctcaggactgattacctgtgtcccagccactcagcatatgtgacccttgagccaagtgtccacctctgccccagtcagctgtgttcagggaatgtggatgtctcaaagtacaagcatgg

SEQ ID NO: 57623 - DNA, 601 bp, Human
ggccaacagcgatgattgcagccctacagctgtcacaacaacccattgaccactgtgtgcaatgctgtgcttgccacgggcaaaacacttcgtctcttagttcttcggtttcctcatctgtaaaacaggggtagtaagtagtatgtactttatagggctgttatgaggatcgaatgcattaatgcctgatgaatcccttaaaatagtccctggcatgaataaatgttccataaatgttaactctcacttattaagtatttattgagcatcttctgtatgccaagtacagtttatgccctgrgagtataatgatgagcaaaatttcctcacattgcatgcagtgaagtgtggaagagatgcaattaagcgtgcatttataagtcagtggtttaagtgccgtgatggagaggatttagaatataagttccatgaaagcagaagctcttttgttcacagctgtatccccaatgcctaggaagaacttgaccctcagtatacatttgctaggtgaatgaacgaatgagtcaagttctatcttagccgcacatgaagatgaggtgtcaatggagtaaagttgggagtgaggagagaagggagggga

SEQ ID NO: 57624 - DNA, 601 bp, Human
tccccaatgcctaggaagaacttgaccctcagtatacatttgctaggtgaatgaacgaatgagtcaagttctatcttagccgcacatgaagatgaggtgtcaatggagtaaagttgggagtgaggagagaagggaggggaacttggtgtgaaccccatctctgcaagggtccagctgggtggccttggtgaagttactctgtagttaggatctgtttcattgttgctaaaatgggaacaaatgataccttctgcatggcatgtcataaggattggagagagtacatgtgagacacccagcrtacacatgtagctctcaagcagtgtgttgagactgggtgtggtggttcacacctgtaatcctagtactttgcaaggctgaggcaggcagatcacttgagcccaggagtttgagaccagcctgggcaacatagcaaaaaccctgtctctacaaaaaataaaaattagccaggcatatggcatgtgccttcagtcccagctgctcaggaggctgaggtggaagggtcgcttgaacctgggaggcagaggctgcggtgagctatgatcgcaccactgcactccagcctgcatgacagagcaag

SEQ ID NO: 57625 - DNA, 601 bp, Human
gagacacccagcgtacacatgtagctctcaagcagtgtgttgagactgggtgtggtggttcacacctgtaatcctagtactttgcaaggctgaggcaggcagatcacttgagcccaggagtttgagaccagcctgggcaacatagcaaaaaccctgtctctacaaaaaataaaaattagccaggcatatggcatgtgccttcagtcccagctgctcaggaggctgaggtggaagggtcgcttgaacctgggaggcagaggctgcggtgagctatgatcgcaccactgcactccagcctgcrtgacagagcaagaccctgtctcaacaagacaaaaaacaaaacacacacaaacacagaaatgtgtttccttttcccttcccattctttgtgcttcttggtatctcctcttgtttaagagactgttgatatggagaaaggtctggatcatttttggtcagaaatgcttgaatccttgtcttggagatcgctcaagaaaatatttacatgaagaaaagtgcaaaaccaacagaggcaacttattattagttgtgattttgccccagatcttaaagtagagctcacaaggccttgaggaactcc

SEQ ID NO: 57626 - DNA, 601 bp, Human
ccaacagaggcaacttattattagttgtgattttgccccagatcttaaagtagagctcacaaggccttgaggaactcctttcttctctactaggcaggactaaggaaattcaaacctgaactcaaacctaactcttggcctctgtaagatcaatatatcagagaaaccagaagggaccacaagagccaagagtagagacagaatgtgtcctaggtcttggagaggagctggctcaggccacttctaccaagggtctcagggcaatactataagacttggacccagtagcgtcctgggagargtgaaggatgtaagggagaaggagaagagaaagatggcaaggatgccttttaacctccatgcgagctccaccactggggtctggccaatccgtgtcttggaatccatccaattaaatcaactctgcctccttagaggttaagtaggggtgtaagagaacctggagcttctcctacaggccaataccagtcatgaacaggggttccttttttattattattatactttaagttctggggtacacgtgcagaatgtgcagttttgtttcataggtatacacctgccatggtggtttgctgga

SEQ ID NO: 57627 - DNA, 601 bp, Human
cactgaactcccaactttaaggtgaatgtccaagaagcacaatgggaactgttctgtggcacagagcagggggactctgataggaaccttatgtattcacttagtctcattgtccggagatagagacatggctggttaagctgccaaaagggatcccttagttttttggggggtggatttccaagccctgttgttgttactaggacggcacctcaatctttgagcaggacagatgattgctggggtccttttgtagctgagagcactcagggtcccactggcgacagcagaaaagacctcrcttctcaaacttggctgtccagtgctctggacgagtacttcatctgcctgactgcagagggtgggaacgttgtgaaagaaactttgtagctcattaacaagataagaagcaaccgaagtctgcagtggctgaggattttcagtcaggtttattgagacatacgtttcctgtggtaaaagtcactttaaacaattttttttgagacagggtcttgctctcccacccatgctggagtccagtggcgtgatcatagctcactgcagccttgaactcttgggttcaagtgatcctcccaccttg

SEQ ID NO: 57628 - DNA, 601 bp, Human
ctcattgtccggagatagagacatggctggttaagctgccaaaagggatcccttagttttttggggggtggatttccaagccctgttgttgttactaggacggcacctcaatctttgagcaggacagatgattgctggggtccttttgtagctgagagcactcagggtcccactggcgacagcagaaaagacctcgcttctcaaacttggctgtccagtgctctggacgagtacttcatctgcctgactgcagagggtgggaacgttgtgaaagaaactttgtagctcattaacaagatargaagcaaccgaagtctgcagtggctgaggattttcagtcaggtttattgagacatacgtttcctgtggtaaaagtcactttaaacaattttttttgagacagggtcttgctctcccacccatgctggagtccagtggcgtgatcatagctcactgcagccttgaactcttgggttcaagtgatcctcccaccttggcctccctagtagctagaactacaggcatgcaccactatgtctggctttaatacatatatatagtagagacagggtctcactgtgttgcctaggctgatctcaaa

SEQ ID NO: 57629 - DNA, 601 bp, Human
gacagggtcttgctctcccacccatgctggagtccagtggcgtgatcatagctcactgcagccttgaactcttgggttcaagtgatcctcccaccttggcctccctagtagctagaactacaggcatgcaccactatgtctggctttaatacatatatatagtagagacagggtctcactgtgttgcctaggctgatctcaaactcctgggttcaagctcaagcagtcctcccgccttggcctcctaaagtgttgggattgaaggcatgagctactgtgcccagcaaaattcacttttttycttttttcttttttttgagatggagtcttgctctgtcgcccaggctggagtgcagtggcatgatttcagctcactgcaacctctgcctcttgggttcaagcaattcttctgtctcagcctcccaagtagctgggactacaggtgcatgccactatgcccagctaatttttgtattttaaatagagacagggtttcaccatatcggtcaggctggtcttgaactcctgacctaaggtgatccacccacctcggcttcccgaagtgctgggattacaggcatgagccactgctccaggccac

SEQ ID NO: 57630 - DNA, 601 bp, Human
ttcatcacagttaatatatagaccactccaatatccaaaacaaaaaagttgctgcatctgcctctttttagttaattccctatccacctccaaccccttttaaccactgatgttttctgtccccatagttttgtgtttttcagaacatttagaaatgaacctacacttgtgttgaacatctttgttttaccagaatcctttcgaggttcatgaatgctgctgcatgtgtcaatagttcattcctttttactgctgaaaagtattccactgtgtggatgcctcacactgtatccattcacasgtcgaacgacatttgggtcctttccagtttggggctattataagtaaggtagctataaaccttcatgtatggatatggttgttgttttttttttttccccttctctgtcacccaggctggagtgcagtagcacgatctcggctcactgcaacctccgcctcctgggttcaagtgattctcgtgcctcaccctcccaagtagctgggactacaggcatgtgccaccacaccctgctaatttttgtatttttaatagagacagggttcctccatgttggccaggctggtctcgaactcctga

SEQ ID NO: 57631 - DNA, 601 bp, Human
ctccaaccccttttaaccactgatgttttctgtccccatagttttgtgtttttcagaacatttagaaatgaacctacacttgtgttgaacatctttgttttaccagaatcctttcgaggttcatgaatgctgctgcatgtgtcaatagttcattcctttttactgctgaaaagtattccactgtgtggatgcctcacactgtatccattcacacgtcgaacgacatttgggtcctttccagtttggggctattataagtaaggtagctataaaccttcatgtatggatatggttgttgttktttttttttccccttctctgtcacccaggctggagtgcagtagcacgatctcggctcactgcaacctccgcctcctgggttcaagtgattctcgtgcctcaccctcccaagtagctgggactacaggcatgtgccaccacaccctgctaatttttgtatttttaatagagacagggttcctccatgttggccaggctggtctcgaactcctgacctcaagcgatctgcccgcctcggcctcccaaagtgctggaattacaggcgtgagccactgtgcccggcctggatgttttcatttca

SEQ ID NO: 57632 - DNA, 601 bp, Human
caaccccttttaaccactgatgttttctgtccccatagttttgtgtttttcagaacatttagaaatgaacctacacttgtgttgaacatctttgttttaccagaatcctttcgaggttcatgaatgctgctgcatgtgtcaatagttcattcctttttactgctgaaaagtattccactgtgtggatgcctcacactgtatccattcacacgtcgaacgacatttgggtcctttccagtttggggctattataagtaaggtagctataaaccttcatgtatggatatggttgttgtttttkttttttccccttctctgtcacccaggctggagtgcagtagcacgatctcggctcactgcaacctccgcctcctgggttcaagtgattctcgtgcctcaccctcccaagtagctgggactacaggcatgtgccaccacaccctgctaatttttgtatttttaatagagacagggttcctccatgttggccaggctggtctcgaactcctgacctcaagcgatctgcccgcctcggcctcccaaagtgctggaattacaggcgtgagccactgtgcccggcctggatgttttcatttcaccg

SEQ ID NO: 57633 - DNA, 601 bp, Human
acctacacttgtgttgaacatctttgttttaccagaatcctttcgaggttcatgaatgctgctgcatgtgtcaatagttcattcctttttactgctgaaaagtattccactgtgtggatgcctcacactgtatccattcacacgtcgaacgacatttgggtcctttccagtttggggctattataagtaaggtagctataaaccttcatgtatggatatggttgttgttttttttttttccccttctctgtcacccaggctggagtgcagtagcacgatctcggctcactgcaacctccgyctcctgggttcaagtgattctcgtgcctcaccctcccaagtagctgggactacaggcatgtgccaccacaccctgctaatttttgtatttttaatagagacagggttcctccatgttggccaggctggtctcgaactcctgacctcaagcgatctgcccgcctcggcctcccaaagtgctggaattacaggcgtgagccactgtgcccggcctggatgttttcatttcaccgaaaagtaggattcctgggtcctaggagagttccagtttatgttctttcttcactaacacttggtatcg

SEQ ID NO: 57634 - DNA, 601 bp, Human
gcctggatgttttcatttcaccgaaaagtaggattcctgggtcctaggagagttccagtttatgttctttcttcactaacacttggtatcgttggttttagttttcaaacattttagcaactctggtaggtatgtgatatggttaggctttgtgtccccacctaaatctcatcttgaattgtaatcctcataatccacacatgtcaagggagagaccaggtggaggcaattgaatcttggggcagtttcccccatgctgttctcatgatagcgagtgagttctcacacgatctgatggttytataaggggcatgtccccctttgctcggcacttctccttcctgctgctttgtgaagaaggtgccttgctttcccttcgccttccactacgattttaagtttcttgaggcctcctcgtcctcaagaaaattgactgttagtcaattaaatctctttcctttgtaaattacccaatctcaggcagttctttatagcagtatgaaagcagactaatacagtatggaattattttaaagttttgaaaagaacagtttccttaggagaagcactcatcacattaacagcacataaaagaatatct

SEQ ID NO: 57635 - DNA, 601 bp, Human
agcaactctggtaggtatgtgatatggttaggctttgtgtccccacctaaatctcatcttgaattgtaatcctcataatccacacatgtcaagggagagaccaggtggaggcaattgaatcttggggcagtttcccccatgctgttctcatgatagcgagtgagttctcacacgatctgatggttttataaggggcatgtccccctttgctcggcacttctccttcctgctgctttgtgaagaaggtgccttgctttcccttcgccttccactacgattttaagtttcttgaggcctcctygtcctcaagaaaattgactgttagtcaattaaatctctttcctttgtaaattacccaatctcaggcagttctttatagcagtatgaaagcagactaatacagtatggaattattttaaagttttgaaaagaacagtttccttaggagaagcactcatcacattaacagcacataaaagaatatctatgtagtatgtctgtttatttgcttacatgttcattttctgtcactagagtacaattttaaaggaggcatctgtggcagcatcaataaatacatgtgaatggatgaatgaaggaa

SEQ ID NO: 57636 - DNA, 601 bp, Human
aaaacaaaagaaaacaaaaaaccatcaaacaacttgcacaaactcacacagcttagagccccggaagtttatccaagtctgccttttaccactgcactgcactgccaggctatcaagggcatatttattgattaggaaattatgtaaggttctgtgagaaatagctcccaaaatatagtgacttaaacaaggcagaaattaggtttttctctcaggggtcagcccaaagggacaaaattcaaggctggtagggtggctttgtcctttccacatatggctccaagtttgggtccaggacagkcacttccagttctcaccatctttgaaccagtgggaagagggaaaggctcaaggaagtatgcatttccatttgaagggaatggccctggagcacacacatcccattggccagaactcagcaccatggcggcacctgcaagaggtgctgggaaatatggcctctatctggatagccatgctctctgctaaaactcaaggattctactattaaagggaagaatggatattggtggaaaaccagcagtctctgccacaacttgcagactgtccactgggctttgaactttattctgtcagtgat

SEQ ID NO: 57637 - DNA, 601 bp, Human
gcacaaactcacacagcttagagccccggaagtttatccaagtctgccttttaccactgcactgcactgccaggctatcaagggcatatttattgattaggaaattatgtaaggttctgtgagaaatagctcccaaaatatagtgacttaaacaaggcagaaattaggtttttctctcaggggtcagcccaaagggacaaaattcaaggctggtagggtggctttgtcctttccacatatggctccaagtttgggtccaggacagtcacttccagttctcaccatctttgaaccagtgggragagggaaaggctcaaggaagtatgcatttccatttgaagggaatggccctggagcacacacatcccattggccagaactcagcaccatggcggcacctgcaagaggtgctgggaaatatggcctctatctggatagccatgctctctgctaaaactcaaggattctactattaaagggaagaatggatattggtggaaaaccagcagtctctgccacaacttgcagactgtccactgggctttgaactttattctgtcagtgatgaggaactggcaatggtttctaagcagggagattt

SEQ ID NO: 57638 - DNA, 601 bp, Human
agtttcttaggagggcaagtcccattggcagccacacttcaagtctctacttgtgtcttttgctcctgatccactggtcaaagcaagtggcatgtgagatgcacagtcacagtgtgggaaggggcagtccatggctgttgacacccagaggcatgaacaaatcatgggcatttctgcagccatgcaccaccactgttttcagcattgagatgtggggctgatgcattctttgcatggagaagacctgtggccctgcagcacccacaggtttgtgctggaggaggaaagagcatcattctcwggccaggatgtggtaggaaaggcaggtggggtaggactcctctttatgaggccaaggcccggatggcctgtggggcaggggagcagacaggctttgagagctatggccacaaagctacagggacactggaggtgctggtggctcccacagacctgttggtctgcagcaggctgggtgtcatgaggctagtggtactgctctcccaagggtcctgaggcccagaggacagagggagaaagtcatagggcagagagtgacagagaggactgtgagggtgaataagggtggtagggagcaaga

SEQ ID NO: 57639 - DNA, 601 bp, Human
tcatgggcatttctgcagccatgcaccaccactgttttcagcattgagatgtggggctgatgcattctttgcatggagaagacctgtggccctgcagcacccacaggtttgtgctggaggaggaaagagcatcattctctggccaggatgtggtaggaaaggcaggtggggtaggactcctctttatgaggccaaggcccggatggcctgtggggcaggggagcagacaggctttgagagctatggccacaaagctacagggacactggaggtgctggtggctcccacagacctgttggtgtgcagcaggctgggtgtcatgaggctagtggtactgctctcccaagggtcctgaggcccagaggacagagggagaaagtcatagggcagagagtgacagagaggactgtgagggtgaataagggtggtagggagcaagacagacagcaagaaacacacatgcatagacagacacagatgcaggggaaagatggacacatgcaaccctaacacagggaggaatgtggggcgtggaagctacagagagactcagctagagagagactcaggcaaaaggagggacaggcagacacacagacca

SEQ ID NO: 57640 - DNA, 601 bp, Human
cagaccgattcacagacacggccaaggcagtgagccacgtgcagaagtgggacagcagagacaagagacatgcagcaacgtggaaacagagagacagacacagaaacatggcaagagccacagggggacagtgaggttggagccttctgcctgcaggacaccagctcctcttaccacacatggggccctaatatagggacaatgtccctgcctcagagacagtggtgggtgggagctcaggctggtgctcaggtcccagagggctctcccttccctccccacaactcatttctagtttttstaataggcctgctgcctcctgggacttgggtggtctgagaagggtcccttgcccccagatcccttgaaataggggcccatggggtgacttggcctctccttctggcttctccaactggaactagcgtccccctggagaatcctgggtgcctggcacaccttcctggagtggggcattattgctcaagacctagaagaaatcacccaccacattgaaatagacacagatactctacggaggagtgcgcagagggagtggatatcctataacatgagagatggccgaaggccaaattcagtg

SEQ ID NO: 57641 - DNA, 601 bp, Human
acttctccccacaagagcactccccaaaaaccttgtgctcaaaactccccgtctcagactctttccagggagcccaacctattagctgttaatatttaaaaatcagagctgtcacgtacacatcgagattcctgcatacgttgagaaatggggaatgtttttgctctgtttcccacttggcttggccaagtccctgccacccccttagctttcctcactcatgtgaccagccagcctgtgagcattgaagttggtgactctggcttcagagccttaaggggtgtggggtgtgcttgcttcrgactgcacccttggctgtgggtggggaacagacaagttctacctcctttgcccatcagggttcagggggaagagttggaaaagcccttctgatgagatcctggcaggcaagttggtctcagccaggctcgtgtgtctcagctgtctcaaaggagggaaacaggaagggctcagcggtcttgggtggggcagatgtctgcagcccccagcctgggccagcctaagccacatcccctctctctgccctcacagcctgcatgatgaatgtgcacaagcgctgcgtgatgaatgttcccagcct

SEQ ID NO: 57642 - DNA, 601 bp, Human
attagctgttaatatttaaaaatcagagctgtcacgtacacatcgagattcctgcatacgttgagaaatggggaatgtttttgctctgtttcccacttggcttggccaagtccctgccacccccttagctttcctcactcatgtgaccagccagcctgtgagcattgaagttggtgactctggcttcagagccttaaggggtgtggggtgtgcttgcttcagactgcacccttggctgtgggtggggaacagacaagttctacctcctttgcccatcagggttcagggggaagagttggaraagcccttctgatgagatcctggcaggcaagttggtctcagccaggctcgtgtgtctcagctgtctcaaaggagggaaacaggaagggctcagcggtcttgggtggggcagatgtctgcagcccccagcctgggccagcctaagccacatcccctctctctgccctcacagcctgcatgatgaatgtgcacaagcgctgcgtgatgaatgttcccagcctgtgtggcacggaccacacggagcgccgcggccgcatctacatccaggcccacatcgacagggacgtcctcattgtcctcg

SEQ ID NO: 57643 - DNA, 601 bp, Human
gtttcccacttggcttggccaagtccctgccacccccttagctttcctcactcatgtgaccagccagcctgtgagcattgaagttggtgactctggcttcagagccttaaggggtgtggggtgtgcttgcttcagactgcacccttggctgtgggtggggaacagacaagttctacctcctttgcccatcagggttcagggggaagagttggaaaagcccttctgatgagatcctggcaggcaagttggtctcagccaggctcgtgtgtctcagctgtctcaaaggagggaaacaggaagkgctcagcggtcttgggtggggcagatgtctgcagcccccagcctgggccagcctaagccacatcccctctctctgccctcacagcctgcatgatgaatgtgcacaagcgctgcgtgatgaatgttcccagcctgtgtggcacggaccacacggagcgccgcggccgcatctacatccaggcccacatcgacagggacgtcctcattgtcctcggtaggtggccctggggctccactggctcctgaccttgcttgacctgtgtgattgagaaggggagggtggcggaggggtggggcagtc

SEQ ID NO: 57644 - DNA, 601 bp, Human
gcatttcctttactcagatagcagagaagggaagcttgcttcttccgcaaacttttccagcaggaaaaatggagtcttgatgataaaccccagatttggagaatataatatcttgggaaggaggagggttggagggtgcaattcaggggctttccacatatttgaaatatttctttcttgaacctgatggtggctatgctgtaattttattattctctatattttctgcatgtctaaaatatttcatgataattagaaagcaggatggtacagtctcctgggagatgcagtgagaggaggmgctgctggtggtggtggtggtggtggtggtggggctgtcactcatgtatcccagcattcaagacatacctggctctgatatgggaagttcaagcaaaattggaactcagcagcactggcttgaggaatactcagccataagccccggtataaccagcactgagctggctgggagtggagctaaaactttgcaggaatttcttctcaaaggctagtgacaaactactgtggactttatatatctaatgaatataaataagggtttatgagttggtaactcaggaaattgatcatggaagag

SEQ ID NO: 57645 - DNA, 601 bp, Human
cctttactcagatagcagagaagggaagcttgcttcttccgcaaacttttccagcaggaaaaatggagtcttgatgataaaccccagatttggagaatataatatcttgggaaggaggagggttggagggtgcaattcaggggctttccacatatttgaaatatttctttcttgaacctgatggtggctatgctgtaattttattattctctatattttctgcatgtctaaaatatttcatgataattagaaagcaggatggtacagtctcctgggagatgcagtgagaggaggagctgcgggtggtggtggtggtggtggtggtggggctgtcactcatgtatcccagcattcaagacatacctggctctgatatgggaagttcaagcaaaattggaactcagcagcactggcttgaggaatactcagccataagccccggtataaccagcactgagctggctgggagtggagctaaaactttgcaggaatttcttctcaaaggctagtgacaaactactgtggactttatatatctaatgaatataaataagggtttatgagttggtaactcaggaaattgatcatggaagagattaat

SEQ ID NO: 57646 - DNA, 601 bp, Human
gggaaggaggagggttggagggtgcaattcaggggctttccacatatttgaaatatttctttcttgaacctgatggtggctatgctgtaattttattattctctatattttctgcatgtctaaaatatttcatgataattagaaagcaggatggtacagtctcctgggagatgcagtgagaggaggagctgctggtggtggtggtggtggtggtggtggggctgtcactcatgtatcccagcattcaagacatacctggctctgatatgggaagttcaagcaaaattggaactcagcagcrctggcttgaggaatactcagccataagccccggtataaccagcactgagctggctgggagtggagctaaaactttgcaggaatttcttctcaaaggctagtgacaaactactgtggactttatatatctaatgaatataaataagggtttatgagttggtaactcaggaaattgatcatggaagagattaattttgcaaaaattagtgtttctgaggcctcagactggttcagtagctctgatgcattgagccctgggttgcggaggggctttacgtagattgtgtaaaagctgaaaaat

SEQ ID NO: 57647 - DNA, 601 bp, Human
tcaagggaagccagttttccccactgattgaggttcccgatgctggtgagacaaatatgagactctgcttccctctggtgtcattctgtgggaaatacactcgttccaaagcatgactgcgggcagccaacatttatgggccgcatgggatgtgcagtgctctaaaccttacgtgttatctctttccaccttcacaacattgtgaaatctctattattcttgtttgagagggagactccatctgttgcccaggctggagtgtggtggcgccatcttagctcactggaacctccacctccckggttcaagcgattctcctgcctcagcctcctgagtagctgggattacaggcgcccaccaccacgcctggctaatatttgtatttttagtagagacagggtttcaccacgttggccaggctggtctagaactcctgacctcaagtgatccgcccatctcggcctcccaaagtgctgggattacaggtgtgagccactgcgcccaaccttctattattcttgttttatgaacaaagaagccacggctcagagaagttatattccaagagctcacaccatttgcaataataataaaacaatag

SEQ ID NO: 57648 - DNA, 601 bp, Human
ccaaagcatgactgcgggcagccaacatttatgggccgcatgggatgtgcagtgctctaaaccttacgtgttatctctttccaccttcacaacattgtgaaatctctattattcttgtttgagagggagactccatctgttgcccaggctggagtgtggtggcgccatcttagctcactggaacctccacctcccgggttcaagcgattctcctgcctcagcctcctgagtagctgggattacaggcgcccaccaccacgcctggctaatatttgtatttttagtagagacagggtttcaccacgttggccaggctggtctagaactcctgacctcaagtgatccgcccatctcggcctcccaaagtgctgggattacaggtgtgagccactgcgcccaaccttctattattcttgttttatgaacaaagaagccacggctcagagaagttatattccaagagctcacaccatttgcaataataataaaacaatagctaagatgtgtttagtttttaaaatgtgttaatcattgtgaaaagcacttacaggcagtatctgatttacattgtttcaacaactcaaatgagttaagttatcat

SEQ ID NO: 57649 - DNA, 601 bp, Human
cctcccaaagtgctgggattacaggtgtgagccactgcgcccaaccttctattattcttgttttatgaacaaagaagccacggctcagagaagttatattccaagagctcacaccatttgcaataataataaaacaatagctaagatgtgtttagtttttaaaatgtgttaatcattgtgaaaagcacttacaggcagtatctgatttacattgtttcaacaactcaaatgagttaagttatcattctacccatcagaaaacacatttcctcacctaggtctgtttgactcaaaagtactrtatagtaggttacttttttgtttagtttagtttcgtttcgtttctctatgccctccaccgtatttattccttttgtggtttggctagggcacctcctatgggcattccttagggagtctttgttctgatgtggtacagtacaatatttcttcaagttcaaggtcaaagtcttcccccttaatcatagatatgctgtgaactttgagaacctggatcacaagcccccgcttctcaggacacactgataggaggtgtatccatttgctgtggctgccataacaaaataccacaaactgggtg

SEQ ID NO: 57650 - DNA, 601 bp, Human
agccactgcgcccaaccttctattattcttgttttatgaacaaagaagccacggctcagagaagttatattccaagagctcacaccatttgcaataataataaaacaatagctaagatgtgtttagtttttaaaatgtgttaatcattgtgaaaagcacttacaggcagtatctgatttacattgtttcaacaactcaaatgagttaagttatcattctacccatcagaaaacacatttcctcacctaggtctgtttgactcaaaagtactatatagtaggttacttttttgtttagtttmgtttcgtttcgtttctctatgccctccaccgtatttattccttttgtggtttggctagggcacctcctatgggcattccttagggagtctttgttctgatgtggtacagtacaatatttcttcaagttcaaggtcaaagtcttcccccttaatcatagatatgctgtgaactttgagaacctggatcacaagcccccgcttctcaggacacactgataggaggtgtatccatttgctgtggctgccataacaaaataccacaaactgggtggcttaagacaagacgtttaaaaaaaaaaa

SEQ ID NO: 57651 - DNA, 601 bp, Human
ttctttttttctttttattttgttttagatggagtcttgctctgtcacccaggctggagtgcagtggcatgatctctgctcactgcaacctctgcctctcatgttcaagcgattctccggtctcagcctcccgagtggctaggattacaggcacgtgccaccatgcccagctgattttttttatttttagtagagacggagtttcaccatgttagccaggatggtctcaatctcctgacctcaagtgatccgcccgccttggcctcccaaagtgttgggattacaggcgtgagccactgtkccggcctaaatgtctgttgtttaagccacccagtccatggtattctgttatgacagcctgagctggctgatatagtcagttactgctgtaggctgctggggatggaggtgggaaggtagagtaacttcccaggtgaggaggcttctgtgcagttgaggacagttatctggacataggggtaactgtgagccattaacagccatcatacacagcacccaggggatgggtgcattggccagcatggaggggagctgggcagggtccaacagcatctggcacactcaagtttcccttggtctc

SEQ ID NO: 57652 - DNA, 601 bp, Human
ataccattattctcatgggaggtagaacatgcagaaaatcttaagtaccaggtccaacgtcaacagcaaatgttactgggactgagacccgcttgttggagtcatgaccacccttgttccctggacaatgtagaaaagacatggagcagtgggatttgtagtatcccaggaaaccgtattgacatcatgatgcccataggtgtcatgagatcaggcaatacaatgtccagatcagagttgtaaaatgctcccaaggtttgtgaagcctgcgtgttcatacatgcaacaataattttttttktgtgtgtgtgacagagtcttgctgtcacccaggctggagtgcagtggtgcaatctcagctcactgcaacctccccctcccaggttcaagccattctcctgcctcagcctcccgagtagctgcgactacaggcgcatgccaccatggccggctaatttttttttgtatttttggtagagatggagtttcactgtgttagccaggatggtctcgatctcctgacctcatgatttgcccacctcagcctcccaaagggctgggattacaggcgtgagccaccgcacccagctaacaatatctt

SEQ ID NO: 57653 - DNA, 601 bp, Human
accattattctcatgggaggtagaacatgcagaaaatcttaagtaccaggtccaacgtcaacagcaaatgttactgggactgagacccgcttgttggagtcatgaccacccttgttccctggacaatgtagaaaagacatggagcagtgggatttgtagtatcccaggaaaccgtattgacatcatgatgcccataggtgtcatgagatcaggcaatacaatgtccagatcagagttgtaaaatgctcccaaggtttgtgaagcctgcgtgttcatacatgcaacaataattttttttgtktgtgtgtgacagagtcttgctgtcacccaggctggagtgcagtggtgcaatctcagctcactgcaacctccccctcccaggttcaagccattctcctgcctcagcctcccgagtagctgcgactacaggcgcatgccaccatggccggctaatttttttttgtatttttggtagagatggagtttcactgtgttagccaggatggtctcgatctcctgacctcatgatttgcccacctcagcctcccaaagggctgggattacaggcgtgagccaccgcacccagctaacaatatcttat

SEQ ID NO: 57654 - DNA, 601 bp, Human
cattattctcatgggaggtagaacatgcagaaaatcttaagtaccaggtccaacgtcaacagcaaatgttactgggactgagacccgcttgttggagtcatgaccacccttgttccctggacaatgtagaaaagacatggagcagtgggatttgtagtatcccaggaaaccgtattgacatcatgatgcccataggtgtcatgagatcaggcaatacaatgtccagatcagagttgtaaaatgctcccaaggtttgtgaagcctgcgtgttcatacatgcaacaataattttttttgtgtktgtgtgacagagtcttgctgtcacccaggctggagtgcagtggtgcaatctcagctcactgcaacctccccctcccaggttcaagccattctcctgcctcagcctcccgagtagctgcgactacaggcgcatgccaccatggccggctaatttttttttgtatttttggtagagatggagtttcactgtgttagccaggatggtctcgatctcctgacctcatgatttgcccacctcagcctcccaaagggctgggattacaggcgtgagccaccgcacccagctaacaatatcttattc

SEQ ID NO: 57655 - DNA, 601 bp, Human
ttattctcatgggaggtagaacatgcagaaaatcttaagtaccaggtccaacgtcaacagcaaatgttactgggactgagacccgcttgttggagtcatgaccacccttgttccctggacaatgtagaaaagacatggagcagtgggatttgtagtatcccaggaaaccgtattgacatcatgatgcccataggtgtcatgagatcaggcaatacaatgtccagatcagagttgtaaaatgctcccaaggtttgtgaagcctgcgtgttcatacatgcaacaataattttttttgtgtgtktgtgacagagtcttgctgtcacccaggctggagtgcagtggtgcaatctcagctcactgcaacctccccctcccaggttcaagccattctcctgcctcagcctcccgagtagctgcgactacaggcgcatgccaccatggccggctaatttttttttgtatttttggtagagatggagtttcactgtgttagccaggatggtctcgatctcctgacctcatgatttgcccacctcagcctcccaaagggctgggattacaggcgtgagccaccgcacccagctaacaatatcttattcaa

SEQ ID NO: 57656 - DNA, 601 bp, Human
gatcagagttgtaaaatgctcccaaggtttgtgaagcctgcgtgttcatacatgcaacaataattttttttgtgtgtgtgtgacagagtcttgctgtcacccaggctggagtgcagtggtgcaatctcagctcactgcaacctccccctcccaggttcaagccattctcctgcctcagcctcccgagtagctgcgactacaggcgcatgccaccatggccggctaatttttttttgtatttttggtagagatggagtttcactgtgttagccaggatggtctcgatctcctgacctcatgrtttgcccacctcagcctcccaaagggctgggattacaggcgtgagccaccgcacccagctaacaatatcttattcaatgctttttcaattcagtatctacctatcaacataacaactgacatctattatttatactcccatctacattacagccacctccaaatgcttagccatgtccatcctcatatctatctcccaaaagttgggagtgttcttaaagaaagcagaaagaacctttttttttttaaatgtttctctttggaactcccattctatattcttaccattatattgtgttat

SEQ ID NO: 57657 - DNA, 601 bp, Human
tatttttggtagagatggagtttcactgtgttagccaggatggtctcgatctcctgacctcatgatttgcccacctcagcctcccaaagggctgggattacaggcgtgagccaccgcacccagctaacaatatcttattcaatgctttttcaattcagtatctacctatcaacataacaactgacatctattatttatactcccatctacattacagccacctccaaatgcttagccatgtccatcctcatatctatctcccaaaagttgggagtgttcttaaagaaagcagaaagaacctttttttttttaaatgtttctctttggaactcccattctatattcttaccattatattgtgttatacagaaactttttagactgaaacatctccctgacagccttaggtactcccaatattgtgatatttaaatccttcttaagatctgacatccacacatcaaaagaaaaagagtaccaaagaggctgagtgtggtggctcacgtcggtaatcccagcattttgggaggctgaggcggctgtatcacctacagtcaggagttcaagaccaacgtgacaaaaccctgtctctactaaaaat

SEQ ID NO: 57658 - DNA, 601 bp, Human
ttaacttttatttgaactttggtgggggggtacgtgtgcaggtttgttatataggtaaacttgtgtcatgggggtttgtgtaatattgcccagccatgcgtcaattgcagacagaaaattattataaactaggccgcgagggcccactagggggcagtctctgccttcaaagccattcctcctcggaggctctctcaggagatgccccaatttgtgaaaccacagtactgtcattgctcataatggaaggtgcagcagagaccagctacgctcactgaggtccagagaaaggttacttctycaggtcacacacagatagggcccagttctggtagatctcccttcccttttacattattggtttgtaattttttcccaagtctttattttgaactaagttgaaagaattttacagcaaacactcatttatccaccacctatattctgtcgttaacgtttccacacttgcttaatcacatttccaactatctcgctctccatccatcaatctgtcttatttttgacacatttcaaagtaaactgcagacaccaattcgatttcccccaaacacttcagcatgcccaacatcaatagaattca

SEQ ID NO: 57659 - DNA, 601 bp, Human
gaactttggtgggggggtacgtgtgcaggtttgttatataggtaaacttgtgtcatgggggtttgtgtaatattgcccagccatgcgtcaattgcagacagaaaattattataaactaggccgcgagggcccactagggggcagtctctgccttcaaagccattcctcctcggaggctctctcaggagatgccccaatttgtgaaaccacagtactgtcattgctcataatggaaggtgcagcagagaccagctacgctcactgaggtccagagaaaggttacttcttcaggtcacacacagatagggcccagttctggtagatctcccttcccttttacattattggtttgtaattttttcccaagtctttattttgaactaagttgaaagaattttacagcaaacactcatttatccaccacctatattctgtcgttaacgtttccacacttgcttaatcacatttccaactatctcgctctccatccatcaatctgtcttatttttgacacatttcaaagtaaactgcagacaccaattcgatttcccccaaacacttcagcatgcccaacatcaatagaattcaaaatttacttgta

SEQ ID NO: 57660 - DNA, 601 bp, Human
aactttggtgggggggtacgtgtgcaggtttgttatataggtaaacttgtgtcatgggggtttgtgtaatattgcccagccatgcgtcaattgcagacagaaaattattataaactaggccgcgagggcccactagggggcagtctctgccttcaaagccattcctcctcggaggctctctcaggagatgccccaatttgtgaaaccacagtactgtcattgctcataatggaaggtgcagcagagaccagctacgctcactgaggtccagagaaaggttacttcttcaggtcacacacagatagggcccagttctggtagatctcccttcccttttacattattggtttgtaattttttcccaagtctttattttgaactaagttgaaagaattttacagcaaacactcatttatccaccacctatattctgtcgttaacgtttccacacttgcttaatcacatttccaactatctcgctctccatccatcaatctgtcttatttttgacacatttcaaagtaaactgcagacaccaattcgatttcccccaaacacttcagcatgcccaacatcaatagaattcaaaatttacttgtag

SEQ ID NO: 57661 - DNA, 601 bp, Human
cccaagtctttattttgaactaagttgaaagaattttacagcaaacactcatttatccaccacctatattctgtcgttaacgtttccacacttgcttaatcacatttccaactatctcgctctccatccatcaatctgtcttatttttgacacatttcaaagtaaactgcagacaccaattcgatttcccccaaacacttcagcatgcccaacatcaatagaattcaaaatttacttgtagggtttcttttttttttttaacttttgaggtgaaatgtacatacaatgatacatacaaaattttttttttttttgagacagtctcactttgtcacccaagctggagtgtagtggcgtaatcacggcttactgcagcctcgacctcccaggctcaattgattctcccacctcagcctacaaagtagctgggactacaggcatgagccaccacactcagctaatttttgtagttttgtagagatggggttttgccatgttgcctaggctggtcttgaactccatggttcaagcaatcctcccactttggcctcccaaagcgctgggattatagatgtgagccactgtgcccggtgatgtctta

SEQ ID NO: 57662 - DNA, 601 bp, Human
gactctgtctcaaaaaaaagaaaagaaaagactgaattaaaatgagaaaatgagtataatttttgacatgggaactggttacacaggtgaatttcctttgtgagaattcaagctgtaagattatgatttatacacttttctataggtatattatacttcctatacttttattatttaaaagtttgtgataaaaattctaaataactaaaaacaaaacaccaatgggttagagctacagatattggtgtaaagcagaggttgccaaactggcctgctgcctgtttttataaataaagttttrttggaacacagccacatccattcatttatatattatctatggctgctcttgtgatacaatggcagagttcactgcgtagttgtgacaaagcttgtacaatctgcaaaatgtaaaatatttgttctctggcctttactgaaaacatttggcagtccttgaactagaggaacatctatggttaagtgaaagggttaggttgcgtaaaaatatatttagtatgatctcattttgaagaaataagcaacagcaacagacacctcctatgtgtgaagttttgtctgtatattttataacctgtgt

SEQ ID NO: 57663 - DNA, 601 bp, Human
aaaatgagtataatttttgacatgggaactggttacacaggtgaatttcctttgtgagaattcaagctgtaagattatgatttatacacttttctataggtatattatacttcctatacttttattatttaaaagtttgtgataaaaattctaaataactaaaaacaaaacaccaatgggttagagctacagatattggtgtaaagcagaggttgccaaactggcctgctgcctgtttttataaataaagttttattggaacacagccacatccattcatttatatattatctatggctgmtcttgtgatacaatggcagagttcactgcgtagttgtgacaaagcttgtacaatctgcaaaatgtaaaatatttgttctctggcctttactgaaaacatttggcagtccttgaactagaggaacatctatggttaagtgaaagggttaggttgcgtaaaaatatatttagtatgatctcattttgaagaaataagcaacagcaacagacacctcctatgtgtgaagttttgtctgtatattttataacctgtgtgtgaagaaaggtgtggaaggataccaaccaggttgtaaacactggg

SEQ ID NO: 57664 - DNA, 601 bp, Human
tgagcagagctgggcccaggccctgtctgggtatttttgagtttttattgtcactagcttccatcttgtgtagcatctgccttgtgagctgggcctgttctccgagtttcatggtgtttgatgttttttgccttctttcagcaaggtcgctggcatcatccttgctgagtcgcatatgttctgggaaccacctcctcttctctgtgcctctcgcctggcaggtctacgctaaactgccccctgccctcccaggcccaccccacctccaagtctgagttctttgacttaaacttcaatcctktttcccatgggctgtggcttcccaaccctcagtttcagttgaagctaatttttttttccagaaatcactgtgggccctggctgctctgggtgtggtctggggaccagctgcatcccatcggcattacctgggagctcgttagcaattcgggatctcagcttcccctccaggcctgctgaatcagaatctgcaatttaacaacatcccctggggatgcactgtaacattcgagcagccctgctgcagaggatcgcagtgagacgggaagaatgtgtcttttccactagatggcaggcctta

SEQ ID NO: 57665 - DNA, 601 bp, Human
taaactgccccctgccctcccaggcccaccccacctccaagtctgagttctttgacttaaacttcaatcctgtttcccatgggctgtggcttcccaaccctcagtttcagttgaagctaatttttttttccagaaatcactgtgggccctggctgctctgggtgtggtctggggaccagctgcatcccatcggcattacctgggagctcgttagcaattcgggatctcagcttcccctccaggcctgctgaatcagaatctgcaatttaacaacatcccctggggatgcactgtaacattygagcagccctgctgcagaggatcgcagtgagacgggaagaatgtgtcttttccactagatggcaggccttacctgcgcttggctcctgcgcagaccaccacaggtggatgtgccaggggtgatgtgaacctccagccccgcgttggccatggcatcttaccagtcatgaagctcgggtgtcagtcccgccagggctggaatcctctttcattggtgacctgcacctacctgcatgtcctggcctggtgcagcatgagcttctggcttgagccatttgtgtaaagtgacccagagcctttc

SEQ ID NO: 57666 - DNA, 601 bp, Human
ctccaggcctgctgaatcagaatctgcaatttaacaacatcccctggggatgcactgtaacattcgagcagccctgctgcagaggatcgcagtgagacgggaagaatgtgtcttttccactagatggcaggccttacctgcgcttggctcctgcgcagaccaccacaggtggatgtgccaggggtgatgtgaacctccagccccgcgttggccatggcatcttaccagtcatgaagctcgggtgtcagtcccgccagggctggaatcctctttcattggtgacctgcacctacctgcatgkcctggcctggtgcagcatgagcttctggcttgagccatttgtgtaaagtgacccagagcctttctttcttccctgctttgcctttgtcctctaccacctggaaggtgaaggcatgtctctggggagcttcctagtcattagcctctgtgttgcttttctggatggcttgctgcacgtctctgctaattttaggccaatgtggtctatgattacaaaggttttgcatgggctttggagtcaggcctgggtttgaatcctgcctttcccactcctccaacaagtatttgttgggggcctccc

SEQ ID NO: 57667 - DNA, 601 bp, Human
tccaggcctgctgaatcagaatctgcaatttaacaacatcccctggggatgcactgtaacattcgagcagccctgctgcagaggatcgcagtgagacgggaagaatgtgtcttttccactagatggcaggccttacctgcgcttggctcctgcgcagaccaccacaggtggatgtgccaggggtgatgtgaacctccagccccgcgttggccatggcatcttaccagtcatgaagctcgggtgtcagtcccgccagggctggaatcctctttcattggtgacctgcacctacctgcatgtmctggcctggtgcagcatgagcttctggcttgagccatttgtgtaaagtgacccagagcctttctttcttccctgctttgcctttgtcctctaccacctggaaggtgaaggcatgtctctggggagcttcctagtcattagcctctgtgttgcttttctggatggcttgctgcacgtctctgctaattttaggccaatgtggtctatgattacaaaggttttgcatgggctttggagtcaggcctgggtttgaatcctgcctttcccactcctccaacaagtatttgttgggggcctccca

SEQ ID NO: 57668 - DNA, 405 bp, Human
gaggaagcaaacaaaacactttgagaaaacaaggaacactatcaaggaaataaaataaagcggcatgatgtgatagagggtggccagtgggctgagtgtgattagcagggataatggcatttagttgagacctcagggaccagcaggagggagccagcttgctgaaaattccagggaagagtataccaggcagagggagcggcagaggcagaggccagagggaagagtgaagcagcaggcttgtgagtgacaggaactgacagccagtgggtgtgactggagcctcgggatggggaggggygggtgacgctggaggaaaggcagggacagccagttaggctttgtgagccccatggtgggcttggtttctttctaagtgcatggaaatttagatcccaggagtat

SEQ ID NO: 57669 - DNA, 601 bp, Human
atctgagcctggtgtggtagcatgtggctatggtcccagttactcaggaggctgaagcaggatcatcagttgaggccacaagtttgagaccagcctcagcaacacagtgagaaaaaaagtcttaaaaattagctgggtaggcagggtgcggtggctcatgcctgtaatcccagcacttggggagtctgaggtgggtggatcacaaggtcaggcgttcgagaccagcctggtcaacatagtgaaacctcatctctactaaaaatacaaaaaaaaaattagctgggcgtggtggtgcgtgtckgcagtcccaactgctcaggaggctgaggcaggagaatcgcttgaacccgggaggcagaagttgcagtgagctgagattgtgccaccgcactccagcctgggtgacagagtgagactccatctcaaaaaataaataaataaaataaaataaaataaaatacaaattagctggacatggaggcatgcacctgtagtcccagctacttgggaggctgaggcgggaagatgacttgagcccaggagttggtggctgcggtgagctatgatctcgctactgcactctaggctgggcgacagagcg

SEQ ID NO: 57670 - DNA, 601 bp, Human
gtggtagcatgtggctatggtcccagttactcaggaggctgaagcaggatcatcagttgaggccacaagtttgagaccagcctcagcaacacagtgagaaaaaaagtcttaaaaattagctgggtaggcagggtgcggtggctcatgcctgtaatcccagcacttggggagtctgaggtgggtggatcacaaggtcaggcgttcgagaccagcctggtcaacatagtgaaacctcatctctactaaaaatacaaaaaaaaaattagctgggcgtggtggtgcgtgtctgcagtcccaactrctcaggaggctgaggcaggagaatcgcttgaacccgggaggcagaagttgcagtgagctgagattgtgccaccgcactccagcctgggtgacagagtgagactccatctcaaaaaataaataaataaaataaaataaaataaaatacaaattagctggacatggaggcatgcacctgtagtcccagctacttgggaggctgaggcgggaagatgacttgagcccaggagttggtggctgcggtgagctatgatctcgctactgcactctaggctgggcgacagagcgagaccctgtctct

SEQ ID NO: 57671 - DNA, 601 bp, Human
gcgacagagcgagaccctgtctctccttctaaaaaaaaaaaaaagaatttgagcacccgcctctagtccctaaggcagtgcatggaggaggctggatttgtaccctgggtccatctgtctggcaggttctaacacattaagtcagatgttggaaagatacagtttaagactatgagacattggaacataagaaacacccaccataccagtggggagaggaaggagatgcttcagcactggtagttctcatagtcttatctttcagtggctttagggcacaggttgggactagtttagcctyaaggtcttggagaagacctgcttttcatttgcctgttgccccagcactgtggggtcagaatctttcttgtgatcagagtttagagaagggagggagcagtgggctggaggcattccaggtagccctggagaaggcaggagaggcataagttagaagggtgagggaagggaggagggccagtggctgacgcttactgagcccttgctgtgaacccagcacagtgctagccatcgtggggcacaaaagcctgtgcaagatgcagtcgcagctcctgagcagcctcgctgtctggttgggttc

SEQ ID NO: 57672 - DNA, 601 bp, Human
tagagacagggtttcaccatgttggtcaggctgcctgacctcaaatgatctgcccacctcggccccccaaagtgctgggattacaggtgtgagtcaccgtgcccagccacagccaccttttctaaaacccttccaaatgcctggcttttgctaggaactctacaagcgttccttcaggtaatcctcctaacaacttttgctattacccgtagtccttctctccattatatggtgaggaaactgagactttgcttcatatgactccattttccccaacacttcctgctagcctgttttgctyctttgggagtatgagagtcagtgtttgctggactgtgaggctgaagatgataacatttcttcaaattggcctgtttttttttttttttttttttttttgcagaaagacagatttcactggccaagatctgcccaagaggctgaataaattcctaggttgtgagaagcaggtggatggagaagactttctctccaaacctccctgtgttaggaccagggaatgggttatgtgaatctggcaaccctgtcccaccctggacctgcaccctttaccactaccctggcacatccgggacctgca

SEQ ID NO: 57673 - DNA, 601 bp, Human
ctctagcatcatccgggacctgcacccttaactactaccctggtctgcctccttgagtggcccagggaacatctagaagctgagagaaagagagggataaaaccaagttcacagcagtatcctaagaaagtgttctcacttaaaaatgcaaagatgctcacagagtgttcaggttacactggaaaactccagaaacaaagtggtttgtgtacatgggaggaagcagaatcaacttcccaccttagcattgtgggtgcttagcccacgcctgtgtatcgctcagggaatcagagtcactatragcatcatggaataagggatttactgtacacgttagaccttatacaagcttggagatgctggagacgggaagatctggaggggtgaattgagaatcagaggaagagcagtggtgcaggtggacaagtaggagttggtaggggatccaagaagccaagcacgttgagctgctgacatagatattgatgaatttcatgaagcttttacaggcactggtttcacccttgggtaactcagtacaggtatgtcgacagccttccactaattcaaagatggttcataggtgtcccagaatctttta

SEQ ID NO: 57674 - DNA, 601 bp, Human
ttccagcccatctaggttttatgtaacacacacacacacacacacacacactgcacaaacaagcacaaactcacaaacacacacacattgcacaaacaagcacacactcacaaccaaaaccaaactgccattaatgcttacctctacttatgctcaccacacactctgatacattctcctctcttttgtggccctcttttctgttcatttccattctatttcctttaagaaaccctttaaggaaaatgctcttactctgcaaattgatttcactaacaattggcaaatgtgtcatgacccrccgcttgaaaaacactgtcctagacaacaaaattctctttctgcatcctgagatgatactactcttttggggggtctgggggtaccaccagccacattgcactgttgacttatcttgggtttatgatcagttaaagctctcttgtctatcacatcgggtgctgctagcctgcaggccccacatccttgtgcaagattttttttttttttgagactccaggatgaaacctgatgcatttcatcttgtagggtttggccttttgctccacggccaggctgagagcttttgggtcttcctgtt

SEQ ID NO: 57675 - DNA, 601 bp, Human
ggtgagttctttactgtctctaggaatgggctagccctgggacagacagtttctccagggtcagcaaggctccgagacaccaaagcatcagaaatacagaaaatagagccaggtgcagtggctcatgcctgtaatcccagagactcaggaggctgaggtgaagaatcacttgaggcaaggagtttgagaccagtctgggcaacatagtgagacccctgtccctaaaaaaaattaaaaataaaattacccaggcatggtagtgcagcatgcctgtaatctcagctactcaggagactgaggmaggaggatcactgaatccaggagttcaaggaaagaggccgggcacagtggctcacgcctgtaatcccagcactttgggaggctgaggcaggtggcgagtgaatcaccaggtcaggaaagggagaccatcctggccaacatggtgaaaccctgtctctactaaaaatacaaaaattagctgggcatggtggcgggcacctgtaatcccagctactcaggaggctgaggcaggagaatcgcttgaacctgggaggtggaggttgcagtgagcaagcgagactccgtctcaaaaaaaaaaaaa

SEQ ID NO: 57676 - DNA, 601 bp, Human
aaccctgtctctactaaaaatacaaaaattagctgggcatggtggcgggcacctgtaatcccagctactcaggaggctgaggcaggagaatcgcttgaacctgggaggtggaggttgcagtgagcaagcgagactccgtctcaaaaaaaaaaaaaaagacataaaattaatagaccttagactattttatttaattattttatcaaaataggataggcatagttaaaaatgccaatgtgcattggagagctgaggatgaaaagcaatgtcctgtacttgagcttgcatcagaatcatctasagagtgccccaccctcagagtttctgattcagtagacattgaagaatgagaatttgaatttctaacaggtccccagagaatgctggtgtgttcacactccggttaccagaaagggatcccgatccagaacccaagagaggttcttaggtcttttgcaagaaagaattcgaggcaaatccataaagtcaaagcaagcttactaagaaagtaaaggaataaagcatggctactccacaggcagagcagccctaaagctgctggctagccacttttgaggtcatttcctgattatatgctaaa

SEQ ID NO: 57677 - DNA, 601 bp, Human
tatcaaaataggataggcatagttaaaaatgccaatgtgcattggagagctgaggatgaaaagcaatgtcctgtacttgagcttgcatcagaatcatctagagagtgccccaccctcagagtttctgattcagtagacattgaagaatgagaatttgaatttctaacaggtccccagagaatgctggtgtgttcacactccggttaccagaaagggatcccgatccagaacccaagagaggttcttaggtcttttgcaagaaagaattcgaggcaaatccataaagtcaaagcaagcttaytaagaaagtaaaggaataaagcatggctactccacaggcagagcagccctaaagctgctggctagccacttttgaggtcatttcctgattatatgctaaaaaaggggtggatttttcatgagttttctgggaaaggggtgggagattcccagaactgaggattcctcctctttttagaccatgtagggtaacttcctgacgttgccatgacgattgtaaactgtcatggcgctgctgggagtgtctcttagcatgctaatgcattacaattactgtataatgagcagcaaagacgaccag

SEQ ID NO: 57678 - DNA, 601 bp, Human
agggatcccgatccagaacccaagagaggttcttaggtcttttgcaagaaagaattcgaggcaaatccataaagtcaaagcaagcttactaagaaagtaaaggaataaagcatggctactccacaggcagagcagccctaaagctgctggctagccacttttgaggtcatttcctgattatatgctaaaaaaggggtggatttttcatgagttttctgggaaaggggtgggagattcccagaactgaggattcctcctctttttagaccatgtagggtaacttcctgacgttgccatgacrattgtaaactgtcatggcgctgctgggagtgtctcttagcatgctaatgcattacaattactgtataatgagcagcaaagacgaccagacgtcacttttgttgccatcttggttttggaggattttgacctacttctttaacacaacctgttttatcagcaaggtctttgtgacctgtaccttgtgctgacgtcctgtctcattcagtgacttagaatcccttaacctcctgagaatgcagcccagtaggtctcagccttattttacccagcccctattcaagatggagtcactctggtt

SEQ ID NO: 57679 - DNA, 601 bp, Human
catttactccctatgagatgtgactattgtccctattctgtagaggaggcaactgaagctcggaaaggttaaatgacttggccagattcatatagctgataagtgctggtgctggaatttaaacccaggtttgtcttaatatggagatcttagcacctattttatatgaagagacaatcctttagggatactggggaaacctgtggcttttggacaataaattaaaaaccctttcccaagaaggggagctgtgtgtgtatcaatcaaacaaaatgagaactattctgagagggaggaaaargttcttttctgtgggaacgctgaccaagccgttgacagctcatttatgtgatgctggtgcagtttgacattcatagtacaagacttgcatgcaattagcacgaatcgttctaacagtctcttgaaaacatttggaattttccctctgtctggccttgtgcatgatgtaaacatggctttatttagttggtcatccatcccagaatagtgtggtctgcatctgtctgcatcactgtggtctgattgaggtcttgttttcctggagggcagagactgttgtgtaggcttgctttgtggatcc

SEQ ID NO: 57680 - DNA, 601 bp, Human
caatgctcctttgatttcatttcttctttccagacgaatccactgtcttagcccgttgttggagaaatcccgacctaagcaggctttcaaattggggaaagaaaagtgaaccaatctgaaatcatggaatggttggtggagaaggacaagtaggcatatccataaagagccagcagtcccaaaggatgttccagtgcatctttctgcttatttcttctagttttgtaggggtgtgtggtgtgcaatgctgtttgcttgacagaatcctttcagtctctctctctctcgaaatataaatttyctgcactacaacagcctactaagtgccagacacagtgctgggctctttacctgcatcaacccattttgtctccattgacaaaaggggaaactgaggctcagagaggttaattgacttgctcaaggtcaactgggcttctgtgtggcagaactggagtttggtcccaggtctgtttgcatctaacacccagccccttaaccactttgccgaattgagaatttggaaattaaaatggtgatttcaactcagggatgggtgtgctttctttcagccttgcagtaagtgcacatcttctttctc

SEQ ID NO: 57681 - DNA, 601 bp, Human
ctcatgcctggcttggtgcactccatgtcacctaaacgagttctcgctccatgttcactagagatctggttgtttaaaagagtctggcacctcccctctctcattcttgttcccgctcctaccatgtgatacacgggctcccctttctccttgtaccatgattggaagcttcctgagtccctcaccagaagtggatgccagcaccatgcttcctggacagcctacagaaccatgaacaaaaataaacctcttttctttataaagtacccagcctcaggtattccttgagagcaacgcaaayggatgaacacagcctatttccatagccttgctattggtgagtcttgggcccgtggtgcatgcacaggggccagatccagcccttaccccaagagcagattcaaacgtgtctttccctgattatttatggccactaaaatggaaggtgatggttgtggtgggtgtctatgatcagggctcaataaatatttgttgaaaacaaaaatgtaaacaagaaaaagacaggaccttgtcaacaagtgttatatagttgcagatctttatcttggattgttcagactctgcccttctctggcaggca

SEQ ID NO: 57682 - DNA, 601 bp, Human
ttgttcccgctcctaccatgtgatacacgggctcccctttctccttgtaccatgattggaagcttcctgagtccctcaccagaagtggatgccagcaccatgcttcctggacagcctacagaaccatgaacaaaaataaacctcttttctttataaagtacccagcctcaggtattccttgagagcaacgcaaacggatgaacacagcctatttccatagccttgctattggtgagtcttgggcccgtggtgcatgcacaggggccagatccagcccttaccccaagagcagattcaaacrtgtctttccctgattatttatggccactaaaatggaaggtgatggttgtggtgggtgtctatgatcagggctcaataaatatttgttgaaaacaaaaatgtaaacaagaaaaagacaggaccttgtcaacaagtgttatatagttgcagatctttatcttggattgttcagactctgcccttctctggcaggcacacttttgggaatgggaagggccaacagtgcttctttggtcccattagatccccatgtcagccctatgaaataatactatcccatacttactactatttcagcttt

SEQ ID NO: 57683 - DNA, 601 bp, Human
tgcttcctggacagcctacagaaccatgaacaaaaataaacctcttttctttataaagtacccagcctcaggtattccttgagagcaacgcaaacggatgaacacagcctatttccatagccttgctattggtgagtcttgggcccgtggtgcatgcacaggggccagatccagcccttaccccaagagcagattcaaacgtgtctttccctgattatttatggccactaaaatggaaggtgatggttgtggtgggtgtctatgatcagggctcaataaatatttgttgaaaacaaaaatktaaacaagaaaaagacaggaccttgtcaacaagtgttatatagttgcagatctttatcttggattgttcagactctgcccttctctggcaggcacacttttgggaatgggaagggccaacagtgcttctttggtcccattagatccccatgtcagccctatgaaataatactatcccatacttactactatttcagctttacagaagggaaaaatgcagctcagagaggtgaattcacttgcccaaagtcccatcgctagggagcgatgggatttgaattaaaaatgcagatgtgattga

SEQ ID NO: 57684 - DNA, 601 bp, Human
ctttcctttcatacctcattcattcattcattcacttattctttaatctcttctgtatgggaggtcatttgctagatactggatggctgtaggaatgaatatgattctttacacgctgagtatttcatagccctactaagagagaagaagagagagctcactataaaaggggggattggtgaagagataatggagtaggaagcacatgctgtgggaggtgccaggggatgagaggttaattccaacccatggggttgtgataggcttcacagaggcaaaggcagtggacttagttctggayggggcagagatctaacgcttattgatggcttgccccttgctaggactcagctcggtgggcgctttgtctattttctactttgaaagatgaatagaaactttgacggtcttttgccctctgaaatccactcttcacacccagccacaggaatctttctaaaatgtaaatcaggccatgtcacccccctgcttaaatgattccaagccttctcagagcttccaactgaaacctaaactcctcactcctgctctaagagcctgcagattctgcttccttcagcctctttccaaccttgtttgt

SEQ ID NO: 57685 - DNA, 601 bp, Human
cttatctgaagaaacccctcccagtcactccctatcccattactctgtttgcatttgtttatttatttgcttcttgcctgtttctctccactggatggagagcaagaaccttccttattttttatgccactttgtgctagtgcagtgcacaattgacatgtacagatgcacaattagagtttgctgagtaaatggctaaataggttaaaaaaaaaaaccaaaaacggtgggctgctaggcagaagtgtaaccacacaagtgaaccttgaaagttaccatgaaacgtaaccttcatgccctrtgaaggtgccttaggtttctggtgtgtttggaccatagattgtagctatgaagtctgattaatgcctgaatcagacattgaatgacctgaataaatagttaaaaagttggacttctaggctgaagtgtaaccacatgagagaagcatgaatgttaccatgaaggtgcctagggtttctggtgtgttcagaccatagattgtagctatgaagtctgattaatgccagctcacagaagagcttgctcaagcatgctagggatttggtgagccattgtaggtggtaatgacctgatctagtta

SEQ ID NO: 57686 - DNA, 601 bp, Human
gtgcacaattgacatgtacagatgcacaattagagtttgctgagtaaatggctaaataggttaaaaaaaaaaaccaaaaacggtgggctgctaggcagaagtgtaaccacacaagtgaaccttgaaagttaccatgaaacgtaaccttcatgccctgtgaaggtgccttaggtttctggtgtgtttggaccatagattgtagctatgaagtctgattaatgcctgaatcagacattgaatgacctgaataaatagttaaaaagttggacttctaggctgaagtgtaaccacatgagagaascatgaatgttaccatgaaggtgcctagggtttctggtgtgttcagaccatagattgtagctatgaagtctgattaatgccagctcacagaagagcttgctcaagcatgctagggatttggtgagccattgtaggtggtaatgacctgatctagttaccatgggtgacaattaaaaagaaggattaaagatgtaagggactagagctgtagagacccatccaggagctattgatccctgtaggatggaggagatgaaacatacatgaattaaggaagtggaaggataagaataaattgatg

SEQ ID NO: 57687 - DNA, 601 bp, Human
ccagtgtggtggtgcatgcctgtggtccaagccactggggaggctaaggtggaaggagcccttgagcccagaagtttgaggctgcagtaagctatgatcacagcactgcactccagcctgagtgacagagtgacaccctatctcgaataataattattattagtagtaataattatagtgcttttagagaatgaaggggaaccagccgagtaaatggtcatagaagccaagggaagagagaattcaagaaagtggatatggccaacaccttagatgctgccaactggtaatgataaacacsaggctaagaattgaacagagtcactggatttggtcatttaacttagggacttgggaagtgctctttcagtggcatagtaggagttaagaggcaggatgccggaaagcctggatgctggatgttgaggagggaattgaaggaggggatgtggaaagaggagtgtagacaactcatgagaatttgggttgtggaagaaaggggccagggaaggcgtcttagaaggaagttatttctgagaggcatctgagcaggtttatagcatgaatggaagaaagcaaggtgcctgggaatagggatagg

SEQ ID NO: 57688 - DNA, 601 bp, Human
tttaacttagggacttgggaagtgctctttcagtggcatagtaggagttaagaggcaggatgccggaaagcctggatgctggatgttgaggagggaattgaaggaggggatgtggaaagaggagtgtagacaactcatgagaatttgggttgtggaagaaaggggccagggaaggcgtcttagaaggaagttatttctgagaggcatctgagcaggtttatagcatgaatggaagaaagcaaggtgcctgggaatagggataggaattaagcagaagcggtcctaggctttgtcttcaggmagataggtgttcaagtcccagctctgccacatgctggctgtgggactttgggcaagttaatgaagccccatgagtctcagtgtcctcatctggcgagcagagagagtagcctgtaccttgcagagtcatggcaaggatgaaacaagaatgtctctcagggccttcacagcgcttagtgcataatgaggggttagttagtgaactcctaccaagctcctttgtacagggcatttagcaaagacgtcagtgaccctgagaatccctagtctaaggtaggtaccccttccctaagcgctgaac

SEQ ID NO: 57689 - DNA, 601 bp, Human
gggccttcacagcgcttagtgcataatgaggggttagttagtgaactcctaccaagctcctttgtacagggcatttagcaaagacgtcagtgaccctgagaatccctagtctaaggtaggtaccccttccctaagcgctgaacttcctcccttatgcatgtatcacatctacaatgtttccttgtgtagtggatactgtggtgtgccaccaggatccctctctcagcacagaggcactcctgccccaagccacgcagagtattggctctgaccactcacggcttcagtatttccgtaggayttgccctgagggagctgcagtgcccaaggttatgccctcttccaggggcagctcacagtctatgattggttgctggtggggaatgggcttataaatgctcttccccagcctcagtagggaacaagtctaaggggccatcccagctacagagctccctcatggatcaggtgacacctctgttgcagctacattgcagttcagtttctcgatttcatcctgcttcccccattccttgcaggagttcctcccaaggttattccctgagaagccgcctgcatacaatatccagatcagtctttt

SEQ ID NO: 57690 - DNA, 601 bp, Human
tgggctgcattctacatcattttagtacagagaggttgttccttggggcctttaattttctagctttcattattgagagagtaaaatgtatcacttgcattccaaaattgatttttatttcccaaaagaagcccataaaaataaataacttcccgggagggaaaacagaaaagcactctatacactgggcaatttgttaaaaaagaaaagaaaaggaaaggaagcctggagcgacaaagcaatctaaacatttagattgtatctcttgtattcccccactccccctgcaccttaaataaawaaaaaaaaaaaaaaaaaaaaaaacttgaggcctgctggactttgaaaatgcccatgttgttgagaaaactctgttgggcagcttcatgggacagcatcctttggagcactgcctcatggttcacacccctggtatcccaacccactgctatgttgttattagcaagatacgtttccagtatctcattactaattgtatcagtaagcatttgctgtgtaacaaattgctgcaagggtagtgggcttaaaacaacattctttctctcaattttgtgggtcttctgggaggttcttgtgatct

SEQ ID NO: 57691 - DNA, 601 bp, Human
cttcagagtgcatgacatgggctcttttcctttttagtttctgattgagttcaagcagtaagaggcattgattggcaagagattgtaggatggtaggaatgagaagatgcggcatttctgtcccaattcctctgctcttggctgtgtgtccagcagtatcagaaggccccttctctgtgtctccagatttcactgggctctggtaacactacttccttctttggcctcttcaggcctaggggtagcaatgacatctcaatgctgctactctctggatgtctcaccatgcgttgttgatccstttaaccctgtcttcacatttgtgagtagtaccttaattaaaatctctagagccttctgaattggattctgttttctgcttgcgcctatcctgatacactttttttttttttttgagatggagtctcactctgttgcccaggctggagtgcagtggcatgatcttggctctctacaacctccgcctcctgagttcaagcgattctcctgcctcagcctctcaagtagctgggattacaggcgtgtgccaccatgtctgcctaatttttgtatttttaggagagacagagtttcatcatgt

SEQ ID NO: 57692 - DNA, 601 bp, Human
aggggtagcaatgacatctcaatgctgctactctctggatgtctcaccatgcgttgttgatccctttaaccctgtcttcacatttgtgagtagtaccttaattaaaatctctagagccttctgaattggattctgttttctgcttgcgcctatcctgatacactttttttttttttttgagatggagtctcactctgttgcccaggctggagtgcagtggcatgatcttggctctctacaacctccgcctcctgagttcaagcgattctcctgcctcagcctctcaagtagctgggattayaggcgtgtgccaccatgtctgcctaatttttgtatttttaggagagacagagtttcatcatgttggccaggctggcctcgaactcctgacctcatgtgatccgcccgccttggcctctcagagtgctgggattacaggcgtgagtcaccatgcctggccactgatgtactttcactgggttccattttttttataaggggagaaagaatggagtttgcagcatgcgcttagggaacccagtatcatgatgatagaggagtgagtagcctgcatgaatgctgctgtggcaggaagaatgtt

SEQ ID NO: 57693 - DNA, 601 bp, Human
ctctggggaaaaaaaatctttatttcacattcacccttggatagaatttgaaactggctgttattttctttcggcactttaaatataccatcccgttgttcttcttccatcatttttgttgattttgtcagtcttattgtggctcttttgaagtcctattgttgcctttatgcaatctgtatgattttagattttctctctctctttgattttcagcaatgtgactgtgatgttcctgtgtgtgtgtgtgtgtgtgtgtgtgtgtgtgtgtgtgtgtgtgtttgtatgtgtttatcttggytggtgtttctttacttcttgcctctttaacttgatgtttttcattagtattttcttgtccattgtctgccctatccttttctctccttttcatgcttgactttgattatatgtatgttagaccttggtactgtgtcctctgtctctgacactctcttctgtactctctgtctcttttaatctttatgccatagtctgatttttcttaataatctgtttttcagctcactgatttgccttctaactgcttccaatctgctgctaagccatgcattgagttattaattttaagtattgcatt

SEQ ID NO: 57694 - DNA, 601 bp, Human
agatgtgtatcaccacaccccactaatgtttgtatttttgtagagatggggttttactatgttgtccaggctggtcttgaattcctgagctcaagccgtctgcccatgtttgcctgtcaaagtgctgagattacaggcatgcatcaccacgcctaggtgttttttgcttctggtcctatttcttggcatgtttggaagttttgtttgaatttcagatgattccttgctaaattagaaagctgttggacaggtgtggtggctcatgcctgtaatctcagcactttgggaggacaaggtgggwggatcatctgagatcaggagtttgagatcatcctggccaacatagtgaagccccatctctaccaaaaatacaaaaattagcctggcatggtggcacatgcctgtaatcccagctactggggaggctgaggcacgagaatcacttgaacctgggaggcggaggttacagtgagcctgggtgacagagcgagactccgtctcaaaaaaaaaaaaaaaaaagagagagagagagagctgaggaagaggttattttccatgcaggttggggtcacccttctggtggtgatcgagctcactgtgt

SEQ ID NO: 57695 - DNA, 601 bp, Human
ttccttgctaaattagaaagctgttggacaggtgtggtggctcatgcctgtaatctcagcactttgggaggacaaggtgggtggatcatctgagatcaggagtttgagatcatcctggccaacatagtgaagccccatctctaccaaaaatacaaaaattagcctggcatggtggcacatgcctgtaatcccagctactggggaggctgaggcacgagaatcacttgaacctgggaggcggaggttacagtgagcctgggtgacagagcgagactccgtctcaaaaaaaaaaaaaaaaaagagagagagagagagctgaggaagaggttattttccatgcaggttggggtcacccttctggtggtgatcgagctcactgtgtgctggtttatagccttcgtaaggtttgttctatttctggttcatttccactcctatggtgtagaggtttccaactctgaggctgaagacttgccagggccctccttttaactgggtcctgaaccccaatttttgtttctctagcaccataagcctgacaaaacctctcagctgatttctgttttgtgtctcaacctctgcagtgtgattggtagagact

SEQ ID NO: 57696 - DNA, 601 bp, Human
ccttgctaaattagaaagctgttggacaggtgtggtggctcatgcctgtaatctcagcactttgggaggacaaggtgggtggatcatctgagatcaggagtttgagatcatcctggccaacatagtgaagccccatctctaccaaaaatacaaaaattagcctggcatggtggcacatgcctgtaatcccagctactggggaggctgaggcacgagaatcacttgaacctgggaggcggaggttacagtgagcctgggtgacagagcgagactccgtctcaaaaaaaaaaaaaaaaaagagagagagagagagctgaggaagaggttattttccatgcaggttggggtcacccttctggtggtgatcgagctcactgtgtgctggtttatagccttcgtaaggtttgttctatttctggttcatttccactcctatggtgtagaggtttccaactctgaggctgaagacttgccagggccctccttttaactgggtcctgaaccccaatttttgtttctctagcaccataagcctgacaaaacctctcagctgatttctgttttgtgtctcaacctctgcagtgtgattggtagagactca

SEQ ID NO: 57697 - DNA, 601 bp, Human
ttgagatcatcctggccaacatagtgaagccccatctctaccaaaaatacaaaaattagcctggcatggtggcacatgcctgtaatcccagctactggggaggctgaggcacgagaatcacttgaacctgggaggcggaggttacagtgagcctgggtgacagagcgagactccgtctcaaaaaaaaaaaaaaaaaagagagagagagagagctgaggaagaggttattttccatgcaggttggggtcacccttctggtggtgatcgagctcactgtgtgctggtttatagccttcgtaasgtttgttctatttctggttcatttccactcctatggtgtagaggtttccaactctgaggctgaagacttgccagggccctccttttaactgggtcctgaaccccaatttttgtttctctagcaccataagcctgacaaaacctctcagctgatttctgttttgtgtctcaacctctgcagtgtgattggtagagactcaagagaaaaatcaatgcctagcgttgagttcacttctctgctcttcccctcccactatgatttggcccctcaagtcctgccttccctggaagctttgattcc

SEQ ID NO: 57698 - DNA, 601 bp, Human
gaacctgggaggcggaggttacagtgagcctgggtgacagagcgagactccgtctcaaaaaaaaaaaaaaaaaagagagagagagagagctgaggaagaggttattttccatgcaggttggggtcacccttctggtggtgatcgagctcactgtgtgctggtttatagccttcgtaaggtttgttctatttctggttcatttccactcctatggtgtagaggtttccaactctgaggctgaagacttgccagggccctccttttaactgggtcctgaaccccaatttttgtttctctagcrccataagcctgacaaaacctctcagctgatttctgttttgtgtctcaacctctgcagtgtgattggtagagactcaagagaaaaatcaatgcctagcgttgagttcacttctctgctcttcccctcccactatgatttggcccctcaagtcctgccttccctggaagctttgattcctagccccaagaataagcttcaagctctggtggcctccctccttcttagcaggtgccctctgtctagcttcttagtcctttgccctgtgttgagaattgatttatggcccaaaggaaaaaaaaa

SEQ ID NO: 57699 - DNA, 601 bp, Human
aagagagagagagagagctgaggaagaggttattttccatgcaggttggggtcacccttctggtggtgatcgagctcactgtgtgctggtttatagccttcgtaaggtttgttctatttctggttcatttccactcctatggtgtagaggtttccaactctgaggctgaagacttgccagggccctccttttaactgggtcctgaaccccaatttttgtttctctagcaccataagcctgacaaaacctctcagctgatttctgttttgtgtctcaacctctgcagtgtgattggtagagmctcaagagaaaaatcaatgcctagcgttgagttcacttctctgctcttcccctcccactatgatttggcccctcaagtcctgccttccctggaagctttgattcctagccccaagaataagcttcaagctctggtggcctccctccttcttagcaggtgccctctgtctagcttcttagtcctttgccctgtgttgagaattgatttatggcccaaaggaaaaaaaaaaaacaaaaaaccacacacagaatattggacttatcttaattctaattccttcaaaattccagtttcttgaaa

SEQ ID NO: 57700 - DNA, 601 bp, Human
taagcctgacaaaacctctcagctgatttctgttttgtgtctcaacctctgcagtgtgattggtagagactcaagagaaaaatcaatgcctagcgttgagttcacttctctgctcttcccctcccactatgatttggcccctcaagtcctgccttccctggaagctttgattcctagccccaagaataagcttcaagctctggtggcctccctccttcttagcaggtgccctctgtctagcttcttagtcctttgccctgtgttgagaattgatttatggcccaaaggaaaaaaaaaaaacaaaaaaccacacacagaatattggacttatcttaattctaattccttcaaaattccagtttcttgaaaaatattttttatctggcttttatagttgctctcagtgggagagctactttatcattgccccaagtggtatgatattaaataaaaatataaaatacaaaatagatttagagtggtataattatgtaaaaattgaatgttaacatggaaaaagaccagaaggtgaatatacaaatgaaagcatttatttaattttgggataagatctaaggtaatatttgtttggttcagaaaa

SEQ ID NO: 57701 - DNA, 601 bp, Human
ctttcagatcctggtaggggaccctgagaactttggggagtgaagatagtgaagtaaaggttgctaagcattctgctagaacactatggagacagcgatataaaataagagccaataataacaaagtagcacatagtgaatgtttaccatatgccagacattctattaatttataatgattgtaacattcctatgagccaacatccttatcattagccccattttttaaacaaggagactgagttaccgagaagttaggtaactttcaggtcacaaagctgctctatggcagagctgatcygccaggatctctgggtttaagctcctcaccatcacacttgactaatttggtatagaaagtggctttagatcagataagggtacatgaaatgcaggaggtgccgtgttagaggacagtttggtccagtccccatgtcctggggcaaatgaagcagatggcctcagaacagcctgtttttaaatcatgtaagactgacttctttcagctgctggattcctgcctcccagagtgagacgttgaagtttggcccggaagaggctgagcactggggacgagcagtgctgtgctgtgtatagagtg

SEQ ID NO: 57702 - DNA, 601 bp, Human
tctgtaatcctagcactttgagaggccaaggcgggtggatcgcttgagctcaggagtttgagactagcctgggtaacatggtgagaccctgtctaaaaaaaaaaaaaaaaaaaaaaaaaggacaaacaggactggggaaaaggaataagaggagcccgtccaaccttccaatttccaccaattttaatgtggatccagaattgagaatgctagtctagctcaactcaacagggccagtggttctacttgtgattgggggtaaaggtcctagggtagtaaagagagtgagtacctgcctggsttgtccgctctgcacatgtctctgggcagtagctgtgggatgtggtcctggacactagatcccatctgtctcctcctatggaggcaggatcttacagggaacagccggcagccaaggctagctggagtctggcctacaccatataaggagatggtgcaggaaaggctgaaagttatggtgggggccgaagagggcgttgagttgcagtaaccatgcccaagcctttgtggagttaatgatcacagtggacacattctggaggggtcgtcggcatcactgggccctgctccaggatctcag

SEQ ID NO: 57703 - DNA, 601 bp, Human
tagggtagtaaagagagtgagtacctgcctggcttgtccgctctgcacatgtctctgggcagtagctgtgggatgtggtcctggacactagatcccatctgtctcctcctatggaggcaggatcttacagggaacagccggcagccaaggctagctggagtctggcctacaccatataaggagatggtgcaggaaaggctgaaagttatggtgggggccgaagagggcgttgagttgcagtaaccatgcccaagcctttgtggagttaatgatcacagtggacacattctggaggggtcgycggcatcactgggccctgctccaggatctcagcaaggatgttattattatcatgagggtgcccaattcagtttgctacttgtttatgggctgattgcaatttggatagagtttaacccccaccccacccccgccttttgtttttaaaaatttgctgaggtgaaattcacatgacttaaaatgatctgttttagagtgaacagttcagcggcatttagtacatgcacagtgttgtgcaaccaccactgctatttagttccaaaacatttccatcattccaaaataaagccccatactgatt

SEQ ID NO: 57704 - DNA, 601 bp, Human
atctcagcaaggatgttattattatcatgagggtgcccaattcagtttgctacttgtttatgggctgattgcaatttggatagagtttaacccccaccccacccccgccttttgtttttaaaaatttgctgaggtgaaattcacatgacttaaaatgatctgttttagagtgaacagttcagcggcatttagtacatgcacagtgttgtgcaaccaccactgctatttagttccaaaacatttccatcattccaaaataaagccccatactgattaagcagtgactacccatccctgcctyctcccagcccctggcaaccatcaatctgcttttgtttttaatttttttgagacagggtgtttctctgtcacccaggctggagtgcagtggtacgatcatagctcactgcagcctggaactcctgagctcaagcaatcctcccacatcagcctcctaagtagctgggactgtaggcatgcaccaccatgctcagataattattatttttattttttataaagatgggggtctccaactcctggcctcaagtgatcctcccacctcagcttcccaaagagttgggattacaggtgtaagcca

SEQ ID NO: 57705 - DNA, 601 bp, Human
ccaatctgctttctttaactctctctttctctctctctctcttttttttttgagatggagtttccctcttgtcacccaggctggagtgcaatggcatgatctctgctcactgcaacctctgcctcctgggttcaagcaattctcctgcctcagcctcccaagtagctgggattacaggcctgtgccaccagaccgagctaatttttgtatttttagtagagacggggtttcaccatgttggccaggctgatatcgacctcctgacctgaggtgatccacccgcctcagcctcccaaagcastgggattacatgtgtgcgccacgcacctggcctaactctctctctctttttaaggctgtttaaaaatgaaactattcagtagctcaagtataccttactgtaaagaggaagtatttatgcagtgctcagtcatcttgatcagagatgattatcaaaacatcaaaatatctctatgccagctggcaactaagaaataccaccagatgtcctctgcctctctggccttgttagtttcttctccaagagcccttggatgtgatctgataatgaaaaggtgaatgtctagttcagtgggagcct

SEQ ID NO: 57706 - DNA, 601 bp, Human
ctctctctttctctctctctctcttttttttttgagatggagtttccctcttgtcacccaggctggagtgcaatggcatgatctctgctcactgcaacctctgcctcctgggttcaagcaattctcctgcctcagcctcccaagtagctgggattacaggcctgtgccaccagaccgagctaatttttgtatttttagtagagacggggtttcaccatgttggccaggctgatatcgacctcctgacctgaggtgatccacccgcctcagcctcccaaagcactgggattacatgtgtgcrccacgcacctggcctaactctctctctctttttaaggctgtttaaaaatgaaactattcagtagctcaagtataccttactgtaaagaggaagtatttatgcagtgctcagtcatcttgatcagagatgattatcaaaacatcaaaatatctctatgccagctggcaactaagaaataccaccagatgtcctctgcctctctggccttgttagtttcttctccaagagcccttggatgtgatctgataatgaaaaggtgaatgtctagttcagtgggagccttcacatctaccccagggc

SEQ ID NO: 57707 - DNA, 601 bp, Human
aatttttgtatttttagtagagacggggtttcaccatgttggccaggctgatatcgacctcctgacctgaggtgatccacccgcctcagcctcccaaagcactgggattacatgtgtgcgccacgcacctggcctaactctctctctctttttaaggctgtttaaaaatgaaactattcagtagctcaagtataccttactgtaaagaggaagtatttatgcagtgctcagtcatcttgatcagagatgattatcaaaacatcaaaatatctctatgccagctggcaactaagaaataccrccagatgtcctctgcctctctggccttgttagtttcttctccaagagcccttggatgtgatctgataatgaaaaggtgaatgtctagttcagtgggagccttcacatctaccccagggctttggctgtctccaatctgatggataaaccgcttgctaaatattttgactatcagccctgtgattaaggtcaggattagaactgttgtatttgtaagaacctctcctaaagatggcctcccattgcccacctgtttgaatcctacctgccttaaacatttttgccatttttatttatttct

SEQ ID NO: 57708 - DNA, 601 bp, Human
ttttaaggctgtttaaaaatgaaactattcagtagctcaagtataccttactgtaaagaggaagtatttatgcagtgctcagtcatcttgatcagagatgattatcaaaacatcaaaatatctctatgccagctggcaactaagaaataccaccagatgtcctctgcctctctggccttgttagtttcttctccaagagcccttggatgtgatctgataatgaaaaggtgaatgtctagttcagtgggagccttcacatctaccccagggctttggctgtctccaatctgatggataaacygcttgctaaatattttgactatcagccctgtgattaaggtcaggattagaactgttgtatttgtaagaacctctcctaaagatggcctcccattgcccacctgtttgaatcctacctgccttaaacatttttgccatttttatttatttcttagaaacaggatcttgctctgtctcccaggctggagtacagtggtacaatgttggctcattgcagcctcagactcctgggctcaagtgatcctcccgcctcagccccttgagttactgggactacaggcgcatgccaccatgtctggct

SEQ ID NO: 57709 - DNA, 601 bp, Human
tccaagagcccttggatgtgatctgataatgaaaaggtgaatgtctagttcagtgggagccttcacatctaccccagggctttggctgtctccaatctgatggataaaccgcttgctaaatattttgactatcagccctgtgattaaggtcaggattagaactgttgtatttgtaagaacctctcctaaagatggcctcccattgcccacctgtttgaatcctacctgccttaaacatttttgccatttttatttatttcttagaaacaggatcttgctctgtctcccaggctggagtacrgtggtacaatgttggctcattgcagcctcagactcctgggctcaagtgatcctcccgcctcagccccttgagttactgggactacaggcgcatgccaccatgtctggctaatcgtgaaaattgtttttgtagagacaaagtcttgctatgttgcccaggctaatctcaaattcctggcctcaagtgatcctccctccttgacctctcaaattgctgggattacaggtgtgagccattgcgcctggccggttttttaaatgtctcagtctaaagttcaatattcatcccctagcccctaag

SEQ ID NO: 57710 - DNA, 601 bp, Human
cctcaagtgatcctccctccttgacctctcaaattgctgggattacaggtgtgagccattgcgcctggccggttttttaaatgtctcagtctaaagttcaatattcatcccctagcccctaagccatgtttttaacacctcgataaacgatgtgctgactttacctaaaatgtgtccagtattccttctgagatggaaagatgctattttgggggtaaatatgttgatcttttccagaaggagtccaagacagctgatgatagcttttgcttgttctctatagaagagcaagtgatggccrggcgtggtggctcacgcctgtaatcccaacactttgggaggccgaggcaggcggatcacgaggtcaggagatcgagaccatcctggctaacatggtgaaaccccgatacaaaaatattagccgggcgtggttggtggcgggcgcctgtagtaccagctgctggggaggctgaggcaggagaatggcatgaactcaggaggtggagcttgcagtgagccgagatcatgccactgcacttcagtctgggtgacagagcaagactccatctcaaaaaaaaaaaaagaagagcaagtgatgtgt

SEQ ID NO: 57711 - DNA, 601 bp, Human
cctccttgacctctcaaattgctgggattacaggtgtgagccattgcgcctggccggttttttaaatgtctcagtctaaagttcaatattcatcccctagcccctaagccatgtttttaacacctcgataaacgatgtgctgactttacctaaaatgtgtccagtattccttctgagatggaaagatgctattttgggggtaaatatgttgatcttttccagaaggagtccaagacagctgatgatagcttttgcttgttctctatagaagagcaagtgatggccgggcgtggtggctcaygcctgtaatcccaacactttgggaggccgaggcaggcggatcacgaggtcaggagatcgagaccatcctggctaacatggtgaaaccccgatacaaaaatattagccgggcgtggttggtggcgggcgcctgtagtaccagctgctggggaggctgaggcaggagaatggcatgaactcaggaggtggagcttgcagtgagccgagatcatgccactgcacttcagtctgggtgacagagcaagactccatctcaaaaaaaaaaaaagaagagcaagtgatgtgtttaagacacacctcg

SEQ ID NO: 57712 - DNA, 601 bp, Human
gaggccgaggcaggcggatcacgaggtcaggagatcgagaccatcctggctaacatggtgaaaccccgatacaaaaatattagccgggcgtggttggtggcgggcgcctgtagtaccagctgctggggaggctgaggcaggagaatggcatgaactcaggaggtggagcttgcagtgagccgagatcatgccactgcacttcagtctgggtgacagagcaagactccatctcaaaaaaaaaaaaagaagagcaagtgatgtgtttaagacacacctcgaagctactgccatagaatgtgtraccatggttatggatttcataaggggcaccctaagagggaaaaataatctgacccagatggatcttccgaggcactgtgatgtcgtgcctaagagtgcagccttgggaggaagacagagagggttcaaatcccgctctactgttatcagctctctgtataccttggacaagtcactcaaccccctcagctgtcaggttccacatcagtaaaatggggaaaacagtaacactcacatcataaggttcttgtaaggattcaatgagataattcatgtgcagtccttagaatagtgcttggct

SEQ ID NO: 57713 - DNA, 601 bp, Human
atacaaaaatattagccgggcgtggttggtggcgggcgcctgtagtaccagctgctggggaggctgaggcaggagaatggcatgaactcaggaggtggagcttgcagtgagccgagatcatgccactgcacttcagtctgggtgacagagcaagactccatctcaaaaaaaaaaaaagaagagcaagtgatgtgtttaagacacacctcgaagctactgccatagaatgtgtgaccatggttatggatttcataaggggcaccctaagagggaaaaataatctgacccagatggatcttcygaggcactgtgatgtcgtgcctaagagtgcagccttgggaggaagacagagagggttcaaatcccgctctactgttatcagctctctgtataccttggacaagtcactcaaccccctcagctgtcaggttccacatcagtaaaatggggaaaacagtaacactcacatcataaggttcttgtaaggattcaatgagataattcatgtgcagtccttagaatagtgcttggctcatatagtaagagctcattcaccgtcaactattattatttaatctattttctatcatattttggaata

SEQ ID NO: 57714 - DNA, 601 bp, Human
gaggcaggagaatggcatgaactcaggaggtggagcttgcagtgagccgagatcatgccactgcacttcagtctgggtgacagagcaagactccatctcaaaaaaaaaaaaagaagagcaagtgatgtgtttaagacacacctcgaagctactgccatagaatgtgtgaccatggttatggatttcataaggggcaccctaagagggaaaaataatctgacccagatggatcttccgaggcactgtgatgtcgtgcctaagagtgcagccttgggaggaagacagagagggttcaaatccygctctactgttatcagctctctgtataccttggacaagtcactcaaccccctcagctgtcaggttccacatcagtaaaatggggaaaacagtaacactcacatcataaggttcttgtaaggattcaatgagataattcatgtgcagtccttagaatagtgcttggctcatatagtaagagctcattcaccgtcaactattattatttaatctattttctatcatattttggaataaaacattttggcttactaaaaaagaacaaaaagaacatgtatttaaaatcagtaggcaacagtga

SEQ ID NO: 57715 - DNA, 601 bp, Human
gacatcaaacacttccattattttagaaagttctattggacagtgtaactgtaataggttcactgcccaatgcatgcagcaagtcaatacactaagccactgagttgcagcagagaaacaggtttaattgtagggaagagacaggaggaaacctcaaatccatctcccagaggagtctggggctaggatttttaagggttttgcagtgggctgaagtgtggagattgttgattggtggaaaagagcaggatggagtcatgggacagggagataaagaagctgtgttctcttgctgattcarttcctctgtttggggtctttaaactggttggcatcagctattctgctggaattcaggatctgtttaagcaactcttaaacaaaagcctatgattctaatgtcagaaatcctatctgtaggaacaacgaggttgcaaatggtcagtatccagtgttacctgacttttagttgcaaggaagtgggtcaaagttagcctgattaatgctgaattgtaactatatttctgtccagaattcttcctaccctggtgaggctggcttcaacaacactggtcaaaagcagtggttttcatacatgagt

SEQ ID NO: 57716 - DNA, 601 bp, Human
gtttagaataacaggcagaggcatagggtgggggctgtgccggaactccgtctatctcagctgtgtacccttttatagatggtcatcggatttgtatttgcatctcagtgtagtcagacattcttccagaacactccagcagtgcttctgtgcctgctggaaaatagctgcagctctctcctgaggcagctcttcccacagtcccagctgctcccctgggatcctccttggacctccccatagcctggcaagtaaagttagcacctgggcatatcagggggcctctaggaccctgttccartactgagcacagcatcagtactggttagcttgtgcttgggctgtgccatttggaagtattttgaagatgcacatgcacgtgtgtgtgtgtctgtgtgtctacggtggtgaagaatggagggatgtgggatggggcagattcagtagatgccttgagatatggatagtttggtaaaattatgataataagaaaatggaaaggatgccagtttccttccagctagttaagacccattactttactcattgacccacctaacccatccatccatccacccatgcattcatctctccatccatc

SEQ ID NO: 57717 - DNA, 601 bp, Human
ttttcttgtgtctgtgtttttgtctctgttgctggtgttcttttcgtttgtgtcgtgcgctttgttttttctttgttctgtcttgttgtgtcttgtgtcctcgctttgtcttgtgtgtttttttttggttgtttttcttgtgttctgtcttttgtgtttgttctttctgttgtgttggtcggcggcttgttttttttctcttccttccttccattccatgtccattccattcctatgttcatacattcatccatacattcattcatctgtctaacccatccatccatccactcagccaacycatccatccatgtaatcatatatccgtttaggataaatgtatccagcactctcttttagtgcttctgtgtgactgaggatgtttgacaatgaaaggaggaagcattcatctgctgggaccccttctaacagatgttttcttctcccttcatccctgaacaacagtaggagaaacaggaaacttgtcttcaaatggtagcccttttccctgactgtctgaggatcatggtctgagaatgtgcctctcagtttttaaaaatccttgaattccatgattcagtgatgtagttaatgtagacag

SEQ ID NO: 57718 - DNA, 601 bp, Human
gcgactctgcagctccagggactccatgttagtatttatgtcacatctttagaaataatcacattgcaaagcagcacccagagccatgtctgcagccgctgcagcgtgggagagggggctgttgagcacctcctgcctccatgcttcatgctgcatttactcagcacccaagcaagggtggggccccatggcacgccatcctggttcctgtcccgaggatatgagtgaggaattggtaaacctcgtctgtccttcttgttttcacttaacttgaggcaggaggtggtctccaaacaagaartaaagctaacttattggatgcctgactcccaaaccatctgtcctaggcagacagaaagaccctcagggccaacctgaggggaacagatgtttatggggggcaggtttactcttgtttttccaagctgggctgaagagctcctcttccatctgcatcaagccctgaaaactctgccgtgcatgagtaaagtagcaagtgctgcatcccccagtgagatccagtggtgacattgtccacaccactggggaatgctagttattaagagactgggcttgtgagagctcaaaggtggactaaccc

SEQ ID NO: 57719 - DNA, 601 bp, Human
ggactccatgttagtatttatgtcacatctttagaaataatcacattgcaaagcagcacccagagccatgtctgcagccgctgcagcgtgggagagggggctgttgagcacctcctgcctccatgcttcatgctgcatttactcagcacccaagcaagggtggggccccatggcacgccatcctggttcctgtcccgaggatatgagtgaggaattggtaaacctcgtctgtccttcttgttttcacttaacttgaggcaggaggtggtctccaaacaagaagtaaagctaacttattggrtgcctgactcccaaaccatctgtcctaggcagacagaaagaccctcagggccaacctgaggggaacagatgtttatggggggcaggtttactcttgtttttccaagctgggctgaagagctcctcttccatctgcatcaagccctgaaaactctgccgtgcatgagtaaagtagcaagtgctgcatcccccagtgagatccagtggtgacattgtccacaccactggggaatgctagttattaagagactgggcttgtgagagctcaaaggtggactaacccagatcttccctgtcgagg

SEQ ID NO: 57720 - DNA, 601 bp, Human
agcagctgctgtttatgaatcactcatcacctgcccagcacaataccaggattcaaatataacttaataatcacagtaattctatggcacacttattattgttcagatggcagtgatatgaatagtagggactcaggtacacaaaatgagaaagaggcagatcaaacagcacggggttgtagattgcaccaaagggaggagaccagaatgatttctagattcttactggggcagttgggtggatagttcaacactcactaagactggcattgaaagacagggaggagacatggtggtgtcrggggagcaggaggataatgagcgttgttggacatgttgagtttagcgtacatatgggacatccagtacaagataaccagtggacagttgtacatacagttgtaaaggtcagtaaagaggtgtgggtgggagttgtcagtatttaggtagaagtaaaatcataagagtagagcccctggaaaaatacggaaactaacaaacaaacttccgaataatccatggtttagttcaaagaagaagtctcaagggaaataagaaaatattttgaattgaaagaaaataaaagtataacacatgatac

SEQ ID NO: 57721 - DNA, 601 bp, Human
ctcatcacctgcccagcacaataccaggattcaaatataacttaataatcacagtaattctatggcacacttattattgttcagatggcagtgatatgaatagtagggactcaggtacacaaaatgagaaagaggcagatcaaacagcacggggttgtagattgcaccaaagggaggagaccagaatgatttctagattcttactggggcagttgggtggatagttcaacactcactaagactggcattgaaagacagggaggagacatggtggtgtcgggggagcaggaggataatgagygttgttggacatgttgagtttagcgtacatatgggacatccagtacaagataaccagtggacagttgtacatacagttgtaaaggtcagtaaagaggtgtgggtgggagttgtcagtatttaggtagaagtaaaatcataagagtagagcccctggaaaaatacggaaactaacaaacaaacttccgaataatccatggtttagttcaaagaagaagtctcaagggaaataagaaaatattttgaattgaaagaaaataaaagtataacacatgatactttgtggaatccagattaaaaa

SEQ ID NO: 57722 - DNA, 601 bp, Human
cataccaaaaccagacaaaaatagtacaagaaaactacaagcaaatatctcaaatattttcttccagttcgtcatttgtgttttgcagaacaaatgtttttaaactttaataaagtacaatttatcatttttttcttttataggtcatgtttttagtgtcatgtgtaagaactctttgtaaacataaatataaaaatcttcatagaaatattagcaaattaaattcagcaatatataaatgaaaaatacactccgtccaaatgagttttatcctgagaatgcaagctggcttaataataawaaaaaaaatcaaccaatgtaatttaccatattaataatctaaagaaagaaaaaaaattaacatatcaattgatgcagaaaaaattggacaaaactcaatattcatttatgatgaaagttctcagcacactagaaatagaagggaactttcttgatccaataagaagtatctaccaaaaacctgtaacatacttaatgatgaaaaactgcatgctttctcattaagctatgaaacaaaactaaaatgttcatcctccccagtcctattcaacatcatgtcataaccagcacagtaagataa

SEQ ID NO: 57723 - DNA, 601 bp, Human
agaagtatctaccaaaaacctgtaacatacttaatgatgaaaaactgcatgctttctcattaagctatgaaacaaaactaaaatgttcatcctccccagtcctattcaacatcatgtcataaccagcacagtaagataaaaaaaatttttaaaggcatgtggggctcggctcggtggctcatgcctgtaatcccagcactttgggagcctgaggtgggtggatcatctgaggtcaggagttcgagaccaacctggccaacatggtgaaacccccacatctactaaaaatacaaaaattagycgggcgtggtggcagatgcctgtagtctcacctacttgggagtaggcaggagaattgcttgaacctgggaggcagaggttgcagtgagctgagattgcaccactgcactccagcctgggtgacagagcaagactctgtctcaaaaaagtaataataaaataaaaaataaaaaccatatggaatggaaaggaaaaaaagaaaaattgtttctatacacagaaaacagtattgtttatgtagaaaatccacaggaatctaccaagaaattactagaaataatgagtgagtttagctgggttg

SEQ ID NO: 57724 - DNA, 601 bp, Human
tcatgcctgtaatcccagcactttgggagcctgaggtgggtggatcatctgaggtcaggagttcgagaccaacctggccaacatggtgaaacccccacatctactaaaaatacaaaaattagtcgggcgtggtggcagatgcctgtagtctcacctacttgggagtaggcaggagaattgcttgaacctgggaggcagaggttgcagtgagctgagattgcaccactgcactccagcctgggtgacagagcaagactctgtctcaaaaaagtaataataaaataaaaaataaaaaccatayggaatggaaaggaaaaaaagaaaaattgtttctatacacagaaaacagtattgtttatgtagaaaatccacaggaatctaccaagaaattactagaaataatgagtgagtttagctgggttgcagcatacaagtcaacacacaaaaatcaattgtatttctatatattaacaactagaaaccaaaaatttaaaaaatactacttacagcagctgcaaaacaaaggaaatatttaggtataaatctaacaacacatgtctagaatctatatgctaaaaattccaaaacactgaaagaaatc

SEQ ID NO: 57725 - DNA, 601 bp, Human
atacaaaaattagtcgggcgtggtggcagatgcctgtagtctcacctacttgggagtaggcaggagaattgcttgaacctgggaggcagaggttgcagtgagctgagattgcaccactgcactccagcctgggtgacagagcaagactctgtctcaaaaaagtaataataaaataaaaaataaaaaccatatggaatggaaaggaaaaaaagaaaaattgtttctatacacagaaaacagtattgtttatgtagaaaatccacaggaatctaccaagaaattactagaaataatgagtgaktttagctgggttgcagcatacaagtcaacacacaaaaatcaattgtatttctatatattaacaactagaaaccaaaaatttaaaaaatactacttacagcagctgcaaaacaaaggaaatatttaggtataaatctaacaacacatgtctagaatctatatgctaaaaattccaaaacactgaaagaaatcaaagaatacctaaataaatgaagagataacccatgttcatggattgaaagactcagcagagtgaagatagcaagtcttacgattgatttgtaggcttaatgaaattcaa

SEQ ID NO: 57726 - DNA, 601 bp, Human
caagtcaaaatcccagcaggattttttgtatgtttggacacagtgattctaaaacttgtatagaagggcagtgaatccagaatggccaaaacaattcttaagatgaagaataaagttggaagaattactgtacccaatcttaagacttactatataaagcttcagtaatcaaatgtgatattggtgacaggatagatacacaagccattggaacacagtagagaatccagaaatagacccacacaaatacggcctattgattttcaacaaaagtgcgaaaacaatgaaatggaaaaaggayggtctttcaacaaatgatgttggaatgattagacattcatatgaaaacaaaatgaaccttgacctccatctcacaccttttgcaagaattaactcaaaatgggtcatggagcaaaatataaaggtataaaatttcagaaaacacaggagaaaatctttatgacctgtagttatacaaagagttcttagacgtgacacttaaaaacgtgacccataaaagaaaaaaaaaaagtggtaaattgtactttattaaagtttaaaaacttttattttgcaagaaacaaactataaactggaagaa

SEQ ID NO: 57727 - DNA, 601 bp, Human
aagtcaaaatcccagcaggattttttgtatgtttggacacagtgattctaaaacttgtatagaagggcagtgaatccagaatggccaaaacaattcttaagatgaagaataaagttggaagaattactgtacccaatcttaagacttactatataaagcttcagtaatcaaatgtgatattggtgacaggatagatacacaagccattggaacacagtagagaatccagaaatagacccacacaaatacggcctattgattttcaacaaaagtgcgaaaacaatgaaatggaaaaaggacrgtctttcaacaaatgatgttggaatgattagacattcatatgaaaacaaaatgaaccttgacctccatctcacaccttttgcaagaattaactcaaaatgggtcatggagcaaaatataaaggtataaaatttcagaaaacacaggagaaaatctttatgacctgtagttatacaaagagttcttagacgtgacacttaaaaacgtgacccataaaagaaaaaaaaaaagtggtaaattgtactttattaaagtttaaaaacttttattttgcaagaaacaaactataaactggaagaaa

SEQ ID NO: 57728 - DNA, 601 bp, Human
gcaaatcacatatctgacaaaggacttgtatccaactcattgtatcagaactctcagactcatttgtatgaagccagccttacttaaaatgtaatctaaaaacctgaacaaacactttaccaaataatacaaggatggccaatacattcatggaaagatattcaatatcactagaaattacagaaatgcaaattaaaaccacaatgagataccattgcacacttactagaatggctaaaataatgatgataatgataataaatactgtcaatatggtgtgctaatgagtatgcagaacaaraggaactctcattcatcactgtgggaatgcaaaatggtacagctgctccgggaaagtgtggcagcttcttataaagctaaacaaacgcatataactgaatgatcccactcctagttatttatcttaaagaagtgaaactttatgctcacacaagaacccgtgagtatatcagctctatttgtaatcactaaaatttgaagaccactgaaatattctttaacagttgaatagataaaccttgatacatccatgcaataaaatactactctgcaataaaaaagaattaactgttcatataca

SEQ ID NO: 57729 - DNA, 601 bp, Human
actctcagactcatttgtatgaagccagccttacttaaaatgtaatctaaaaacctgaacaaacactttaccaaataatacaaggatggccaatacattcatggaaagatattcaatatcactagaaattacagaaatgcaaattaaaaccacaatgagataccattgcacacttactagaatggctaaaataatgatgataatgataataaatactgtcaatatggtgtgctaatgagtatgcagaacaagaggaactctcattcatcactgtgggaatgcaaaatggtacagctgctcygggaaagtgtggcagcttcttataaagctaaacaaacgcatataactgaatgatcccactcctagttatttatcttaaagaagtgaaactttatgctcacacaagaacccgtgagtatatcagctctatttgtaatcactaaaatttgaagaccactgaaatattctttaacagttgaatagataaaccttgatacatccatgcaataaaatactactctgcaataaaaaagaattaactgttcatatacacaacaacatggatgaccctcaaaggccctttgccgagaaagagaaacca

SEQ ID NO: 57730 - DNA, 601 bp, Human
attcaatatcactagaaattacagaaatgcaaattaaaaccacaatgagataccattgcacacttactagaatggctaaaataatgatgataatgataataaatactgtcaatatggtgtgctaatgagtatgcagaacaagaggaactctcattcatcactgtgggaatgcaaaatggtacagctgctccgggaaagtgtggcagcttcttataaagctaaacaaacgcatataactgaatgatcccactcctagttatttatcttaaagaagtgaaactttatgctcacacaagaaccygtgagtatatcagctctatttgtaatcactaaaatttgaagaccactgaaatattctttaacagttgaatagataaaccttgatacatccatgcaataaaatactactctgcaataaaaaagaattaactgttcatatacacaacaacatggatgaccctcaaaggccctttgccgagaaagagaaaccaatctcaaaaggttttcttgctgtatgattccatttaggtattattcttgaaaagataaaactgtagtgatgagaaacagatcggtggttgccaggggctgaggatgagaa

SEQ ID NO: 57731 - DNA, 601 bp, Human
tgaaactttatgctcacacaagaacccgtgagtatatcagctctatttgtaatcactaaaatttgaagaccactgaaatattctttaacagttgaatagataaaccttgatacatccatgcaataaaatactactctgcaataaaaaagaattaactgttcatatacacaacaacatggatgaccctcaaaggccctttgccgagaaagagaaaccaatctcaaaaggttttcttgctgtatgattccatttaggtattattcttgaaaagataaaactgtagtgatgagaaacagatcgktggttgccaggggctgaggatgagaagaggatgtgactatagaggagaagtatgaggaatttttccgaggtgatagaactcttctgtattctgattgtgtgatggttacgtgaatctatacatgcattaaaatgtataaattttttcacaaaactgtgcaccaaaaagtcaattttactgcatgtaattaaacacataaaataaatgttataggcagaaaataagctgataaaagacacaagtacacacagagagagagaagagagagaaaagaaggcaatagtccaagatgaagaggga

SEQ ID NO: 57732 - DNA, 601 bp, Human
gctctatttgtaatcactaaaatttgaagaccactgaaatattctttaacagttgaatagataaaccttgatacatccatgcaataaaatactactctgcaataaaaaagaattaactgttcatatacacaacaacatggatgaccctcaaaggccctttgccgagaaagagaaaccaatctcaaaaggttttcttgctgtatgattccatttaggtattattcttgaaaagataaaactgtagtgatgagaaacagatcggtggttgccaggggctgaggatgagaagaggatgtgactrtagaggagaagtatgaggaatttttccgaggtgatagaactcttctgtattctgattgtgtgatggttacgtgaatctatacatgcattaaaatgtataaattttttcacaaaactgtgcaccaaaaagtcaattttactgcatgtaattaaacacataaaataaatgttataggcagaaaataagctgataaaagacacaagtacacacagagagagagaagagagagaaaagaaggcaatagtccaagatgaagagggagatggataagaggaatgcagaagaaagaaggttgtcatg

SEQ ID NO: 57733 - DNA, 601 bp, Human
aacccttcaataaaagaattacattttttccctagtattcacaaaattagtgatatattaacttgttaaggaaacctcattaaattccctccaaaatgcccccagaaattgctcagcccacattttccgataaaaataaaacagaactagaaattaatgacaaaaacatataataccaaagatcaatggatgagtgagatggaggtaggaatcagatgggagcctcaagaattgaaatcttgaaattgcttctgtaaggaatgggaaattaactagggacacccaataggtttgacaagcmgtgtgcgggactttgctgtggttggagatcatgggtatatagtggcatgaagcccctatgtgtgacactttcccctggggacactgtctagagcaaatttcactcatggttgagggtatgcacacaggatgttgaagagacaggaaggtaaggacatttaagccactggtcagaagcgattgaatggcttttccatatgggaagtggtagggaggaagtaaaaccgtagcaatgcactgatggaccaggggaaaggaaacagttgaggaactggagggtttgatgaaatgaaaaaaaaaa

SEQ ID NO: 57734 - DNA, 601 bp, Human
tgacaagcagtgtgcgggactttgctgtggttggagatcatgggtatatagtggcatgaagcccctatgtgtgacactttcccctggggacactgtctagagcaaatttcactcatggttgagggtatgcacacaggatgttgaagagacaggaaggtaaggacatttaagccactggtcagaagcgattgaatggcttttccatatgggaagtggtagggaggaagtaaaaccgtagcaatgcactgatggaccaggggaaaggaaacagttgaggaactggagggtttgatgaaatgaaaaaaaaaaaaaaagccaggtaaagggagtagagacataaaaggataaactaccactggagagtttagaggctatgccatatcaggtgaaactccaaatgcctggactggagtggagaggaggtcataagaagaatggatgatacgtttgacttcacgtcgtctattattctcagacctcctccaagattcatttgtatgaaaatcacattggagggatactcttttagccctggaatttatcttgattgttacataatttggtctaaattctctgaaaggagaaaggaaatcaacatttg

SEQ ID NO: 57735 - DNA, 601 bp, Human
gttcctctacctgttcctcagaggtggacattattttaaatcaattttgggtatatcttttcagactcttttctatatatttacattcatatatgaccttgtagaaaatgcattttactgtacctttcttttaaatatttggagggcctttaaaatttttttattctgacataatctcaaaatgacagaaaattgcaataacagtaaaagaaatttctgtatacactttacctgatgtactaattgtttatattttgctccatttggtttagcattttctctactaatgtatttttatatstgtgcacattttttttctgatccatctgagagtaagttggggtcatggtttccacttatcctgaaatacttcagttgtatttcccaagaacaaaaatattcttagtacatttattcaaatgaggaaatgcaacattgacccaatgctattatctgacggttcagctccagatttcactaattgaaccactaatgccttcacgcttctttcttaaacaaagaggcattatattgccctcatcttcttttttcaacgtgcttcatcttgcttttttcaacacgtttctgcatatagataacc

SEQ ID NO: 57736 - DNA, 601 bp, Human
ttttattctgacataatctcaaaatgacagaaaattgcaataacagtaaaagaaatttctgtatacactttacctgatgtactaattgtttatattttgctccatttggtttagcattttctctactaatgtatttttatatgtgtgcacattttttttctgatccatctgagagtaagttggggtcatggtttccacttatcctgaaatacttcagttgtatttcccaagaacaaaaatattcttagtacatttattcaaatgaggaaatgcaacattgacccaatgctattatctgacrgttcagctccagatttcactaattgaaccactaatgccttcacgcttctttcttaaacaaagaggcattatattgccctcatcttcttttttcaacgtgcttcatcttgcttttttcaacacgtttctgcatatagataacccaatgttatcggcatgggcaaagtgcgtcacagtatgaatgcgccatatattatttactgtttcccccattggtgggcactcaggttatttcctacttttataattgcacacatcctcaggctgaatattagtgggtattactttggattaatgttct

SEQ ID NO: 57737 - DNA, 601 bp, Human
tgcagaggcctcgcttgctccaaagacccttagacagaaacaggcagacctcaccctgcacccagagccccatgcccacggcaagcagtgttctctggaccaggacacgcttctcctgtactctttgcaaacttccaccagtggggacgtttgctatttctgctctgtgtgaagcatttggtaccatctgggctggctgagtttcaacaaagatagtaaagaaacatttatcaagaaaaatcaaagtcggtctcgccaagtgtggtctagagagatttgcttccgcgatacatatgcggcyctcttgctgctgggaaacacgactcaactttgaaacacttcaggagggacagccctttggatcttagcctgcagctactgtcaactgctcatgatagatggttttagtagccagagctcttggagatgtgaatgccagcagtctcaggatgcattccacagcattccgttgcacagaaagttttggcccctttggtagagaataagctcaaaaggacaaaagtagaagaaaggacctataaaggtgagggaagagtcatgcctcagtgagtaatgtttggctctgcaatgattagattcc

SEQ ID NO: 57738 - DNA, 601 bp, Human
ggctctcttgctgctgggaaacacgactcaactttgaaacacttcaggagggacagccctttggatcttagcctgcagctactgtcaactgctcatgatagatggttttagtagccagagctcttggagatgtgaatgccagcagtctcaggatgcattccacagcattccgttgcacagaaagttttggcccctttggtagagaataagctcaaaaggacaaaagtagaagaaaggacctataaaggtgagggaagagtcatgcctcagtgagtaatgtttggctctgcaatgattagawtcccaagaaaaggtcattcttggctgcacacagtggctcacacctgtaatcccagcactttgggaggccgaagcgggaggatcactcgtggccaggagtttgacaccagcctgggtaacatagtgagactccatctctacaaaaattttttaaaagttagctggatgtagtggcacatgcctgtagtcccagctattcagggtgctgaggtggtagcatcgcttgatcctgggagatcaaggctgcagtgagccgtgatcgcgccaccgcactccagcgagaccctgtgtcaaaaaaaaa

SEQ ID NO: 57739 - DNA, 601 bp, Human
cattcttggctgcacacagtggctcacacctgtaatcccagcactttgggaggccgaagcgggaggatcactcgtggccaggagtttgacaccagcctgggtaacatagtgagactccatctctacaaaaattttttaaaagttagctggatgtagtggcacatgcctgtagtcccagctattcagggtgctgaggtggtagcatcgcttgatcctgggagatcaaggctgcagtgagccgtgatcgcgccaccgcactccagcgagaccctgtgtcaaaaaaaaaaaaaaaaaaaaattrctcttaaaccacgagtcttgagattgacagcttcaaaatacaacactcttgtccagcaaagagcactctaaaagagctgtaaattccttaagcttatgatagaagatctttttccagtgactacccttgtggtgtcagttcataagactggggcggaggagggggagtggccttgccagggagaagaaagatgagctgtttcctcttgcctctgtgttaccaatcaaccagacagacaagcttctggcgcatctgagtgtctcaatcctgtgtgtgtgcagctcactatgtgatagatgt

SEQ ID NO: 57740 - DNA, 601 bp, Human
ctggatgtagtggcacatgcctgtagtcccagctattcagggtgctgaggtggtagcatcgcttgatcctgggagatcaaggctgcagtgagccgtgatcgcgccaccgcactccagcgagaccctgtgtcaaaaaaaaaaaaaaaaaaaaattgctcttaaaccacgagtcttgagattgacagcttcaaaatacaacactcttgtccagcaaagagcactctaaaagagctgtaaattccttaagcttatgatagaagatctttttccagtgactacccttgtggtgtcagttcataaractggggcggaggagggggagtggccttgccagggagaagaaagatgagctgtttcctcttgcctctgtgttaccaatcaaccagacagacaagcttctggcgcatctgagtgtctcaatcctgtgtgtgtgcagctcactatgtgatagatgtgtcactccaagatcccagcctagaaactggtacatgttattttccttggaaggctcaagaaatgaaagtaacagttggatattatattctatggggaaaatgcatgggtattttgagaaattattattctccagaacaatgttact

SEQ ID NO: 57741 - DNA, 601 bp, Human
ccttggaaggctcaagaaatgaaagtaacagttggatattatattctatggggaaaatgcatgggtattttgagaaattattattctccagaacaatgttacttaatgtgtgtcttatagactggcagcatcagcatcacatggaaatgttttagaaaagcatatggacaggtttcactgcagacttagggaatcagaatctatctgtgggggtgggtgccagatacatgtgtctcatgagtcctctgagtaatttttatgcacactaaggtttaagaagctctcctgtggaagggttcgmgtaaacatcgaatgcattgttaagaagaaaaccacaaatggttccatttgatgtcagtacgtgtggaaatggttaactcttcataataaaaatagacaaacaggcaaggcatggtggctcacacttgtaatcctagcactttgggagaccaaggctggaggatcatttgcatccaggagtttgaaaccagtctgggcaacatagagagacccccacctctacaaaaatttttttaaaaattagttaggcataggttggcaagcacctgtagtcccagctacttggaaggctgagttggga

SEQ ID NO: 57742 - DNA, 601 bp, Human
aaatgcatgggtattttgagaaattattattctccagaacaatgttacttaatgtgtgtcttatagactggcagcatcagcatcacatggaaatgttttagaaaagcatatggacaggtttcactgcagacttagggaatcagaatctatctgtgggggtgggtgccagatacatgtgtctcatgagtcctctgagtaatttttatgcacactaaggtttaagaagctctcctgtggaagggttcgagtaaacatcgaatgcattgttaagaagaaaaccacaaatggttccatttgatgwcagtacgtgtggaaatggttaactcttcataataaaaatagacaaacaggcaaggcatggtggctcacacttgtaatcctagcactttgggagaccaaggctggaggatcatttgcatccaggagtttgaaaccagtctgggcaacatagagagacccccacctctacaaaaatttttttaaaaattagttaggcataggttggcaagcacctgtagtcccagctacttggaaggctgagttgggaggatcacttgagcccgggaggtcgaggctgcagtgaaccatgatcatgccactg

SEQ ID NO: 57743 - DNA, 601 bp, Human
aaggcatggtggctcacacttgtaatcctagcactttgggagaccaaggctggaggatcatttgcatccaggagtttgaaaccagtctgggcaacatagagagacccccacctctacaaaaatttttttaaaaattagttaggcataggttggcaagcacctgtagtcccagctacttggaaggctgagttgggaggatcacttgagcccgggaggtcgaggctgcagtgaaccatgatcatgccactgcactccagcctgggtgacagagtgagaccttgtctctctctctctctctctcacacacacacacacaacaaaaacgtagtgaaagagggcattgcatatgaataagaataataatgaaatagcagtaatatatagcagttaacatttattgagtattttttaagttccaggttctgtgctaaacatgtatattctttatccaattttactcttgtaacaacctattttattgatcaagaaattgaggttcatatgtgtgaagtaactgcttggtaagatgcggaccctgggatcttatagccctgtgtccatgacactatatggtctgtcttggggacaagattaacatttt

SEQ ID NO: 57744 - DNA, 601 bp, Human
ggatcacttgagcccgggaggtcgaggctgcagtgaaccatgatcatgccactgcactccagcctgggtgacagagtgagaccttgtctctctctctctctctctcacacacacacacacaacaaaaacgtagtgaaagagggcattgcatatgaataagaataataatgaaatagcagtaatatatagcagttaacatttattgagtattttttaagttccaggttctgtgctaaacatgtatattctttatccaattttactcttgtaacaacctattttattgatcaagaaattgagkttcatatgtgtgaagtaactgcttggtaagatgcggaccctgggatcttatagccctgtgtccatgacactatatggtctgtcttggggacaagattaacattttattttgtcccctatatccccagggcctagcagaatgcttagcacttagtagggacttgcttgttgaacttaactgatcaaggtcaacatcttgcttttggtgtaaaaatgagatgcagcttgcaagctgagatgggagatgaattcagcctgtggaaaaatagaagacactgccatgttgctggagtgcagaaaa

SEQ ID NO: 57745 - DNA, 601 bp, Human
attgatcaagaaattgaggttcatatgtgtgaagtaactgcttggtaagatgcggaccctgggatcttatagccctgtgtccatgacactatatggtctgtcttggggacaagattaacattttattttgtcccctatatccccagggcctagcagaatgcttagcacttagtagggacttgcttgttgaacttaactgatcaaggtcaacatcttgcttttggtgtaaaaatgagatgcagcttgcaagctgagatgggagatgaattcagcctgtggaaaaatagaagacactgccatrttgctggagtgcagaaaaaatgtcagcacagaataagttacagcttgatcctggtagccgattcaatgcttctcccatctcatttattcggtctcaaccccttactagctgtatcattttagggaagtcagtcttatttattttccagcaatggtcagctgtttgagtgtaggaaaaggacagagtaagaaaggacaggtatttgaatttaagtagggctggggtcatgtgagacaagtaaaataaaaagaaagaggggcaagggagttgagggtctttccaaaggagtagctaaaatgc

SEQ ID NO: 57746 - DNA, 601 bp, Human
aaaaatagaaattggtgtaagatagtagggtacttgaaactgagattgagaaagtggtataatttctgggataataggctccagagcgtgaccatggtaggagataactatgattgggggtgagcaaaggttgcaggaagtgagggggtgctttctctcctactttccaatattctttcttctaatctgtttttcttgttatcttgagtttacaaaatttctggttttatttatgctgtggatatttttccagccttttccctatgggctgtctgggtgcaggttatgggtgatacatggrtaataggtgcatcttggtttagagggtaactctttatttcttactgcacttatggaacacgagaaaaaaaagtattaaataatggctatggtaatggatatctttgtcttattccttactttaatggaattgcatttatcatgaaccatggtgctgttatttcagatagcctttatcctgttaaaattctctgctgtttctagataactacaatgatcttatggttttcttctttgatctataaatatgatgaatatattgaaaatagatttcctaagattgaaccatctttgcattcct

SEQ ID NO: 57747 - DNA, 601 bp, Human
gcacttatggaacacgagaaaaaaaagtattaaataatggctatggtaatggatatctttgtcttattccttactttaatggaattgcatttatcatgaaccatggtgctgttatttcagatagcctttatcctgttaaaattctctgctgtttctagataactacaatgatcttatggttttcttctttgatctataaatatgatgaatatattgaaaatagatttcctaagattgaaccatctttgcattcctgataggagtcattatgtattcaccttttagcagatagttagagtcratttggattgaatgtattactgtggattgttctactgtaagtgagatgattgacattgtatccttaagagctgtgcaattctcattttctagtctgcttccattgactacctgcattactggtttctgaattgattcctaattaactacttcctgtttctccaagctgatgatttagtctccctcatcctttctatagccagttgcatcttcactgctgattccctgcctccttttctcctgtaagttcatcttttttttttgacggagtctcactctgtcgcccaggctggagtgcagt

SEQ ID NO: 57748 - DNA, 601 bp, Human
ttaatggaattgcatttatcatgaaccatggtgctgttatttcagatagcctttatcctgttaaaattctctgctgtttctagataactacaatgatcttatggttttcttctttgatctataaatatgatgaatatattgaaaatagatttcctaagattgaaccatctttgcattcctgataggagtcattatgtattcaccttttagcagatagttagagtcgatttggattgaatgtattactgtggattgttctactgtaagtgagatgattgacattgtatccttaagagctgtrcaattctcattttctagtctgcttccattgactacctgcattactggtttctgaattgattcctaattaactacttcctgtttctccaagctgatgatttagtctccctcatcctttctatagccagttgcatcttcactgctgattccctgcctccttttctcctgtaagttcatcttttttttttgacggagtctcactctgtcgcccaggctggagtgcagtggcatgatcttggctcactgcaagctctgcctcctgggttcacgccattctcctgcctgggcctcccaagtaggt

SEQ ID NO: 57749 - DNA, 601 bp, Human
attatgtattcaccttttagcagatagttagagtcgatttggattgaatgtattactgtggattgttctactgtaagtgagatgattgacattgtatccttaagagctgtgcaattctcattttctagtctgcttccattgactacctgcattactggtttctgaattgattcctaattaactacttcctgtttctccaagctgatgatttagtctccctcatcctttctatagccagttgcatcttcactgctgattccctgcctccttttctcctgtaagttcatcttttttttttgayggagtctcactctgtcgcccaggctggagtgcagtggcatgatcttggctcactgcaagctctgcctcctgggttcacgccattctcctgcctgggcctcccaagtaggtgggaccacaggcacctgccaccatgcctggctaatttttttgtattgttagtagagacagggtttcaccatgttagccttatagcctctttacctgggtgttctggagtcagggtggagctgagctctaatgctgctgacattgttccagccttctctctatgggctgtctgggtgctggttatgggtga

SEQ ID NO: 57750 - DNA, 601 bp, Human
gagatgattgacattgtatccttaagagctgtgcaattctcattttctagtctgcttccattgactacctgcattactggtttctgaattgattcctaattaactacttcctgtttctccaagctgatgatttagtctccctcatcctttctatagccagttgcatcttcactgctgattccctgcctccttttctcctgtaagttcatcttttttttttgacggagtctcactctgtcgcccaggctggagtgcagtggcatgatcttggctcactgcaagctctgcctcctgggttcaygccattctcctgcctgggcctcccaagtaggtgggaccacaggcacctgccaccatgcctggctaatttttttgtattgttagtagagacagggtttcaccatgttagccttatagcctctttacctgggtgttctggagtcagggtggagctgagctctaatgctgctgacattgttccagccttctctctatgggctgtctgggtgctggttatgggtgatacatggataataggtgtaccttggtttagagggtaattcttcctttctttagctttttctttttgaatggaggtaaa

SEQ ID NO: 57751 - DNA, 601 bp, Human
tttagtctccctcatcctttctatagccagttgcatcttcactgctgattccctgcctccttttctcctgtaagttcatcttttttttttgacggagtctcactctgtcgcccaggctggagtgcagtggcatgatcttggctcactgcaagctctgcctcctgggttcacgccattctcctgcctgggcctcccaagtaggtgggaccacaggcacctgccaccatgcctggctaatttttttgtattgttagtagagacagggtttcaccatgttagccttatagcctctttacctggktgttctggagtcagggtggagctgagctctaatgctgctgacattgttccagccttctctctatgggctgtctgggtgctggttatgggtgatacatggataataggtgtaccttggtttagagggtaattcttcctttctttagctttttctttttgaatggaggtaaaattaacgtaacataaaattaaccattaactgtttttaaacgtacaattcagtgacatttatagaatattcacagtgttggacaaccatcatctctatctagttctcagaaattttcatcacctctaaaag

SEQ ID NO: 57752 - DNA, 601 bp, Human
tctcctgcctgggcctcccaagtaggtgggaccacaggcacctgccaccatgcctggctaatttttttgtattgttagtagagacagggtttcaccatgttagccttatagcctctttacctgggtgttctggagtcagggtggagctgagctctaatgctgctgacattgttccagccttctctctatgggctgtctgggtgctggttatgggtgatacatggataataggtgtaccttggtttagagggtaattcttcctttctttagctttttctttttgaatggaggtaaaattaaygtaacataaaattaaccattaactgtttttaaacgtacaattcagtgacatttatagaatattcacagtgttggacaaccatcatctctatctagttctcagaaattttcatcacctctaaaagaaaccctgtactcattaagcagtcactccccatttccctttccctccagcctctggcaactattaatagtagtctactttctgtctctatggatttacctgtttgggatgtttcatgtaaatggaatcatacaatatgtgaccttttgtgttggggtacacaaatgttcatagcag

SEQ ID NO: 57753 - DNA, 601 bp, Human
caggcacctgccaccatgcctggctaatttttttgtattgttagtagagacagggtttcaccatgttagccttatagcctctttacctgggtgttctggagtcagggtggagctgagctctaatgctgctgacattgttccagccttctctctatgggctgtctgggtgctggttatgggtgatacatggataataggtgtaccttggtttagagggtaattcttcctttctttagctttttctttttgaatggaggtaaaattaacgtaacataaaattaaccattaactgtttttaaaygtacaattcagtgacatttatagaatattcacagtgttggacaaccatcatctctatctagttctcagaaattttcatcacctctaaaagaaaccctgtactcattaagcagtcactccccatttccctttccctccagcctctggcaactattaatagtagtctactttctgtctctatggatttacctgtttgggatgtttcatgtaaatggaatcatacaatatgtgaccttttgtgttggggtacacaaatgttcatagcagcagtattcacaacagccaaaaagtggaaacaacc

SEQ ID NO: 57754 - DNA, 601 bp, Human
tatgcatcaactgctgaatggataaacaaaatgtgggatatctatacaatggaatattattcagtcatgcaaaaaaatgaagtgctgatacatgctataatgtggtgaactttgaaaacgttatgctaaatgaaagaagccagcctttcctgtgggctttgtggaaaataagcttagaaaacttacagttaatcttggtatgggaagagcagtgtaaaagtcagaaatccatttttaaccaacacagaccagagttgacatcttatcagcccatctcattttgtgcactgcttcagctatrgatgttaataaaattaaatttctcactaaacaagtgtgatgccaaagaaccttccacaagttctgcagctgtcactgcttggtgcttaaacatgttggacagtattaatgcaaaaactgctttttctttttcagtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagattgtaagtgga

SEQ ID NO: 57755 - DNA, 601 bp, Human
aagaaccttccacaagttctgcagctgtcactgcttggtgcttaaacatgttggacagtattaatgcaaaaactgctttttctttttcagtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagattgtaagtggaaatgactgcagtgagcatgggtggtggaggttgggttatgtgccmcctgagatcagggagttcctcctcccttagctcctgtttccttccttccctacctccctccttttctgtcttctccatccctcactcctatctttccctcccttcttttccatctgcaattttgtattgtgagccaagaaaaaaaattagagctatttttttaatagagatgagaatgcctgtggtgtgggggagtgggtaggacaggaaatggtgtgatgtgttgctaagtgaaggcaagttgtgggagaaatgatggggctcagcaaataggggaacataacctacagggtgtggtga

SEQ ID NO: 57756 - DNA, 601 bp, Human
cttctccatccctcactcctatctttccctcccttcttttccatctgcaattttgtattgtgagccaagaaaaaaaattagagctatttttttaatagagatgagaatgcctgtggtgtgggggagtgggtaggacaggaaatggtgtgatgtgttgctaagtgaaggcaagttgtgggagaaatgatggggctcagcaaataggggaacataacctacagggtgtggtgacagcctctctagagttgggtttatggatgatgcttggcctgcagccttctgggacatctccaccagcctmccttgagggtcttccctggccagggctccaagaatctgggagtctctttcttgtacatctaggcatcaggagttggttataacagccaattcactgagcatatatgatgtgtgacaaacactgggttaagcgatccgacttcatcggctcattttattcccaatgtagcaatagggcttatagaggttaaagagtatgcccaaagtcccatagcaaatatggggtggagtgggattcagcttctggcagtctgactttagcggtcatacttttttagccaccagctagaagcacagttcc

SEQ ID NO: 57757 - DNA, 601 bp, Human
ccaccagctagaagcacagttccttgtcctgtctcctcttccctctctcagggcaaagctgggccccttctcagcctcagtcaaggacatgtctcagaacagacaatttccccaggatttttctccatgcatttcctcagcctcattctcaacccacctgtgtgcagatatacacatgtacacacccaattatgcaattgatatctgtatttcttataggcaataggaattcctgaatatcctgaaccctattaagacataagataacaaaagtagttagaactgttcttgtcatagccartctaagacctctgcctgtttaagccacaggctgtcaaacagaaaaagctctcactccctggagagctagcctgggatggaaactgaatatgtttctttcagcagcttgtaatctttaaaactttctacctccaggtcttgtcctcttgtacatttattctgcttgagaaattactacaacctccactgatgtcttttctttttctctatgcagtcagctgaaagaatcggacaaagacagaagactgtcagtagagatttgggattgggatttgaccagcaggaatgacttcatgggatc

SEQ ID NO: 57758 - DNA, 601 bp, Human
gcaggaaggaaggaagggaggaagggaaggagggacagaaggagggagggagggaattagttctagtattttaaaaatctggggctagaaggcaacaattgagaacagttgaatagttaatgccccctttagacaggacatggattttctatttgtcaccgtcctcaccactccctattttattacatctgggccaatttactaaactacatgatgagactgtaactgcccagtggcttctttgtgcctgctgcccagacagagccgatttatcaagatgggagaattgcaatagggaaaragttttacacacatagagccagctaaatgggagaacagagtttttttatgactcaaatcagcctccctgaaaatttggaagctagggcttttcaaagatagtttggcaaggagtagggtggctagggaatgggtgctgctgactggttggggatgcagtaataggggtgtgaaaaatggtcctcgtgcactgagtccacttctgggtggggccacaggactagttggcaggtccaggtggggcagtctggttgtcaggaaggcaaaagcctgaaaagacatctcaaaaggccaatctcaa

SEQ ID NO: 57759 - DNA, 601 bp, Human
gataatgggcattaatgggcattggccaaagatttccttagctcactaaggagaaaagcagcaggatgaatgaatgattccacagaaggtttgataaactgatgttcgtgtagtcagtagaaaaagatatgctgaaataactttgctcagttaaatataaaactgactgatatacaggacaatagaatcataagctttggggttatctactagaatgaaacaaaaaaaagattttggccaggcatggcggctcacacctgtaatcccaacactttgggaggctgaggcgggcggatcaccygaggtcaggagtttgagacgagcctggccaacatagtgaaaccatgtctctactaaaaatacaaaaattagctgggcatggtggcaggtgcctgtattcccagctactcgggaggctgaggcagaagaatcgcttgaacccaggaggcagaggttgcagtgagctgagatggtgccacggcactccagcctgggcaaagatttcacctcagttttctaaaagttaacatgtatctttgcagactagggaggccatctggggctgacctgatggtgaataataaactaaacaaagtaatat

SEQ ID NO: 57760 - DNA, 601 bp, Human
ctaaggagaaaagcagcaggatgaatgaatgattccacagaaggtttgataaactgatgttcgtgtagtcagtagaaaaagatatgctgaaataactttgctcagttaaatataaaactgactgatatacaggacaatagaatcataagctttggggttatctactagaatgaaacaaaaaaaagattttggccaggcatggcggctcacacctgtaatcccaacactttgggaggctgaggcgggcggatcacctgaggtcaggagtttgagacgagcctggccaacatagtgaaaccaygtctctactaaaaatacaaaaattagctgggcatggtggcaggtgcctgtattcccagctactcgggaggctgaggcagaagaatcgcttgaacccaggaggcagaggttgcagtgagctgagatggtgccacggcactccagcctgggcaaagatttcacctcagttttctaaaagttaacatgtatctttgcagactagggaggccatctggggctgacctgatggtgaataataaactaaacaaagtaatattactgtgaggaaagaaatagctaattagaaaatgctctagcatga

SEQ ID NO: 57761 - DNA, 601 bp, Human
ctgagagcagggaagaaaaaaacggcttaagaatagggatagtgtatcaggagtaagcccaaaatattactgcatttacacttagatgatcatttaattctccagttattctaggtttcatcatttccaaggctcagaatagttcagcagtgtgttagggatacacagcttgtaagcaacggtgctgggttcaggtccagatttctatgatgccagagcctaagcatatacaaattccattctgcctcctgatacagggttaggtggaaggctagagggtagacagctgggattttatttyggctttcctgactggatggatgctttgtgacctcaggtgagccacttcacctctctgtactacagctttcacagcagatatgccacccatcagattgattacaacaccccctgtcctccatccaccacttaggatagctgtgaagttgatgacataatagttggaagggaacttttccaaaataaaagccctctgcagatttttgcagataaaagtcctcctcagatttacggccaagacatttgcgatgctgtcttgactgtaaatggaccagatcctagacatttggattcttgcccc

SEQ ID NO: 57762 - DNA, 601 bp, Human
ttattctaggtttcatcatttccaaggctcagaatagttcagcagtgtgttagggatacacagcttgtaagcaacggtgctgggttcaggtccagatttctatgatgccagagcctaagcatatacaaattccattctgcctcctgatacagggttaggtggaaggctagagggtagacagctgggattttatttcggctttcctgactggatggatgctttgtgacctcaggtgagccacttcacctctctgtactacagctttcacagcagatatgccacccatcagattgattacaayaccccctgtcctccatccaccacttaggatagctgtgaagttgatgacataatagttggaagggaacttttccaaaataaaagccctctgcagatttttgcagataaaagtcctcctcagatttacggccaagacatttgcgatgctgtcttgactgtaaatggaccagatcctagacatttggattcttgcccctgggattctttgaacattatgtgatcttgagcaagtctcacaccctttctgaaactcagattcaccatttagaaggggatgggctccatcagctcttctgttgtg

SEQ ID NO: 57763 - DNA, 601 bp, Human
gtttgttttgagacggagttttgctctgatgcccaggctggagtgcagtggcacagtctctgcaggttcaagcgactctcctgactgagcctcttgagtagccaggattacaagtgcctgccaccacacccggctaatttttgtatttttagttgagacaaggtttcaccatgttggccaggctggtctcgaactcctgacctcaggtcatcctctcacttcggcctcccaaagtgttgggattacaggtgtgaaccaccgcacgtggccaaaaataatgaacaagcatttaagggaatawatgtttcctctaagttttgatatgctaacattctggcttttgctacttccttgagggcctgcagttgaggttttagtttcttttctaacatgctttaatttaggcattttttttaacccctagaattagatttttgtttaaatttttaatattaatgttaagttactgttttagtgctttcaagttagagaatatggcctgtgcacttttctttttccctcctgttttctttcctttctttcagcatagcttagtatttgttcaatgttgttaaaagttctgtggacttgcaagaaaaag

SEQ ID NO: 57764 - DNA, 601 bp, Human
acggagttttgctctgatgcccaggctggagtgcagtggcacagtctctgcaggttcaagcgactctcctgactgagcctcttgagtagccaggattacaagtgcctgccaccacacccggctaatttttgtatttttagttgagacaaggtttcaccatgttggccaggctggtctcgaactcctgacctcaggtcatcctctcacttcggcctcccaaagtgttgggattacaggtgtgaaccaccgcacgtggccaaaaataatgaacaagcatttaagggaataaatgtttcctctragttttgatatgctaacattctggcttttgctacttccttgagggcctgcagttgaggttttagtttcttttctaacatgctttaatttaggcattttttttaacccctagaattagatttttgtttaaatttttaatattaatgttaagttactgttttagtgctttcaagttagagaatatggcctgtgcacttttctttttccctcctgttttctttcctttctttcagcatagcttagtatttgttcaatgttgttaaaagttctgtggacttgcaagaaaaagattatattagct

SEQ ID NO: 57765 - DNA, 601 bp, Human
ttataaggtccagatcttttttttctgaggcggtgtttcactcttgttgcccaggctggagtgcaatgccgcgatcttggctcaccatagcctccgccttccgggttcaagctattctcctgcctcagcctcctgaatagctgggattacaggcatgtgccaccacgctcagctaattttgtatttttagtagagatggggtttctccatgttggtcaggctggtcatgaactcccgacctcaggtgatccgcccgcctcggcctcccaaagtgctgggattacagatgtgagacaccacscccagctaaggtccagatcttttataccttcatattgtccttttgtttgcttgagctaaatgtgtagtgtttattaagtttcttcaggcaaaatgattcacaaacattctttttatttctaggggtttttgccttatctgtatatggcaatattattaaccacataactctacaagtcttattatattgacatgaagttatctttgttgcagctaatgcgttttctctataattttactttgttgctggcattcattcattcattcattgaatatacacagtgagcacctgctgtgctga

SEQ ID NO: 57766 - DNA, 601 bp, Human
acattctttttatttctaggggtttttgccttatctgtatatggcaatattattaaccacataactctacaagtcttattatattgacatgaagttatctttgttgcagctaatgcgttttctctataattttactttgttgctggcattcattcattcattcattgaatatacacagtgagcacctgctgtgctgaagagacactaatgagcaaaacagacaagaatccgtggcctcatggagttttctttttagttgaagaaaaataaacaacaattgtaaatgaacaaaaataagtartaaaacatggcatgtttgaggctgataagtgtcatagagaaaagtaaacaagaaatggggacaaggaatcttggggagtggagatgttcagattttatagggaactcaggaaagaactcactgaaaaggtaacatagagcaaagatctaaagcaggtgaggagggagctgtgtggatatctagggagaggttgtcttaggcagagaggacggcaagctcaaaggccctggggcaggagtgcacccggcaagttggaagagcagtaaggagactcctgtagctggagctggatccatgagg

SEQ ID NO: 57767 - DNA, 601 bp, Human
ttctttttatttctaggggtttttgccttatctgtatatggcaatattattaaccacataactctacaagtcttattatattgacatgaagttatctttgttgcagctaatgcgttttctctataattttactttgttgctggcattcattcattcattcattgaatatacacagtgagcacctgctgtgctgaagagacactaatgagcaaaacagacaagaatccgtggcctcatggagttttctttttagttgaagaaaaataaacaacaattgtaaatgaacaaaaataagtagtamaacatggcatgtttgaggctgataagtgtcatagagaaaagtaaacaagaaatggggacaaggaatcttggggagtggagatgttcagattttatagggaactcaggaaagaactcactgaaaaggtaacatagagcaaagatctaaagcaggtgaggagggagctgtgtggatatctagggagaggttgtcttaggcagagaggacggcaagctcaaaggccctggggcaggagtgcacccggcaagttggaagagcagtaaggagactcctgtagctggagctggatccatgagggga

SEQ ID NO: 57768 - DNA, 601 bp, Human
ctaatgagcaaaacagacaagaatccgtggcctcatggagttttctttttagttgaagaaaaataaacaacaattgtaaatgaacaaaaataagtagtaaaacatggcatgtttgaggctgataagtgtcatagagaaaagtaaacaagaaatggggacaaggaatcttggggagtggagatgttcagattttatagggaactcaggaaagaactcactgaaaaggtaacatagagcaaagatctaaagcaggtgaggagggagctgtgtggatatctagggagaggttgtcttaggcagmgaggacggcaagctcaaaggccctggggcaggagtgcacccggcaagttggaagagcagtaaggagactcctgtagctggagctggatccatgaggggagagtggaggaggattaggtcttggaggatatggggagagggttggcggatcctgtcggccttgtcaggactttgtcttctactctgaagaacacggggagccaaggaattaatgagattgaactgacctttgcatatgtcctctagttgtggtgtggtcgatcccttttccctagtaggtcctttcccattcttttatgtc

SEQ ID NO: 57769 - DNA, 601 bp, Human
gagagtggaggaggattaggtcttggaggatatggggagagggttggcggatcctgtcggccttgtcaggactttgtcttctactctgaagaacacggggagccaaggaattaatgagattgaactgacctttgcatatgtcctctagttgtggtgtggtcgatcccttttccctagtaggtcctttcccattcttttatgtctaatctttctaagtcctttggtcttgtgtaacaagcggcacgttgttggatttttttttttttttatttttgagacagagtctcactctatcgcccakgctggagtgcagtggcacgatctcagctcactgcaacctctgcctcctggattcaagtgatttttctgcctcagcctcccgagtagcagggattacaggcatgggccaccacacccatctaatttttgtgtttttagtagaggtgggccttcaccatgttggccaggctggtctcgaactcctgacctcatgatctgcccaccttggcctcccaaagtggtgctggggttacaggcgtgagccaccaagcctggcctttttttcttttttttttaaaattttactttaagctctgggata

SEQ ID NO: 57770 - DNA, 601 bp, Human
agacagagtctcactctatcgcccaggctggagtgcagtggcacgatctcagctcactgcaacctctgcctcctggattcaagtgatttttctgcctcagcctcccgagtagcagggattacaggcatgggccaccacacccatctaatttttgtgtttttagtagaggtgggccttcaccatgttggccaggctggtctcgaactcctgacctcatgatctgcccaccttggcctcccaaagtggtgctggggttacaggcgtgagccaccaagcctggcctttttttcttttttttttwaaattttactttaagctctgggatacatgaacagaaagtgcaggtttgttacataggtatacatatgccaggtggtttgctgcacctatcaacctgtcatctagatttcaagccccgcatgcattaggtatttgtcttaatgctctccctccccttgcccctcaccccctaacaggccccggtgtgtaatgttcccttccttgtgtccatgtgttctcattgttcaacttatgagtgagaacatgcagtgtttggttttctgtttctgtgttagtttgctgagaatgatggtttccagct

SEQ ID NO: 57771 - DNA, 601 bp, Human
tacaggcatgggccaccacacccatctaatttttgtgtttttagtagaggtgggccttcaccatgttggccaggctggtctcgaactcctgacctcatgatctgcccaccttggcctcccaaagtggtgctggggttacaggcgtgagccaccaagcctggcctttttttcttttttttttaaaattttactttaagctctgggatacatgaacagaaagtgcaggtttgttacataggtatacatatgccaggtggtttgctgcacctatcaacctgtcatctagatttcaagccccgcrtgcattaggtatttgtcttaatgctctccctccccttgcccctcaccccctaacaggccccggtgtgtaatgttcccttccttgtgtccatgtgttctcattgttcaacttatgagtgagaacatgcagtgtttggttttctgtttctgtgttagtttgctgagaatgatggtttccagctttatccatgtccctgcaaaggacatgaactcatccttttttatggctgcatagtattccatggtgtatatatgccacattttctttatccagtctatcattgatgggcatttgggttgg

SEQ ID NO: 57772 - DNA, 601 bp, Human
cacattttctttatccagtctatcattgatgggcatttgggttggttccaagtctttgctattgtagctagtgctgcaataaacatacatgtgcatgtgtctttatagtaggatgatttataattctgaatctgaagatcttttttccacaggaaaatgttttaatgtttatagctataattgccatgtttcttatggtgtttctaaagttttctttttctttcctatttcattctttttttttcatctccttctaaacagataactattatcttaaatcagtgttatattactttttttwaaaaaaactttctgttattattaataatcacattttggtcttattacaaaaaaaaacaaaaaacaaaaaacaaaaaaactaatgctttggaatcagacttcccgggttagaatttctactgtaccacttcctagctgtgtacccttggcaagttacttcgcctctctgtgctgtgtttcctcatttggagataatagtcgtaattatgtcacaggattgttgcagtatcaaattagttaatataagtgaggtgcccaatgtctgctaaatagcactcagtaagtgttagtcattattgtt

SEQ ID NO: 57773 - DNA, 601 bp, Human
caaatatgaattaggtagtttctagaatgttctctcttttggcagcagttgtatttcatgggagttactttgattctgcattgtttctttctatttaaatgactaaatttttcacacatcctattgtgcttatttgcctatccttatagaagggtgagcacagacatttctgtgtccttgttctaacatttcatatctggataaagggagacaggagtcttttgtattttttggaattctgttttgtcagatcaggagtcctgttcctgacatttgggcggggctacagtggagacaggtscataacaggcacccctcaagccagatggagagcccatcttcctcacgttggttctgtgcatctcaaagtcagaaggggtcctgctcctctctgagggggcacacgtgtcctatttggaggcagtagtggcagcgtccttcactcactctgtggcgtactggccaccgtgaacacacgctgtggcaccatgcccctgcccgctgcgccaggcactgacatgtctcctcttgcatatgaatgggaatcggcaaccctcacccggtcattgatggtctcagccggggtcattattgggctctg

SEQ ID NO: 57774 - DNA, 601 bp, Human
tgagagcgaggagttttggggtcttttttctttcccactgattcaaatgcttttagaatgtcccttttctttcctcacactcatctcatcctcttactagatgaaaaaatctttgtggtcaagaaacaaactgaagcccccatgtttattattatattagtagtagctgggcatggtgggatgtgcctataatctcagctacttgggatgctgaggcaggaggattgcttgagcccaggagttcaagactggcctgagcaacatagcaagaccctatctctgccagaaaagaaaaaaaagaaaaaaaaaacagccaggtgtggtgggatgtgcttttagtctcagctagttgaaagctgaggccggaggattgtttgagcccaggaggtcaaagctgcagtgagctatgattgtgctgctgcactccagccttggtgacagaacaaggccctgtctctaaaataataataatgacattagtcacagtaataataatcatgatgatgccactaattgaatacttgctgaatgccaagtgctgtgcttatcattttacatgcgtcattacatttcaatttcacaagaattctatgaaaaagga

SEQ ID NO: 57775 - DNA, 601 bp, Human
taaggttatgagatgagatttgcacccagacatggtttgactccagggcttgtgcgcttaaccactaagggatgccgtttctcaaaaaggctgactacagcacattttgggaaaacttttgcagagaaaatagcatcatgaagtcaagtccatggtcacctaaatgcagttgagtgccaggatggcaaagtggcaccctatgcaccctatgtagggtgaaaggtagaaatgctggaagagcatgacaagagtgtatttacagtcaggcagtgggggttgcaatttgggaggatagggtgaraagatcacttgaggtcaggaattcaagactagtctgagaaacatagccaactcccatctctacaaaaaaatttttttttgtttaattagctgggcatggtggcacatgcctatagtccccagctactcaggaagctgaggcaggaggatcgcttgaacccaggagctcgaggcttcagtgagctgtgattgcactattgcactccagcctgggtgacagagtgagaccctatctctaaaagcaacaacaacaataacaacaacaacaagaaatttacgatgagggatcttcatagcattc

SEQ ID NO: 57776 - DNA, 601 bp, Human
atgccgtttctcaaaaaggctgactacagcacattttgggaaaacttttgcagagaaaatagcatcatgaagtcaagtccatggtcacctaaatgcagttgagtgccaggatggcaaagtggcaccctatgcaccctatgtagggtgaaaggtagaaatgctggaagagcatgacaagagtgtatttacagtcaggcagtgggggttgcaatttgggaggatagggtgaaaagatcacttgaggtcaggaattcaagactagtctgagaaacatagccaactcccatctctacaaaaaaawttttttttgtttaattagctgggcatggtggcacatgcctatagtccccagctactcaggaagctgaggcaggaggatcgcttgaacccaggagctcgaggcttcagtgagctgtgattgcactattgcactccagcctgggtgacagagtgagaccctatctctaaaagcaacaacaacaataacaacaacaacaagaaatttacgatgagggatcttcatagcattctttcagaataagaaactacttaatggacaaaaagtaggtaaaaatatacagtaatttaacgatataactaa

SEQ ID NO: 57777 - DNA, 601 bp, Human
tgccgtttctcaaaaaggctgactacagcacattttgggaaaacttttgcagagaaaatagcatcatgaagtcaagtccatggtcacctaaatgcagttgagtgccaggatggcaaagtggcaccctatgcaccctatgtagggtgaaaggtagaaatgctggaagagcatgacaagagtgtatttacagtcaggcagtgggggttgcaatttgggaggatagggtgaaaagatcacttgaggtcaggaattcaagactagtctgagaaacatagccaactcccatctctacaaaaaaatwtttttttgtttaattagctgggcatggtggcacatgcctatagtccccagctactcaggaagctgaggcaggaggatcgcttgaacccaggagctcgaggcttcagtgagctgtgattgcactattgcactccagcctgggtgacagagtgagaccctatctctaaaagcaacaacaacaataacaacaacaacaagaaatttacgatgagggatcttcatagcattctttcagaataagaaactacttaatggacaaaaagtaggtaaaaatatacagtaatttaacgatataactaag

SEQ ID NO: 57778 - DNA, 601 bp, Human
aacaacaagaaatttacgatgagggatcttcatagcattctttcagaataagaaactacttaatggacaaaaagtaggtaaaaatatacagtaatttaacgatataactaagaaaactgtgtaagtgtgtatagagagagagtgagaactttgcctcctatgtacatgtgatatacattttttttctgctgtccatggaagagttacaaaaatacatagtgtacctggtagtgtaccatgcacactacccccacccaacatactgaaaaacaaaccaaaacaaaccaaaaaaccctcaacrtatattttttcaagtagagctttatataggcctccttttcatatgctgatcaataaaataataccgagtcgagtcatgaaatgtgtcccacccccttgtctcccttcaggtttaagttactgagccaggaggaaggcgagtacttcaatgtgcctgtgccaccagaaggaagtgaggccaatgaagaactgcggcagaaatttgaggtgaggtttcttttctttttctcttctttcttttttctctttcttttttccttctttcctcctgctccctcctctttctttctctttctctctt

SEQ ID NO: 57779 - DNA, 601 bp, Human
ctcctgctccctcctctttctttctctttctctcttattcttttttctctccttccttacttccttcttcctctctcttttctttccttctttctcctttctttctttcttgcttacttgcttgctttctcgctttcttcctttctctcttgctttctcttgcttgctttctcgctttcttcctttctgtcttgctttctttcttgcttgctttctttaccccccttttctttgttttttccttccttccttcctgccttccttcctctctctttctctttccctctcattctttcttttytttctctctctgtccttcctttgtttctttctctctccttccttcttcctttcttccttccttcctttcctcccttccttctttccctccttcctccctccctcccccctttcctttctttcttcctccttcctctctcttttcattctttctcccctttctctctctcttcctctctcttgtctctctcttctttcttcatctcctttctttcatcagtgggaaccagttaggtttgctgctgtgctgattttcctgtttatggcatggtttctactaagacttttcatgactctgagc

SEQ ID NO: 57780 - DNA, 601 bp, Human
cctgaaataaatccctttccttctacggggacaaataaacaccattttcagctacctaagagcagcaggtgtataggacacatccttgctttacaaagaaaatgtttgggggaagataggtttgaatacttacattatatgtgcattgagtgattttagtagtttcctgaggaaaagcacattattttgttcccacaaactcaatacactgagtctggtgggagatgatcaattctagataaaccatgatggcctactaactccccaaaaatgtatataatagcatagctaaaatgaaatkaatttttattattgttattcatcaaataatgacacacacaaataaaaaaaaaacgtgtaaagaccatgtaaagtcctgggaaagagaggtcaggtaccttgagaacatgtacaagagaaatgtcacgtagtttgagagaatggggaggtgtcaggaaggaaacagcaatggaagtttaccatgtaaaaagaggggaaaatgtattctgttctgcaaacagcatgtgcaaaggccctgtggttgggggttatatagcaacgatgtgagactgaaagaagaccagcctgggtagagcagaga

SEQ ID NO: 57781 - DNA, 601 bp, Human
ccaacttgctgatgaagtggtatcatttgctgctgttatagaaatgtactattacgggtgaaaaacacaaggccagtattttcttgtatataaccaagtctcagttttgcaaaatgatttttttctgtcctggggcagctggggtgacatttcagaacaccaaggaaaagatttgctacacaaacagagcatttgtctgggccagtaattggcttggaataggagactgttttatccgcatgcaagaaattgtgtccctttctttctagcaagagcctgcaaatgcttgtttatgcctgamttataatcgctgcatactgtagttgttgattaaaaaaaatgtttccaacagaccgaaaattgttctcaggctcacagaggaatttcagttgaccttgaacatgagaaatgtaatccctgggcgataaccaattagcacccggaatgactcagaaattactttcaagcctcttatctggaggaattctgagtgacagtaaaatcgagctgctagaattggggtaatagaatttcatggtagtgtgagcttggcgcagttaccacacgtggtatacttcagaacatcagagctggctgtttg

SEQ ID NO: 57782 - DNA, 601 bp, Human
tcatttgctgctgttatagaaatgtactattacgggtgaaaaacacaaggccagtattttcttgtatataaccaagtctcagttttgcaaaatgatttttttctgtcctggggcagctggggtgacatttcagaacaccaaggaaaagatttgctacacaaacagagcatttgtctgggccagtaattggcttggaataggagactgttttatccgcatgcaagaaattgtgtccctttctttctagcaagagcctgcaaatgcttgtttatgcctgacttataatcgctgcatactgtasttgttgattaaaaaaaatgtttccaacagaccgaaaattgttctcaggctcacagaggaatttcagttgaccttgaacatgagaaatgtaatccctgggcgataaccaattagcacccggaatgactcagaaattactttcaagcctcttatctggaggaattctgagtgacagtaaaatcgagctgctagaattggggtaatagaatttcatggtagtgtgagcttggcgcagttaccacacgtggtatacttcagaacatcagagctggctgtttgcttagggggctttcagtcgacc

SEQ ID NO: 57783 - DNA, 601 bp, Human
ctgttatagaaatgtactattacgggtgaaaaacacaaggccagtattttcttgtatataaccaagtctcagttttgcaaaatgatttttttctgtcctggggcagctggggtgacatttcagaacaccaaggaaaagatttgctacacaaacagagcatttgtctgggccagtaattggcttggaataggagactgttttatccgcatgcaagaaattgtgtccctttctttctagcaagagcctgcaaatgcttgtttatgcctgacttataatcgctgcatactgtagttgttgattwaaaaaaatgtttccaacagaccgaaaattgttctcaggctcacagaggaatttcagttgaccttgaacatgagaaatgtaatccctgggcgataaccaattagcacccggaatgactcagaaattactttcaagcctcttatctggaggaattctgagtgacagtaaaatcgagctgctagaattggggtaatagaatttcatggtagtgtgagcttggcgcagttaccacacgtggtatacttcagaacatcagagctggctgtttgcttagggggctttcagtcgaccgtgggctttg

SEQ ID NO: 57784 - DNA, 601 bp, Human
gtttgcttagggggctttcagtcgaccgtgggctttggaaaagaagactccattttggatggcgcacagtgggatttctcagagtcttaaaatttatttgtataacaaagtgcttactgtgtgccatttatgattctaagtgctttgcaaatattaactcaggtaatttaatccttacaacaacctagaatggtaggtactattatcacgctattttacttttacaaatgaagaaactgaagcccacagaggtttaagtaactttataaggtcccagagccagtcattgtcctgggtttgrgttttcccagaaacagactataaggattcaagtgcaagtactttatttgagaggtgatcctggaagcaccataagttaataaggaagcattgccagaaaaggtgggaaaccaggaaagtaagtattatcaagcagactactgctgtgggcagctagggtttaaccctgctggagaactctcaagtcagcgcggaatgcatgcctcagaatttcccaatcaagggacaggaagctgaggggttatccgtcggctccccttccgttgcaggctaagggctgctcccagggaaatccactcac

SEQ ID NO: 57785 - DNA, 601 bp, Human
atggtaggtactattatcacgctattttacttttacaaatgaagaaactgaagcccacagaggtttaagtaactttataaggtcccagagccagtcattgtcctgggtttgggttttcccagaaacagactataaggattcaagtgcaagtactttatttgagaggtgatcctggaagcaccataagttaataaggaagcattgccagaaaaggtgggaaaccaggaaagtaagtattatcaagcagactactgctgtgggcagctagggtttaaccctgctggagaactctcaagtcagygcggaatgcatgcctcagaatttcccaatcaagggacaggaagctgaggggttatccgtcggctccccttccgttgcaggctaagggctgctcccagggaaatccactcacccgcactttcaatgtgccctgtgcgctgtgcccgctcctataaccagaaaataagctacaggcaaagaatcacaggtgtttgctgttagcagccctaggtgtagagagcagcatgctggtggtgtcttggaggaacaccagcgattgtacctgtgcaatgtagcctaatggttaagtgtgattgcttga

SEQ ID NO: 57786 - DNA, 601 bp, Human
aggtttaagtaactttataaggtcccagagccagtcattgtcctgggtttgggttttcccagaaacagactataaggattcaagtgcaagtactttatttgagaggtgatcctggaagcaccataagttaataaggaagcattgccagaaaaggtgggaaaccaggaaagtaagtattatcaagcagactactgctgtgggcagctagggtttaaccctgctggagaactctcaagtcagcgcggaatgcatgcctcagaatttcccaatcaagggacaggaagctgaggggttatccgtyggctccccttccgttgcaggctaagggctgctcccagggaaatccactcacccgcactttcaatgtgccctgtgcgctgtgcccgctcctataaccagaaaataagctacaggcaaagaatcacaggtgtttgctgttagcagccctaggtgtagagagcagcatgctggtggtgtcttggaggaacaccagcgattgtacctgtgcaatgtagcctaatggttaagtgtgattgcttgagagccagactgcctagatttgaatcccagttctgccacctccttgctgagtggctgtaag

SEQ ID NO: 57787 - DNA, 601 bp, Human
caggcattcatcatcgggagtggagcccagagtctggctgccagggcttctccactgtcccctcgtgctgtctggaaggtggcttggctctttgctcagaaatgctatttgctttctctcttagcattgagttctagggctctaaatcgcagacatgaaaaggcaaccattagtgtattcctgtttctgaaagcacatcccacacagcaagataaaggacgagtttaatttgtgcctcaattttaaaatgttcgctctttgatgcagtgtgtgctaggcattgtccccttggaacaatggratatttcaaaggacaaaggacagggctcctgtcctctgaaggctcactgagtaggggccacaaacccaggtgttttcaggagccaggcaaacaacaagaaggcgaaagagcttggcatcacccagtgttagcagatccccttcttcaaaagaagctggggatctgggttttcatatctccaaattttcaacagttggcaactaattaaatattaaaatgacaacaaactctgtgcagaccagaccaacagggttatcagacttcttttttttttttccagggttattagacttctgatct

SEQ ID NO: 57788 - DNA, 601 bp, Human
tattagacttctgatctagattctagaagttaaattaacatgcccatgagaaaagttataaaagcaagctgggagggagggaggaaagaggggtgccagccccagattcagaggagagaagggagtttctagtgctgagggatgaggctgttagctgctccttgaaggacaaggaaaaaatcaacccctcttcccacccccccaaaaaagtccttatctgtccactacgcaaagtcaaatgaagaaatcaggaagtttgaggtccgtgctcacgtttcatggggagtgtgtgctgggaccygcaggtggatgggaaagttcccaggatgggaaatgggaactggggcaggcaggacttggatcttcacagtctggagaatggagactgtgaatcagatgggtcctgagccaggattcaaagaaggcaggacacatggtgctaaggtgatggggtggtggagcagggaggggagtagggaaagtgtttgggtcaggccagcttgggggtgatgatttaggagggtgtgaggacatagcccgagaaaggtgagacggcttctgtcctaccctggctcttttgtttgcagtttccattgcaaat

SEQ ID NO: 57789 - DNA, 601 bp, Human
tgtcctaccctggctcttttgtttgcagtttccattgcaaataagatgaccttgtagttttaactaccccctcgttgcctctacaccccaaatctctgtctccagtccagatatctttgctcaagccccaaacccatgtatacaactgcttactgggtatttacacttgggttaaacctcaacatatcttactgcaaagtaaactgaccaagtatattcacagcagcgttgttagtaggccgaaaggggaaacaactcaaatgcctgtacacaggagacgggataaacatcaacaatgagkgccattcagcaatacaaagagacaaattaccgatttatgcaaaaacatggatgcatttcaagaacattttgatgagtgaaagaagccaggcacaagagtacacactctacaatgctgttcagatgaaattcaagaacagacaaaactgacctatgggatagaaactggaacagagattgccttagtggcgggggttgcggggggcgtcgactgggaacttttggagggtgatggaaatgttccgcgtcttgtttggggtttgggttacatgggtgtgcacatttgtcaaaatctacagaa

SEQ ID NO: 57790 - DNA, 601 bp, Human
cacgtgagattggtgcactttgcggtgcccacctcaagtttcaaaacatgaataaagagaaaatggcggatgctttgttagccatggttcctatatggtaacagtggaatatgcaccccatgagggagaaataaaccttgaagttttaagctgctgtggggaagaggggatctcaacatgcctgaaatcacaccggtcatctctgcccaccctcttccccacacttccaaacttgctcctcctccgcttcttctcatctcagtggaaacaaccagcatcctgccagttggtcagaacagargctggggagctgtccttcatctccaatctcccttctcccttgcccaatctgctacccatctggggtcagtctgtctcccaaatagatccactttgttcagtctacactgcagacaactgagtccatcatttttttttcttttaagacagggtctccctttatcactcaggctggagtgcagtggtgcaatcatggctcactgcaacctccaactcctgggctcaggggatcctcccacctcagcctcccgcgtagctgggactacaggcacacaccaccatgcctggctcatcatttctc

SEQ ID NO: 57791 - DNA, 601 bp, Human
aataaaccttgaagttttaagctgctgtggggaagaggggatctcaacatgcctgaaatcacaccggtcatctctgcccaccctcttccccacacttccaaacttgctcctcctccgcttcttctcatctcagtggaaacaaccagcatcctgccagttggtcagaacagaagctggggagctgtccttcatctccaatctcccttctcccttgcccaatctgctacccatctggggtcagtctgtctcccaaatagatccactttgttcagtctacactgcagacaactgagtccatcatttttttttcttttaagacagggtctccctttatcactcaggctggagtgcagtggtgcaatcatggctcactgcaacctccaactcctgggctcaggggatcctcccacctcagcctcccgcgtagctgggactacaggcacacaccaccatgcctggctcatcatttctctccttgataatgcagtgacttcctagtgatcactcagcccacgtgctggggggtctcctctccactcagagtgacctgttaaatatgtatggtcataccatagccctgcttcaaacctttcaaaggctg

SEQ ID NO: 57792 - DNA, 601 bp, Human
ccacgtgctggggggtctcctctccactcagagtgacctgttaaatatgtatggtcataccatagccctgcttcaaacctttcaaaggctgtctgtcatgctcatagtcagcctgaatttcttaaggtcctttcaacactttgtctgcctcctgtgccatatctgccttgcatttcatgatccagccagacgatgtttcattccttgaatgtgtcttcccctctgttccataaatgctgttcctgctgccaataccagtttatctacttcagcaaccccaacataccttttggacacagtrtggaggacccaatcccagctagaatgcacgttttttcagagtatctgtatccattttgccctctgatgtatcctcagcacctagaggagcacttagcatgtagcaggtactcaacaagaatttttgatttgtttgttggtttgtttatgacagagtcttgctctgttgcccagactggagtgcaatacagtgatcagagcttactgcagcttccaactcctgggcttaagggattctcctgccttaaacctcccaagtagctgggactacaggcccactgccaccatgtccagctaatta

SEQ ID NO: 57793 - DNA, 601 bp, Human
ccaataccagtttatctacttcagcaaccccaacataccttttggacacagtatggaggacccaatcccagctagaatgcacgttttttcagagtatctgtatccattttgccctctgatgtatcctcagcacctagaggagcacttagcatgtagcaggtactcaacaagaatttttgatttgtttgttggtttgtttatgacagagtcttgctctgttgcccagactggagtgcaatacagtgatcagagcttactgcagcttccaactcctgggcttaagggattctcctgccttaarcctcccaagtagctgggactacaggcccactgccaccatgtccagctaattaaactttttttttgagatagggtctggctgtgttgcccaggctggtcttgaactcctggcctcaagcagtcctgcctcagccttccaaagctttgtgattacaggcatcagccaccacatccagcctcaataaatgttttttgaatgaatgaatgaatcttccctgatattcaaaactttggaaagatttattttgcctctttatcttcaaagcaaccaaataatgcaacaataataatagctaccatt

SEQ ID NO: 57794 - DNA, 601 bp, Human
gggaagggccctcttatcagaggtgagagagttctggggaaagagtgctctgagcagagggaacagcaggtgcaaaggccctggggtaagagcatgtttggtgcattcagagagcagcaaggaggccagtgcggaagtagaaaggaggctgaaatcagaggggctcagtcatctgtggcctttggcttttactttgagaataatgggatggtatatatattgggcagaggaatgttatgacttaactgatgtattctgggccacacagctgattcatgtcagaggattctaccacgaggctttttttttttttttttttagtgagagagagatgggatctcactctgtcacccaggctggtgggcagtggtgtgattatagctcacagcagcctctaactcctgggctaaagcagtcctcccaccttggcctcccaggtagctgggatgacaggtgcacaccaccttgcctggctaactttctttatttttgtagagacagggtcttgttatgttgcccaggctgttctcaaacttctatcctcaatcgaatctcctgtctcagcatcaaaaagtgttggaattgcaggtgtgagccactg

SEQ ID NO: 57795 - DNA, 601 bp, Human
ggctttttttttttttttttttagtgagagagagatgggatctcactctgtcacccaggctggtgggcagtggtgtgattatagctcacagcagcctctaactcctgggctaaagcagtcctcccaccttggcctcccaggtagctgggatgacaggtgcacaccaccttgcctggctaactttctttatttttgtagagacagggtcttgttatgttgcccaggctgttctcaaacttctatcctcaatcgaatctcctgtctcagcatcaaaaagtgttggaattgcaggtgtgagccactgtgcccagccacacatgagcttttaactccacagttttctctctgctaaacgtgaatccagtaacgaagtcctggcagctgcaggtctcccactcatggcttccagtttttgcctcattccaaagcacctgctgccactctgagccccattccacagctcatggcaaggagtccctctcccattgcactgaggacacacgtggccctcactcatccatttatgcaacaaatatttagttgggaactatactagttgtcaggaaaaccatggagaatgagaaatattccgtgtccacaa

SEQ ID NO: 57796 - DNA, 601 bp, Human
agggtcttgttatgttgcccaggctgttctcaaacttctatcctcaatcgaatctcctgtctcagcatcaaaaagtgttggaattgcaggtgtgagccactgtgcccagccacacatgagcttttaactccacagttttctctctgctaaacgtgaatccagtaacgaagtcctggcagctgcaggtctcccactcatggcttccagtttttgcctcattccaaagcacctgctgccactctgagccccattccacagctcatggcaaggagtccctctcccattgcactgaggacacacrtggccctcactcatccatttatgcaacaaatatttagttgggaactatactagttgtcaggaaaaccatggagaatgagaaatattccgtgtccacaacagtctccaatttattggaaggaaacaagtgaacaggcagttatcctccagtatttatgggaagagaagtggatgaaggaagaaaatcagaggagaacctagtgcagacagagagaatcgatgagggcttccctgagccatgaaaatgtgaaccccaagctgggttgctgaaggggagagaatagccatttgtaccacagta

SEQ ID NO: 57797 - DNA, 601 bp, Human
atctcctgtctcagcatcaaaaagtgttggaattgcaggtgtgagccactgtgcccagccacacatgagcttttaactccacagttttctctctgctaaacgtgaatccagtaacgaagtcctggcagctgcaggtctcccactcatggcttccagtttttgcctcattccaaagcacctgctgccactctgagccccattccacagctcatggcaaggagtccctctcccattgcactgaggacacacgtggccctcactcatccatttatgcaacaaatatttagttgggaactatacyagttgtcaggaaaaccatggagaatgagaaatattccgtgtccacaacagtctccaatttattggaaggaaacaagtgaacaggcagttatcctccagtatttatgggaagagaagtggatgaaggaagaaaatcagaggagaacctagtgcagacagagagaatcgatgagggcttccctgagccatgaaaatgtgaaccccaagctgggttgctgaaggggagagaatagccatttgtaccacagtagcagcagcaggtgcaaaggccctgtggttggaggggcctgggacatccagg

SEQ ID NO: 57798 - DNA, 601 bp, Human
cacatgagcttttaactccacagttttctctctgctaaacgtgaatccagtaacgaagtcctggcagctgcaggtctcccactcatggcttccagtttttgcctcattccaaagcacctgctgccactctgagccccattccacagctcatggcaaggagtccctctcccattgcactgaggacacacgtggccctcactcatccatttatgcaacaaatatttagttgggaactatactagttgtcaggaaaaccatggagaatgagaaatattccgtgtccacaacagtctccaatttwttggaaggaaacaagtgaacaggcagttatcctccagtatttatgggaagagaagtggatgaaggaagaaaatcagaggagaacctagtgcagacagagagaatcgatgagggcttccctgagccatgaaaatgtgaaccccaagctgggttgctgaaggggagagaatagccatttgtaccacagtagcagcagcaggtgcaaaggccctgtggttggaggggcctgggacatccaggggagtgaaaggagaatgaagctacattgcagagaagaagcaccctagcaatgatggagctg

SEQ ID NO: 57799 - DNA, 601 bp, Human
tcatggcaaggagtccctctcccattgcactgaggacacacgtggccctcactcatccatttatgcaacaaatatttagttgggaactatactagttgtcaggaaaaccatggagaatgagaaatattccgtgtccacaacagtctccaatttattggaaggaaacaagtgaacaggcagttatcctccagtatttatgggaagagaagtggatgaaggaagaaaatcagaggagaacctagtgcagacagagagaatcgatgagggcttccctgagccatgaaaatgtgaaccccaagcwgggttgctgaaggggagagaatagccatttgtaccacagtagcagcagcaggtgcaaaggccctgtggttggaggggcctgggacatccaggggagtgaaaggagaatgaagctacattgcagagaagaagcaccctagcaatgatggagctggaaagccaggtagggcctaaacacacaagtccatgaaagcacctcgatctttaccctgaaaatgatgggatgccactgagacattttaagcaggaggggacttggttggatgagaggctcactgtggttgtgtgtgaaacccagtgt

SEQ ID NO: 57800 - DNA, 601 bp, Human
ttggaaggaaacaagtgaacaggcagttatcctccagtatttatgggaagagaagtggatgaaggaagaaaatcagaggagaacctagtgcagacagagagaatcgatgagggcttccctgagccatgaaaatgtgaaccccaagctgggttgctgaaggggagagaatagccatttgtaccacagtagcagcagcaggtgcaaaggccctgtggttggaggggcctgggacatccaggggagtgaaaggagaatgaagctacattgcagagaagaagcaccctagcaatgatggagctgsaaagccaggtagggcctaaacacacaagtccatgaaagcacctcgatctttaccctgaaaatgatgggatgccactgagacattttaagcaggaggggacttggttggatgagaggctcactgtggttgtgtgtgaaacccagtgtaagggaaatcactgtgccttgtgcaggtgagagatgatggcaggtagtgatggttgagatggaaagaagtagatgaattctagagacagctgggaggaaagaaatgacagttctggttatggttgagacatgagggataaaagaaagatggagt

SEQ ID NO: 57801 - DNA, 601 bp, Human
gtgtgtgaaacccagtgtaagggaaatcactgtgccttgtgcaggtgagagatgatggcaggtagtgatggttgagatggaaagaagtagatgaattctagagacagctgggaggaaagaaatgacagttctggttatggttgagacatgagggataaaagaaagatggagttgcaaaggatgtccgacaggtttcaggcttgtggagtgatgcatggctatgcttttcatggggacagggtgccggagctgcaggaactacagcttcccattgtgtgcctgtgccttcctacaagatcgycctcaaaccctgagcatgttttctgtgtgcttcctttttgcagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtatggtatgatttggtggctccacctgctttggaaggaacatctaacaacacaggcacatttgctgttcctatgggacggacgtcctagtgggagagagagtaagaagt

SEQ ID NO: 57802 - DNA, 601 bp, Human
aagagctaggaaagaatgttctcagaagagagcaagtgcaaaagttccaaggtggggacaggctgggtgcatcctaggaaccatcagaaggtgttggggcaaaatgtcactagcagaaggaggtataggacgtgatgttgcagagataagcagggcccaaggatgcaaaccttataagctacaatgaggagtttgggtttcactcacagtgcagcggggagccattgaacctttttaagcagattagtgacacgatcggatttgccttttggaaaagatcactctgacagccaagaatggraacggttcctttcaaacagttgcacagtggaaggatgaccctgggactcatacagtgtttctggacgcttttatagatactgcgagatgctgttttactgaagttgagattgtgttataagtatttctgactcatttagtgttgttttggggtttttagtctctttgcgtgccacaaagatgtctagcataaatctcataccatgaactcaggtgtgcaaaaaatataaatttcttttccatctatgtaacgtaagccaaaaacctgggagttatccctgagcttccctctttcctgtat

SEQ ID NO: 57803 - DNA, 601 bp, Human
aacagttgcacagtggaaggatgaccctgggactcatacagtgtttctggacgcttttatagatactgcgagatgctgttttactgaagttgagattgtgttataagtatttctgactcatttagtgttgttttggggtttttagtctctttgcgtgccacaaagatgtctagcataaatctcataccatgaactcaggtgtgcaaaaaatataaatttcttttccatctatgtaacgtaagccaaaaacctgggagttatccctgagcttccctctttcctgtattcccaccgttcctgsccaccgccccccgcagccatgtacgatgcattggcgaattctgacagttccttcaaagtatatcatgtattcactaacttctcttcatctctctaataccacccaaatctaatcattaatatcacctggataactgcagaaactcctcagtggtttctcaatcccaatcttgttacctataattaatcccaatcccaatcttttttacctataattaatcgttacctataattaattgcaatcccaatcttgttacctataattaatcgttacctataattaattgcaatcccaatcttg

SEQ ID NO: 57804 - DNA, 601 bp, Human
cctgggactcatacagtgtttctggacgcttttatagatactgcgagatgctgttttactgaagttgagattgtgttataagtatttctgactcatttagtgttgttttggggtttttagtctctttgcgtgccacaaagatgtctagcataaatctcataccatgaactcaggtgtgcaaaaaatataaatttcttttccatctatgtaacgtaagccaaaaacctgggagttatccctgagcttccctctttcctgtattcccaccgttcctggccaccgccccccgcagccatgtacratgcattggcgaattctgacagttccttcaaagtatatcatgtattcactaacttctcttcatctctctaataccacccaaatctaatcattaatatcacctggataactgcagaaactcctcagtggtttctcaatcccaatcttgttacctataattaatcccaatcccaatcttttttacctataattaatcgttacctataattaattgcaatcccaatcttgttacctataattaatcgttacctataattaattgcaatcccaatcttgttacctataattaatttactttcta

SEQ ID NO: 57805 - DNA, 601 bp, Human
ttggcgaattctgacagttccttcaaagtatatcatgtattcactaacttctcttcatctctctaataccacccaaatctaatcattaatatcacctggataactgcagaaactcctcagtggtttctcaatcccaatcttgttacctataattaatcccaatcccaatcttttttacctataattaatcgttacctataattaattgcaatcccaatcttgttacctataattaatcgttacctataattaattgcaatcccaatcttgttacctataattaatttactttctacttcgyagccgtaataattttttaaagcttacattaggtcaaggggctcccctgcttaagaccctccaatgactttccatccaattagaagcaattctatgttacatccttagcttgtatcaccctttatcatctggcccttgttctctgtgtgacttcctttcttctttctcctccccatcacccactgtgctctggccacaacatcagctcttgggtcactgaaacacacaaagctccttcctcccttagaggctttgtgattcagctccttttgctgtttgcaaggccggctgcttcctgcaa

SEQ ID NO: 57806 - DNA, 601 bp, Human
tctgaagagcttcagcatgggatgggaatagagagtaagggcagccagtaagatggcccatccagtccctaaggttgggaataggcagttggcagtggtccacaacgttgtatggtttttaccagcagctctgagtatccctggggtggagatggagaaggagatggtggatttgaactaagcgtgggattagtagaatcagtgaactagaagattatggaagaaagagagttaaggattctgggaagagagatgtccactgcagatccacagagcctgtaccaagtgctcaagaaaagcrtgttgaatacatgaatgaaaatggtatctagattgggttggggaagatgtctagcataaagagggtcatcacctgggtgggaaaaagggagtttagaagtctaaggatgaaaaaaaaatagatgaggtcaagatacgtaaaatgttaggaagaattgaggcattgagatttcaaacatggagcagtttctctgatgatgaggaagaaagtggcctaaataaagaagaggttctaataagctgagtttttacaaattaaatgagcactttttttttctttttgagatagagtctcactctc

SEQ ID NO: 57807 - DNA, 601 bp, Human
tgctcaagaaaagcatgttgaatacatgaatgaaaatggtatctagattgggttggggaagatgtctagcataaagagggtcatcacctgggtgggaaaaagggagtttagaagtctaaggatgaaaaaaaaatagatgaggtcaagatacgtaaaatgttaggaagaattgaggcattgagatttcaaacatggagcagtttctctgatgatgaggaagaaagtggcctaaataaagaagaggttctaataagctgagtttttacaaattaaatgagcactttttttttctttttgagayagagtctcactctcttgtccaggctggaatgtagtggtgcattacggttcactgcagcctcgacatgctggactcaagcagtccagctcctacccaagttcacatctttctctgacccccaaataactgcatgcaccaccatgcctggctaatttttgtttttgtttttttgaatcagaatcttactctgttgcccaggctggagtgcaatggcgccatctcggctcactgcaacctctacctccagggttcaagtgattctcctgcctcagtctcgcgctcggctaatttttgtagttt

SEQ ID NO: 57808 - DNA, 601 bp, Human
actctgttgcccaggctggagtgcaatggcgccatctcggctcactgcaacctctacctccagggttcaagtgattctcctgcctcagtctcgcgctcggctaatttttgtagtttttaatagagacagggtttcaccatgttgaccaggctggtcttgaactcctgacctcatgtgatccgttcgcctcggcctcctaaagtgctgggattacagacatgagccaccgcacctgacctaatttttgtatttttttgtagagacatggtctcactatgtttcccaggctgctcaagtactyataagctcaagcaatcatcctgccgtggcctcggaaagtgctaggattacaggtgtgagccaccgcacctgtcctaaattttatatatatatgctttcttttttcctttttttttttttttttgagacggtgtttctctcttgttgcccaggctggagtgcaatggcacaatctcagctcaccgcaacctccgcctcccaggttcaagtgattctcctgcctcagccttttcgagtggctggcattacaggcacgcgccaccacgcccagctaattttccacttttagtagagacggggt

SEQ ID NO: 57809 - DNA, 601 bp, Human
atctcggctcactgcaacctctacctccagggttcaagtgattctcctgcctcagtctcgcgctcggctaatttttgtagtttttaatagagacagggtttcaccatgttgaccaggctggtcttgaactcctgacctcatgtgatccgttcgcctcggcctcctaaagtgctgggattacagacatgagccaccgcacctgacctaatttttgtatttttttgtagagacatggtctcactatgtttcccaggctgctcaagtactcataagctcaagcaatcatcctgccgtggcctcrgaaagtgctaggattacaggtgtgagccaccgcacctgtcctaaattttatatatatatgctttcttttttcctttttttttttttttttgagacggtgtttctctcttgttgcccaggctggagtgcaatggcacaatctcagctcaccgcaacctccgcctcccaggttcaagtgattctcctgcctcagccttttcgagtggctggcattacaggcacgcgccaccacgcccagctaattttccacttttagtagagacggggtttctccatgttggtcaggctggtcttgaactcc

SEQ ID NO: 57810 - DNA, 601 bp, Human
gcctcagtctcgcgctcggctaatttttgtagtttttaatagagacagggtttcaccatgttgaccaggctggtcttgaactcctgacctcatgtgatccgttcgcctcggcctcctaaagtgctgggattacagacatgagccaccgcacctgacctaatttttgtatttttttgtagagacatggtctcactatgtttcccaggctgctcaagtactcataagctcaagcaatcatcctgccgtggcctcggaaagtgctaggattacaggtgtgagccaccgcacctgtcctaaattwtatatatatatgctttcttttttcctttttttttttttttttgagacggtgtttctctcttgttgcccaggctggagtgcaatggcacaatctcagctcaccgcaacctccgcctcccaggttcaagtgattctcctgcctcagccttttcgagtggctggcattacaggcacgcgccaccacgcccagctaattttccacttttagtagagacggggtttctccatgttggtcaggctggtcttgaactcctgacctcaggtgatctgcctgcctcagcctcccaaagtgctgggatta

SEQ ID NO: 57811 - DNA, 601 bp, Human
ttgtagtttttaatagagacagggtttcaccatgttgaccaggctggtcttgaactcctgacctcatgtgatccgttcgcctcggcctcctaaagtgctgggattacagacatgagccaccgcacctgacctaatttttgtatttttttgtagagacatggtctcactatgtttcccaggctgctcaagtactcataagctcaagcaatcatcctgccgtggcctcggaaagtgctaggattacaggtgtgagccaccgcacctgtcctaaattttatatatatatgctttcttttttcctttttttttttttttttgagacggtgtttctctcttgttgcccaggctggagtgcaatggcacaatctcagctcaccgcaacctccgcctcccaggttcaagtgattctcctgcctcagccttttcgagtggctggcattacaggcacgcgccaccacgcccagctaattttccacttttagtagagacggggtttctccatgttggtcaggctggtcttgaactcctgacctcaggtgatctgcctgcctcagcctcccaaagtgctgggattacaggtgtgagccaccacgcccggcca

SEQ ID NO: 57812 - DNA, 601 bp, Human
acaggtgtgagccaccgcacctgtcctaaattttatatatatatgctttcttttttcctttttttttttttttttgagacggtgtttctctcttgttgcccaggctggagtgcaatggcacaatctcagctcaccgcaacctccgcctcccaggttcaagtgattctcctgcctcagccttttcgagtggctggcattacaggcacgcgccaccacgcccagctaattttccacttttagtagagacggggtttctccatgttggtcaggctggtcttgaactcctgacctcaggtgatcygcctgcctcagcctcccaaagtgctgggattacaggtgtgagccaccacgcccggccatgatattcttaataagcaatgcattcacatgattcatcattaagattatattaaaaggataaacactgagaagtcctgctcctacccaagttcacgtctttctctgaccacttactgctactgctttccctatgtgaacacttttattcagttaatttgcgtctttccagtccccctgagctaatttaacattttttattcttgtccttattaactcaaaagttcatgtactacgcctgttt

SEQ ID NO: 57813 - DNA, 601 bp, Human
ccaaatggtatattcataataaatacaaaaaaaaacgaagtgactctctcctctctctttctgtccctctctcatgcacgtgcatctatctatctatctatctatctatccatctgtctatctaatctatcatctatctacctatcatctttctgttatctatctacccatcatctatctatcatctatcatctatatctatcatctgtttatcatctatcatctatttacctattatctgtctatcttattatctatcatctgtctacgtatcatcaatcaatcaatcatctatctgtcrtcatagaaagattttcataacatatcaaataaaaataaaagcaaattatggaacattatgattggcaatataaaatgtgtatagaccaattccttttatgtaatatactcatggtccctgctttcattaaactttttcttcaacatttcattatgaaaatttaaaaaatggaaaagttgaaatgattgcataatgaacatctataacacccaccacctggattccacaagtaacatttgactgtatttgctttatcatgtatccatctgtctatccgtccatcaacgcttttttaatgca

SEQ ID NO: 57814 - DNA, 601 bp, Human
aaaaaacgaagtgactctctcctctctctttctgtccctctctcatgcacgtgcatctatctatctatctatctatctatccatctgtctatctaatctatcatctatctacctatcatctttctgttatctatctacccatcatctatctatcatctatcatctatatctatcatctgtttatcatctatcatctatttacctattatctgtctatcttattatctatcatctgtctacgtatcatcaatcaatcaatcatctatctgtcgtcatagaaagattttcataacatatcaartaaaaataaaagcaaattatggaacattatgattggcaatataaaatgtgtatagaccaattccttttatgtaatatactcatggtccctgctttcattaaactttttcttcaacatttcattatgaaaatttaaaaaatggaaaagttgaaatgattgcataatgaacatctataacacccaccacctggattccacaagtaacatttgactgtatttgctttatcatgtatccatctgtctatccgtccatcaacgcttttttaatgcatttcaaagcaagttgcagacatccataca

SEQ ID NO: 57815 - DNA, 601 bp, Human
gtatcatcaatcaatcaatcatctatctgtcgtcatagaaagattttcataacatatcaaataaaaataaaagcaaattatggaacattatgattggcaatataaaatgtgtatagaccaattccttttatgtaatatactcatggtccctgctttcattaaactttttcttcaacatttcattatgaaaatttaaaaaatggaaaagttgaaatgattgcataatgaacatctataacacccaccacctggattccacaagtaacatttgactgtatttgctttatcatgtatccatctktctatccgtccatcaacgcttttttaatgcatttcaaagcaagttgcagacatccatacactttacatttgcagataactgcaaatgcactttacattcagcatgtataccatttaaccagaattcaatatttgcaatgattattttaaaggtaaaattacacacactgaaatgcagctatcttaagtatatcattctatgagttttgaaaaacgcatagtttttaaaatgcagtggaggtatacacattcatttaaaaaatcacacaggcatgaaagcaactgtgatgtttagtatgtt

SEQ ID NO: 57816 - DNA, 601 bp, Human
tctttcgtcctgtatggctccattaatccctagagctttgtttttctctgcagtcagagggtggaggaggcacaagctgcttcttaaaagtctcagcttgggaagtggcaccaatcatttctgcctactctctattagagaaaatatagccacgtggccacacttcagtgcaaaggaggccgggagaacaatttgggtggatgacacgtcgtctcagccacattccctacttttcagtcctggctgcaatttttcacggtgacacacaaaagaccttctgacttttccctttagagctctygatgtatcacactccacacacaaaaaacttcaagtgcctcttttctgtgacatttctttgtgttcaaatcatggagcacgccaggtgttagtggtgactttcttgaagctagcacgagccaggaataagtcaagtaggaagaagtcagcagcttatgaaattaaaaagaaaaagtgaagttactatagaaactaggtgcccaggtatcacattttttctcttttaaaaatcccatccagctctgttgctgtctatgaatctaagatgatctaaaatcagaagcagagaggtgagagacag

SEQ ID NO: 57817 - DNA, 601 bp, Human
gcacgagccaggaataagtcaagtaggaagaagtcagcagcttatgaaattaaaaagaaaaagtgaagttactatagaaactaggtgcccaggtatcacattttttctcttttaaaaatcccatccagctctgttgctgtctatgaatctaagatgatctaaaatcagaagcagagaggtgagagacagaaccattaagcttccccatctagtgcttgacttccctaaaataatcccaggacactgaaccaatgacattaaatgcctgggtgtatcactaaggaggctgtggagggtctgktggtggccccttccactagggtacccctagaaacttggcatttgtgtgacactctccaagatgctggcatcaacttttgtagctcaaaattcagaccgtacaacagagttgactatagtcttggccaggttttccaaatattagtcatttatgcacctgttatgggtttttccttgccattacatgcctcctttattcgatcatatttttctttaaagtgactttaacttgacttccttttcttcttcttaacattgccctaagcaataatatatgtgaaatcacaagtttgatgtacca

SEQ ID NO: 57818 - DNA, 601 bp, Human
ctctgttgctgtctatgaatctaagatgatctaaaatcagaagcagagaggtgagagacagaaccattaagcttccccatctagtgcttgacttccctaaaataatcccaggacactgaaccaatgacattaaatgcctgggtgtatcactaaggaggctgtggagggtctgttggtggccccttccactagggtacccctagaaacttggcatttgtgtgacactctccaagatgctggcatcaacttttgtagctcaaaattcagaccgtacaacagagttgactatagtcttggccargttttccaaatattagtcatttatgcacctgttatgggtttttccttgccattacatgcctcctttattcgatcatatttttctttaaagtgactttaacttgacttccttttcttcttcttaacattgccctaagcaataatatatgtgaaatcacaagtttgatgtaccagttatacatttattttaatgtgtttggtttgatataccagttatatatttattttaatgtgttttaggaaaatatattaaaagaagagtaattttgttcttgtactagtacctgaaccacatttggtg

SEQ ID NO: 57819 - DNA, 601 bp, Human
aacaaacaaatatatctgcctgccctcatgaaacttatattctagtggtagtgatggtgacgacgaagatgatgataacacctaacattttttgggtccttactatgtgccaggctctgttataagtgcttagtatgtattcattagctcacacttactctatgatgcagctactgttgtccccattttacagatgaggagagtgagatgcagaaagttggaataacttgctgaagtcacacagctagtaaatggcattaaacagatcagctttgatttagatgtgtatgatttggggctyttttttttttttctagagacagggtctcactctgtcacccaggctggagggcagtggtgcaatcatagctcactgcagccacgaactccttggctcaagtgatctgcctgcctcagcctcccaaagtgctggcattacaggcatgagccactgtgaccagctgattttgggatcttgattgcttgaaacttaacatgtaatttcctagttttaacagcgattccgtggaatgtcacaaacatattctaggaggttagtcatttttccctcttattttctcatctttccctctaagtgcta

SEQ ID NO: 57820 - DNA, 601 bp, Human
aagagggcccatgagaatggctttcactcctccagcctctgcccttctgacctcctccacaggcttcagccttatgggagtccccaagtcttggaagcatctctagtgagtgcagtgactccttagctggttccttttcaaccttcaacctccattttcttaacccttaccaactctactgcccagctgcacccactccaattccactcacaccctgcccattatcgccaacgtttctgagctcatgctcattgacaaggaccatgccatggatttgcatgcattatatcatattaattcwcaccataatcctgcaaggtagtcactgataatcactctattatatcatatagaaattgtaaggcagagaggttaagtgacttctccaagaaggaggcgggaccttgaaagctggttttgtgatttcagttgcctcttgccatctcttctccactttggggtccacacatcttcccaaacccctagtttaaattttttttttttttttgacaagagtctcactctgtcacccaggctggagtgcagtgacgtgaccatggttcgctgcagcttcaacctcccaggctcaagcaatcctccc

SEQ ID NO: 57821 - DNA, 601 bp, Human
tatgaagacaaatatattaatattacatattaaaacatgtacttccacctaggttcacttttttccttgtgatttaaaaaaaaaattaaagtgccttatgaaccttgaaaacagcatgggccctgagcactgtgcctggtgggttttgatggagaagtcagccctatgttccagctccagcatctcaatagcacctccctctgcagcctccaaacttttcttcccaaaggccagggtgcttaactaccatgctctgtgagcatgagagagcattccagagttccaggccccagacctcagkgtcccttttttttttttttttttttttcctttttgagacagagtcttgctctgttgcccaggctggagtgcagtggggtgatcttgagtcactgcacctcccaggttcaagcaattctcctgcctcagcctcccgagtggctgggattacaaatgcctgccaccacgcccaagtaatttttatgtttttaatagagacagggtttcaccatgttggccaggctggtctcgaactcctggcctcaagtgatccgcctgcctcagcctcccaaagtgatgggattacaggcttgagccacca

SEQ ID NO: 57822 - DNA, 601 bp, Human
aagtcagccctatgttccagctccagcatctcaatagcacctccctctgcagcctccaaacttttcttcccaaaggccagggtgcttaactaccatgctctgtgagcatgagagagcattccagagttccaggccccagacctcagggtcccttttttttttttttttttttttcctttttgagacagagtcttgctctgttgcccaggctggagtgcagtggggtgatcttgagtcactgcacctcccaggttcaagcaattctcctgcctcagcctcccgagtggctgggattacaaaygcctgccaccacgcccaagtaatttttatgtttttaatagagacagggtttcaccatgttggccaggctggtctcgaactcctggcctcaagtgatccgcctgcctcagcctcccaaagtgatgggattacaggcttgagccaccacacctggcctcacagcatcatctgctggagccaagcccggcaccagattttaacaggaagaaattgcctgaggagattaaaaggcagcttagttcatgccaggaacaaaggccttctctaaagtctgagcttctgttgtgggagtctctactaa

SEQ ID NO: 57823 - DNA, 601 bp, Human
atacatacatacattagatgtggttatataatcctacagacaaaagcacttccctgtacttcagcctgctttgctatcttcctgcaccatatggtgagttcctttatcatatggttcacagatagctcaaagtgtttgctacctgtttccttaatcctcttccagagaacctttttgacatttgctgtctgatcttggattcctgccttctctttggttctatcgcaattatgtcacttccctgcccccaccaagccttcaacctttccttctttcatatgcaattctgattgcagcgtgkttttttttttttttttgccaactcatcttcccagatcctcgtgaggcccttcttccaccttcccgaattttccaggtctctcctcaatgaagtgacttactgctcttccgcagcctctgccttcaattctcagaaggtagtatgttacaagacaagataaggttcatttttcgcaagaaaataaattatatcaaggaaaatgaaatgtcaggaatttaagttttacaaccttccatctgctgcaagtagattgtcaagccagagtgagtaaagcgggtatttgctgagaagacatggctt

SEQ ID NO: 57824 - DNA, 601 bp, Human
tttgacatttgctgtctgatcttggattcctgccttctctttggttctatcgcaattatgtcacttccctgcccccaccaagccttcaacctttccttctttcatatgcaattctgattgcagcgtggttttttttttttttttgccaactcatcttcccagatcctcgtgaggcccttcttccaccttcccgaattttccaggtctctcctcaatgaagtgacttactgctcttccgcagcctctgccttcaattctcagaaggtagtatgttacaagacaagataaggttcatttttckcaagaaaataaattatatcaaggaaaatgaaatgtcaggaatttaagttttacaaccttccatctgctgcaagtagattgtcaagccagagtgagtaaagcgggtatttgctgagaagacatggcttgtttctgtgtatctcaagacacccagaggcaagaagtgccacctgaatgagagagcttccagcagtctgataaccatggctccatctggggggttgtaggggggcccccagcctgtcatccctgcttctcgatgacatctctctgcagatacgcatcagcaccacctctctca

SEQ ID NO: 57825 - DNA, 601 bp, Human
gacaagaaaagcaaataggatgtgggcagttttcctatgagaaagaagaaaacgacgggcctgtctggcacacaggccaaagtgggagtttcctttaaatgtgtattattttttattttaatttttttattttgtttatttatttatttttgagatggagtctcactctgtcgcccaggctggattgcagtagcatgatctcggctcactgcaacctccacctcctgggttcaagcgattctccttcctcagcttcccgagtagctgggattatatgcgcatgccaccatgcccggctaattttttttttttttttgtatttttagtagagacggggtttcaccatgttggccaggctagtcttgaactcctgacctcaaatgatccatctgccttggcctcccaaagtgctgggattacaggtgtgagccactgtgcctggccttttattttaattttttagagacagcatctggctttgttgcctaggctggagtgcagtggcatgatcttagctcactgcagccccgaactcctgggctcaagcgatcctcctgcctcagcctcccgactagctgggactacaagtgcatgccatcgt

SEQ ID NO: 57826 - DNA, 601 bp, Human
gccttttattttaattttttagagacagcatctggctttgttgcctaggctggagtgcagtggcatgatcttagctcactgcagccccgaactcctgggctcaagcgatcctcctgcctcagcctcccgactagctgggactacaagtgcatgccatcgtgcctggctcatttttgttttttttctagagatgggatctcattatgtagaccaggctggtcttaaacttctggccaccagcgatcctcctgcctcagcctcccaaagcagtgggattacaagtgtgagtcacgtcgctggrccctgtgttttctctaaaatgttgcctgattctttgggaaaaatatcgcaaagataaatcaagtcctcttgtagaaggaccagatagagcccattaacatggaaactctgtctcaggtgatcattcatggctactggtccaattattgtgctatcatggtacctgccatcctctgcatatccatctcaactttatctctatgtattatttcagaaatttacagtcctggtaaagtgaatccctggttactaacagcataacccataatcttttctataatacaacaaacataatggcaga

SEQ ID NO: 57827 - DNA, 601 bp, Human
caccagcgatcctcctgcctcagcctcccaaagcagtgggattacaagtgtgagtcacgtcgctgggccctgtgttttctctaaaatgttgcctgattctttgggaaaaatatcgcaaagataaatcaagtcctcttgtagaaggaccagatagagcccattaacatggaaactctgtctcaggtgatcattcatggctactggtccaattattgtgctatcatggtacctgccatcctctgcatatccatctcaactttatctctatgtattatttcagaaatttacagtcctggtaaartgaatccctggttactaacagcataacccataatcttttctataatacaacaaacataatggcagaaatttgtggattgtaatcatccaacacccatgataaatattttggatgtacaaatgtggatggtacctatgattattcatgccgtagttgtttcaaacccccaccccaccccacagtttcaccttatgtactgacctcattgaacaccactgcggagattgataacatttttggagcactgggaactcatctgagtgttttataggcattgctcatttaatcttcaccatgggt

SEQ ID NO: 57828 - DNA, 601 bp, Human
ctcctgctgtgctgaaacccgttctctattagcagtgctctgtaactccaacaacaaaggggggcagtgcttacaaggcagatcagattataaacaagctttcttcctgccacctaattgttgccatgaatgacaggactttaagggtttcatttcattctctttcagtagaagccatcaattattagtttattttcccagcaaccatttaaaaaagagtcaaattaaatctgcttttattttaactatccagctttgtcaaatataacataggattcaaagaaatttgactaagccatayatgtcaccaatgtttattttatttatgtattttttttggcatttctgttcttttgtgagtgtgagtggtgagaacacttgggatctcctcccttagcatatttcaagtatataacacagtattattaactgaattaccatgccataccttttaaattgctagtacttatttatcttgtaactgaaagtttgtaccctttaatcaacatctccccattttctctactcccagcccctagcaaccaccattctgctctctgtttctttaagtttgactattttagattccacatatgtgaga

SEQ ID NO: 57829 - DNA, 601 bp, Human
agcagtgctctgtaactccaacaacaaaggggggcagtgcttacaaggcagatcagattataaacaagctttcttcctgccacctaattgttgccatgaatgacaggactttaagggtttcatttcattctctttcagtagaagccatcaattattagtttattttcccagcaaccatttaaaaaagagtcaaattaaatctgcttttattttaactatccagctttgtcaaatataacataggattcaaagaaatttgactaagccatatatgtcaccaatgtttattttatttatgtattttttttggcatttctgttcttttgtgagtgtgagtggtgagaacacttgggatctcctcccttagcatatttcaagtatataacacagtattattaactgaattaccatgccataccttttaaattgctagtacttatttatcttgtaactgaaagtttgtaccctttaatcaacatctccccattttctctactcccagcccctagcaaccaccattctgctctctgtttctttaagtttgactattttagattccacatatgtgagatcatacagtatttgtctttttttttttttt

SEQ ID NO: 57830 - DNA, 601 bp, Human
ttaactgaattaccatgccataccttttaaattgctagtacttatttatcttgtaactgaaagtttgtaccctttaatcaacatctccccattttctctactcccagcccctagcaaccaccattctgctctctgtttctttaagtttgactattttagattccacatatgtgagatcatacagtatttgtctttttttttttttttttttttttttgagacacagtcttgctctgtctcccaggctagagtgcaatggcacaatctcggctcactgcaacctcacctcccaggctcaagygattcttctgcctcagcctcctgagtagctgagattacaggcatgcaccactatgcccggctaaattttatatttttagtagagacagggtttcaccatgttgaccaggctggtctcaaacccctgacctgaggtgatccacctgtctcagcctccccaagtgctgggattacaggcgtgagccaccgtgcctggccccagtatttgtcttttggtgtctggcttattttgcttaggataaggataaggtgctccaagttcatgaacatttatttcagctcaaaagaaccgttcagttac

SEQ ID NO: 57831 - DNA, 601 bp, Human
agtttgtaccctttaatcaacatctccccattttctctactcccagcccctagcaaccaccattctgctctctgtttctttaagtttgactattttagattccacatatgtgagatcatacagtatttgtctttttttttttttttttttttttttgagacacagtcttgctctgtctcccaggctagagtgcaatggcacaatctcggctcactgcaacctcacctcccaggctcaagcgattcttctgcctcagcctcctgagtagctgagattacaggcatgcaccactatgcccggstaaattttatatttttagtagagacagggtttcaccatgttgaccaggctggtctcaaacccctgacctgaggtgatccacctgtctcagcctccccaagtgctgggattacaggcgtgagccaccgtgcctggccccagtatttgtcttttggtgtctggcttattttgcttaggataaggataaggtgctccaagttcatgaacatttatttcagctcaaaagaaccgttcagttactggaattgatcaatatcaattctattggtaaaaatcaattctactggtatcaacaattaga

SEQ ID NO: 57832 - DNA, 601 bp, Human
tgtctggcttattttgcttaggataaggataaggtgctccaagttcatgaacatttatttcagctcaaaagaaccgttcagttactggaattgatcaatatcaattctattggtaaaaatcaattctactggtatcaacaattagacgacacagcccagagtgtgaaaatagtagttctctcgcatttcttgttacaacccaattagacatttcttattagacccaaccacacatcctcatttaaataccagggccaggtatttcaggtttcaatctccttgttccactcctcccctttcyagcagtcactgtgagtcatcccttctaggggtgtagtgacatttgcttaacaatagcaagtccacagaaaccagagatgactgggctaaatgcaccttcattctaaacttcgtttcacactttcatggctttctcagctagtgggcaaaaatgctacttgattaaattacaggtgtggcatggcctcattttaaaaggttgaaatcttaatgcaacctgtcaatctgacctctgaaatgaaaaattagcttatctatcacacagatccatgcttttatcatctataaagagatttttaaa

SEQ ID NO: 57833 - DNA, 601 bp, Human
acctacatccacactattaattcccaagcatcttctccccattatatcactttccagtttttcctgaggtacgtcttcacttggcagagtctacccagttgccttctcctaaacagactgttagaagtctgaaatcatttttagactgctggcttcctctttactgctagaggcaagtgcatttgattccttcaaaccacatgacttcgcatcagactgatgtggccactgtcaaatgtaacatttaaacatatgtttgtgtggacatatgtgtttggaacatttcatccgaagtctgacrcttaagaatacactttggaaaatcagaattagggccttcaagataaactagaatgtgataggacatcttcatttctggtcaaagttggaagtttgggagagcctcaaaagtgaagaattcgccaacaaccatggtgaatgcagtgtactgagttcttgtaaccacccggtgggatcttcttgcctgctccccagatagagccgatttctcaagaggggaattataatagggaaagagctttacacacaaagactcaaatcagcctccatgaatatttggaggctagaatttttccaagat

SEQ ID NO: 57834 - DNA, 601 bp, Human
cagttgccttctcctaaacagactgttagaagtctgaaatcatttttagactgctggcttcctctttactgctagaggcaagtgcatttgattccttcaaaccacatgacttcgcatcagactgatgtggccactgtcaaatgtaacatttaaacatatgtttgtgtggacatatgtgtttggaacatttcatccgaagtctgacacttaagaatacactttggaaaatcagaattagggccttcaagataaactagaatgtgataggacatcttcatttctggtcaaagttggaagtttrggagagcctcaaaagtgaagaattcgccaacaaccatggtgaatgcagtgtactgagttcttgtaaccacccggtgggatcttcttgcctgctccccagatagagccgatttctcaagaggggaattataatagggaaagagctttacacacaaagactcaaatcagcctccatgaatatttggaggctagaatttttccaagatagtttggcagggagaggaggtggctagggaatgggtgctgctgattggttggagatgcagtcataggggtgtggaaaatggtccttatgctctgt

SEQ ID NO: 57835 - DNA, 601 bp, Human
cagactgatgtggccactgtcaaatgtaacatttaaacatatgtttgtgtggacatatgtgtttggaacatttcatccgaagtctgacacttaagaatacactttggaaaatcagaattagggccttcaagataaactagaatgtgataggacatcttcatttctggtcaaagttggaagtttgggagagcctcaaaagtgaagaattcgccaacaaccatggtgaatgcagtgtactgagttcttgtaaccacccggtgggatcttcttgcctgctccccagatagagccgatttctcargaggggaattataatagggaaagagctttacacacaaagactcaaatcagcctccatgaatatttggaggctagaatttttccaagatagtttggcagggagaggaggtggctagggaatgggtgctgctgattggttggagatgcagtcataggggtgtggaaaatggtccttatgctctgtatccacttctgggtggggtcgcaggactggcttatgggttcatgtcggggctgtccagtagtcagaaagggaaaagactgaaagacatctcaaaaggccaatctgcagttctacaac

SEQ ID NO: 57836 - DNA, 601 bp, Human
atgcagtgtactgagttcttgtaaccacccggtgggatcttcttgcctgctccccagatagagccgatttctcaagaggggaattataatagggaaagagctttacacacaaagactcaaatcagcctccatgaatatttggaggctagaatttttccaagatagtttggcagggagaggaggtggctagggaatgggtgctgctgattggttggagatgcagtcataggggtgtggaaaatggtccttatgctctgtatccacttctgggtggggtcgcaggactggcttatgggttcaygtcggggctgtccagtagtcagaaagggaaaagactgaaagacatctcaaaaggccaatctgcagttctacaacagtgatgttatctgtgggagtaattgggaaagttgcaagtcttgtgacttctggaataatggctagtaatcctttatgtctacaccttagccgaattcaggctcctttcatcctcctaacttggcagtctttcattagttttacaaaggcagtttagtttgggggaagggctgttaccatgtaaactatacactaaatgtttcccaaatttagcttggcccaagtc

SEQ ID NO: 57837 - DNA, 601 bp, Human
ttggcagggagaggaggtggctagggaatgggtgctgctgattggttggagatgcagtcataggggtgtggaaaatggtccttatgctctgtatccacttctgggtggggtcgcaggactggcttatgggttcatgtcggggctgtccagtagtcagaaagggaaaagactgaaagacatctcaaaaggccaatctgcagttctacaacagtgatgttatctgtgggagtaattgggaaagttgcaagtcttgtgacttctggaataatggctagtaatcctttatgtctacaccttagcygaattcaggctcctttcatcctcctaacttggcagtctttcattagttttacaaaggcagtttagtttgggggaagggctgttaccatgtaaactatacactaaatgtttcccaaatttagcttggcccaagtccagaaatgactaagggcagtttggaagtcaaaagcaagatgaggattggttagatcagatctcttccactgtcatcatttagttataatttttgcaaaggcgatttcattctttgctatatgttaagctgttaacatgccttatgtcatgaaatcatcatcatggc

SEQ ID NO: 57838 - DNA, 601 bp, Human
tggctagggaatgggtgctgctgattggttggagatgcagtcataggggtgtggaaaatggtccttatgctctgtatccacttctgggtggggtcgcaggactggcttatgggttcatgtcggggctgtccagtagtcagaaagggaaaagactgaaagacatctcaaaaggccaatctgcagttctacaacagtgatgttatctgtgggagtaattgggaaagttgcaagtcttgtgacttctggaataatggctagtaatcctttatgtctacaccttagccgaattcaggctcctttsatcctcctaacttggcagtctttcattagttttacaaaggcagtttagtttgggggaagggctgttaccatgtaaactatacactaaatgtttcccaaatttagcttggcccaagtccagaaatgactaagggcagtttggaagtcaaaagcaagatgaggattggttagatcagatctcttccactgtcatcatttagttataatttttgcaaaggcgatttcattctttgctatatgttaagctgttaacatgccttatgtcatgaaatcatcatcatggccctactaactcttgtta

SEQ ID NO: 57839 - DNA, 601 bp, Human
tcggggctgtccagtagtcagaaagggaaaagactgaaagacatctcaaaaggccaatctgcagttctacaacagtgatgttatctgtgggagtaattgggaaagttgcaagtcttgtgacttctggaataatggctagtaatcctttatgtctacaccttagccgaattcaggctcctttcatcctcctaacttggcagtctttcattagttttacaaaggcagtttagtttgggggaagggctgttaccatgtaaactatacactaaatgtttcccaaatttagcttggcccaagtccmgaaatgactaagggcagtttggaagtcaaaagcaagatgaggattggttagatcagatctcttccactgtcatcatttagttataatttttgcaaaggcgatttcattctttgctatatgttaagctgttaacatgccttatgtcatgaaatcatcatcatggccctactaactcttgttaatggactcttgtctatattttaccctgatatccaacctgctgtgagacctcttgcttttgtttgtttgtttttattttttgttttttgagacagagtctccctctgttgcccaggctgg

SEQ ID NO: 57840 - DNA, 601 bp, Human
ttggttagatcagatctcttccactgtcatcatttagttataatttttgcaaaggcgatttcattctttgctatatgttaagctgttaacatgccttatgtcatgaaatcatcatcatggccctactaactcttgttaatggactcttgtctatattttaccctgatatccaacctgctgtgagacctcttgcttttgtttgtttgtttttattttttgttttttgagacagagtctccctctgttgcccaggctggagtgcagaggtgagatctcgggtcactgcaacgtccacctcccrggttcaagtgattctcctgcctcagcctcccaagtagctgggattgcaagcatgcaccaccatgcctggctaatttttgtattttttagtagagatggggtttcaccatgttgacaaggctggtctcgaactcctggtctcaagtgatccacctgcctcagcctcccaaagtgctgggattacaggcgtgagccactgtgcccggccaagacctcctgtttggaatggctttcccctccattccaggcctctggttatcagagatgaggtagcttaagcccttcagtgcttaatccctgg

SEQ ID NO: 57841 - DNA, 601 bp, Human
tatgtcatgaaatcatcatcatggccctactaactcttgttaatggactcttgtctatattttaccctgatatccaacctgctgtgagacctcttgcttttgtttgtttgtttttattttttgttttttgagacagagtctccctctgttgcccaggctggagtgcagaggtgagatctcgggtcactgcaacgtccacctcccaggttcaagtgattctcctgcctcagcctcccaagtagctgggattgcaagcatgcaccaccatgcctggctaatttttgtattttttagtagagayggggtttcaccatgttgacaaggctggtctcgaactcctggtctcaagtgatccacctgcctcagcctcccaaagtgctgggattacaggcgtgagccactgtgcccggccaagacctcctgtttggaatggctttcccctccattccaggcctctggttatcagagatgaggtagcttaagcccttcagtgcttaatccctggcccaggcagaaggagggctttggcaaatccgcatgctagaaaagatgagtttggaagggcctggaaaccagggtacatagttccttttcccttgag

SEQ ID NO: 57842 - DNA, 601 bp, Human
agactcagagaggttgagtaactcagccaagaacacacagcaaaccatatgatagagtcaggatttgagctcatgattccaaagtctgaacttgaaccttctatgactataattctaattagatataagcttccagatcatcagactctgtcgatgccataatctctttcttacatggcagagatggtcaggatacctgccacgtggtaaagacgtggatgcagaagttaacctccatttgattagcttcggtgcaccaagctgcacccaggtttctctcgaaatcctgctcctgagtggrtgagtgccccgggaagagcaggtggttggcgtttgctcagttttccagcccctgatcaccctgatggcctctagccagcttttctctctgtcctcctccagtgagggccaggcctggcacaggcagcctcccaatgtttagaaggttccgatttaattggtctagagtgtggcccaagcatcggcttctaaaacctccacagggagttctaatatgcagcagggagaagcagcagctcagtgcagcaggcaaggctcgtccacggaagggctgggggaaggaaggagatcatatttgcct

SEQ ID NO: 57843 - DNA, 601 bp, Human
ttcttacatggcagagatggtcaggatacctgccacgtggtaaagacgtggatgcagaagttaacctccatttgattagcttcggtgcaccaagctgcacccaggtttctctcgaaatcctgctcctgagtgggtgagtgccccgggaagagcaggtggttggcgtttgctcagttttccagcccctgatcaccctgatggcctctagccagcttttctctctgtcctcctccagtgagggccaggcctggcacaggcagcctcccaatgtttagaaggttccgatttaattggtctagastgtggcccaagcatcggcttctaaaacctccacagggagttctaatatgcagcagggagaagcagcagctcagtgcagcaggcaaggctcgtccacggaagggctgggggaaggaaggagatcatatttgccttaaaacttggagttgagctcatctgacctaccctctgcaggtcttcagggggactgggaagaatccatgcaggagatagccccagagatcaaggggatcctcaaagagatgggatcttaagatagagggagggtacactccttgcaacagatcagcaccctgaccct
